United States Patent 10,696,975 (GENES AND USES FOR PLANT ENHANCEMENT) - sequence listing, part 5

SEQ ID NO: 17618 - protein, 630 aa, Colwellia psychrerythraea 34H
MITNLADYPLLSQINIPEDLRNMPQEQLTRISNELRSFLLNSVSKSSGHFASGLGTIELTVALHYVYNTPFDHLIWDVGHQAYPHKILTGRRDQLHTIRQKGGLHPFPWREESEYDTLSVGHSSTSISAALGLAVAAEKEAKNRKTVAVIGDGAMTAGMAFEALNHAGDIKKDMLIILNDNDMSISKNVGALNNHLAKLLSGSIFTGFRESSKKLLGNIPPIKELASRAEEHLKGMVVPSTFFEELGFNYIGPIDGHDVESLVTTIKNMRNLKGPQFLHVVTTKGKGYQAAEQDPIKYHAVPKFNPEETNLPQSKPSLPTYSKIFGDWLCKTAEIDKKLVAVTPAMAEGSGMVEFSQRFPDQYYDVAIAEQHSVTYAAGLAIGGLKPVVAIYSSFLQRGYDQFIHDVAIQNLPVMFAIDRAGIVGADGATHQGVFDLSFLRCIPNTVIMAPSNERECQLMLNTGYKLDGPSVVRYPRGNGTGEILPSVDETIELGKGVTILTATVIESQEQTNKSIAILSFGSMLGEAKKAALELNATLVDMRFVKPLDETLIDTLNAKHDCLVTVEDNAIAGGAGSGVNEYLLAQGKPVTILNIGVTDHFVKHGTQEEMHHELELDAEGIVIKIKRFIN

SEQ ID NO: 17619 - protein, 389 aa, Xanthomonas axonopodis pv. citri str. 306
MRALCWNGVNDLRVETVPDPALVNPRDVILKVGLTTTCGSDLHFIDGYLPTMREGDVIGHEFMGTVVEIGTAVKNVRVGQRVVVPSFISCGGCWHCERKEFSLCDNTNPNWEMQEPLLGHPTAGIYGYTHAFGGYAGSHATYIRVPHADVGCFEVPDGVSDEDALFLSDAGPTGFMGADFCDIQSGDTVAVWGCGGVGLMAQQSARILGAERVIGIDRLPERLAMARDVLGVEVIDYSAVDSVVDVLREMTGGRGPDACIDAVGMEAHGTGIGHTYDRVKQALHLHTDRGQALREAILACRKGGILSVLGVYGVMDKFPLGAVMNKGLTVRTAQQHGQRYVPKLLDLAQAGRLKSGFLLTHKMPLEDAVRGYDMFKHKHDGCVRAGFVP

SEQ ID NO: 17620 - protein, 406 aa, Silicibacter sp. TM1040
MYDVEKIRSDFPILSREVNGKPLVYLDNGASAQKPQVVIDAVTKAYAEEYSNVHRGLHYLSNLATEKYESVRGIIAKFLNAGHEDHIVLNSGTTEGINLVAYSWAMPRMEAGDEIILSVMEHHANIVPWHFLRERQGVVIKWIDTDADGSLDPQKVLDAITPKTKLIAVTQCSNVLGTVVDVKSITKGAHDKGVPVLVDGSQGAVHMPVDVQDLDCDFYAVTGHKLYGPSGSGAIYIKPERMAEMRPFIGGGDMIKEVSKDQVIYNDPPMKFEAGTPGIVQTIGFGVALEYMMEIGMAEIAAHEADLRDYASERFKGLNWLNIQGHAPGKAAIFSLTLEGAAHAHDISTILDKKGVAVRAGHHCAGPLMDHLGVSATCRASFGMYNTRPEVDTLIEALELAHELFG

SEQ ID NO: 17621 - protein, 388 aa, Dehalococcoides sp. BAV1
MKLSKRIENLPPYLFVQISKKIAEKRAKGEDVISFAIGDPDLPTPKHILAELCKAAEDPSNHRYPETEGLPVLRKAMAEWYQKRFGVKLNPDTEVLPLIGSKEGIGHAAWCFLDPGDIALVPNPAYPVYAISSQLAGAEVFNLPLNKGNNFLPNLEAIPQNILSKAKVLWINYPNNPTGAVAGLSFFQEVANFAAKHNLAVCHDGPYSEIAFDGYKPVSFLEADGAKDVGIEFHSLSKSYNMTGWRIGMAVGNAKMIDALRRFKSNLDSGIPQAIQLMAIAALNGSQEIINQNCAIYQRRRDRLVEALRNIGMEVTAPKASLYIWAPVPESYTSASFATELLDKTGVVVTPGTGYGTAGEGYIRLSLTVPDEQIEKGIAKLAGYKKSS

SEQ ID NO: 17622 - protein, 476 aa, Oryza sativa
MTKPQQQSPPSTTATTTTSPPPPPPSTPPPASSSSSSLAKLPLRLHSLASSSRSLLSALRRSPVTTLVAAFFLLALFMYGEDVRTLAELSIDDYLYPYADFYNVSALPPLLLPPPTCDLSRGRWVFDNTSLPAYREKECTFLTKQVSCLANGRPDDLWQYWRWQPNNCSLPTFDARRFMEKMRGKRMMFVGDSLNRNQWESLVCLVQPILSKGRKKIVKRGSFNIFYAKEYRATLEFYWAPFLVESNSDNPNFHHIDQRIISPERIESHANNWKDVDYLIFNTYIWWMNNEDIKVRRPNSTSWSDHDEVPRIETYGRVFKTWSTWLEQNVDPARTSVFFMTISPLHNSPAQWGNPNGIKCVKETLPVLNYTKPLDLNHDMRMYDLVAKVAKNMKNVPVSLIDITRMSDYRKDAHTSLYSIRQGKLLTPEQKADPQKYADCIHWCLPGVPDVWNQILYTRILSKSSPPSTHPSLPPQ

SEQ ID NO: 17623 - protein, 253 aa, Dehalococcoides sp. BAV1
MRQIIIAGNWKMNTTLSEACTLVQSMKCELERIEGIEKIICPPFISLYPIKTMLENSSIKLGAQNLFYQEKGAYTGEISPLMLKELCQYVIIGHSERRAYFGETGQVVNQKIKAALQAGLLPIVCVGEKPEENENGQTRQVLETQLKEALDGLNLSCIIIAYEPIWAIGTGKAATASEANSAIGYIRRVLGDTLGNAAAQTSPILYGGSVNEKNITEILSQTNIDGALVGGASLKAESFVSICRQAAVIQNKH

SEQ ID NO: 17624 - protein, 397 aa, Dehalococcoides sp. BAV1
MENLTIRDLNFSGKKALVRVDFNVPINEETGTINDSSRIRAAIPTIDYLLDHQAKVILCSHLGRPDGMIVESMRLAPVAKRLSEILRQEVFTASDCIGDEVAAKVDALEDSQVLLLENLRFHPEEEANDPIFAKKLADLADIYVDDAFGTAHRKHASIVGVAKYLPAVAGLLLEKELNALGKVLEHPPRPFMILLGGAKVSDKVGMLENVMDKVDTILIGGGMAATFLKAQGLEIGDSLIDDSLDTAKMLMDKAKSKNVKIILPDDVLVTFDKIGPEARAENVSVENIPHTAKIVDIGLLTITHFTKHLEKCKTVFWNGPMGIYEIPQFSEGTRAMVNTMTRLHATTIIGGGSTAEIVTELNIASKMSFVSTGGGASLKFLSGEKLPGVEVLAKKNE

SEQ ID NO: 17625 - protein, 120 aa, Zea mays
MALRTAVLRHLRVPVTGSNQSQIGFLGSIRAFSSHDDHLSKQEVVDRVLDVVKCFPKVDPAKVTPDVHFQKDLGLDSLDTVEIVMAIEEEFKLEIPDKEADKIDSCPLAIEYVFNHPMSS

SEQ ID NO: 17626 - protein, 147 aa, Listeria innocua Clip11262
MEQTYVMVKPDGVERGLIGEIVAKIEKKGIKLVAGKLMQIDRTLAEQHYAEHIGKPFFEDLIGFITSGPVFAMVLEGDDVIKTARRMMGKTNPLEADPGTIRAEYAIHTNRNVIHGSDSPESAKREIQLFFEPHEILSYEKAVDTWI

SEQ ID NO: 17627 - protein, 633 aa, Dehalococcoides sp. BAV1
MSKLLDTINSPSDLKKLSLDELRELAVQIREELVNRVTLNGGHLASSLGVVELTIALHRVFESPKDKIIWDVGHQSYAHKLLTGRREQFATLRQHGGLSGFTCRDESPHDPFGAGHASTSISAGLGMAVARDLAKEDYSVISVIGDGAISGGMSFEAINNAGHLHTKFIVILNDNGMAISPSTGALSKFLNNVRFDPRFEFAKRNAKQTITNMPFGKAVWAFTKSIKRKFEKSMLPGSLWEELGFIYLGPVDGHNIRELEAALKRAKDFESKPVLIHMITKKGKGYDDAEADAVKYHGISPKSGGLKSSHGLSYSQVFGQTLHKIMSQNPQVVAITAAMTDGCGLGEIAAAFPDRVFDVGICEQHAVTFAAGMATQGYIPVVVIYSTFLQRGFDQIIHDVCLQKLPVVFAIDRGGIVGDDGKTHQGIFDLSFMSLIPDMVVSAPSDENDLQHLLYTAVNSGKPFALRYPRGFGEGVEIESSLHNIPIGQNEILVNGSDVAILATGKSVAFAREALEILTESGIKPTLVNNRYISPLDSELVLKIAQSHKYLVTVEENVISGGLGSRINTLLAEAGLVNKIKIANIGIPDKFVEHGNQSLLRAKYGLDGKGIAQRVLSLVGNPNEMKHPQIICP

SEQ ID NO: 17628 - protein, 482 aa, Prochlorococcus marinus str. NATL2A
MLEVHSHKHLKKYYQKNLALWPHNLTLARLISRSLSRKDNTFIQLSSDSRNFWWPGLLIPLCLHNNNIVLILSERQYRLLFEVELPKLSSSRLGFDYVEGIELIPSDEKIWVLRYQDLIFANEKDLLKNRQLIFPESEFISNELRESMSIKITPKDWQNLIASRSRFEASIIEAHERLSRSLFSHSLSSDAVIRIDYKELLALKEILKDDLPSIMPWRRALNVVNNRWVTWAKLDNQKLSWDWYIQPLLPLQTLSGLLSKNTLLMLTNSGQSDSFFLDLNSKKFTFNVKVDLGNKYDQEPIPLFVPKRQPLPNTSHFYRHIIRQCQRLILGRTHPTIVLVDDLQLRLQITSELAGEFGLRVVHETTNIETNGIVCCSCQWWIVNQYNLPTPDQLIFPVIPLPTLESPWIAAKVEMLKHQGRDWFREFLFPETLAILLKSLAIIRGKDVRVAILDGRMRYRNWGKLIFEALEPWVALERLLPY

SEQ ID NO: 17629 - protein, 855 aa, Oryza sativa Japonica Group
MMVTWPWRALPLAAVLFLFLSPAASVDTVTMEAPLAGNRTIVSAGGTFTLGFFTPDVAPAGRRYLGIWYSNILARTVVWVANRQSPVVGGSPTLKINGNGSLAIVDGQGRVVWASPVMSASVLSAGSAKAQLLDNGNFVLRFASAGVAWQSFDYPTDTLLPGMKLGIDFRTGLDRYMNSWRAADDPSPGEYSFRIDPSGSPEFFLYRWSTRTYGSGPWNGYQFSGVPNLRTNTLLSYQYVSTADEAYYRYEVDDSTTILTRFVMNSSGQIQRLMWIDTTRSWSVFSSYPMDECEAYRACGAYGVCNVEQSPMCGCAEGFEPRYPKAWALRDGSGGCIRRTALNCTGGDGFAVTRNMKLPESANATVDMALGLEECRLSCLSNCACRAYASANVTSADAKGFDNGGQDLFVRLAASDLPTNSVSDNSQTAKLVEIIVPSVVALLLLLAGLVICVIKAKKNRKAIPSALNNGQVTPFGQRNHTASALNNWEITPFWQRNHVAASNDAQDNNSMRPAGQGNHQDLDLPSFVIETILYATNNFSADNKLGQGGFGPVYMGRLDNGQDIAVKRLSRRSTQGLREFKNEVKLIAKLQHRNLVRLLGCCIDGSERMLIYEYMHNRSLNTFLFNEEKQSILNWSKRFNIINGIARGILYLHQDSALRIIHRDLKASNILLDRDMNPKISDFGVARIFGTDQTSAYTKKVVGTYGYMSPEYAMDGVFSMKSDVFSFGVLVLEIVSGKKNRGFYHNELDLNLLRYAWRLWKEGRSLEFLDQSIAGTSSNVTEVLRCIQIGLLCVQEQPRHRPTMSAVTMMLSSESPALLEPCEPAFCTGRSLSDDTEASRSNSARSWTVTVVEGR

SEQ ID NO: 17630 - protein, 121 aa, Glycine max
  misc_feature (46)..(46): Xaa can be any naturally occurring amino acid
  misc_feature (65)..(65): Xaa can be any naturally occurring amino acid
  misc_feature (83)..(83): Xaa can be any naturally occurring amino acid
  misc_feature (93)..(93): Xaa can be any naturally occurring amino acid
KVGASFSEGGAVLTQNGRFYLGEQNNDPERAKKLPCLADLVGKDSXGTAHRAHASSEGGTKYLQXSAAGFLSQKEPVYLVAAXEGPKGPKVAXFGGSNVSYQTGEIDSLSQKADILLVVGG

SEQ ID NO: 17631 - protein, 486 aa, Anisophyllea corneri
VSTLEKKNLGRIAQIIGPVLDVAFPPGKMPNIYNALVVKGRDTVGQQINVTCEVQQLLGNNRVRAVAMSATDGLTRGMEVIDTGAPLSVPVGGATLGRIFNVLGEPIDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLIVARARKIERFLSQPFFVAEVFTGSPGKYVGLSETIRGFQLILSGELDSLPEQAFYLVGNIDEATAKATNLEMGSKLN

SEQ ID NO: 17632 - protein, 381 aa, Aspergillus oryzae
MRWFTIERLFFIWKLLKYQYSNPSFVLKAVKDVAFEDRPVPALQDPWDVRVQIAQTGICGSDVHYWQRGRIGDFVLTSPIVLGHESSGTVMDVGSAVKNLKVGDRVAIEPGIPCRHCEYCHSGSYNLCPNDRFAATPPHDGTLSKYYITQSDFCYPIPDHMNMEEGAMVEPVAVACQITKVGNVRANQKIVVFGCGPIGLLCQAVSKAYGAKKVIGVDISKSRAEFAKTFGADDVFVPPPPPADVSPEEWSEKLAKIIKEQFDLGEGPDVVLEATGAQPCIQTGIHLTKKGGTYVQAGMGRENVMFPITTACIRDLTIRGSIRYSTGCYSTAVDLIASGKVDVKRLITNRYTFEEAEQAFELVRQGKESVIKVIIEGYQGR

SEQ ID NO: 17633 - protein, 295 aa, Prochlorococcus marinus str. NATL2A
MEELIQKALSSSNKVSSNSLIEKIIPVGGGCIHKAWSIHFQNGKRVFAKSNYIDNINMFKFERECLSVLKRFANESYICVPETLDLISYQNISILFLEWIDLKQCQQNVLGKGLALLHKSSSEWSKKNFGWEEEGFIGSSTQARGWKSNWGEFFVNYRLRPQLLQAKAWGVRVEDYEDVLIYLSSYLNDHQPKTSLVHGDLWSGNCGSTKNGLGSLYDPACYWADREVDISMTKLFGGFNREFYKGYEEIWPLNKFSKDRNDIYNLYHLLNHANIFGGSYKENSLKILKDLRSRV

SEQ ID NO: 17634 - protein, 232 aa, Rhodopseudomonas palustris CGA009
MDKEELKRRAAARALEEVRGGMKLGLGTGSTAKHFVELLGERVRLGLEIIGVPTSEVTRADAERCGIRLTSLDEIDRLDITIDGADEVDHHLDLIKGGGGALLREKIVAAASDRMIVIADESKLVDTLGRFPLPIEVIPFGLGATRRALQNAFTAAGCDGELKLRPGKDGHAFVTDGGHWILDAQLGRIPDAPRLAQLLSVIPGVVEHGLFVGMASTVVLAGADGIRTIERA

SEQ ID NO: 17635 - protein, 335 aa, Hyphomonas neptunium ATCC 15444
MPGKVLVLGGAGYVGSHCCRAFSEAGWDVTVFDNLSTGWRDLVRWGKLIEGDLNSPGDIEAAFSAIKPDAVAHFAASTLVGESVTEPGKYYRNNTFTTLNVLDAMQRHNTRAIIFSSTCAIFGHAQTEFLAEDHPKNPINPYGMSKLMVEQMLAGFDHAHGIRSACLRYFNAAGADRQALTGERHACETHLIPLALKGAYDPGYSFTITGTDFDTPDGTALRDYIHVEDLAEAHLLALNALEQGAPSNAFNLGTGRGTSVAEIVDAVERATGRRLPRKIGPRRPGDAARLIAAPGRAKDVLGWTAKRSDVDNIITSALAWHQKDWAQHKEDSLQG

SEQ ID NO: 17636 - protein, 470 aa, Geobacter sulfurreducens PCA
MSQNFGKISQVIGAVIDVEFEPGKLPPIYNALRVTNPAIDDKEYNLVLEVAQHLGENAVRTIAMDSTDGLVRGQAVLDTGKQISVPVGRKTLGRILNVIGEPVDEMGPVNAEKEYGIHREAPAFVDQSTKVEAFTTGIKVVDLLAPYARGGKIGLFGGAGVGKTVLIMELINNIAKQHGGFSVFAGVGERTREGNDLWMEMKESGVLDKAALVYGQMNEPPGARARVALSALSIAEYFRDEEGQNVLLFVDNIFRFTQAGSEVSALLGRIPSAVGYQPTLATEMGELQERITSTTKGSITSVQAIYVPADDLTDPAPATAFAHLDATTVLSRQIAELGIYPAVDPLDSTSRILDPQVIGEEHYSIARQVQYVLQKYKDLQDIIAILGMDELSEEDKLVVARARKIQRFLSQPFHVAEAFTGSPGKYVELKDTIKGFQEIVAGKHDDVPEQAFYMVGTIEEALEKAKKLAA

SEQ ID NO: 17637 - protein, 154 aa, Bacillus pumilus SAFR-032
MNTIQGHVVAEGLKFAIVVARFNDFITSKLLDGAEDTLLRHGANGDDIDVVWVPGAFEIPYMAKKLAETEKYDAVITLGTVIRGATTHYDYVCNEAAKGIAQSAMSTGVPIIFGVLTTESIEQAIERAGTKAGNKGSESAAAAIEMANLNRTFR

SEQ ID NO: 17638 - protein, 461 aa, Rhodopseudomonas palustris CGA009
MADFDADLFVIGGGSGGVRAARIAAGYGARVVVAEEYRFGGTCVIRGCVPKKLMVYASQVHEEIRDAAGFGWSIPTAEFNWSALIANKDKEIARLEQIYANNVEKAGARTIKARAVFDDPHTLLLSTGEKVRAKTILIATGGAPNHGKPIPGIEHVISSNEVFHLPQQPKRILIQGGGYIALEFACIFAGLGSDVTLVYRGDNILRGFDEDVRTHVRTEMERAGITIITGCTVTAVEKLGEEYTSHLSSGSSIASDQVMFAIGRHPAVASLGLEKAGVAINPDNGGIAVDDHCRTSVPHIYAVGDVTHRTNLTPVAIREGHAFADNVFGGKQIQVDYAYVPTAVFSQPQVGTVGLTEAQARAQYSVVDIYKTDFRPMKGTMSGSQSRVLMKLIVDGTTDRLLGCHIVGPDAAELVQVVAVAMKMKATKADFDGTMALHPTAAEELVTMRTRTARYQREAAE

SEQ ID NO: 17639 - protein, 208 aa, Bacillus pumilus SAFR-032
MYQSVEEAVKALKEGEIIIVVDDEDRENEGDFVALAEHATPEVINFMALHGRGLICTPVHASIAKHLNLHPMVEQNTDAHHTAFTVSIDHVTTTTGISAFERSTTMLAMLNKDATPEEFARPGHVFPLIAKEGGVLERPGHTEAAVDLAKLAGSQPAGVICEIMNVDGSMARVPELKDIQKQHGLKMLTIEALQTYLHHKDTATIETK

SEQ ID NO: 17640 - protein, 300 aa, Salmonella typhimurium LT2
MTMVRIACVGITVMDRIYYVEGLPTEGGKYVAKRYTEVGGGPAATAAVAAAKLGAQVDFIGRVGDDDTGNSLLAELESLGVNTRYTRRYTQAMSSQSAIMVDAKGERIIVNYPSPDLLPDADWLNDIDFSQWDVVLADVRWHDGAKQAFTLARQAGVMTVLDGDITPQDISELVALSDHAAFSEPGLARLTGMSEAIDALKKAQMLTNGHVYVTRGSEGCNWLEKAAVRHQPGFTVEVVDTTGAGDVFHGALAFGLASGYAIEEAVRFASGVAALKCTRPGGRAGIPDCEQTRSFLSLFV

SEQ ID NO: 17641 - protein, 472 aa, Bacillus cereus G9241
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLIGMWFNDDTRISLVVGIVFLAIVTISFYAFGIGKRPPLDVPNDQEISSK

SEQ ID NO: 17642 - protein, 444 aa, Xanthomonas axonopodis pv. citri str. 306
MSADTAASAPSSTTAIGGLGDHQASVSVPNSGHWWSRLLAFLGPGYMVSVGYMDPGNWATDLAGGSQFGYLLLSVILLSNLMAIVLQGLSARLGIATGLDLAQACRARYPRGVNLALWGICELAIIACDLAEVIGTAIALKLLFGIPLTMGAIITAVDVVLVLLLMNRGFRALEAFVIALLLIIFACFGIQIALAAPPIAAVLGGFIPRAQVVTDPQALYLAIGIIGATVMPHNLYLHSSIVQTRAYPRTDVGRKSALRWAVTDSTVALMFALFINASILILAAAVFHAQGRTDVQEIEQAHALLAPMLGVGLASTLFAVALLASGINSTVTATLAGQIVMEGFLQLRLPPWIRRLLTRGIAIVPVVIVTWLYGEAGTARLLVLSQVVLSMQLPFAVIPLVRFVSDRQLMGALVAPAWLVRIAWVIAAVIVCLNLKLLWDTALH

SEQ ID NO: 17643 - protein, 792 aa, Xanthomonas axonopodis pv. citri str. 306
MNENILWLHELRLADLARVGGKNSSLGEMIGNLAGLGVSVPGGYATTAEAFKDFIAHNDLSKRIFDRLATLDVEDVNALTLAGKEIRGWVIDAPLQPDLDRDIRSAYAQLCAENGGGDVAVAVRSSATAEDLPDASFAGQQETFLNVTGADDVVHKVKEVFASLYNDRAIAYRVHHGFKHEDVFLSAGVQLMVRSGVGAAGVLFTLDTESGFRDVVFVTSSFGLGEMVVQGAVNPDEFYVYKPTLTAGKPAILRRSLGSKAIRMVYSDVPGERVRTEDTPVELRSTFSISDEDVQELSKQALVIEKHYGRPMDIEWAKDGVSGKLFIVQARPETVKSRSHATQIERFALEAKGAKILAEGRAVGAKIGSGVARVVRSLDDMNRVQAGDVLIADMTDPDWEPVMKRASAIVTNRGGRTCHAAIIARELGVPAVVGSGNATDVLSDGQEVTVSCAEGDTGFIYDGLLPFERTTTDLGNMPPAPLKIMMNVANPERAFDFGQLPNAGIGLARLEMIIAAHIGIHPNALLEYDKQDADVLKKIDAKIAGYGDPVSFYVNRLAEGIATLTASVAPNTVIVRLSDFKSNEYANLIGGSRYEPHEENPMIGFRGASRYVDPSFTKAFALECKAVLKVRNEMGLDNLWVMIPFVRTLEEGRKVIEVLEQNGLKQGENGLKIIMMCELPSNALLADEFLEIFDGFSIGSNDLTQLTLGLDRDSSIVAHLFDERNPAVKKLLSMAIKSARAKGKYVGICGQGPSDHPELAEWLMQEGIESVSLNPDTVVDTWLRLAKLKSEG

SEQ ID NO: 17644 - protein, 400 aa, Magnetospirillum magnetotacticum MS-1
MGFLADALSRVKPSATIAMTQKARELKASGMDVISLSVGEPDFDTPDHIKEAAIDAIRRGETKYPPVSGIVPLREAIVKKFKRENGLDYKVSQTIVGTGGKHVIYNALLATLNPGDEVVIPRPYWVSYPEMVILCGGTPVFAETDMAHDFKLQPEELERAITPKTKWIILNSPSNPSGAAYTRDEMKKITDVLMRHPHVWVLTDDMYEHLTYGDFEFVTPAQVEPGLYDRTLTMNGVSKAYAMTGWRIGYAAGPEQLIKAMDFVQGQQTSGASSISQWAAVAALDGTQEHLARFKAAFQERRDLVVSMLNQSNGLKCPVPEGAFYVYPSCAELIGKTTESGKTLASDEDFVTELLQAEGVAAVHGSAFGLGPNLRISYATSNKTLEEACRRIQRFCGSLR

SEQ ID NO: 17645 - protein, 237 aa, Listeria innocua Clip11262
MTETKEEKVHKVFEKISPSYDRMNSVISFKLHVKWRKETMKLMRVQKGTNVLDVCCGTADWSIMMAEEIGPEGHVTGLDFSENMLKVGREKVKEADLHNVELIHGNAMELPFPDNSFDYVTIGFGLRNVPDYMQVLREMYRVLKPGGQLACIDTSQPNIPGWKQVFNAYFRYVMPVFGKFFAKSYKEYSWLQESTREFPGMARLAEMFQEAGFSYVRYISHSGGASATHFGFKKKEQ

SEQ ID NO: 17646 - protein, 806 aa, Rubrobacter xylanophilus DSM 9941
METKLRWVRRFSEIGLEDVPLVGGKNASLGEMTRELGSLGIRVPEGFAITAEAYRYFLGENELEEPIREVISGMDREDLEDLARRSRKVQDAILAGIFPDDLEVEILRSYRELSAACGEEHADVAVRSSATAEDLPTASFAGQQESFLNVRGEVQLLDAVRRCFASLFTPRAIGYREDMGFDHFDVGLSVGVQKMVRADLASSGVIFTLDPESGFPDVVYVTSTWGLGENVVQGRVVPDGFYVHKPTLREGYAPLVRRRLGSKEFRLVYDESGHRAVKNVPTPPEEREAFSLPDAEVLRLARWAVLIEDHYSGKHGRRTFMDIEWARDGLTGDLFIIQARPETVHGARRSPAVKLYALKEEGEVLAEGLAVGSAVASGEARVLRDPSGISSFRPGEVLVTEMTDPDWEPIMKAASAIVTDRGGRTSHAAIVARELGIPAVVGTRNATRRVRGGEPVTVSCAGGETGRVYRGALRYEETEVDPASFGRPKTSVMMNVGDPEKAFGLAMLPNDGVGLARMEFVFASWVGIHPLALTRFESLPPKTKLEVSRRTGGYADKREFFVDRLSQGIGTLAAAFWPKPVILRLSDFKTNEYAHLLGGELFEPREENPMLGWRGASRYHHPDYREGFMLEVAAIRRVREIFGLKNLKVMVPFCRTPEEGERVLEVMEEGGLERGADGLEVYVMAEIPSNVVLAREFARIFDGFSIGSNDLTQLVLGVDRDSERVSSLFDERDEAVKRMCAELIEEAHRAGRKVGICGQAPSDYPEFAAFLVERGIDSISLSPDAVVPTTLEILRMERAAAGEGSS

SEQ ID NO: 17647 - protein, 347 aa, Rubrobacter xylanophilus DSM 9941
MKALVYHGPGEKSWESKEDPRIERPTDAVVRIDTTTICGTDLHILKGDVPEVAEGRTLGHEAVGTVVDAGPGVENFEEGDRVLVSCISACGRCAYCRRGMYGQCLQGGGWILGHLVDGTQAEFARIPFADNSLYEVPEGLSDEQVVFISDILPTGYEVGVLNGKVEPGDTVAIVGAGPIGLASMLTARLYGPSRIIAIDLADSRLEQARRFGADTTINNSAQDAVEMVMELTGGLGADVVMEAVGVPATFELCTGLVRPGGHVANIGVHGAPATLHLERLWARDVTITTGLVDTYSTPTLLRLVAEGRLDPTPFATHRFALGEILDAYETFADAARTQALKVVLSAE

SEQ ID NO: 17648 - protein, 199 aa, Nicotiana tabacum
KGYVFKIMGGCDKQGFPMKQGVLTPGRVRLLLYRGTPCFRGYGRRNGERRRKSVRGCIVSPDLSVLNLVIVKKGENDLPGLTDTEKPRMRGPREPQRSEALYFKEDDVRKYVNTTAEFTTKWKGSKAPKIQRLVTPLTLQRKRARIADKKKRIAKAKSEAAEYQKLLASRLKEQREKRSESLAKKRSRLSAASKPSIAA

SEQ ID NO: 17649 - protein, 868 aa, Aspergillus nidulans FGSC A4
MPSQEEVVKKFQRIGIVGSGNMGSMMAFAFSEIGLDVSIWDVKYDNVQQLLESAKNTNYKGKIEGFKDVSKFTQSLEGKAERKIFLFSITHGDPADSVLDMIKKDLKKGDIILDGGNENYRRTEARQKICEKIGVSWIGLGVSGGYQSARRGPSLSPGGDKEALDLVMPLLELYAGKDAKSGQPCVTRIGPKGSGHFVKMVHNGIEGGMLSTLAEAWSLLHYGRGMGYEEIADLFESWNKEGVLRNNYLLEIGAELLRVKKTPQGDGNGEGVGDGGFVLDDVLDKVVQDDDNTEGTPYWSVMESASRHISAPTLATAHFMRIASGNRIERLEVAKQLRIPSPSPIRGMKDIEAFKEHLHSAVYSSFLASFCQGLELIARASEDEGWDIDLGKCLQIWRSGCIIRSEGIADILQPAVSGNKGIKNMKYIDTVAQELHRTYPSLKEIVMAATDSDHYIPAISATLEYLKYEGGTNLPTKFMEAQMDFFGAHGYNLPGVPGEDPGPVIGGCSFAPSPLSPNPFEESSPRNNSHAEWLFSPTPTPVSPQTLHPVRIAVIGGTGLRELPGFTQVASLNIQTPWGTPSSPITILHHTHKDKTVAVAFLSRHGLHHQIAPHEVPARANIAALRSIGVRTIIAFSAVGSLQEEIKPRDFVVPDQVIDRTKGIRPFTFFEGGVVGHVPFGDPFDESVAKIVRACGHSLEGEGVKLHDRGTLICMEGPQFSTRAESKLYRSWGGSVINMSCLPEAKLAREAEIAYQMICMSTDYDCWHESTEDVTVEMVMGNMKANAVNAKHFVTAVLDELADDRNAELVQAKQYAGSVKFGLSTAQANWSPEARERMNWLFPGYFEIDLYIRYLLLIQRDIDLTSWN

SEQ ID NO: 17650 - protein, 334 aa, Mycoplasma mycoides subsp. mycoides SC str. PG1
MNYLLIGGAGYIGSHVAEIINKTDNNKVIIYDNLSSGLNDFIEQKSTFIQGDILDFNKLNEVFSSNKIDVVIYLAGLIKVGESVQKPLDYYQTNILGLINTLKIMQAHNVNYFVFSSSAAVYGNNSRHNGYFYEDDPKEPCSPYGRTKYFGEEIIKDFAIANPNFHYTFLRYFNVAGASKSKRIGYLTKDNNKPTHLIPAISYFAFGLTDQFSIFGSDYNTKDGTCIRDYVYVCELAELHLLTAQKMVKENCNLYYNIGSGKGFSNLEIIKEFEKQLGYKLNIDIAPKRSGDPDVLVASNTKLCQELNYKIKTNIKDIVESEIAFRKAHLKNKE

SEQ ID NO: 17651 - protein, 338 aa, Listeria innocua Clip11262
MTQKKVAILGAGSWGTGLALVLADNNHKPVIWGNLDKIVNEINESHTNSHYLPDIILPTEVKATLSLDEAIDGAEIVVIAIPTNAMRVVCKQLNEALKEPTILVHVSKGIEPETNLRMSEVIEEEVDATKRKALVVLSGPSHAEEVALRHPTTLCASCKDLKAAEIVQDRFINNNLRIYTNDDVIGAEIGGALKNIIALGAGISDGLGYGDNAKAALMTRGMAEITRLGVAVGSNPQTFYGLTGIGDLIVTCTSVHSRNWRAGNMLGKGENLDEVLEKMGMVVEGVRTAKAVHGWAKKLDIDMPITESIYAILFENKDAREAVDLLMGRKKKIEKESF

SEQ ID NO: 17652 - protein, 290 aa, Arabidopsis thaliana
MANAITFFKLNTGAKFPSVGLGTWQASPGLVGDAVAAAVKIGYRHIDCAQIYGNEKEIGAVLKKLFEDRVVKREDLFITSKLWCTDHDPQDVPEALNRTLKDLQLEYVDLYLIHWPARIKKGSVGIKPENLLPVDIPSTWKAMEALYDSGKARAIGVSNFSTKKLADLLELARVPPAVNQVECHPSWRQTKLQEFCKSKGVHLSAYSPLGSPGTTWLKSDVLKNPILNMVAEKLGKSPAQVALRWGLQMGHSVLPKSTNEGRIKENFNVFDWSIPDYMFAKFAEIEQVRS

SEQ ID NO: 17653 - protein, 213 aa, Methylobacillus flagellatus KT
MIHYPATAQSQFEAQGLGYIPMVIEQSGRGERSYDIYSRLLKERIIFLVGPVNDATANLVVAQLLFLEAENPDKDIYFYINSPGGSVTAGMGIYDTMQFVKPDVSTLCVGQAASMGALLLAAGAQGKRFCLPNSRVMIHQPLGGFQGQASDIEIHAKEILFLREKLNHILASHTGQPVEKIALDTDRDNFMSAEQSVAYGIVDKVIASRADAA

SEQ ID NO: 17654 - protein, 321 aa, Sesbania rostrata
MASSGYLSVFFHAFVFASLATTGFSQLSPNYYDYTCPNALSTIKSVVEGAVWKERRMGASLLRLHFHDCFVNGCDGSILLDPTSSIDSEKNAGPNFQSARGFEVVDDIKKAVDAACGKPVVSCADILAVAARDSVVALGGPTWEVQLGRRDSTTASRDAANKDIPAPFFSLSQLIENFKNKGLDEKDLVVLSGGHTIGYARCATFRDHIYKDTDINSEFAQQLKYICPINGGDSNLSPLDPTAANFDVAYYSNLLQTKGLLHSDQELFNGGSTDELVKQYSYYPEAFFQDFAKSMIKMGNIQPLTGDQGEVRVDCRKVNYY

SEQ ID NO: 17655 - protein, 1355 aa, Aspergillus nidulans FGSC A4
MATESTYPVISSRLDLRAKHLQQNKADWGDILIRFEEALKHVAAEGNEVSLNRHQSRGQLLPRDRVALLLDQDTPFLELGAFAGFENPNSTPCANLIAGIGNVSLTFAVLKVNRMMEIAFENDLPLISLVQSAGVFLPQQFRVFHKGGQLFRDLAVRTQHGKPSCAIVFGSSTAGGAYHPALSDYTIFVENQAQAFLGGPPLVKMATGEVIGAEELGGANVHATVTGLADQIAIDEFDAIVKAREWVSTLRERAVPLHSLLSPAEPRYPAQDLLYLVNPDIRKPFDMLEVLLRIVDDSRLSMFKPKYGTNMINAWAHILGFPVGIVANQISVINPNEAAKTAQFIRMCNQENTPIIFLHNVTGFMVGAKAEHAGIIKMGAQLVSAVSCSTVPHISIIVGASYGAGNYAMCGRAYKPRFIFTWPTGRCSVMGPDQLSGVMETVQLQSAKSKGKVLEPTLLKKQVESFRQSAARDISSNLNACPYPYFNNAPPISNLRSTKYYSSPENGPPPVVPEWRMVMVDLETVRRECGPISDVRVKSNRYRQDTSELQSHIFYYCASIMANPSLNGETVHAAPLRPPLYVAPSPLGEDGRPIIKKVLIANRGEIACRIIQTCHKLNIATVAVYVNESRDTSSRHIRDADEAINIGSIDQCPRNPFLDGELLIRTALSVNADAIHPGYGYLSENAEFARSIRDAGMIFIGPSDTAMSTLGNKRAAKEYLSKHAPDVPLIPGYVGSSQDAPELSRIAAQIGFPVMLKASAGGGGKGMRIIREAGQLQAELERAQSEALRSFGSADCILEMYVESSKHVEIQLLGDSYGEVVSFFERDCSVQRRHQKVIEETPCTFLTEKTRQEMSATAVRIAKLLGYENAGTVEFVVDAVTGKFYFLEVNARLQVEHPITEEVTGVDLVSLQLYVAAGGSLRALPALQGLTQQGHAIECRLCAEDPRKNFFPEHGKIHLWLPASGVLGPGRDVRYEAAVQSGSSVSIYFDSMIAKIVVWAPTRALAIEKMVKVLAHTICAGVQTNQLLMQRCLLHKAFHNPAYTTSFLSLHLDELLHEPGGLIAEIRKSLPIVPAVALRHLAALSASQKRPFQNVRRRFRNQHHDPVNLQYDVVTMVDWPYSLPETDPTTPLMCVWTPDNTGPSATQEAHLLAIPEIDTSNDVKKPAGTSARYQKVSKVLRDDLVNLSGTRYAVKIESWKPAEGDPALKESWLSSTLEISINGTKLLAYVSVAINRLEALAGCLNRTQTVFCHIPAIGASVEFKRDTSLSFVESTRAAASGENNQEQRTVTAPMPCKVLSTLKKNGEQVKSGDIVMVIESMKMEVTISASADGQFETNWKEGDAVEEGKTLCTVK

SEQ ID NO: 17656 - protein, 479 aa, Combretocarpus rotundatus
SLGRITQIIGPVLDITFPPGKMPNIYNALIIKGRDTGGQQINVTCEVQRLLGNNRVRAVAMSATDGLTRGMEVIDTGAPLSVPVGGTTLGRIFNVLGEPIDNLGPVDTRTTSPIHRSAPAFIELDTKLSIFETGIKVVDLLAPYRRGGKIGLFGGAGVGKTVLIMELINNIAKAHGGVSVFGGVGERTREGNDLYMEMKDSGVINEENIAESKVALVYGQMNEPPGARMRVGLTALTMAEYFRDVNKQNVLLFIDNIFRFVQAGSEVSALLGRIPSAVGYQPTLSTEMGSLQERITSTKKGSITSIQAVYVPADDLTDPAPATTFAHLDATTVLSRRLAAKGIYPAVDPLDSTSTMLQPQIVGDEHYKTAQRVKQTLQRYKELQDIIAILGLDELSEEDRLTVARARKIERFLSQPFFVAEVFTGSPGKYVNLSETIRGFQLILSGELDSLPEQAFYLVGNIDEATAKATNLEKESKLN

SEQ ID NO: 17657 - protein, 320 aa, Lactobacillus acidophilus NCFM
MKNTARAHTNIALIKYWGKSDPILRLPLMSSLSMTLDAFYTDTLIEKTDAKNEFYLNGKRQNRQAKKRVFSYLDTLKEKFGYTDNLIVKSTNHVPTSAGLASSSSAFAALAASFCKLYNLDVDKTELSRLARLGSGSASRSIFGGFAIWQKGNSNQSSYAYALDEKPKMDLQLLAVELNTEQKKISSTKGMKDAQSSPFFSTWTNRNQLELDEMIKAIKQNDFTALGSLAELNANEMHAINLTAQPEFTYFMPETIRAIKLVEDLRTKGIECYYTIDAGPNIKVLCQLKNRKEIIEHFESVFNNVNIVSASFGPGVIYLD

SEQ ID NO: 17658 - protein, 280 aa, Arabidopsis thaliana
SVKPIWGRTKETDEHMGWVFPGSDTEVPGADPDHLNGAKSVRELYEIASPNYTGKYTVPVLWDKKLKTVVNNESAEIIRMFNTEFNHIAGNPDLDLYPSHLQAKIDETNEWIYNGINNGVYRCGFAKKQGPYEEAVEQVYEALDRCEEILGKHRYICGNTLTETDIRLFVTLIRFDEVSSYFQSKKKKYTICERISNVETLIQVYAVHFKCNKKLIREYPNLFNYTKDIFQIPGMSSTVNMNHIKQHYYGSHPSINPFGIIPHGPNIDYTSPHDRHRFSK

SEQ ID NO: 17659 - protein, 84 aa, Vitis vinifera
MAPEEEKMTRRSPLDFPIEWERPKPGRRPDIFPQFSPMKTPLPLPLPADPPEEDEEEEEKKEEEEEDPEKEEPDNPEKPASFGV

SEQ ID NO: 17660 - protein, 130 aa, Brassica napus
  misc_feature (125)..(125): Xaa can be any naturally occurring amino acid
RSSRYLVFNSIFALIFWETRRSDFGVSMGHHITTVILIVLSYICRFSRAGSVVLALHDASDVFLEVGKMSNYSGFEGIAAFSFVLFALSWVLLRLIYYPFWILWSTSYQIIMTVDKEKHPIEGPXIYYYM

SEQ ID NO: 17661 - protein, 221 aa, Glycine max
  misc_feature (200)..(200): Xaa can be any naturally occurring amino acid
MGQKSLIYAFVSRGTVILAEYTEFSGNFNSIAFQCLQKLPATNNKFTYNCDAHTFNYLVDNGYTYCVVADESIGRQLPMAFLERVKDEFVSKYGGGKAATAPANSLNKEFGPKLREHMQYCVDHPEEISKLAKVKAQVSEVNGVMMENIEKVLDRGDKIKLLADKTENLHNQTQDFRTSGTRIRRKMWLQNMKIKLIVLXILIALILIIVLSVCLGFNCGK

SEQ ID NO: 17662 - protein, 530 aa, Bordetella bronchiseptica RB50
MHQRILILDYGSQVTQLIARRVREAGVYSEIHAGDVDDAFVRDQVAQGLKGIILSGSHASAYEEGSMRVPAAVFEVGVPVLGICYGMQSMAQQLGGTVSFSDHREFGYAEVRAHGHTKLLDGLADFTTDEGHGMLKVWMSHGDKVTELPPGFKLMASTASCPIAGMADEDRGFYAVQFHPEVTHTVQGKAMLARFVKDICGCEGDWNMPDYISEAVARIREQVGSDEVILGLSGGVDSSVAAALIHRAIGDQLTCVFVDHGLLRLDEGKQVMQTFAENMGVKIVHVDATSQFMGKLTGVADPEAKRKIIGREFVEVFQDEAGKLQGAKWLAQGTIYPDVIESAGAKTGKATSIKSHHNVGGLPDTLNLQLLEPLRELFKDEVRELGVALGLPPQMVYRHPFPGPGLGVRILGEVKHEYAELLRRADAIFIEELRNAKDPASGLTWYELTSQAFAVFLPVKSVGVMGDGRTYEYVVALRAVQTFDFMTADWAPLPHPLLARVSSRIINEVRGINRVVYDVSSKPPATIEWE

SEQ ID NO: 17663 - protein, 517 aa, Pisum sativum
MGTNEWHVERRSTSDTDSPLAPRRDVLETGTLSIVVLGASGDLAKKKTFPALFHLYKQDLLPSDEVHIFGYARSKISTDELRNKLQSYLIPKKDASPKDLHDVSDFLQLVKYISGGYDSEEGFRLLDIEISEHEYLKNSKEGSSRRLFYLALPPSVYPSVCKMIKTYCMNKSDLGGWTRVVVEKPFGRDLESAEELSNQIGELFEEPQIYRIDHYLGKELVQNMLVLRFANRFFLPLWNRDNIDNVQIVFREDFGTEGRGGYFDQYGIIRDIIQNHLLQVLCLITMEKPVSLKPEHIRDEKVKVLQSVLPIRDDEVVLGQYEGYKDDPTVPDESNTPTFATAILRIHNERWEGVPFIMKAGKALNSRKAEIRVQFKDVPGDIFRSKTQGRNEFVIRLQPSEAIYMKFTVKQPGLEMSAVQSELDLSYGQRYQGITIPEAYERLILDTIRGDQQHFVRRDELKASWEIFTPLLHKIDRGELKPIPYKPGSRGPAEADELLEKAGYVQTHGYIWIPPTL

SEQ ID NO: 17664 - protein, 403 aa, Streptomyces clavuligerus
MKTIDQLLAAGVAGKRVFVRADLNVPLDGTTITDDGRIRAVAPTVARLAAAGARVIVASHLGRPQGAPDPAFSLAPAARRLGELLGTDVAFATDTVGDSARAVVASLADGQVAVVENLRFNPGETSKDDAERGAFADRLASLADLYVGDGFGAVHRKHASVYDLPARLPHAAGELIATEVGVLKQLTDDVRRPYTVVLGGAKVSDKLGVIDHLLEKADRILIGGGMAYTFLKAQGHEVGISLLQEEQVPTVQGYLERARERGVELVLPVDVLVSPAFPDLRTKAPAHPTTVSADAIPADQEGLDIGPESRKLFASKIADSATVFWNGPMGVFEHPDFAEGTKAVAQALVDSPAFTVVGGGDSAAAVRILGFDENAFGHISTGGGASLEYLEGKTLPGLAALED

SEQ ID NO: 17665 - protein, 276 aa, Magnetospirillum magnetotacticum MS-1
MSGLCLPAFEAAHLEPFSPFGFSKSVQADGVERGIMAAAAIIFFAFYGFDAIATAAEETRNPGRDLTIGIVGSMLACVLIYVAVAVAAVGAVAYTRFADSPEPLALILRELGRPRVAHYLAASAVIALPTVILAFFYGQSRIFFTMARDGMLPERLARVSSRGTPVRITLFTAAIVVVLAGFIPLSQLAALANAGTLAAFIAVAACMLVMRARAPDAPRTFRAPAPWVIGPVTILGCGYLFFSLPSQTQFWFVIWNALGVAFYLLYGRRRAGIADV

SEQ ID NO: 17666 - protein, 338 aa, Pseudomonas fluorescens
MNLNRFKRYPLTFGPSPITPLKRLSEHLGGKVELYAKREDCNSGLAFGGNKTRKLEYLIPEALEQGCDTLVSIGGIQSNQTRQVAAVAAHLGMKCVLVQENWVNYSDAVYDRVGNIEMSRIMGADVRLDAAGFDIGIRPSWEKAMNDVVERGGKPFPIPAGCSEHPYGGLGFVGFAEEVREQEKQLGFKFDYIVVCSVTGSTQAGMVVGFAADGRSKNVIGIDASAKPEKTKAQILRIARHTAELVELGREITEDDVVLDTPFAYPEYGLPNEGTLEAIRLCGSLEGVLTDPVYEGKSMHGMIEMVRRGEFPEGSKVLYAHLGGAPALNAYSFLFRNG

SEQ ID NO: 17667 - protein, 339 aa, Flammulina velutipes
MAVKVGINGFGRIGRIVLRNALQVGGIEVVAVNDPFIDLEYMVYMFKYDSVHGRFKDDVHTKDGKLFIAGKPIAVFNERDPANIPWSSAGAEYIVESTGVFTTIDKASAHLKGGAKKVIISAPSADAPMFVCGVNLDKYDPKFKVISNASCTTNCLAPIAKVMHDKFGIVEALMSTIHASTATQKTVDGPSNKDWRGGRAVNNNIIPSSTGAAKAVGKVIPSLNGKLTGLAFRVPTLDVSVVDLVCRTEKSATYEEIKAAMKEASEGSLKDILGYTEDSVVSTDFVSDNRSSIFDAAAGIQLNGNFVKIIAWYDNEWGYSRRVCDLLVYAAQQDAKAQV

SEQ ID NO: 17668 - protein, 320 aa, Listeria innocua Clip11262
MAKVALITTGGTIASKKTASGKLASGELSGEELAALCQLPTEIQIDIYSTFQLPSMHIALPDLISLKQLIESIFMDETYDGIVVTHGTDSLEETAYFLDLAVTDARPIVVTGSQRAPEEPGTDAYVNIRHAIYTACEVNLRQAGTVVVFNERIFAARYVKKVHASNIQGFSAFGFGYLGIIDNDQVFLYQKPLEHECFDIRLDLPEVVVIKCYLGADGLFIDAAIDSGVSGIVLEGVGRGQVAPKMMPAIIRALDANIPVVITTSAEEGNVYTTYDYEGSTFDLYNRGVILGKDYDSKKARMKLMVLLASQEEINQTNFR

SEQ ID NO: 17669 - protein, 483 aa, Rickettsia prowazekii str. Madrid E
MAAFTPITIAYGDGIGPEIMEAVLYILRKAEARISLETIEVGEKLYKKHYTSGISEESWDVIQRTGIILKAPITTPQSGGYKSLNVTIRKTLQLFANIRPVVSFYPFTRTLHPNLNLTIIRENEEDLYSGVEYRQTHNMYESMKLISHTGCKKIIRYAFEYAIKNNRKKVTCLTKDNIMKFSDGIFHRVFNEIAKEYPQINNEHYIIDIGTAKLATKPEIFDIIVTSNLYGDIISDVAAEISGSVGLAGSANIGQHYAMFEAVHGSAPDIAGKGIANPSGLLNAAIMMLVHIGQGDIASLIENAWKKTIEDGVHTFDIYNEHSSSKKVCTKEFAVEVIKRLGQLPITLPKAAYPLIVKKQESNIDYKIDTREVKKLVGTDIFINMHVFSAHDIADKINKLDIGNFELKTISSKGLKLWPHDSRFEIISDHWCCRFMNKDGTEIKHLDITMLLQSLSKANIDFIKVENLFEFDGVAWYSLAQGE

SEQ ID NO: 17670 - protein, 192 aa, Vibrio angustum S14
MPFKVGLKSNIPADLLSFNGLESGKEHVAVIFKDADKTTAPLVRMHSECLTGDVFHSSRCDCGEQLDETIEKMGELGGIILYLRQEGRGIGLYNKIDAYKLQSEGMNTYEANNHLGFGDDLRDFSEAAYMLKALGLTEIRLVTNNPKKIRELSENGINIVEVVGTKAHVKDGNESYLKTKASHGHHRFNFEN

SEQ ID NO: 17671 - protein, 334 aa, Mycoplasma mycoides subsp. mycoides SC str. PG1
MNYLLIGGAGYIGSHVAEIINKTDNNKVIIYDNLSSGLNDFIEQKSTFIQGDILDFNKLNEVFSSNKIDVVIYLAGLIKVGESVQKPLDYYQTNILGLINTLKIMQAHNVNYFVFSSSAAVYGNNSRHNGYFYEDDPKEPCSPYGRTKYFGEEIIKDFAIANPNFHYTFLRYFNVAGASKSKRIGYLTKDNNKPTHLIPAISYFAFGLTDQFSIFGSDYNTKDGTCIRDYVYVCELAELHLLTAQKMVKENCNLYYNIGSGKGFSNLEIIKKFEKQLGYKLNIDIAPKRSGDPDVLVASNTKLCQELNYKIKTNIKDIVESEIAFRKAHLKNKE

SEQ ID NO: 17672 - protein, 708 aa, Dehalococcoides sp. BAV1
MDLSWLVWTAGLIAVLFALYLIRDVMRRDSGTPAMQDIAGRILEGAVAFLRRQYRTIAILAVVAAVAVGAVVGLLGGERGLEAYGITGIGIAWRTALAFLAGALCSGISGVIGMYISVKSNLRCAAAAAKGGLSEAVTVAIRGGAVSGFLIVALSLLGVAGIYYMYGGNPEVTPHLIIGFGFGASFVALFAQLGGGIYTKAADMGADLVGKVEAGIPEDDPRNAAVIADLVGDNVGDCAGRGADLFESTAAENIGAMILGITLYLATGNAAWVLFPLVVRAFGILASIVGIMFVRGKDNESPMNALNRGYFTAVGLSIIGIFIANQTIGGDLWLFGAGVIGILTSVAMVFITQYYTEFRYKPVQEIANASRTGAATNIVSGTAVGLETAMPTAITIGAALLLSYWMGGQTGIAGGAVFGTAAATMGMLMTCPFILAMDTFGPITDNANGVIEMAGVGGKVRKITDRLDAVGNTTKALTKGYALASAGLAAFLLFEAYLERVAFLRGETEMMAVDLSRIEVFVGGLLAVALVFFFSAVAIKAVGRTASKIIEEVRRQFKADPGILAGTSRPDYARAVDITAAAGLREMIFPGLLPVLSPIVLGVFLKLTGYDSAMAIAGFLMVGTIGGIMMAAYLNNSGGAWDNAKKYIETGEMLEKDGSPVLKHTVTHAATVVGDTVGDPFKDTAGPSIHVLIKLLSTITLVLAPLFI

SEQ ID NO: 17673 - protein, 473 aa, Pseudomonas syringae pv. tomato str. DC3000
MSSSSTTAAADTQGRQNASPNRLIFISVLVATMGALAFGYDTGIIAGALPFMTLPADQGGLGLNAYSEGMITASLIVGAAFGSLASGYISDRFGRRLTLRLLSVLFIAGALGTAIAPSIPFMVAARFLLGIAVGGGSATVPVFIAEIAGPSRRARLVSRNELMIVSGQLLAYVLSAVMAALLHTPGIWRYMLAIAMVPGVLLLIGTFFVPPSPRWLASKGRFDEAQDVLEQLRSNKDDAQREVDEMKAQDEQARNRPKAKELLRQRWVIKLLLIGIGLGFTAQLTGVNAFMYYTPIILKNTGMGTNAALTATIGNGVVSVIATLLGIWAIGRYGRRHLLMTGLVMVILMQAALGCVLQFMPQNLTQSYTALACILVFLLFMQMCISPVYWLLMSELFPMQVRGLLTGTAVSMQWLFNASVAFTFPIAVDTIGNPTFFIFAAINVGSLIFVFLCLPETKGKSLEQIEKHLKKEL

SEQ ID NO: 17674 - protein, 488 aa, Mycobacterium avium 104
MVIFGVTGDLARKKVMPAIYDLANRGLLPPSFSLVGFARRDWSTQDFGKVVYEAVKEHCRTPFRQENWDRLAEGFRFVPGAFDDDEAFGRLAETLDKLDAERGTGGNHAFYLAIPPKSFPVVCEQLHKSGLARPQGDRWSRVVIEKPFGHDLESAQSLNKAVNAVFPEESVFRIDHYLGKETVRNILALRFANQLFDPIWNSHYVDHVQITMAEDIGLGGRAGYYDGIGAARDVIQNHLMQLLALTAMEEPVSFSPLALQAEKIKVLSATHLAHPLDETTSRGQYTAGWQGGEKVVGLLDEEGFAKDSITETFAAITLEVDTRRWAGVPFYLRTGKRLGRRVTEIALVFKRAPHLPFDATMTDELGANAMVIRVQPDEGVTLRFGSKVPGTAMEVRDVNMDFSYGSAFAEESPEAYEQLILDVLLGEPSLFPVNAEVELAWHILDPVLDNWASGGRPEPYEAGTWGPDSAFEMLHRTGREWRGHDTQR

SEQ ID NO: 17675 - protein, 383 aa, Lactobacillus acidophilus NCFM
MNNKIYMDNAGTSPMAPQVVKTMTDMMTNVFGNASATNYYGREAKRVLEDSRHILAESINADDKEIIFTSGGTESDNTAIMQTALARQNEGKHIISTKFEHEAVLRPLARLEKMGFEVTYLNVDKNGQINLDDLKNAIRPDTILVTIMMVNNEVGSLAPIKEIGEIVAPTNAWFHTDAVQAYGEVPIDVKDMKIDLLSTSAHKLNGPKLLGFLYERDGIKLPSFMLGGDQELKRRPGTENVPAIAGFAKAIEIHSNKAIIANEERYFNFKHALVDGLKKNGVDIEVNGNIEDQMAPQVISIWFKGIRSDVLLTNLDLAGVVGAAGSACTAGSLDPSHVLIAMYGKDSPRVWESLRFSFSIENTIEEVNSVVEILTRIINRLKK

SEQ ID NO: 17676 - protein, 286 aa, Coprinopsis cinerea okayama7#130
MIKRRTRPPTQTRQISVEVEDPKEQEVGEEEPDLPIADLIEWRKLRRAREGIDVAKLNVGDAKKKKKRPREEEQGGLRKPLAAEGDEDDEEAKEARARRVVRTNNFTQQTNALDVDKHMMAYIEENLKVRGKPRNEEDDEDKKPLDPQDILYRQVADRFRLDKPKAATEEGNVTNSMSMLTAIPEVDLGMDTRLKNIEETEKAKRVVAEERQERKKVNPDEEHLVATRFYRPNLRAKSDADILRDAKLEAMGLPPQDDAHHRSNHDRAQTATDEIVMERFKKRMRK

SEQ ID NO: 17677 - protein, 280 aa, Xanthobacter autotrophicus Py2
MTFPVPRAPAPTDAALLAGLAEAALAAGVVIRRIEAEGITHRQKSDRSPVTEADHAAEATIFAALSQLMPGVPVVAEEATAAGTEVICGNRFVLVDPLDGTREFISGNGEYTVNIAVVEDGVPVLGVVYAPARALLFAGRPGSAFRAIRAPGARVDAQDWTPIACRKVQDGALVVAESRSHGDPATDALIARYQVAERIPAGSALKFGLIAEGKADFYPRLGPVMEWDSAAGHALVVAAGGSVTRPDGSPLTYGHSEVGYMVHGFVAWGSGGPPEIGSVG

SEQ ID NO: 17678 - protein, 460 aa, Cryptococcus neoformans var. neoformans JEC21
MPRISVPAFAKTVSSRLNFTSTRTLLYTRRMSTTPNAVIPQAKRMFDGATHKLDVWSIFTPANVPADCINLGQGFMNWAPPDWIRAESHESMDHDIMSNHYSHPRGRPRLLKAISKHYSPQFENIVARGKDLTNEEILVTSGANCGMFAALTAHCEPGDEVICIEPYFDQYFASIHFQGAKPVFVPLHPPTGKGIKHGGDWTLNIDEFAAAFTPKTKAVIINTPHNPVGKVFTKEELEQIAKVCIEKNVLVLADEVYDCMVYDGNKHFRIATLPGMWERTLTVGSGGKSFACTGWRVGWLIGPPQLTAATLAAHSRIVFCTNSPMQEAVAIGLEKAAEHKFFEEQVAAYEERRDILCSYFDQIGLSYTKPEGSYFLLVDISPVKVPEGYPIVETCKGRGKDFEFCWWLCQELKVVGIPPSEFYSEEHVNIGERFARFAFCKDPELLHAAGKRLLKLKEYL

SEQ ID NO: 17679 - protein, 575 aa, Bordetella bronchiseptica RB50
MASSPADTPHRNWLRWLPGLAVLKTYQAAWLPRDLAAGLVLTAMLVPVGIAYAEASGVPGVYGLYATIVPLLAYALFGPSRILVLGPDSALAAPILAVVLSVSEGDPMRAVATASLMAIVSGLFCIILGLLRLGFITELLSKPIRYGYMNGIALVVLASQLPKLFAIPTDDGGPLRELWQLAQAVLDGRTNGYSLAVGSATLGLILLLKRFKRLPGILIAVVLATLAVSLFGLDGRGVQVLGEIPQGLPGFTIPWLSNADLARIVLGGCAVALISFADTSVLSRTYAARTHTRVDPNQEMVGLGVANLATGFFQGFPVSSSASRTPVAEAAGSRTQLAGVVGALAVAALLLAAPNLLRHLPSSAMAAVVIAAAIGLFEFKDLRRIFRIQQWEFWLSMLCFAAVVAFGAIPGICLAVVVAVLEFLWDGWRPHFAVLGRVPDLRGYHDLKRYPHAALIDGLVLFRWDAPLFFANAELFQQRLLEAVQASPTPVRRVVVTAEPVTSVDVTSADMLRELSHHLAESGIALHFAEMKDPVRDKLKRFELSEVFGADRFHPTVESAVDDYLKRPPQGTIDP

SEQ ID NO: 17680 - protein, 283 aa, Medicago truncatula
SELCNLKASATPLSYVETEDICGRPLGLRFDKKTGDLYIADAYFGLMKVGPQGGFATSLATEAEGVPFRFTNDVDIDTEGNVYFTDSSTKYQRRNFIQLILSGDNSGRVLKYNSATKETTVLVRNIQFPNGISLSKDGSFFVFSEGVIGRLCKYWLKGDKAGTLEILAILPGFADNVRVNENGDFWVAIHCRRYMYSYINALYPKIRKAILKLPIPTRIQYLLHIGGKMHAAVVKYSPDGKLLQILEDNEGKVVKAVSEVEEKDGKLWIGSVLMPFIAVYHLT

SEQ ID NO: 17681 - protein, 484 aa, Medicago truncatula
MATLADTFLADLDELSDNEAEIPADNDADAADMDEDVDGDLADLENLNYDDLDSVSKLQQTQRYVDVMQKVEEALKKGSDVSQGLDLEDDPEYQLIVECNALSVDIENEIVIIHNFIRDKYRLKFPELESLVHHPIDYARVVKKIGNEMDLTLVDLEGLLPSAIIMVVSVTASTTTGKPLPEEVLSKTIEACDRALALDSAKKKVLDFVESRMGYIAPNVSAIVGSAVAAKLMGTAGGLSALAKMPACNVQLLGAKKKNLAGFSTATSQFHVGYIEQTEIFQTTPPSFRMRACRLVAAKSTLAARVDSIRGDPSGKTGRSLKDEIHKKIEKWQEPPPAKQPKPLPVPDSEPKKKRGGRRLRKMKERYAITDMRKLANRMQFGIPEESSLGDGLGEGYGMLGQAGSGKLRVSAGQSKLAAKVAKKFKEKSYGSSGATSGLTSSLAFTPVQGIELSNPQAHAHQLGSGTQSTYFSETGTFSKIQKN

SEQ ID NO: 17682 - protein, 409 aa, Methylococcus capsulatus str. Bath
MALFVHKYGGTSVGSPERIKNVAKNVIRARSRGDDIIVVVSAMSGETNRLVALAHEMHERPSTREMDVLLATGEQVTIALLSMALEAAGCPACSYTGGQVRILTDDAHTKARILDIDTDRIRSDLAAGRVVVVAGFQGITEAGDITTLGRGGSDTTAVALAAALKADECLIYTDVDGVYTTDPRIEPKARRLDRITFEEMLEMASLGSKVLQIRSVEFAGKYNVPLRVLSSFAAGPGTLITYEEASVEKPLISGIAFNRDEAKLTVKGVPDKPGVAYQILGPVAHANIEVDMIVQNVAEDATTDFTFTVHRNDYRKALDILQATCTALGAREVTGDDKIVKVSLVGVGMRSHAGIAARMFEALAREGINIRMISTSEIKISIVVDEKYLELAVRTLHEAFNLDREPDAV

SEQ ID NO: 17683 - protein, 524 aa, Methylococcus capsulatus str. Bath
MTDIHAQKILILDFGSQYTQLIARRVRELGVYSEIHPYDCGDDFITEFAPQGIILSGGPESVTGTGTPRAPASVFTLGVPVLGICYGMQTMAAQLGGKVEAVEHREFGYAQVRAHGHSQLLNGIEDHTTPEGHGLLDVWMSHGDQVVGLPPGFKLIASTESAPIAGMADEERRFYALQFHPEVTHTRQGKRILERFVRKLCQCEARWTTGNIVEDAITRVRNRIGAERVVLGLSGGVDSSVVAALLQHAIGEQLTCVFVDTGLLRLNEGDQVMATFAEHMGVRVIRVNAEERFLQALQGIADPEDKRKIIGRLFVEIFDEEAAKIEDARWLAQGTIYPDVIESAGSKTGKAHVIKSHHNVGGLPETMKLQLVEPLRELFKDEVRQIGLELGLPYEMVYRHPFPGPGLGVRILGEVRKEYADLLRRADAIFIEELYRHDLYDKVSQAFAVFLPVKSVGVMGDGRRYDYVVALRAVETIDFMTARWAHLPYDFLDLVSRRIINEIPGISRVTYDISGKPPATIEWE

SEQ ID NO: 17684 - protein, 493 aa, Burkholderia pseudomallei K96243
MRSIAARSSHAGAGLEQEGVMDLEEGVRQLYPYAAEFGALHEFPERGMPRERLLEELRSMAVREDRKWESGRCSGTMYCGDHEHYAFLNEAYGLFSHVNALQRDLCPSMNRMESEIVAMTVALLHGEAVQRHDGAHRACGALSLGGTESILNATLAYREKARAERGIERPRMIWPASAHPAFRKAAHLFGFDVTVAPIDPVTMQVDADFVRDAVDANTVMLVGSACNYPYGTIDPIGALSAIAVEKDVWLHVDGCLGGWMLPWGEALGYPDIPAFDFRLPGVTSISADTHKFGYGPKGGSVLAWRDASFRRHQYFLMTDWVGGVYGSPGLTGSRSGGLIAATWAALRSLGREGYLARAKAIFETAFDMQAAVRAIPELRVLGKPTFCFAFTSDAFDIYHVNDFMRQRGWRFNGLQHPDALHMCVTGPQTQPGVAERFRQDLGEAVEHARHRAHARPQSSGVYGGDAAGLDLRDDARARAFFTQVLDLFTDCPL

SEQ ID NO: 17685 - protein, 314 aa, Aspergillus nidulans FGSC A4
MSRRSLWGSLRLVSKRQFAVSEAQYRCFSCSLRTQNQSKSDKDRMTHFGFTNIPEHEKESMVGKVFSSVASSYDTMNDLMSMGIHRLWKDHFVRSLNPGSALPSRDNDSAEKGWNILDIAGGTGDIAFRMLDHATNINHDYHTRVKIADINPDMLAEGKKRSIQTPYYNSERLSFMQGNAEHMPSIPDNSVDLYTVVFGIRNFTDKQAALVEAYRVLKPGGVFACMEFSKVDNPLFNAVYKQWSFSAIPLIGQLVAGDRESYQYLVESIEKFPSQEEFRGMIQKAGFMIPGRGFENLTGGIAAIHKGIKPLSRA

SEQ ID NO: 17686 - protein, 296 aa, Coprinopsis cinerea okayama7#130
MDVSSILEAQKAKERSVLVEKETPLVVDAGHLMVTDLNVIDEESYKDGVQALIGTLFSLPTTSSEEGPLAQLPPQEYQLPRAKPLPKPKPMTKWERFAAAKGIQHKKRDRKVWDEEKQEWVNRWGRDGKNKEAEEQWATPVPHNADADYNPQLEARKERKARVAKNEKQRLQNIARASGSSAQASRKEELDRTLATTRTSTASMGRFDKKLEGEKKIRGIKRKFEPNEGSVEKEAKANLSLLAKMDSDSRKMRRTEKESESVLNVRKAVRHASKGKGSLALAKGDKKGGKAGKGRR

SEQ ID NO: 17687 - protein, 363 aa, Alkaliphilus metalliredigens QYMF
MDKFAFLIHPIELKDIYRKYQFLQKLPKSMVERLINWIPPSQISHITNVQSPFNEVEGWFVGVPLTSEMMMSLKQEEVTKKIIKAGRISEKLGAKIMGLGAYTSVVGDAGITIARELDIAVTTGNTYTVATAFEAAKEATKTLGKKIKNCEIAIVGANGSIGSVCAELAYREGKRVNLIGRDGGKLVNLKRKLESKYIFEQNRKEIQCFTQINEGINTADIVITVTSSVHDVIQAEFIKSGAVVCDVARPRDVSKQVQEERKDVLIIEGGVIQVPEGVQFNFNFGFPPGLSYACMAETMILALEKKYENFSLGREIEIKKVDEINLLAKKHGFKIAGLRSFEKVIDEKYIEGVLKNIEKVANA

SEQ ID NO: 17688 - protein, 473 aa, Alkaliphilus metalliredigens QYMF
MGVIKDQILSEKKKYITIEKAMELSNLETQVKYEQFINPQLLKLLKILSFDRVFVKAKDTKLWDDQGREYIDFLGAYGALNIGHNNEFVISSLQKITNLPNLLQTALNPLSGALAEALANITPGSLMHTFFCNSGAEAVEGALKLARIATGKARIIYCSSSFHGKSMGALSVTGREKYRKYFQPLIASTEEVIYGDISELIDLLETYDDIAAMILEPIQGEGGVIVPSKGYLKMVRELCNQYDVLLIADEVQTGFGRTGNWFACEDEEINPDIMCMAKSLGGGIIPVGAYIATKAVWEKGYGSMDKCLLHTSTFGGNTWAMAAGLATIQFIDESNLVHEARKKGTYFLEKLNQLKEDYPLLKDVRGRGLMIGLEFEPISNQLTKRFELTSELLGEYTGGVIASKMLNDYGIVTAYTLNNPYVIRVEPSLTISYEEIDHFVAALRDILQKHKGITSMALSNTKYFIKSFINRGV

SEQ ID NO: 17689 - protein, 477 aa, Hillebrandia sandwicensis
  misc_feature (35)..(35): Xaa can be any naturally occurring amino acid
GRIAQIIGPVLDVAFPPGKMPNIYNALVGKGRDTXGQQINVTCEVQQLLGNNRVRAVAMSATDGLMRGMEVIDPGAPLSVPVGGATLGRIFNVLGEPIDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATTLEMESKLK

SEQ ID NO: 17690 - protein, 688 aa, Oryza sativa
MCRICFSGENEGSTKAAKMLPCKLCNKKYHRSCLKNWGEHRDLFHWSSWVCPSCRSCEVCRRPGDPNKLMFCKRCDGAYHCYCQQPSHKNVTHGPYLCPKHTRCHSCGSGVPGSGHSTRWFLGYTCCDACGRLFVKGNYCPVCLKVYRDSEVIPMVCCDVCEKWVHIECDGISEEKYQQFQSDQNLQYTCGACRGECSQIRDTEDAVRELWKRRDVVDHDLMASLRAAAALPSLEDVSPSHPNSDDEKLGAYVMKNDGRNTLKFSFKSNSTKPALDSSEQEKNAIKSSGSNKKHSMKKGNQNNKTVSEQDEIFLEKRNETKSLGSLGDQIADVTRDKSSFKNDADAFVLSSAQSAEKALKLQSAKAAAHNADMIPKVKIKGTKVPSLHFKDVGEENAAKSDTGKGTKLVIHIGSRHKSRSGSPKSEMSNSQKEQELVSMHGGKVDVTSQFKSSRSEIKEKSVMKLVRETGVQQNSLLGDLGASKKHATGKRSNAIVSAMENASESGTRSRSFGQKQSVNHLTENQGNASFSVNNSPDSLKPSLLKLKFKRPIFEQPSTQSSQPEEPGTWASPQEELNVAKGQRSKRKRPSLDKMDGSESKAPAAKRHEQSTGEEAMDANWILRKLGKDAIGKRIEVQLASDGKWHQGVVSNVINGTLCLQLDNGRSENIELGKRAIRLIAQRSKSGKR

SEQ ID NO: 17691 - protein, 257 aa, Zea mays
RPTRPRTRGEFEEVEAAPVLVDGPLEPQTSNIMSTTTHIQEDPLSAFFSAAANAGGNSAVAVARQPIQLFGATPVATHAATSITTIQSPGLHYLLPSQASSVSGMPADAHGSIGRSTNLVNPSLFSPLTSSQTTMVCTNSVVAIAPPQHPQTAQQPQSAPLLQPFLLPTASPSPPYGTPLLQPFPPPNPSPSLASAPVLSPTLSRDKVRDALLRLVEVYCSVYFISMYDLNALFFFLKKKKKKKKKKKKKKKKKRAA

SEQ ID NO: 17692 - protein, 520 aa, Coprinopsis cinerea okayama7#130
MASSQAAVFDQVPRPNRRKMAGRKEWGDYPCHQQVAFPPYRNCMTHVLSANLDPATNEELGTVPEMGLEETKEAIEAAAKAFTTWGRTTAKYRHDLLIKFFQLMQQHQDDLARLITLENGKTLTEAKGETAYSASFIEWFAEESVRTYGGLLSSMLVPKLPSNTTCRANPFPLPQRPKRRRQTTRRSILTPWNFPSAMITRKLGAALAAGCTAVIKPPPETPFSALALAELAARADIPPGVINIVTTQKNVTEVGRELCENKIIKKVSFTGSTPVAKLLYGLAASTLKKVSLEAGGNAPFIVFDDADVDEAVEAAIVCKFRGSGQTCVCANRIFVQSGVYAEFASRLAERVAAFKVGNGLEEGVTHGPLIHAKAVEKVERHVADAVSKGAQVLVGGKSIPNSSFFIPTVLSDVPSDAALNTEETFGPLAALTKFETEDEVIRLANNTDVGLAGYFFSRDVGRVWRVAEALEVGMVGANTGLISQAVIPFGGVKESGLGREGGPHGIEEYMNTKLIVFGGL

SEQ ID NO: 17693 - protein, 393 aa, Xanthobacter autotrophicus Py2
MAAAPLPRSIALSRRSAVEPFIVMDVMEHAARIEAGGGHVIHLEVGQPAAPAPTVARRAAAAALEAGQVGYTAALGIPALRARIARHYGEIHGVAVDPERVVVTHGSSGGFVLAFLALFEPGDRVAIAAPGYPPYRHVLHALGCEPVLIETRAEDRHALTPERLLEAHRKAPLKGVLVASPANPTGTMMDRAALTALHACARDLNLAFISDEIYHGLDYAFPAVSAVEIGEDVTVINSFSKYFCMTGWRVGWMVVPPGVSRTMERLQQNLSISVPTLSQIAADAAFEGRAEMDLVKATYVENRRILTEGLPQAGLKRFLPADGAFYLYADVSEFTDDSAAFARRMLDAAHVATTPGVDFDPFHGHQFLRISYAGSAPDMAEAVARIGAFLKRG

SEQ ID NO: 17694 - protein, 167 aa, Zymomonas mobilis subsp. mobilis ZM4
MLHRPVMERESRYFVNKEEAADSPLAVALFDLQHVTAVFYGRDFISVTLDSPSLWSNLESKIIMIISDHFDNDIPLLVENFEKNEIKDHDEEDDVILQIKDLIDSRVRPAVARDGGDIVFQKFEDGIVYLSMRGACAGCPSSVATLKQGVETLLKHFVPEIKEVRAI

SEQ ID NO: 17695 - protein, 506 aa, Enterococcus mundtii
MNEKNVLFTIFGGTGDLAQRKLYPSLFRLYKKGNLSEHFAVIGTARRPWSDEHYREVVKGTIKTLNPSAEEAERFASHFYYQSHDVNDSSHYQTLKELSDRLDEKYHLNGNRMYYLAMAPQFFGTIVSHLKSQKIITEAGFNRLIIEKPFGSDFHSAFELNEKIRQVFPEDDIFRIDHYLGKEMIQNISAIRFANNIFESQWNNRYIDNIQITFGESLGVEDRGGYYDHSGALKDMVQNHILQVLALLAMEPPVAFSEKEIRSEKIKALKAIRIYEKKEVLENFVRGQYAAGQLDDQTFKGYREEDNVDPESTTETFVAGKFTIDNFRWSGVPFYVRTGKRLTEKGTRINIVFKQVPVNVFKTSIDEPCNDPTLPPNVLTIYIQPTEGFSFTLNGKKVGQGFATDPIKLEYRNSAEMVENSPEAYEKLMLDALNGDSTNFSHWEEVAQSWHIVDVIRQVWDQVQPDFPNYKAGSMGPEAAFELLEKDGFEWIWQPDHWYRERGKLD

SEQ ID NO: 17696 - protein, 458 aa, Zymomonas mobilis subsp. mobilis ZM4
MTETSVSFKTLGLDSSLVQALDGLGYSKPTPIQAQAIPHLLEGKDLCGIAQTGTGKTAAFALPSIHYLATNPQARPQRGCRMLILSPTRELASQIARACNDYTRHLRMSVNAVFGGVPIGRQMRMLDRGTDILVATPGRLLDLIDQRALVLKDVEVFVLDEADQMLDLGFIHALRRIDKLLPKNRQTLFFSATMPKTIQELSSQFLSDPVTVSVAPQSSTAERVEQFGIFVNQSEKQALLTITLKNTPGLDRALVFTRTKHGADRVVRHLEAAGLPAAAIHGNKSQPQRERALNAFRNGRLKILVATDIAARGIDVPGVSHVFNYELPNVAEQYVHRIGRTARAGRDGQAISFIANDERSYLRSIERLTRVKLQILPLPENFVMEKELLPHPAPMRPERDGRDGRGGRGGGRGRFGGGAKPGFNHSHGKGDDRGDRGGERPRRPRRPQMRGVRAVARS

SEQ ID NO: 17697 - protein, 385 aa, Rhodopseudomonas palustris CGA009
MSNKVFADLPVTVFEAMSQLARDNDAINLGQGFPDDPGPEDIRRAAADAVLNGYNQYPSMIGLPELRQAISTHYAHWHGVQLDPMTEVMVTSGATEALASAILSVVEPGDEVIVFQPVYDSYLPIIRQAGGIPRLVRLEPPHWRITEESLRRVFNAKTKAIVFNNPLNPAAVVYPREDLELLARFCQEFDAVAICDEVWEHVTFDGLSHIPLITIPGMRDRTIKIGSAGKIFSLTGWKVGFVCAAPKLLRVAAKVHQFLAFTTAPNLQAAVAYGLGKSDDYFLQMRKDLARSRDRLAQGLSSIGFPVIRSQGTYFLTVDLSPLGLNETDEAFCKRIVTDYKVAAIPVSAFYEEEPVTSVVRFCFAKKDQTLDTALERLSDAVHGR

SEQ ID NO: 17698 - protein, 572 aa, Staphylococcus aureus subsp. aureus N315
MSKLIKGIAASDGVAIAKAYLLVEPDLTFDKNEKVTDVEGEVAKFNSAIEASKVELTKIRNNAEVQLGADKAAIFDAHLLVLDDPELIQPIQDKIKNENANAATALTDVTTQFVTIFESMDNEYMKERAADIRDVSKRVLSHILGVELPNPSMIDESVVIVGNDLTPSDTAQLNKEFVQGFATNIGGRTSHSAIMSRSLEIPAIVGTKSITQEVKQGDMIIVDGLNGDVIVNPTEDELIAYQDKRECYFADKKELQKLRDADTVTVDGVHAELAANIGTPNDLPGVIENGAQGIGLYRTEFLYMGRDQMPTEEEQFEAYKEVLEAMDGKRVVVRTLDIGGDKELSYLNLPEEMNPFLGYRAIRLCLAQQDIFRPQLRALLRASVYGKLNIMFPMVATINEFREAKAILLEEKENLKNEGHDISDDIELGIMVEIPATAALADVFAKEVDFFSIGTNDLIQYTLAADRMSERVSYLYQPYNPSILRLVKQVIEASHKEGKWTGMCGEMAGDETAIPLLLGLGLDEFSMSATSILKARRQINGLSKNEMTELANRAVDCATQEEVIELVNNYVK

SEQ ID NO: 17699 - protein, 519 aa, Arabidopsis thaliana
  misc_feature (28)..(28): Xaa can be any naturally occurring amino acid
MGLVIFLALIVLILIIGLRIFKAFMILXWHPFVLTRRLKNQGISGPNYRIFYGNLSEIKKMKRESHLSILDPSSNDIFPRILPHYQKWMSQYGETFLYWNGTEPRICISDPELAKTMLSNKLGFFVKSKARPEAVKLVGSKGLVFIEGADWVRHRRILNPAFSIDRLKIMTTVMVDCTLKMLEEWRKESTKEETEHPKIKKEMNEEFQRLTADIIATSAFGSSYVEGIEVFRSQMELKRCYTTSLNQVSIPGTQYLPTPSNIRVWKLERKMDNSIKRIISSRLQSKSDYGDDLLGILLKAYNTEGKERKMSIEEIIHECRTFFFGGHETTSNLLAWTTMLLSLHQDWQEKLREEIFKECGKEKTPDSETFSKLKLMNMVIMESLRLYGPVSALAREASVNIKLGDLEIPKGTTVVIPLLKMHSDKTLWGSDADKFNPMRFANGVSRAANHPNALLAFSVGPRACIGQNFVMIEAKTVLTMILQRFRFISLCDEYKHTPVDNVTIQPQYGLPVMLQPLED

SEQ ID NO: 17700 - protein, 507 aa, Bordetella bronchiseptica RB50
MPGRGCVPRFFSSDSIDMTISPLQLLNDPSLLRTDALVDGRWIAASRRFAVHDPATGRKLADVANLDAAHAREAIAAAQAAWPAWRARTVKERSAILRKWFDLLLANQDDLARLLTAEQGKPFGEARGEIAYAASFVEWFAEEAKRINGETLPAFDNNRRLLVLRESIGVCAAITPWNFPLAMITRKVAPALAAGCPVIVKPAEHTPLTALAAAQLAVRAGVPAGVLGVLPADGANSIAIGKELCANDAVRHLSFTGSTEVGRILMAQSAATVKKLSLELGGNAPFIVFDDADLDSAVEGAMQSKYRNAGQTCVCANRIYVQDGVYDAFVEKLADAVRALKVGPGFDEGVTQGPLIEPEAVDKIERHIEDAVSKGGRVVAGGRRLGGLFFEPTVLVDATSQMLCAREETFGPLAPVFRFHADEDAIAAANATEFGLASYLYSRDVGRIFRAAEALESGMVGVNVGILATEHVPFGGVKQSGLGREGGRHGIDDYVEIKYMCVGDILK

SEQ ID NO: 17701 - protein, 340 aa, Rhodopseudomonas palustris CGA009
MRALTLVADRNLVVADLPSPPPPAAGEVQVRIAAVALNHIDVWGYRGMAFVKRKLPIVVGAEASGTIEAVGDGVTAFKPGQKVVMYGALTCGHCKACQEGRDNLCENVGGLIGFHVDGFARELMNIAARLVIPVPDAVDLRDAACAPIAFSTVQHMLFDNAKLQPGETVLVHAGGSGIGTVAIMMAKAIGCTVITTVGDDSKIEGVKKLGADHVINYRQDRFEHECRKITKKKGVDVVFEHVGADTFNGSLLSLKRGGRLVTCGSTSGPTTTLNLMQLFQQQYKIFGSFGATMKNIAESLDKMAAGMLPVIDTEVPLDDVGAALKRMESRQVFGKIIVRF

SEQ ID NO: 17702 - protein, 507 aa, Burkholderia pseudomallei K96243
MRVACFVDFMQPHPGNIRTHIGVPTDVGTAKENVMDLEEGIRRLYPYAEEFGVMRGFPEQGTPRDELLAQLRSMAEREDRNWESGHSSGAMYSGDRDHHAWLNEAYSVFSHVNALRRDMCPSMNRMESEIVGMTVAMLHGDAVAAHHPGQRACGMITLGGTESILGATLAYREKARAERGIERPRMIWPASAHPVFRKAAHLFGFDVTVAPIDPVTMQVDADFVRDAVDANTVMLVGSACNYPYGTIDPIGALSAIAVEKDVWLHVDGCLGGWMLPWGEALGYPDIPAFDFRLPGVTSISADTHKFGYGPKGGSVLAWRDASFRRHQYFLMTDWVGGVYGSPGLTGSRSGGLIAATWAALRGLGREGYLARAKAIFETAFDMQAAVRAIPELRVLGKPTFCFAFTSDAFDIYHVNDFMRQRGWRLNGLRRPDALQMCVTGPQTQPGVAEQFRCDLGAAADYARAHAQERPKTSGVYASDAAGVDLSDDARTRAFFTQVIDLFTDCPL

SEQ ID NO: 17703 - protein, 369 aa, Photobacterium damselae subsp. piscicida
MKSRAAVAFGPGLPLEIVEIDVAPPKKGEVLVKISHTGVCHTDAYTLSGDDPEGLFPVVLGHEGAGVVVEVGEGVTSVKPGDHVIPLYTAECGECDFCTSGKTNLCVAVRETQGKGVMPDGTSRFSYNGQPLYHYMGCSTFSEYTVVAEVSLAKINPQANAEQVCLLGCGVTTGIGAVHNTAKVQEGDSVAVFGLGGIGLAVVQGARQAKAGRIFAIDTNPSKFELAKQFGATDCINPNDYDKPVQQVLVEMTKWGVDHTFECIGNVNVMRSALESAHRGWGQSVIIGVAGAGKEISTRPFQLVTGRVWKGTAFGGVKGRTQLPGMVEDAMSGKIELAPFVTHTMELDKINEAFDLMHDGKSIRTVIHY

SEQ ID NO: 17704 - protein, 538 aa, Burkholderia pseudomallei K96243
MPTFDSRLDTASAAFRDNAEHMRALIAQWHALNARAADESAKAGPRFDKRGQLLPRERLALLVDAGAPFLELASLAGYLVGESDPDQSVPGAGLIGGIGYVSGTRCMIVVADSGIDAGALQPMGLEKFQRLQRIALEHRLPFVHLVESAGANLMQYRVEEFIHGGRHFFQLAKLSAAGIPVFTLVHGSSTAGGAYMPGLSDYVVMVRDRAKAFLAGPPLLKAATGEIATDEELGGAAMHASVSGLAEYVADDDADGIRILRELVDKLGWRDREAALPTGAEPALDPEGLLGILPRDGKKPVDMREVIARLVDASDLLEFQPAYGPATVCVHARIHGMPVGIVTNNGPLDPAGATKATHFIQACCQSDVPLVYLQNTTGFIVGKASERAGMIKHGAKMIQAVSNATVPQITILCGASFGAGNYGMCGRGFDPAFVFSWPNARTAVMGAEQAALTMAIVMEGAARAKGIEPERARIDALREKIVANFERQTHAFYTSGRMLDDGVIDPRDTRRVLAITLAVCRDGRRKSLQPLTFGVARP

SEQ ID NO: 17705 - protein, 584 aa, Zea mays
MDAQDGDERPLIIHRLPLLQDESTSEFTSDGTVDLRNQPARKQRTGKWKACFFILGAEFAECVAFFAISKNLVTYLTGVLHESNVDAATTVSTWIGTSFFTPLVGAFLADTFWGRYWTILAFLSVYVTGMTVLTASALLPLLMGASYSRSAHRLFAYLGLYLAALGTGGIKPCVCALGADQFDASDPVERRAKGSFFNWYYFSINIGSLLSATVVVWVQDNVGWGVGFAIPTLLMLSGLVLFVAGRKVYRYQRVGGSPLTRASQVVVAAVRNYRLVLPEPDDSSAALLHQAPPGTTEGNDSTMQHTSQFRFLDKAAIVAPSSGEKGATASPWRLCTVSQVEELKTVLRMFPVWVSMVLFFAATAQMSSTFIEQGETMDNRVGPFTVPPASLSTFDVISVMVCIPIYDKALVPLARRATGKERGLSQLQRLGVGLALSVAGMVYAALLEARRLSLARAAADGRPPMSIMWQAPAFAVLGAGEVFATIGILEFFYDQSPDGMKSLGTALAQLAVAAGNYFNSAVLAAVAAVTTRNGEAGWIPDDLDKGHLDYFFWFMAVLGVVNLLHFLHCSVRYRGSSNNSTYSS

SEQ ID NO: 17706 - protein, 183 aa, Fragaria x ananassa
SREMLIDFVPTTNGLSLADAPAFKKAAGGAPANVAVGIARLGGSSAFIGKVGEDEFGYMLADILKENNVNNEGMRFDPGARTALAFVTLRSDREREFMFYRNPSADMLLQEAELDLDLIRKAKILHYGSISLITEPCKSTHIAAAKAAKELVLFWSYDPNLRLPLWPSAKSARKRNFEYVGNC

SEQ ID NO: 17707 - protein, 557 aa, Acetobacter pasteurianus
MTYTVGMYLAERLVQIGLKHHFAVGGDYNLVLLDQLLLNKDMKQIYCCNELNCGFSAEGYARSNGAAAAVVTFSVGAISAMNALGGAYAENLPVILISGAPNSNDQGTGHILHHTIGKTDYSYQLEMARQVTCAAESITDAHSAPAKIDHVIRTALRERKPAYLDIACNIASEPCVRPGPVSSLLSEPEIDHTSLKAAVDATVALLKNRPAPVMLLGSKLRAANALAATETLADKLQCAVTIMAAAKGFFPEDHAGFRGLYWGEVSNPGVQELVETSDALLCIAPVFNDYSTVGWSGMPKGPNVILAEPDRVTVDGRAYDGFTLRAFLQALAEKAPARPASAQKSSVPTCSLTATSDEAGLTNDEIVRHINALLTSNTTLVAETGDSWFNAMRMTLAGARVELEMQWGHIGWSVPSAFGNAMGSQDRQHVVMVGDGSFQLTAQEVAQMVRYELPVIIFLINNRGYVIEIAIHDGPYNYIKNWDYAGLMEVFNAGEGHGLGLKATTPKELTEAIARAKANTRGPTLIECQIDRTDCTDMLVQWGRKVASTNARKTTLA

SEQ ID NO: 17708 - protein, 371 aa, Acetobacter pasteurianus
MDVRAAVAFEAGRPLEIERVQLEGPRAGEVLVEVKATGLCHTDKYTLSGADPEGLFPAILGHEGAGVVVEVGAGVQHLRPGDHVIPLYTPECRECKSCLSRKTNLCTAIRATQGKGLMPDGTSRFSFKGQPIHHYMGCSTFANYTVLPEIALAKIRPDAPFDKVCYIGCGVTTGIGAVLFTAKVEPGSTVVVFGLGGIGLNVIQGAKMVGADRIIGVDINPAREAMARQFGMTDFVNPRDLGPNGDVVGHLVELTGGGADYTFECVGNPTLMRQALECAHRGWGVSTIIGVAAAGQEISTRPFQLVTGRRWIGSAFGGARGRTDVPKIVDWYMENRINIDDLITHKLPLERINEGFDMMERGESIRTVVEF

SEQ ID NO: 17709 - protein, 679 aa, Dehalococcoides sp. BAV1
MSIWIALVVGLVGLAVAGLLAKFVLKQDEGTPKVREIAAAIKEGAMAFITREYTVMAIFVAAVTIILAFLPSLGWPVSVSFLFGALCSGLAGFIGMSIAVRANSRTTTAASHSLNQGLKLSFRAGSVMGMCVVGIGIIGLSIMYFAFGSDVDFIKILPGYGFGASSVAIFARVGGGIFTKAADTGADIVGKVEKGIPEDDPRNAAVVADFVGDNVGDVAGMGADLFESYVDSIIATMALATIGAFSMKLGYALVPSQEAAFFLPMLVAAGGILASVIGIFLVRTGEKLQMKALLAALRKGTLAAAFLSAVFSFLAVWYLQADFGLFFAILAGLVAGVLIGESTNYFTSYVYKPTLGIAASCQTGAATNIISGFSVGLMSVVPPIVLVVIAIVISYAFGDVYGVALAGVGMLATLGIQDATDAYGPVADNAGGIAEMSGLPKEVRERTDALDSLGNTTAAIGKGFAIGSAGLTSLALLLSYTQAVGISASQVSLLDVKVLAGLLLGVMMPAVFCSLTLKAVGVTSFSIVNEVRRQFKEIAGIMEGTAKPEYGKCVDICTRDSIKQMILPGVITVVSPVIVGWLLGPVAVVGFLTGTILCGFILAVTFANAGGAWDNAKKWVETGAYGGKGSDAHKAAVVGDTVGDPMKDTAGPSLNIMIKLVAIIALVMAPILANFSGII

SEQ ID NO: 17710 - protein, 527 aa, Agrobacterium tumefaciens str. C58
MDGTHLFELVIAMFLAIIVLHYIAHRLGLPPSVALLAGGGTLAFVPGLPTISVNPELVLVIFLPPLLLDGAWSISVDRLKRHVFGIASLAIGAVLFTTVIVAVVVHFLMPSLPWAACAALGAIVSPPDAVSARAVLERIRIPRRLQILLEGESLLNDASGLVLFRFAVAAAAGGVFSTVDALGEFFFLAVGGAAVGAFVGLLWVKTVRHLGDEYLMIAATAVLSWAAYILAEQAQTSGVIATVTAGLIASWHQHTVLSAATRMRGTSFWNVLVFLMEAMVFILIGLSLRDVVERGGGFGSIASSMALPALAVLVTLVAARFVWIFASDLVIRLFHGLKLAHSKPLGPGAVTALGWAGMRGVVTLALALSLPEDFPGRDFILVMAFAVIMGTVLIQGTTLGRIIAWAGLGGIEPERAPMTMSEAEASMAQVQFTTVQGLAYDENGELIHPQLLKRYEHRLAASVKYAESTEKYSPLLHAHFDVVLKAVAAGRKELIRLRREGQIDDETLRELEHDLDLEELTAISAKA

SEQ ID NO: 17711 - protein, 179 aa, Alkaliphilus metalliredigens QYMF
MAERMVGLKAPYFEMKTVDGEGMEFGKVSLDDYKGQWLVLFFYPLDFTFVCPTEITGINERLVDFGRLNASVLGASTDSEHSHKAWINAAQDQGGLGKLSFPLASDMTQKVARDYGILIEEEGIALRGLFIIDPEGILRYSVVHDLNVGRSVEETLRVLQGLQSGGLCPFNWSPGEDML

SEQ ID NO: 17712 - protein, 487 aa, Allium cepa
MATKNQVAGPQQQKKVEFLPRGERKNAAPVPDGKNRRALGDIGNVLEAKPHNKITRPITRSFGAQLLANAQAAAVPNKKPGNVNGEREVRKACTKEDRGKAVVNTKPAVCIKEDKGKEAANPKPTVCIKEDKGKEVVNPKPAVCIKEDKGKVVVNPKPTAVIEISPDTVEKVRERSGSKKSRKKKVKTMSQVLSARSKAACEITKKPKDTIPDIDASDAGDQLAVVDYVEDLYKFYKHAENAFMPCHYMDIQVEINEKMRAILGDWLIEVHCKFELMPETLYLTFYIIDKYLSMEKVIRRELQLVGISSMLIASKYEEIWAPQVEDFITISDRAYNQEQILGMEKLILNKLEWTLTVPTPYVFLVRFIKAAMSDKQLEHMVYFFAELGLLQYKMVMNCPSMLAASAVYAARCTLSRSPLWTETLRRHTGFSEPELKECAKMLVSSHIAAPEGKLNAIYKKYSRSEHGAVALHPPAMKVVEESKETKA

SEQ ID NO: 17713 - protein, 535 aa, Magnaporthe grisea 70-15
MGLVEVVLEHVSVKAAVLWIVGSWVLYLVVKNVLEERKINKLGARAARMPSRLPLSLDNIIRAVRANIQNRNLQMWRSHMSHSITYTVEGRLLFQRIILTADPENIKAILATQFTDYGKGEPFHQEWKPFLGDSIFATDGEKWHTSRQMLRPQFVKDRVSDLECFESHIKTLFKAMANGGALEGEHQHVELSAINGKRFEITDLFFRFSLDVATDFLLGYDVKSLSTPHAEFAEAFNEVQHVQSTITRSGPAQALVPKGSYYRGLKVMDNFINPFIDRALRLSPDELASKTKSDHGYTFLHELASFTRDRKVLRDQIVAVLLAGRDTTAATLSWTIYELGRHPECVKRLRQEIAEVVGFGRTPTYADLKSMKYLQNVMHETLRLYPAVPFNVRLALHDTTLPRGGGPDGTLPVPVLKDTPIGYSTLLMQRRRDLYPPVSENFADPDVFSPERWFHWQPRPWQYVPFNGGPRICIGQQFALTEMGYVLVRMFQQYERVVSYMDEIDGGNPTIKADIVMQPGDGVIVAFWEGDNEKI

SEQ ID NO: 17714 - protein, 390 aa, Methylobacillus flagellatus KT
MRALTYHGSKDVRIETVPDPVLQADDDIIIRVTSTAICGSDLHLYRGKIPQLHDGDILGHEFMGIVEDTGHGVTEVRKGDRVIIPFVIACGHCFFCAQQQFAACETTNPGPGPSLNKKSGTPPAALFGYSHLYGGIPGGQAELVRVPHGNVGPFKINGSLADEQVLFLTDILPTGYQAVLNAGVGKGSSLAIFGAGPVGLMAAACARMMGVETIFMIDDLQYRLDFAQAQYNTISINLDEVEDPADYILEHTAHRGVDGSIDAVGFEAKGSVVESALTALKLETSNGKVIRQCIAATRRGGTVSIPGVYAGFIHGFLIGDAFDKGLTFKMGQTHVHRFLPELLEFIENGDLHPADIITHRMALEDAPLGYRIFNDAEENCRKVVLTPGLH

SEQ ID NO: 17715 - protein, 609 aa, Oryza sativa Japonica Group
MMIQQHRLHTQSDLARDILLNFDTLLPKFIKVYPRDYKRVLDKLKEEKAAKEAEQKAREVVDKKPVEVIQAPNGISVKTEKVMNEEPSSRPSRVSNAVKYRGFIKYEREGTSYRDPNERVKDWNEVAIELVPGPLLKTQSARCMDCGTPFCHQEGSGAGCPLGNKIPEFNELVHQNRWHEALDRLLETNNFPEFTGRVCPAPCEGSCVLGIIDNPVSIKSIECAIIDKGFEEGWMVPRPPLRRTGKRVAIVGSGPAGLAAADQLNKMGHFVTVFERADRIGGLMMYGVPNMKADKEGIVQRRVELMAKEGVQFIVNAHVGSDPLYSVEKLRSENDAIILACGATKPKDLPIPGRELAGIHFAMEFLHANTKSLLDSNLEDGNYISAQGRKVVVIGGGDTGTDCIGTSIRHGCTNLVNLELLPEPPRKRAPDNPWPQWPRIFRVDYGHQEATSKFGKDPRSYKVLTKRFIGDENGNVKALEVIRVEWGKVNGRFQFKEVEGSEEIIEADLVLLAMGFLGPEATVANKLGLEQDMRSNFKAQFGNFATNVEGVFAAGDCRRGQSLVVWAITEGRQAAAAVDNYLSKDDEGETNGTEDIAVSSEGLVQPVVA

SEQ ID NO: 17716 - protein, 1279 aa, Aspergillus nidulans FGSC A4
MVYRSTFPHLEIPKSNILSYLYPPNQTVSDQPIWIDASNPNNSLSPRQMLTWVRRLGYGLDRLGIRKGEVVIILTPNHIFVPVAYQGIVGSGRVFSGANPTYTQLEIEHQLKDTGSKLILVHPSLVKTAVDAASRVGILKERIFQFADHPCETLDGVQDWRDFIGSEDEAREWRWDDMADTSTTTVATINYSSGTTGLPKGVCVSHRNLIANVEQTIFMRDQGFPHALVPASRPPERWVGFLPLYHAYGQLYACLMAPKLGFPVYIMRKFVYEEFLATIERYGITHLQVAPPILIMLDKRSETARYNLSSVRNILCGAAPLSRELQNTIQNRFKTNVVQGWGMTEVTCGAIHVPGGLYDESGSVGMLDPNCECKLLDEEGRPVRPGEPGELHVRGPNVCLGYWRNDKATKESLDSDGWLKTGDIMVAKDDCFWVVDRKKELIKVNALQVSPAELEAVLLGHDGIADAGVVGFIANGQECPRAYVQIKEEASGLTEADIQSYMKDRVAKHKQITGGIQLVDEVPRLASGKLHRRVLKEWAQRDAAGYYGRNASYEIRPWLPSHLSGDGYLEALVQPNVNPVFGEIKKANQEGTDPWFEDYEIKYCYRNQFAFLGNGTVKAEVKQGTLGLATVDYSNTLASAPLLYVLCLSALRPSSRLCSMGFVCNERSFIPPRPFKNIGFVAIVADAAVGAMVYYAFTVLWPQLIESIYTTDSIQIGLQSSVVGGGVLLGQILGGMALGFVPGVKYQCIIDYCFLPCHGFYYPTECFGLGYLVNGYSVGHLGLHDIGLAAGVLGSLRALGGAVAQAVYVSVLNNEVAKNIPKYVGAAATAAGLPESSLSSLLEAVSSGSSLQGIDGVTESVVTALLTAHKVAYSESFRIVFLCTIPFSVLLVISSCFVPTIANNLQLEISSREAVGKRRSRLAAFPICKETMKAAQWDPKLQKVVVNRVPIRTPGPNQILVKLASASLCHSDILAINQPNMAEPFTLGHEGAGYVAELGTKCTDKGFREGDPVGFLHINGCCFECEGCMVHNNNCTQGTPVVSGFGGIRDFGFFQEYAAVDWQNIIHLPYQLDSKRSSAIFCAGITAFHAVDSCNLTAGQWFAAIGAGGLGQLAVQYANAMGYRVIATDINDGALETCKRQGADVIINSLSRPDYANEVKKLTPGGVHPTAVFSGAPAAYRGAPLLELSTFDLAIGTYVVKSESTSIPQRMAKAVDFTAKHGITPEIKVRSGLEDVDEMQASYIHALDYLFTTPFTARELHLLRPVHPDHDIILETSMR

SEQ ID NO: 17717 - protein, 406 aa, Exiguobacterium sibiricum 255-15
MVSQPIVPVERLKKRHYIGPAFVAAVAYLDPGNFAMNMTAGAQYGFLLLWVIVAANLMAVMIQTLSAKLGLVSNTSLAEVIRDELSPVMRILYWAQAELVAMATDLAEFVGAALGFNLLFGIDLKIAALLTAVASFVILGFERKGLRHFEAVIGALVLVIALAFAIQVIEVKPVLRDVAGGLIPGFSGTSSIVLAAGMLGATVMPHAIYLHSDLTKRRMGTIADKKGLLRIQKMDIWAAMLIAGAVNGAMLVIAATVFFGTSQQAETLESIFHGLGTSLGGAAPYLFGGALLISGLASSSVGTMSGDAIMRGFLKMEIPIFLRRSVTMLPAILLLLSGFDPTRALIWSQVALSFGIPFALIPLIRATSSERIMGKYKNQPLTKGISWTIVSIVIVFNVYLLGDLLF

SEQ ID NO: 17718 - protein, 226 aa, Cryptococcus neoformans var. neoformans JEC21
MSAYDPLSGHPGHLSEAQETALKEFRQELTTEELIPADWEALVQRIGYNRFDDQTLLRFLRARKFDLPKAKLMWANNEKWRKQFGADEIAANGFDYPEQSQVVKYYPQFYHKTDNDGRPVYIEQLGKLDINKLYAITTQDRQLKRLVSEYEKFLRDRLPASSKMTGHLVETSCTILDLYNAGISTFYKVKDYVRAASAVGQNNSRSDGTHVYHQCTISLLNRLVSH

SEQ ID NO: 17719 - protein, 234 aa, Bradyrhizobium japonicum
IRRGATGRSRCCDVAGGTGDISFRAAKAAGPGFHATVCDINSDMLAVGRERAAKRHLETQVDFVEGNAEALAFADRSFDAYTIAFGIRNVPQIDLALREAYRVLRPGSRFLCLEFSTVEMPGLDKLYDLFSFKVIPPLGRMITGDGESYQYLVESIRKFPKPNAFADMIRDAGFCRVNWQTLSGGIVALHSGWRLSFLQLPTPRASCALRSCSRAKACSAPSIRAWCRRPGSSR

SEQ ID NO: 17720 - protein, 292 aa, Geobacter sulfurreducens PCA
MQHLIDKANTLMEALPYIRRFSGKTIVIKYGGHAMADEALKESFALDVIMLKSLGINPVVVHGGGPQINETLKRYGIVSEFVKGMRVTDAATMQVVEMVLTGQVNKEVVGYLNQHGGRAVGLSGKDGNLLLCRKLLQEVRQDDGTVESVDIGFVGDVVKVNQELIQTLEHGKFIPVIAPVGVGEQGESYNVNADLVAGRVAGALRAEKLILLTDVAGVKDKAGALLSSIRLDTVPGLIDDGVITGGMIPKVTCCVDAIEEGVRKASIIDGRVLHAVLLEIFTDVGVGTEIHR

SEQ ID NO: 17721 - protein, 613 aa, Pseudomonas aeruginosa UCBPP-PA14
MEHGSSFLQSGVVFLIAAVFMVPLAKRLQLGAVLGYLLAGVLIGPSVLGLVDNPESVAQISEMGVVLLLFIIGLELSPRRLWVMRKSVFGVGLLQVLLTGVVIGTVALVGFDQPVNSAVVLGLGLALSSTAFGLQILAERKELTQPHGRLAFAILLFQDIAAIPLIAMIPLLSGAHSDAGGSELTQTLKVVGSIAAVVVGGRYLLRPVFRIVAQTKLQDMSTATALLVVMGTALLMELAGVSMALGAFLAGLLLADSEYRHELEAQIEPFKGLLLGLFFISVGMSADISLLLKSPWMVLGLTVLLIALKAPVLYFVGRISGGLDKASALRLGVVLAAGGEFAFVVFKMARDQGLFQNDLHNLLVLSITLSMALTPLLVLGLARLLAKEPEATKPPPEMERIDNDDTPRVVIAGVGRMGQIVARVLRAQRVPFIALDTSVETIELTRTLGAIPIFYGDPMRPEILRAAQVEKAEFFVIATDDPETNIETAKRVRKLYPHLKIIARARNRQHVHLLLDAGVEPVRETFFSSLEMSRMVLCGLGLSEEQADARIRRFRRHDEEVLASQHLFYNDRDALIKSAREARVELETLFQTDQLEDRGAVAAETPEKPSRAS

SEQ ID NO: 17722 - protein, 399 aa, Geobacter sulfurreducens PCA
MNTTQWIAKADKYIMKTYGRYPLVPVRGEGCRVWDADGKEYLDFLAGVAVNNLGHCHPKVVEALRTQAAEIIHCSNYYHIPNQIELAELLCAHSFADKVFFCNSGAEANEAAIKLARKHAREKTGDAERYGIITALASFHGRTMATISATGQEKVQKFFDPLLHGFTYVPFDDAAALEAAVTPTTCAVMLEPIQGEGGVVVPSADYFRKVREICDRHGLLLIFDEVQVGIGRTGKLFAHEHFDVTPDIMTLAKALAGGAPIGAMLARDEIAASFSPGTHGSTFGGNPLVTAAGLAAVRAVLEEGLLNRAEEMGEYLVGELERLKGKYDIITDVRGIGLMVGMELSVPAGDIVLKGLERGVLLNVAQDRVLRFVPPLVVTKQEVNDMIAVLDGILEEMTK

SEQ ID NO: 17723 - protein, 303 aa, Geobacter sulfurreducens PCA
MIRHFLALNQFTKEELDGLFTLSRELKDKQKQGVPHRLLEGKSVALIFEKSSTRTRVSFEVGVAQLGAHPLFISSATSQMGRGEPIKDTARVMARYCDGVMIRTYGQEIVEEFARYSSVPVINGLTDLFHPCQIMADLFTVIEYKGGYQGLKFAWVGDGNNMANTWIEAAAILGFDLALACPTGYEPDRQVWDWAQQRATSSITITEDPEEAVRDADVVNTDVWASMGQEQEQKEREAAFQGYCLDDALVALARPDCMVLHCLPAHRGEEITDSVIEGPRSAVWDEAENRLHIQKAIMASLMK

SEQ ID NO: 17724 - protein, 182 aa, Clostridium thermocellum ATCC 27405
MVLIDYSKLSKEVAYALRHAPWEYGLELDAEGWVDINQLLSSLHECEKWKKVSEHDLHVMIEKSDKKRYEISNGKIRALYGHSIPQRIIKEQKCPPEVLYHGTARRFVKSIKEKGLQPQGRQYVHLSADVETALQVGKRRDIKPVLLIVNALEAWSEGIKFYLGNDKVWLADAIPSKYIRFE

SEQ ID NO: 17725 - protein, 289 aa, Zea mays
  misc_feature (140)..(140): Xaa can be any naturally occurring amino acid
  misc_feature (194)..(194): Xaa can be any naturally occurring amino acid
MHALVRPWDTLPVLLLSRLCMVLLDALRAGWLGSVDEDEEDFSYRRNAGNGPARWGLIRREWATCNVGLLQSPIGLSDTLAGLADRSGRLGRSYRPAAASLVNRGHSIMVRFNSNPGGVVIDGVAYRLRQMHWHAPSEHXINGRRYALELQMVHQSDTNRYAVVSQLYRISRRRPDRTIHRLERYIRRIREEEXPEELIDEEGDPRRPVSRSTAYYKYTGSFTTPPCTEGVTWVVAPQTRRGARRQVRLLRNAVPDGPRSNRRPLQEANGRAIPFFFTSPAPGRGANGD

SEQ ID NO: 17726 - protein, 291 aa, Oryza sativa Indica Group
MSCHFLQVNRQEDYRSTDTEAGAAARREGYNKRRPETTTEKSGRRGTAGAELQSRPRIHLLRRQQVGRSTHSLNPREAVALAAETSCENVDLPDFVNIATGTPFTVNEVEALYDLFRKLSNSIIKDGLIHKEEFHLALFRNKKTNLFVDRVFDLFDQKGNGVIEFDEFVRSLSVFHPDAPEEQKAGFAFKLYDLRQTGFIERHELKEMVLALLDESDLNITSDAVEMIVDRTFDQADTKGDERIDQEEWNEFVKNNPYVLRNMTLPYLKDLTMVFPSFVIHSEVSEADMVA

SEQ ID NO: 17727 - protein, 251 aa, Cytophaga hutchinsonii ATCC 33406
MRKKVIAGNWKMNKTLEEGLSLASEVANMAKDEVPADVNLVMCIPYISLAAVSKVINDKVAIGAQNVYQKESGAFTGEISAPMLKSVGVKYVIIGHSERREYFGETNQQLADKVTISLANGLTPLFCCGETLAQREAGIHINFVNAQLTESLFHLSPEDFKKVVIAYEPIWAIGTGVTASDEQAQEMHAKIREHLASKYGAAVADEISILYGGSMKPDNAKGLLACKDIDGGLIGGASLKSRDFIDIAKSY

SEQ ID NO: 17728 - protein, 144 aa, Zea mays
MNVRKHNPPKPLYTKPLAHTNVYNVARVFWLCSYWMMHPGVIWGLFGFWCPLVRLFGPSAAVPFGHDLTVPEALANTREDGMGALYREGTASLLNSMVNNRFPFTTQEVKDAFGAALNSGDDGAAAAQARLFKKANEGHVIRQN

SEQ ID NO: 17729 - protein, 327 aa, Arabidopsis thaliana
METQIHQLEQEAYTAVLRAFKAQSDAISWEKESLITELRKELRVSDDEHRELLSRVNKDDTIQRIRDWRQGGASQITRHATIQPFDVLPSPTFSAARKKQKTFPSYNPSIGATGNRSFNNRLVSSGISGNESAEALIGRKVWTKWPEDNHFYEAIITQYNADEGRHALVYDIHAANETWEWVDLKEIPPEDIRWDGEESGVALNIGHGSASFRGNRRGQIHGGRGRGPRIHQPRRELVPPPTQQNGSGGRRTSSDDIELFNTDSLVKEVERVFDSTHPDPLELDKAKKMLKEHEQALIAAIARLADTSDGEMDGDPPYSHDHPMPQG

SEQ ID NO: 17730 - protein, 363 aa, Colwellia psychrerythraea 34H
MGFKCGIVGLPNVGKSTLFNALTKAGIDAANFPFCTIEPNTGVVPVPDPRLDKLTAIVKPERVLATTMEFVDIAGLVAGASKGEGLGNKFLANIRETDAIGHVVRCFDNDNIIHVANKVSPVDDIDVINTELALSDMDTAERAIFRLAKKAKGGDKDAKFEMPVLEKILKHVEEGHMVRSLELSKEEKAAVDYLNFLTLKPTMYIANVNDDGFENNPYLDEVQKIADAEGAIVVAVCAEIESELSEMDDEDRVEFMADLGLEEPGLNRVINAGYSLLHLQTYFTAGVKEVRAWTVKQNATAPQAAGVIHTDFEKGFIRAEIISYDDFIEFNGESGAKEAGKWRLEGKEYRVKDGDVIHFRFNV

SEQ ID NO: 17731 - protein, 459 aa, Rubrobacter xylanophilus DSM 9941
MREFDVAVVGSGYVGLVTGACLAYIGHRVTCVDKNERRVADLQRGKMPIYEPGLEEMVARGRSAGQLRFTADLPGCAREAEVVFIAVDTPPGEDGSADLSNVAAVARSIGRALSEAGERERPLIVVNKSTVPVGSGDYVSMLVREGAEEAGNGSVDFRVVSNPEFLREGSAVYDSLFPDRIVLGAESREALDTMRELYEPIIEQSFPAEMDPRPKAAVPFVTTDLASAEMIKYAANAFLATKISFINEIANICELVGADVSSVAYGIGLDGRIGPRFLSAGIGWGGSCFPKDVSALRSIAREYDYEPLLLDAAVCVNERQRKQVISKLQRELHTLKGKRVALLGLTFKPNTDDLREAPSLEIARTLSSLGARVVGYDPVAAKEAARLQPELKAAFDPYEALRGAHAAVVVTEWEEVRSLDPARAASLMEEPRVLVDGRNALDPERCRRGGLLYRGFGRA

SEQ ID NO: 17732 - protein, 491 aa, Listeria innocua Clip11262
MTDELEQKALITIFGGTGDLANRKLYPSLYHLYSKGSLGDNFAVIGTARREWSNDFFRDKVKESIKDIDGSEKDADAFASHFYYQSHDVTNKESYVTLKDLSDELDAKYELGGNRLFYLAMAPNFFGTIASRIKSEGFVDTDGFHRLIIEKPFGHDLASAEELNNSLRQAFKEDEIYRIDHYLGKEMIQNISVIRFANSIIESLWNNRYIDNIQVTLTEVLGVEDRGRYYDESGALRDMVQNHILQIVSLLAMEPPINLTTREIRHEKVRALRSLRVFEGKEVHQNFIRGQYGPGEVGGKELKGYRQEDNVDPHSNTETFVAAKLEIDNFRWAGVPFYIRTGKRLAKKTTQIAIQFKDVPLNLFGQQQSLGGNVLVIHIQPDEGITLHLNVKEPGQGMVTMPVNLNYIHSSPDGMNTPEAYEKLILDCLRGDATYFSHWDEVSLSWNFIDHVADVWTNTKDHFPNYKSGSMGPKEADDLIQRDGFQWFPID

SEQ ID NO: 17733 - protein, 262 aa, Rickettsia prowazekii str. Madrid E
MNDNLINALKDLIINTGKVALDIKKTGILIDTKSDGSVVTNADQEISKIIYQTLRSLTSQIAIVCEEQPLPILNSDTFWLIDPIDGTRSYVEGKNTYTVNIGLIENGFPTIGLIYHPETAKLYYTDVNGRLKIEQNSQEIFVNYSPKHKEPNAVVGFYNSNKATKEFLRSYSFGKINAISSSIKLCLIAEGKADIYPKFGQTMEWDIAAGHALIKASGGNILDCDGQEVTYGKANFANPHFFACSKYWLEMDSVFVSTKSLL

SEQ ID NO: 17734 - protein, 438 aa, Oryza sativa
LQPARTVLRTMASKRFLSLSLLILLLGFSSSLAAGQVLFQGFNWESWKENGGWYNMLMGKVDDIAAAGITHVWLPPPSQSVAEQGYMPGRLYDLDASKYGNEAQLKSLIEAFHGKGVQVIADIVINHRTAEHKDGRGIYCLFEGGTPDSRLDWGPHMICRGDPYGDGTGNPDTGADFGAAPDIDHLNKRVQRELIGWLDWLKMDIGFDAWRLDFAKGYSADVAKIYIDATEPSFAVAEIWTSLAYGGDGKPDYDQNAHRQELVNWVDRVGGANSNATTFDFTTKGILNVAVEGELWRLRGEDGKAPGMIGWWPAKATTFIDNHDTGSTQHMWPFPSDKVMQGYAYILTHPGNPCIFYDHFFDWGHKEEIERLVSIRNRQGIHPASELRIMEADSDLYLAEIDGKVITKVGPRYDVEHLIPEGFQVVAHGDGYAVWEKI

SEQ ID NO: 17735 - protein, 551 aa, Neptuniibacter caesariensis
MAPQDNFIEGIRREFPLLNQLVDDKPLIYFDNAATTQKPNTVIATVEDYYRSANANVHRASHALSAIATSRFEQARQTIADYLNAPSPKQIIWTRGTTEAINLVANSFGQSFQPGDQIIVSEQEHHANIVPWQLLAERSGAVIKVIPVQENGELDQAVFKQLLNERTKLVAITHVSNALGTINPVKQMISQAHDFGAKVLIDGAQALPHFQVDVQELDADFYVFSGHKIYAPTGIGVLYGKESLLESMPPWQAGGEMIEKVSFSGTTFNRLPFKFEAGTPNIAGALGLAEAVRWLIKQPFDLISQHEKALFDSALDACSSLKGFRRIGCPEKHVSLLSFTIEQFHQQDIGLLLDKQGIAIRTGHHCAMPLMHALGLNGTSRASFAFYNTLDEVGQFATALEQLISPISIPVKAAIHQDKTGLVQELLKQKGWNARYRQIMLYGKDHSGLDDSAKSESNLVPGCESQTWLTAQIDKDGKYQFQADSEARIIRGLIAVVLSIFNNKNSAEINRVDIDMIFNQLELQQHLSPSRGNGLRAVIERIYQIANQSEG

SEQ ID NO: 17736 - protein, 295 aa, Oryza sativa Japonica Group
MTEAAEWNDENTKIICELYAEQVRAGNRPSTHLNSIGYSQVALKFQQRTHLLYTKRQLKNKWDKLRNEYTIWKKLLIRGSGLGWDSTKGTIAADENWWNKTNTELPGAKKFRKAGMKNLDHLRVMFDDIASNGVDHTPVPATSSPSTLESPVNVANLDGLDNDMEDNDDTQLEEESPLNRNKKRPRHANNANKNKSSRTEIALLMQAQLKGMADLAEKAQATFENFTSLVGSLGSSIQYVMTLVQECGARSGSDEHFIATELFVSREQREMFLTLSTAEERLEWLRRKYKAKYGA

SEQ ID NO: 17737 - protein, 405 aa, Allium cepa
MAGADENHGAVKLANFRETTNRRALKDIKNFVGAPSFPCAANKRQLKEVVCGNNDSVIPRRPITRQFASTLASKSQQSHGETSNKHGQITGNEKHNPIIIDEDVPMVEESEEMEECELVEEITMEDIVIDSAQDIDIGDVGNPLAVVDYVDDIYNYYRRVEASSCVHPDYMSNQFDINDKMRAILIDWLVEVHYKFELMEETLYLTVNIIDRFLSRQAVVRKKLQLVGVTAMLLACKYEEVSVPVVDDLVTISDRAYTRKEVLDMEKSIVKTLQFNTSVPTPFVFLRRFLKAAGSEKKLELLSSFIIELSLVEYQMLKFQPSLLAAAAIYTAQCSLKGFKFWTRTCEQYTMYTEDQLLECSKMMVGFHRNAGSGKLTGVHRKYSTSKFGFAGKSYPALFLLDNRL

SEQ ID NO: 17738 - protein, 575 aa, Exiguobacterium sibiricum 255-15
MSKYPSKMKRLSFHKLSNEQRMKRAETVFFIFLSRIIVSGDMLLYNGECKRLKASIKGGIEMIPYKHEPFTDFSQEANKKAFEEALELVSKELGKDYPLVIGGERVTTEDKIVSVNPANKEEIVGRVSKATQAHAEDAMQAAVKAFETWKFVNPSVRADVLFKAANIIRKRKHEFSAYLVKEAGKPWNEADADTAEAIDFLEYYARQMLVLKEGKKVESRPGEYNRYDYIPLGVGVIISPWNFPLAIMAGTAVAAIVAGNPILLKPASTTPVVAAKFVEVMEQAGLPAGVLNFIPGPGAEVGDYLVDHPKTRFISFTGSRDVGLRINERASKLNDGQIWLKRVIAEMGGKDTMVIDESADLDYAADMITKAAFGFSGQKCSACSRVVALDSVYDELLAKVVENTNKLSIGNPVDVTNNVGPVIDAAAFKKITSYFDVAKQEGRIAAGGTADDSTGYFVAPTIVADVQPTDRLMQEEIFGPVVAFTKAKDFKEAIDIANNTEYGLTGAVITQDRTNQEYARANFHVGNLYFNRGCTGAIVGYQPFGGFNMSGTDSKAGGPDYLTLHLQAKTTSEMF

SEQ ID NO: 17739 - protein, 163 aa, Listeria innocua Clip11262
MRRIITATVNNSSGVLNRITGVISRRQYNIDSISVGWTEIPNVSRITIVVHVDSLYEIEQVTKQLNKQIDVLKVSDITDDAHIERELALLKINSPAALRSELNAVIEPFRATVIDVGTKNVVIQVTGTSEKIDAFVDTVRPYGIKQMARTGVTGFTRSPKKMG

SEQ ID NO: 17740 - protein, 497 aa, Alkaliphilus metalliredigens QYMF
MSNDYTVIIVLKGEGGRKMNCKMYIDGQWVEGKEGEKLEVVNPATGDILVYIAKAGYAETERAIESADKAFKTWSKTTAGERANYLTKLYHLMIEHKDEIAKIMTLEQGKPLQEAMGEVVYGAGFVEWYAEEAKRVYGETIPASKENKRIMVLKQPVGVVAAITPWNFPAAMITRKMAPALAAGCTVVLKPASSTPLTAIKIFELCEKAGFPKGVVNLVIGDASKIGETLMNDFRVRKLTFTGSTEVGKKLMTQAGATVKRISLELGGHAPFIVFDDADLDKAVTGALNSKLRNCGQVCVASNRFYVQEGIIDDFILKMKEKLKNYKIGSGLEEGVHLGPLIDQNAYEKVKTHIEDAVNKGAKIEFGGEGFHRGSSAAGGYFYQPTLLSNVTEEMLIMKEETFGPVIPVVSFKSEEEVIARANDTKYGLAAYFFTQSLAKGFRVSEALAYGIVGVNDGVPSTPQAPFGGFKESGIGREGGHYGIEGFLETKYVSFEI

SEQ ID NO: 17741 - protein, 332 aa, Oryza sativa
MAEAAAAPPAAAATNYEVDLGNLMAYDPSHHLPAASSSRSAPIAATAIVPCCFDSVTKFPGVARREELREECLRKGTELAQAVADALFALPATEDRDGPMVRLPPPTTRFPREKHLPRPKPPTKWEQFAKMKGITKHKKNKREWDEQTQTWKRTYGYDRVNDDKDIPIIEAKATDEPGVDPFAQRREDKKNHIQLAATALPITGTKADIPKKSRKKDLEDVAGMASSATASGGKFDEKLPGEKPPKNPGKHRKFLPVVEGKGMGNQEKQQNDKILNALLAKSSEDQMDVGRAITMYKVKKEKQRRKDKEKSSSSNKLKPQKKTLKKSSKKKA

SEQ ID NO: 17742 - protein, 386 aa, Solanum lycopersicum
MALHATAFSFTGVSTSSKSSRSALLSLPRRCAVKATSQYPHSFPRCKIQGRALPSDNGLVEKDESSLVVCFGEMLIDFVPTTSGLSLAEAPAFKKAPGGAPANVAVGISRLGGSSAFIGKVGEDEFGYMLAEILKENNVNSDGMRFDPGARTALAFVTLRKDGEREFMFYRNPSADMLLQEDELDLELIRKAKVFHYGSISLITEPCKSAHIAAAKAAKDAGVILSYDPNLRLPLWPSAESAREGILSIWNTADIIKISEEEISFLTQGEDPYDDNVVRKLYHPNLKLLLVTEGPEGCRYYTKDFSGRVKGIKVDAVDTTGAGDAFVAGILSQLASDVSLLQDEGKLRDALSFANACGALTVMERGAIPALPTKEVVLNTLLKSVA

SEQ ID NO: 17743 - protein, 453 aa, Lactobacillus acidophilus NCFM
MKVVKFGGSSLATGNNVNKALNIIKNDSSRQVIVVSAPGKRTDDDIKVTDLLITYAYTSLRSNNYDDTVEKIFRRYELIAQYFDLPESDLTKIKRLLLTLPTYDYPNADYRMATFKAHGERLNAILIAKILNHQGIKTRYLEPKDVGLIVTGTPNNAEVNPETYVNLKRINLKNNEKIIFPGFYGITPSGHIATFSRGGSDITGAILARGFDAELYENFTDVDAIFSANPNIVTNPAPIKKMTYQEMRELSYAGFSVFHDEALIPAIQGEIPVNVKNTNDPEKPGTLIVPEDGFIPKHTITGIAGGKNFAALYLRKYMLNKGAGFTLKLMEIFDRHHVSYEHMPSGIDDLTIIFKKDALSDQLIDVICNEIQTSLNPDQMQWIDDYAITMVVGEGMKDKLTLCASILYPLGEKNISIQMINQGASQISIMIGTRRQDEEEVIKTIYQNFIENR

SEQ ID NO: 17744 - protein, 448 aa, Oryza sativa Japonica Group
MAREVLRKNDAVFADRPTTFAAESFSVGYRSASISPHGDQWRKMRRVLTAEILSPATEHRLRGARGEEADHLVRYVLVRCGRDGAAVDVRHVARHFCGNVIRRLTLGRRHFREPRADDEDAAEPGRDEAEHVDALFATLNYLDAFCVSDYFPALVGLDLDGQEKVIKKVMRTLNRLHDPVVEERVEEWRLLRKAGERRDVADFLDVLASLDDAAGRPLLTVEEIKAQTIDIMIATVDNPSNAVEWALAEMMNKPEVMRKAMDELDTVVGRDRLVQESDVRDLNYLKACIREAFRLHPYHPFNPPRVAMADTTIAGYTIPKGSQVILSRVGLGRNPRVWDEPARVPAGASPVAVPCRRPWRRRRGGAHGGRSCGSCRSAPGRRGCPGVSLGTLITVTLFARLLQGFEWSKPAGVERVELREEAASLVLAQPLVLQATPRLAAHLYGAGK

SEQ ID NO: 17745 - protein, 366 aa, Triticum aestivum
YQLLRLITPRYLCDTIEYSSYASNALGALPYGRPAGGRTSDSRPRCHFRDKLGQGCYGSVYKGVLLPGGVHVAVKMLEGNSNCNGEDFISEVSTIGRIHHVNVVRLVGFCSVEMRRALVYEYMPNGSLDKYIFSAEKSFSWDKLNEIARGIARGINYLHQGCDMQILHFDIKPHNILLDSNFIPKVADFGLAKLYPRGDSFVPLSAMRGTIGYIAPEMISRSFGVISSKSDVYSFGMLLLEMAGGRRNADPNMGSSSQAYYPSWVYDQLTQEEAGEISPVAANMHELEKKLCVVALWCIQMRSRDRPTMSEVIEILEAGVDGLQMPSRPFFCDEGHNHVEDSYLFSSELTAVSEEELSVVSEEDDV

SEQ ID NO: 17746 - protein, 275 aa, Bacillus pumilus SAFR-032
MSKIGFIGAGSMAESMIKGLLKSGIMSNEDMIVTNKTNEKRLEELKVRYGVKTDFSRSFIYEEADILVFALKPKDAESGISEVRPHLQGQLIISILAGISIETIQHYAGEKTAVVRAMPNTSAAIQQSATAIAVSQEVTEDQKKKAIELFETIGHVTVLDESQLNAVTAIAGSGPAFIYHLIEGMERGASELGMDQATAKLLICQMIAGAANMLQSSGKEPAELRKEITSEGGTTEAGLNTLASYQFEEAVVDCVKTATKRAAELNEMFSANTYK

SEQ ID NO: 17747 - protein, 410 aa, Geobacter sulfurreducens PCA
MAKINDHYLKLKAGYLFPEIGRRVREFAAANPSAKVIRLGIGDVTRPLAPAVIKAFHEAVDDLATTENFAGYGPEQGYDWLINAIIEKSYKPLGVDLKTEEMFISDGSKCDCANILDIFALDNVVAIGDPVYPVYNDTNVMIGRTGEADDKGYYKGIVYMPCTEENGFIPSLPTEKVDIIYLCFPNNPTGTVATKAELKKWVDYAIANDAVIFFDAAYEAFITDPAIPHSIYEIEGAKKCAIEFRSFSKTAGFTGVRCGLVVVPEEVMGTTPTGEKYSFNKLWLRRTTTKFNGASYPVQKAAAAVYSDEGWQQNKEIIDYYMENARIIREGLAAAGLTVYGGVNAPYIWLKTPGGMSSWDFFDKLLNECNVVGTPGSGFGPSGEGFFRLSAFGHRENVIEAVERIKKNLK

SEQ ID NO: 17748 - protein, 544 aa, Acetobacter aceti
MPSASMPQLRGMALLNNAHLNKGTAFTEEERRLYGLEGLLPTQVESLDRQVERIHRHLEAKPSNLERYIYLSGLRDQNETLFYKVLMSNPARFVPIVYAPTLAAVCQQFSHIYRRPRGMYISLDMRGRIKEVLRNWPMENVRFMCVTTGGRILGLGDIGVNGMGIPIGKLDLYTACGAVPPDSLLPVQLDIGTTNSALWADPLYLGLRREPPPLDELDSFVEEFIQAVQDIFPQSCIHFEDWKGTDALRYLKKYHDRVLCYNDDIQGTAAVTLAGLITALKIKNESLAQQRFLFLGAGSSGIGTADMLVSALKQEGLSEQDAIDRITLMDVNGLLETSRSDLLPEQERFAKNMPPSRDLLGMIKTVKPTVLIGVSTAGGAFTQDVVEEMSRLNERPIIFPLSLPQKNGECTAEQAYEWSNGHALFAAGLQYPEVTYNDRTFYPGQANNFYIFPALGLAVYATCPKLITDEMVIEAAQALADQVDPAARERGRLFPPQSDILEVSITSATRIAEFIFDKGAATVERPKDIRAWIENLTYKPRYAD

SEQ ID NO: 17749 - protein, 450 aa, Staphylococcus aureus subsp. aureus N315
MNNKRHSTNEQLSLDEINNTIKFDHRSSNKQKFLSFLGPGLLVAVGYMDPGNWITSMQGGAQYGYTLLFVILISSLSAMLLQSMTVRLGIATGMDLAQMTRHYLSRPIAIIFWIIAELAIIATDIAEVIGSAIALNLLFNIPLIVGALITVLDVFLLLFIMKYGFRKIEAIVGTLIFTVLFIFIFEVYISSPQLNAVLNGFIPHSEIITNNGILYIALGIIGATIMPHNLYLHSSIVQSRTYSRHNNEEKAQAIKFATIDSNIQLSIAFVVNCLLLVLGASLFFNSNADDLGGFYDLYHALKTEPVLGATMGAIMSTLFAVALLASGQNSTITGTLAGQIVMEGFLRLHIPNWLRRLITRSLAVIPVIVCLIIFKGNAAKIEQLLVFSQVFLSIALPFCLIPLQLATSNKDLMGPFYNKTWVNIISWTLIIILSILNVYLIVQTFQELQS

SEQ ID NO: 17750 - protein, 344 aa, Oryza coarctata
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKDNVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAKLEHNH

SEQ ID NO: 17751 - protein, 203 aa, Brassica napus
MAPSAASSNNKEGESGEEGYTALEKHVAFFDRNGDGVIYPWETYHGFRALGLGRLPSAIAGLFINMGLSQKTRPGKGFSLLFPIEVKNSHFCIHGSVTEAYDKNGRFVESKFEEIFKKHARSHRNALTYKELLQLLKSNRDPGDFGGWIAAYGEWKLLYELCKDEDGLLTREAVKGAFDGSIFRKLEKERLSSSHKKKEKRRR

SEQ ID NO: 17752 - protein, 356 aa, Bradyrhizobium sp. ORS278
MAREWPMTHPSNHPMDHHHQTLQAHLASQGADADCAAVIEALADAARELARQIAIAPLSGIDEGAATVNTDGDIQKALDIVADNLMREALRRAPVAGILSEEGDRPETVNEAAPLCVAIDPLDGSSNLQNNISVGTIFSIRPRGRDVLSSFFEPGTAQRAAGFFVYGPQTCLVLAIDRRVDLYVLHPTLHEFILAKSGIRIPQDTPEFAINASNRRHWSGAVRNYVDECLSGAAGPRGRDFNMRWIASLVAEAYRILMRGGVFLYPADSRPGYREGRLRLVYEAHPMALIMEWAGGSASSGRARILELSARSPHQRAPLIMGDVRLVRDVDMLHEGVEPLFETSDAPLFARRGLFR

SEQ ID NO: 17753 - protein, 291 aa, Bradyrhizobium sp. ORS278
MSRRHPIISITGSSGAGTTSVKKTFENIFRRENVKAAYIEGDAFHRYNREEMRRKMVEEAERGNKHFSHFSPDTNLFEELEKTFRDYSETGTGTTRHYVHDDEEARLYDARPGTFTEWTQLPADSDLLFYEGLHGAVVTEMVNIAQHADLKIGVVPVINLEWIQKLHRDRASRGYTTEAVTDTILRRMPDYVNYIIPQFSETDINFQRVPTVDTSNPFIARWIPTPDESMVVIRLKNPRGIDFPYLLSMIHGSFMSRANSIVIHGSKLDLAMQLILTPMIMQLMDRKRRTL

SEQ ID NO: 17754 - protein, 198 aa, Vibrio parahaemolyticus RIMD 2210633
MAEVRARVDFKVGAKSNIDAEILSFRGLKTDKEHVAVIFKQADQTQDTPLVRMHSECLTGDVFHSSRCDCGEQLEETIQRMGESGGVILYLRQEGRGIGLYNKIDAYRLQSQGMNTYEANNHLGFDDDLRDFTEAAQMLEALGIKKIRLVTNNPKKIRELAEYGIEIVEVVNTSAHIKDGNENYLRAKVSHGKHNLKV

SEQ ID NO: 17755 - protein, 264 aa, Bordetella bronchiseptica RB50
MRQALFLGYGRMGAALGEAWLRAGLLAGIDAVDPGRDGAGLRARLVRGADELPEQAYDLVVLAVKPAMAQQALRAVPPARLARACLVSIMAGVPAGALRQALQPPRPVARAMPNTPVMAGQGCTGLYGGDDVAPAQRAAIGRLFEAVGAAFWVDTEDQLHAVTALSGSGPAYYHLFSEALAQAGEQLGLPAALARSLAARTALGAASLQCEEGADFAALRREVTSPHGTTHAAIEVFEQAGALRTLVRDAVRQAQARSRELARP

SEQ ID NO: 17756 - protein, 567 aa, Solanum ptychanthum
PRKGCDVLVEALEREGVTDVFAYPGGASMEIHQALTRSNIIRNVLPRHEQGGVFAAEGYARATGFPGVCIATSGPGATNLVSGLADALLDSIPIVAITGQVPRRMIGTDAFQETPIVEVTRSITKHNYLVMDVEDIPRIVREAFFLAKSGRPGPVLIDVPKDIQQQLVIPNWDQPMRLPGYMSRLPKLPNEMLLEQIVRLISESKKPVLYVGGGCSQSSEELRRFVELTGIPVASTLMGLGAFPTGDELSLQMLGMHGTVYANYAVDSSDLLLAFGVRFDDRVTGKLEAFASRAKIVHIDIDSAEIGKNKLPHASICADIKLALQGLNSILEGKEGKLKLDFSAWRQELNEQKVKYPLNFKTFGEAIPPQYAIQVLDELTNGNAIISTGVGQHQMWAAQFYKYKKPRQWLTSGGLGAMGFGLPAAMGAAVGRPGEIVVDIDGDGSFMMNVQELATIKVENLPVKIMLLNNQHLGMVVQWEDRFYKANRAHTYLGDPANEEEIFPNMLKFAEACGVPAARVTHRDELRAAIQKMLDTPGPYLLDVIVPHQEHVLPMIPSGGAFKDVIT

SEQ ID NO: 17757 - protein, 567 aa, Solanum ptychanthum
PRKGCDVLVEALEREGVTDVFAYPGGTSMEIHQALTRSNIIRNVLPRHEQGGVFAAEGYARATGFPGVCIATSGPGATNLVSGLADALLDSIPIVAITGQVPRRMIGTDAFQETPIVEVTRSITKHNYLVMDVEDIPRIVREAFFLAKSGRPGPVLIDVPKDIQQQLVIPNWDQPMRLPGYMSRLPKLPNEMLLEQIVRLISESKKPVLYVGGGCSQSSEELRRFVELTGIPVASTLMGLGAFPTGDELSLQMLGMHGTVYANYAVDSSDLLLAFGVRFDDRVTGKLEAFASRAKIVHIDIDSAEIGKNKLPHASICADIKLALQGLNSILEGKEGKLKLDFSAWRQELNEQKVKYPLNFKTFGEAIPPQYAIQVLDELTNGNAIISTGVGQHQMWAAQFYKYKKPRQWLTSGGLGAMGFGLPAAMGAAVGRPGEIVVDIDGDGSFMMNVQELATIKVENLPVKIMLLNNQHLGMVVQWEDRFYKANRAHTYLGDPANEEEIFPNMLKFAEACGVPAARVTHRDELRAAIQKMLDTPGPYLLDVIVPHQEHVLPMIPSGGAFKDVIT

SEQ ID NO: 17758 - protein, 382 aa, Thermus thermophilus
  misc_feature (1)..(1): Xaa can be any naturally occurring amino acid
  misc_feature (205)..(205): Xaa can be any naturally occurring amino acid
  misc_feature (330)..(330): Xaa can be any naturally occurring amino acid
  misc_feature (338)..(338): Xaa can be any naturally occurring amino acid
XRIQVNAKGAARLLSRHLWVFRRDVVSGPETPGLYPVYWGRRFLALALYNPHTDLAVRAYRFAPAEDPVAALLENLAQALARREAVLRQDPEGGYRLVHAEGDLLPGLVVDYYAGHAVVQATAHAWEGLLPQVAEALRPHVQSVLAKNDARTRELEGLPLYVRPLLGEVPERVQVQEGRVRYLVDLRAGQKTGAYLDQRENRLYXERFRGERALDVFSYAGGFALHLALGFREVVAVDSSAEALRRAEENARLNGLGNVRVLEANAFDLLRRLEKEGERFDLVVLDPPAFAKGKKDVERAYRAYKEVNLRAIKLLKEGGILATASCSHHXTEPLFYAXVAEAAQDAHRLLRVVEKRGQPFDHPVLLNHPETHYLKFAVFQVL

SEQ ID NO: 17759 - protein, 354 aa, Saccharomyces cerevisiae
MVIDLEHVVDYIMHIDSQLQLKKASPAKMNSESREDMAINSIKLLAGNSHPDLAEQISKKLGIPLSKVGVYQYSNKETSVTIGESLRDEDVYIIQTGIGEQEINDFLMELLILIHACKIASARKITTVIPNFPYARQDKKDKSRAPITAKLVANLLQTAGADHVITMDLHASQIQGFFHIPVDNLYAEPSVLNYIRTKTDFDNAILVSPDAGGAKRVAALADKLDLNFALIHKERQKANEVSKMVLVGDVTNKSCLLVDDMADTCGTLVKACDTLMEHGAKEVIAIVTHGIFSGSAREKLRNSRLSRIVCTNTVPVDLDLPIADQIDISPTFAEAIRRLHNGESVSYLFTHAPV

SEQ ID NO: 17760 - protein, 350 aa, Listeria innocua Clip11262
MAYKITSLAGDGIGPEIMASGIKILEAIAAKYNHTFEIESHPFGGAGIDAAGDPIPPETLKACQNADAILLGAIGGPKWDNAPKRPEDGLLALRKALGLFANIRPIQVPSSITHLSPLKKEIVENTDFVVVRELTGGLYFGEPKHWDDVAAVDSLTYTRVEIERIIEKAFEIASTRNKKVTSVDKANVLASSKLWRKIAEEVASRHPDITLEHLYVDAAAMLMIQRPTTFDVIVTENLFGDILSDEASVITGSLGMLPSASHAENGPSLYEPIHGSAPDIANQNIANPMSMISSVSMMLRQSFSLFKEADAIDAATARTMQAGFLTADLGGNTSTTDFTNEVLKQIEGGE

SEQ ID NO: 17761 - protein, 470 aa, Rickettsia prowazekii str. Madrid E
MSFLRKKSFESVKEIGSSSGLSKTLGAFDLILLGLGAMIGTGVFVVTGIIAAKFSGPAVMISYMIAGITCIFVALVYTELAAMLPTSGSIYTYSYVAFGEVFAWMIGSVIILELGVSAGIVAAGWSGYVQGILEAGGIYLPKVLTTVPSNGGVINLPAFLISAFIGFILFLGTKDSKKINAILVFIKMVAIFAFVLAAAPHFDATNWSNFMPFGFGSVVMGSSILFLAFTGFGTIATAAEECKNPKRDIVIGIIGSLILTTLVYVIMSGLVTGIAPFDQLNNDRPLAYALTINNSKIGSAIVSTGAVCGMMTVLMMNIYGTSRIFYAIARDGLLPKSFAKLHPKYDSPYITIIIFSALAAFLGGFCPTEIITQLTSMGALIDYIAVAIIVMMFRIKLPTAQRAFKCPIVFIIAPFILFACIYLLLTQMYGDEIYKGNFNLLTSGRVLIYWFITIFILYLVRSFFMGKEQH

SEQ ID NO: 17762 - protein, 660 aa, Neptuniibacter caesariensis
MTHGFFEQFLVILCCAVIATTLFRRIQLPPLLAYLSVGALVGPYALGVIEDVHSIEFLSELGVVFLLFMLGLEFSVSRMIAMRKAVFGLGSLQVIITSAVIIGFCTLIGMPLTTSVVIAGALSLSSTAIVSRELIHRNELDTPHGQLSVGTLIFQDLAAVFFLIVVPTLNGGASEINGSQVALMLLEGGTLLIVLLLIGHIVMPMLFHESARSGSSDVFVLTSLAAALLAAWLTEAAGLSMALGGFLAGMMLGESRYRYQLEADIRPFRDVLLGLFFVSVGMQLDLQSLLENWYWVLVFTLCLITAKTLIITFIGSLLHKDLVNSLRAGLSLSQGGEFGFALLALALGSQLISPEINTLTVATIIISMIITPIIMNHTHRVDGLLAKQQLEQEDSIDPSGSQIDNHNLNNHVIICGFGRVGQIMARFLDQAQIPYIAIDNDPVRVMEASTAGEHICFGDARRDDILEAVGAKNARMLILSFPETESSLPALKHIRSRFVDLPILVRTRDDSQLDEFQTAGATEVIPEALEGSLMMISHVLSLLGMPHTKIEKQINTVRAERYHMLHGYYHGRHSSKIDSSGRAKEILHPVTIDTDAAEIGKTLKELKLERFKVTVAMIRRQNHSNHNPKGDTRLKSGDIVVLKGPTDKVELAEASILSKS

SEQ ID NO: 17763 - protein, 179 aa, Oryza sativa Indica Group
MATLARVSLPSVLLTLRHGATTQGFAAARPAAVVAKRLLGSVRCGGAAEALGADMAVPRSVPVRVAHELQQAGHRYLDVSLIIVLDLCRTEGEFAGGHPVGAVNIPYMYKTGSGLTKNTHFLEKVSTTFGKEDEIIVGCQSGKRSLMAASELCSAGFTAVTDIAGGFSAWKENELPTNK

SEQ ID NO: 17764 - protein, 422 aa, Listeria innocua Clip11262
MELVDLLVTEEDVEKAYDVLKPVVKHTPLEYDFYLSEKYHCNVYLKREDLQRVRSFKLRGAFYAISRLSAEQLEKGVACASAGNHAQGVAYTCKRMTVPATIFMPTTTPQQKVSQVKFFGGSNVEVVLVGDTFDASATAAKEFAAEHGQTFIPPFDDPDIIAGQGSLAVEMVKDLNKAHEQADYVFAGIGGGGLISGVASYLKAKSPITKIIGVEPAGAPSMTEALKQNQVVTLDKIDKFVDGAAVKEVGSLTFQHAKVLVDEVTTVSEGAVCSTILDMYTKQAIVAEPAGALSVAALETYREEIKDKTVVCIVSGGNNDINRMQEIEERSLLHEGLKHYFIVNFSQRPGALKEFVNDVLGPHDDITKFEYTKKVNRGNGPVIIGVLLQDKNDYEGLLDRVAAFDPSYIPINDNQTLYTLLV

SEQ ID NO: 17765 - protein, 175 aa, Triticum aestivum
MAPTVMASSATSVAPFQGLKSTAGLPVCRRSNGASLGSVSNGGRIRCMQVWPIEGIKKCETLSYLPPLRTEALLKQVDYLIRSKWVPCLEFSKVGLIFREHNTSPGYYDGRYWTMWKLPMFGCTDATQVINEVEEVKKEYPDAYVRIIGFDNMRHVQCVSFIAFKPPGCEESGKA

SEQ ID NO: 17766 - protein, 489 aa, Arabidopsis thaliana
MGCLHSKTANLPSSDDPSAPNKPESVNGDQVDQEIQNFKEFELNELRKATNGFSPSCIVSEGGEKAPNVVYRGKLEGNHLVAIKRFFRQSWPDAQQFVVEATGVGKLRNKRIVSLIGCCAEGDERLLVAEYMPNDTLSKHLFHWEKQPLPWDMRVRIADYIAEALDYCNIENRKIYHDLNAYRILFDEEGDPRLSTFGLMKNSRDGKSYSTNLAYTPPEFLRTGRVIPESVIFSYGTILLDLLSGKHIPPSHALDIIRGKNALLLMDSSLEGQYANDDATKLVDLASKCLQSEAKDRPDTKFLLSAVAPLQKQEEVASHVLMGLPKNTVILPTMLSPLGKACAKMDLATFHDILLKTGYRDEEGAENELSFQEWTQQVQEMLNTKKFGDIAFRDKDFKNSIEYYSKLVGMMPVPSATVFARRAFSYLMTDQQELALRDAMQAQVCIPEWPTAFYLQALALSKLGMETDAQDMLNDGAAYDAKRQNSWRC

SEQ ID NO: 17767 - protein, 406 aa, Xanthobacter autotrophicus Py2
MTTDFHRIRRLPPYVFEQVNRVKAAARNAGADIVDLGMGNPDLDAPAHVIEKLKETIGKPRTDRYSASKGIPGLRRAQAAYYERRFGVKLDPDKHVVATLGSKEGFANMAQAITAPGDVILTPNPSYPIHAFGFLMAGGVIRSVPVEPGPEFFHAMERAVQHSIPKPIAVVLCYPSNPTACVADLEFYKDVVAFAKKNDLIVLSDLAYAELYFDDTPPPSVLQVPGAMDVTVEFTSMSKTYSMAGWRMGFAVGNERLIAALSRVKSYLDYGAYTPIQVAATAALNGPQECIAEMRETYKKRRDALVESFGRAGFPVPSPRASMFAWAPIPEPFRAMGSVEFAKLLIEKADVAVAPGVGFGEHGDDFVRIAVVENEQRIRQAARNIRRFFEQAGTTLHNVVPLSAAR

SEQ ID NO: 17768 - protein, 505 aa, Bdellovibrio bacteriovorus HD100
MPQKSLSGYLNLGSVIFSYFHSGLDFKSPPCYLSVFHFFRGVPVSQNEFSTLPLSPELLTVVQELGFETLTPIQQESIPLLLAGKDIIGQAKTGSGKTAAFSLPILNKINLDQPLLQALILCPTRELASQVVTEIRKLGRRLPGLKVLAMTGGQSGREQADALENGVQIVVGTPGRLADFVGRNRIDLSAVKTVVLDEADKMLDMGFADEIKTVMRDLPGSRQTVLFSATFPESIEHLSRKYQRHAQQVIIEDEEQNLIEQLVYDSEDNDKTNVLMRILQQHPSDSTIIFCNTKNAVAEIAERLNDLGAASGCLHGDMEQRERDRVMAMFRNGSHRILVATDVAARGLDIDNLELVINFDLPLSPEIYVHRIGRTGRAGKTGVAVTIAHPKDTLKLGQFEELTGGKFARPSLGFKNQYGLNKTLKEAPMKTISISGGRKDKLRPGDILGALTGAAGGLTSADVGKIEIQDKISFVAVSAKVADGAMQKLRDGRIKGQKFQVKFVK

SEQ ID NO: 17769 - protein, 251 aa, Triticum aestivum
  misc_feature (81)..(81): Xaa can be any naturally occurring amino acid
  misc_feature (96)..(96): Xaa can be any naturally occurring amino acid
  misc_feature (246)..(246): Xaa can be any naturally occurring amino acid
MGRKFFVGGNWKCNGTTDQVEKIVKTLNEGQVPPADVVEVVVSPPYVFLPVVKSLLRPEFHVAAQNCWVKKGGAFTGEVSXARCSVNLGVPWVILXGHSERRALLGESNEFVGDKVAYALSQGLKVIACVGETLEQREAGSTMEVVAAQTKAIAEKISDWSNVVVAYEPVWAIGTGKVATPAQAQEVHASLRDWLKINVSPEGAESTRIIYGGSVTAANCKELGAQPDVDGFLVGGASLKPEFIDXQRGPP

SEQ ID NO: 17770 - protein, 421 aa, Xanthobacter autotrophicus Py2
MSVKISVLDNGVTVITDEMSHLGTASLGIWVGAGARDEQEDEHGISHLLEHMAFKGTRRRSARRIAEEIEQVGGDINAATSVEQTTYNVRVLGEDVGLGIDILADILTEPAFAPDELEREKNVIVQEIGAVMDTPDDLVFDLFQEQAFPGQSVGRSILGTPDTVRAFSRDQLGAYLGRTYRGPRMVVAAAGAVEHDRLVEEAGQRLKIIAPATKPELPQATYGGGTRLLARDLEQVHVLLGLEGCSFKDPEYHAVQVLANVLGGGMSSRLFQDVREDRGLCYSIYAFHWSYQDTGLFGVYAGTDTGDVEELSNAVIDQILDTAETVTELEVARAKAQMKVGLLAALESSGARADQLARQILGFGRVIPVEEIVARVDAVDVAGVRRAAQGLIGRGRPTLTAIGPGGGLEPAARAVERLKVH

SEQ ID NO: 17771 - protein, 116 aa, Bdellovibrio bacteriovorus HD100
MGKKIYVGNLSYSLDDQSLADTFAEFGNVESARIVIDRETGRSKGFAFVEMSTDDEAATAIAKLNGVELMGRAMNVSEAKPMAPRENRGGFGGGRGGGGGGNRGGGFGGGNRGGRF

SEQ ID NO: 17772 - protein, 329 aa, Xanthobacter autotrophicus Py2
MSELVTLKTYLGTWAGADTGRTAVAQAVTAIAEAGVGIADLVARGPLEEGLASIRGVDPNAGGDAQKELDVVAEERIKAALLPTPTAFLASEESEELIPLNPDGRLVIAVDPLDGSSNIDTNVSVGTIYSILPYDAAVHTDPVSAVMRPGVNQVASGFLAYGPATILVATFGEGTQVFVHDRQTGEFVLARTNVEIPAETKEYGVNQSNVRHWAEPMSAYIADCLAGKDGPRGKDFNMRWVGSMVADAFRIFTRGGVYVYPGDKRKGYENGRLRLIYEANPVAFLTEQAKGAATDGKTRILDIQPHHIHQRIPLVFGSKAEVEKIASYY

SEQ ID NO: 17773 - protein, 145 aa, Xanthobacter autotrophicus Py2
MTSDDTPSLAEALAETEAGTRTRPHNTDRLFLRALPFYARHGLFEAERELGQRFVVDVDCWLDTRPAAWADDAALTVSYQQVYEHVSAVVTDDPVRLIETLAERIATRILDHFETVEQVRVVVHKPGAPITGVFGDVGIEIIRSR

SEQ ID NO: 17774 - protein, 346 aa, Pseudomonas aeruginosa UCBPP-PA14
MNTLDTGWRMPAEWTPHAATWMAFPHNRMLWESEWGVSLADVQQDFAAVANAIARFEPVKLVVDPAALDRAGELCAGNVELIELAIDDSWCRDSGPSFVCHPQLGLAGVSWRFNAWGGKSAYAQDASLARRILDGLGLECFGVPLANEGGAIHVDGEGTLITTESVLLNANRNPGLSKAEIEALFARLLGVTRTIWLPGDPDRVTGDMTDGHVDGVCAFARPGALLLDATCDTTSAYAEVVRENRRALELALDARGRRFELIELFDAGEVAPEEGVFCASYTNFYIANGAIIMPAYGVAADDAAAATLARAFPAREVVPVRIDHLAHGGGGVHCITQQQPAWPARR

SEQ ID NO: 17775 - protein, 275 aa, Wolbachia endosymbiont of Onchocerca volvulus
MSLIKLSPTIAVTDKVNRLKSQGKEICVLAAGEPDFDTPGHIKKAAIQAINEGKTKYTAVDGTRELKGAIIDKLKRDNDLEYMPSQICVSAGAKQVLFNLLMATINPEDEAVIPAPCWVSYVDMVSFFGGLPVIAECKDNFKLTSELLRSKITEKTKWLILNSPNNPAGVVYTYDELKKIAQILLEYPHVNIITDDIYEHIVYDGKFFTIAQVEPRLYDRVFVVNGVSKAYAMAGWRIGYVAGRSDVVKAISILQSQSTSNPNSIAQAAAVEALN

SEQ ID NO: 17776 - protein, 294 aa, Glycine max
MEQYEKVEKIGEGTYGVVYKARDRVTNETIALKKIRLEREDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCIFAEMVNRRPLFPGDSEIDELFKIFRILGTPNEDTWPGVTSLPDFKSTFPKWPSKDLANVVPNLDAAGLNLLSSMLCLDPSKRITARSAVEHEYFKDIKFVP

SEQ ID NO: 17777 - protein, 545 aa, Geobacter sulfurreducens PCA
MISTSNISLAYGKRVIFKDVNIKFVPGNCYGLIGANGAGKSTFLKILAGLSEPDSGTVSVGPRERISFLKQDQFAFDEHTVFNTVIMGNPRLYEVMHEREAIYAKAEFSEEDGIRSAELEAEFAEMDGYEAESEAAVLLNGLGIPEELRHKQMKELEGGEKVRVLLAQALFGNPDVLLLDEPTNHLDLKTITWLEDFLARFNNTVIVVSHDRHFLNQICTHVADIDFGRIQVYVGNYDFWYQASQLTLKQKQDESRKIADKAAELKEFIQRFSSNASKAKQATSRKKLLEKLTVEEMPVSSRKYPYVVFKPERPCGDVILEISGLSKEIDGVQVFKDLDLIVGKGDKIAFVGANSLAKTTLFQILAGELEPDAGSFRWGVTITSAYFPKENGSYFDNDLNLIEWLGQFAPPTEGESFARGFLGRMLFSGDEATKKASVLSGGERVRCMLARMMLLGANALVLDEPTNHLDLESITALNNGLIAFSEVVLFSSHDHEFVNTLANRIVEFTPGGIIDRKMTFDDYLESAEVAEERDRLCQGHCDLTL

SEQ ID NO: 17778 - protein, 491 aa, Bacillus pumilus SAFR-032
MNTETNNPKAVIVIFGATGDLAKRKLYPSIHRLYHSGKLGDQFAVVGVGRRPWSHEDLRAVVKESVSSDDAEAKIEEFSSHFYYHDFDVSNPASYQSLNTLLAGLEDTYSIPNNRMFYLAMAPEFFGTIAKFLKSEGVSKTTGWSRLVIEKPFGHDLPSAKKLNEEIRDAFSEDQIYRIDHYLGKQMVQNIEVIRFANAIFEPLWTNRYISNIQITSSESLGVEDRARYYESSGALRDMVQNHMLQMVALLAMEPPIKLNTEEIRSEKRKALRALRPFSKDEVDQFFVRGQYDAGTVDGGMVPSYLEEQNVDPNSNTETFVAGKLLIDNFRWAGVPFYIRTGKRLEKKSTQIVVQFKDIPMNLYYGNGNSMHPNLLVIHIQPDEGITLHLNARKLDGGTFAKPIKLDYQTNYNDIMNTPEAYEKLIHDCLLGDATNFAHWDEVALSWNFVDPISEKWAENKTLKPNYPAGSMGPKEADQLLEKDGYHWWNI

SEQ ID NO: 17779 - protein, 701 aa, Ustilago maydis 521
MQAGKIVQRPSGDGTPILEPVTPSGKRSEGSTHGVLAAAAAAALTATESAPVTPLVSSTASLGSATPTGNATLSNTIAATRSKTIVLADAGRAPWYNSVGEPVPAYVVGIAGGSASGKTSVAREILKKLPNVPWVAIVSQDAYYKSLSPEESKLAFQEQYDFDHPDAFDYDILKKCIRDLRQSKAVEIPVYSFVQHQRTSETNYLYGPAVLIVEGIFVLHDPEIRQLLDLKVYVQADSDLMLARRIKRDIVERARSVNSVLDQYLRFVKPAFDTFVSATARHADMIVPGSHNEVAIEVISQHMEKQLRNRSRKLRAEFYKTPATQVPAPTANDKNVLAVMSPYDGLGSPHERRASLTHMKPILNRSESFGMSSSQLVRGVSSNSAADGTGLPPNVILLAQTPQLQSLLTILHDRSTPTGEFTFACKRVGTLVVELATTLLPYREKEIAIHGGRKHIGHELNVSSLCSVSVLRSGAVLEPSLRRAFPAMSLGSLLIQSNEEDGEPHLYDVSLPSFIRRRETAEKSWVFLLDAQIGTGAAAFMAIRVLLDHSVPEEQIIFLTLLASSQGGIHALNRAFPRVRIVVAGVDPGLQKLRIPWQTSSSNHSNTSKHDRGEPIHYDDNAPVDEDDLSPGLNHRDNLHLLASPPLTSVDGKFAANRGARHQTQRQPSLTHSPAKGSRVVFAITPGCGSIGDRFWGTGSR

SEQ ID NO: 17780 - protein, 377 aa, Wolbachia endosymbiont of Brugia malayi
MSDLAKRMSLIKPSPTIAVTDKANRLKDEGKKICILAAGEPDFDTPDHIKKVAIQAIDEGKTKYTAVDGTRELKEAIISKLKRDNNLEYALSQVCVGAGAKQVLFNLFMATVNPGDEAIIPAPYWVSYVDMVSLFGGLPVVIECGQGLKLTPELLKNKVTKKTKWLILNSPNNPAGVVYTYDELKAIAQVLLEYPHVNIITDDIYEHIYDEKFFTIAQVEPKLYNRVFVVNGVSKAYAMTGWRIGYIAGRSDVVKAISTLQSQSTSNPNSIAQAAAVEALNGDHSFLKERMGIFKSRRDFVIEKLNSAPGLLASIPQGAFYLFVSCKDLLGKSTKSGKVINNDLDFAEYLLEDHLVAVIPGIAFGLKNFIRISYATS

SEQ ID NO: 17781 - protein, 156 aa, Magnetospirillum magnetotacticum MS-1
MPLPEPSSVLAAQIAQNLARVRTRVDDAARAAGRAASDVRLLVATKTQPADAVRTVVEAGADLIGENRVQELVAKAPDLADLVTAGRVEVHMIGHLQRNKVNQVLATATGVESVDSLALAEALAARCARDGRVLDVLVQVNVSGEESKSGVRTRRR

SEQ ID NO: 17782 - protein, 2313 aa, Clostridium thermocellum ATCC 27405
MKRKNKVLSILLTLLLIISTTSVNMSFAEATPSIEMVLDKTEVHVGDVITATIKVNNIRKLAGYQLNIKFDPEVLQPVDPATGEEFTDKSMPVNRVLLTNSKYGPTPVAGNDIKSGIINFATGYNNLTAYKSSGIDEHTGIIGEIGFKVLKKQNTSIRFEDTLSMPGAISGTSLFDWDAETITGYEVIQPDLIVVEAEPLKDASVALELDKTKVKVGDIITATIKIENMKNFAGYQLNIKYDPTMLEAIELETGSAIAKRTWPVTGGTVLQSDNYGKTTAVANDVGAGIINFAEAYSNLTKYRETGVAEETGIIGKIGFRVLKAGSTAIRFEDTTAMPGAIEGTYMFDWYGENIKGYSVVQPGEIVVEGEEPGEEPTEEPVPTETSVDPTPTVTEEPVPSELPDSYVIMELDKTKVKVGDIITATIKIENMKNFAGYQLNIKYDPTMLEAIELETGSAIAKRTWPVTGGTVLQSDNYGKTTAVANDVGAGIINFAEAYSNLTKYRETGVAEETGIIGKIGFRVLKAGSTAIRFEDTTAMPGAIEGTYMFDWYGENIKGYSVVQPGEIVVEGEEPGEEPTEEPVPTETSVDPTPTVTEEPVPSELPDSYVIMELDKTKVKVGDIITATIKIENMKNFAGYQLNIKYDPTMLEAIELETGSAIAKRTWPVTGGTVLQSDNYGKTTAVANDVGAGIINFAEAYSNLTKYRETGVAEETGIIGKIGFRVLKAGSTAIRFEDTTAMPGAIEGTYMFDWYGENIKGYSVVQPGEIVAEGEEPGEEPTEEPVPTETSADPTPTVTEEPVPSELPDSYVIMELDKTKVKVGDIITATIKIENMKNFAGYQLNIKYDPTMLEAIELETGSAIAKRTWPVTGGTVLQSDNYGKTTAVANDVGAGIINFAEAYSNLTKYRETGVAEETGIIGKIGFRVLKAGSTAIRFEDTTAMPGAIEGTYMFDWYGENIKGYSVVQPGEIVAEGEEPGEEPTEEPVPTETPVDPTPTVTEEPVPSELPDSYVIMELDKTKVKVGDIITATIKIENMKNFAGYQLNIKYDPTMLEAIELETGSAIAKRTWPVTGGTVLQSDNYGKTTAVANDVGAGIINFAEAYSNLTKYRETGVAEETGIIGKIGFRVLKAGSTAIRFEDTTAMPGAIEGTYMFDWYGENIKGYSVVQPGEIVAEGEEPTEEPVPTETPVDPTPTVTEEPVPSELPDSYVIMELDKTKVKEGDVIIATIRVNNIKNLAGYQIGIKYDPKVLEAFNIETGDPIDEGTWPAVGGTILKNRDYLPTGVAINNVSKGILNFAAYYVYFDDYREEGKSEDTGIIGNIGFRVLKAEDTTIRFEELESMPGSIDGTYMLDWYLNRISGYVVIQPAPIKAASDEPIPTDTPSDEPTPSDEPTPSDEPTPSDEPTPSDEPTPSETPEEPIPTDTPSDEPTPSDEPTPSDEPTPSDEPTPSDEPTPSETPEEPIPTDTPSDEPTPSDEPTPSDEPTPSDEPTPSDEPTPSETPEEPIPTDTPSDEPTPSDEPTPSDEPTPSDEPTPSDEPTPSETPEEPIPTDTPSDEPTPSDEPTPSDEPTPSDEPTPSDEPTPSDEPTPSDEPTPSETPEEPIPTDTPSDEPTPSDEPTPSDEPTPSDEPTPSDEPTPSDEPTPSDEPTPSETPEEPIPTDTPSDEPTPSDEPTPSDEPTPSDEPTPSDEPTPSETPEEPIPTDTPSDEPTPSDEPTPSDEPTPSDEPTPSDEPTPSETPEEPIPTDTPSDEPTPSDEPTPSDEPTPSDEPTPSDEPTPSETPEEPIPTDTPSDEPTPSDEPTPSDEPTPSDEPTPSDEPTPSETPEEPIPTDTPSDEPTPSDEPTPSDEPTPSDEPTPSDEPTPSETPEEPIPTDTPSDEPTPSDEPTPSDEPTPSDEPTPSDEPTPSETPEEPIPTDTPSDEPTPSDEPTPSDEPTPSDEPTPSDEPTPSDEPTPSDEPTPSETPEEPIPTDTPSDEPTPSDEPTPSDEPTPSDEPTPSDEPTPSDEPTPSDEPTPSETPEEPTPTTTPTPTPSTTPTSGSGGSGGSGGGGGGGGGTVPTSPTPTPTSKPTSTPAPTEIEEPTPSDVPGAIGGEHRAYLRGYPDGSFRPERNITRAEAAVIFAKLLGADESYGAQSASPYSDLADTHWAAWAIKFATSQGLFKGYPDGTFKPDQNITRAEFATVVLHFLTKVKGQEIMSKLATIDISNPKFDDCVGHWAQEFIEKLTSLGYISGYPDGTFKPQNYIKRSESVALINRALERGPLNGAPKLFPDVNESYWAFGDIMDGALDHSYIIEDEKEKFVKLLED

SEQ ID NO: 17783 - protein, 372 aa, Pseudomonas aeruginosa UCBPP-PA14
MTRRHFLQRLGASAGLGAALTLGLEFGSPRGQAAAADHWHMPDEHLPQERVFLAYAASPSIWKDLAEDVNRSVALLARTIARYQPVTLLCRPTQEAAARRACGGANIDYLALPLDDIWVRDYGGCFVLNGEGEAGLVDFNFNGWGGKQQAGNDSRVAGVLSERLEVRYIASQLTGEGGGIEVDGRGTAILTESCWLNDNRNPGMDKGQVEAELKALLGLRKIVWLPGIRGRDITDAHVDFYARFVRPGVVIANLDNDPDSYDYAVTREHLEILRTATDADGRALQVHTLSPPLKPRRDYSRNNPDFAAGYINYLPINGAVIAPQFGDASADRHCGELLGRLYPGRDIVQLNIDPIAAGGGGIHCVTKHMPRA

SEQ ID NO: 17784 - protein, 365 aa, Hyphomonas neptunium ATCC 15444
MGFKCGIVGLPNVGKSTLFNALTQTAAAQAANYPFCTIEPNVGEVAVPEARLTKLAAVAGSKEIIPARMNFVDIAGLVEGASQGEGLGNKFLANIRETDAVIYVLRCFENDDITHVRGKVDPIADFEIVETELMLADLESLEKRKANIVKRANTGDKEAKAQVALMDLALNELREGRPARYAKVPADDVKAWNMLQLLTAKPILFVANVDEASAATGNAFSKLVEERAKKEGALAVVISAQIESELAMLDEAEGKEFLETLGLEEPGLTRLIRTGYELLGLQTYFTAGPKESRAWTIRKGWTAPKAAGVIHGDFEKGFIRAETIAFEDYVACGGEVGAKEAGKMRSEGKEYIVQDGDVMLFRFNV

SEQ ID NO: 17785 - protein, 476 aa, Solanum lycopersicum
MVNYFEIFLYISMFVLGYLSYYFCFGKNNNSSSKKNAYKLPPGSMGWPYIGETLQLYSQDPNAFFINRQRRFGEIFKTKILGCPCVMLASPEAARFVLVNQANLFKPTYPKSKENLIGQSAIFFHQGDYHNHLRKLVQAPLNPESIRNQIPYIEELSISALNSWVGGHVVNTYHEMKKFSFEVGILAIFGHLDGHVKEELKKNYSIVDKGYNSFPINLPGTLYRKALQARKKLGKILSEIIREMKEKKTLEKGLLSCFLNAKEEKGFLVLNEDQIADNIIGVLFAAQDTTASVLTWIIKYLHDNPKLLECVKAEQKVIWQSNEQENHGLTWTQTRKMPITSRVVLETLRMASIISFAFREAVADVEYKGYLIPKGWKVMPLFRNIHHNPEFFPDPQKFDPSRFENAPKPNTFMPFGSGVHACPGNELAKLEILIMTHHLVTKFRWEVVGSGSGIQYGPFPVPLGGLAARFWKTTST

SEQ ID NO: 17786 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRGNSEDIYAGIEWKADSADAEKVIKFCREEMGVKKIRFPEHCGIGIKPCSEEGTKRLVRATIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 17787 - protein, 316 aa, Brassica napus
  misc_feature (16)..(16): Xaa can be any naturally occurring amino acid
  misc_feature (20)..(21): Xaa can be any naturally occurring amino acid
  misc_feature (23)..(23): Xaa can be any naturally occurring amino acid
  misc_feature (31)..(31): Xaa can be any naturally occurring amino acid
  misc_feature (53)..(53): Xaa can be any naturally occurring amino acid
  misc_feature (57)..(57): Xaa can be any naturally occurring amino acid
IGEGGFGQVFKGWLDXKTLXXSXPVVGIPVXVKKSNPDSAQGLHEWQCEVKFXGKFXHPNLVKLLGYCWEENQFLLVYEYLPKGSLENHLFSKGEALTWDTRLKIAIEAAQGLNFLHNSEKSVIYRDFKASNILLDSNFNAKLSDFGLAKLGPINGFSHVTTRVMGTQGYAAPEYMATGHLYVRSDVYGFGVVLLEILTGLRALDPNRPPLQLNLVEWAKPGLTQKKKIQKMMDPRLEHKYPISAVIRTAALILRCVEEDPKNRPPMDEVLRELEIVRTMRDEPKEEKRKRSGGGPDNNRINRYGSPHVRGTGRTR

SEQ ID NO: 17788 - protein, 213 aa, Zea mays
MTSVWKTKVLPGLNKIFDKDGKKAAAAGFLKSFNKEEIDKEIEDKKTELEPKVVEAYEASPPEVKALFKDKKPVKVSKKNSAAVTKFLDELAKIDFPGAKVVSEAVAKSGTSPLLPAITFILDKVAPFIPKEEPKAEPAAEATSREVAVEEKKEEAEPAAATEAAPAPAETPSEAAVVEEKKEEEKKEEEDKPAAEEEAAPPAAAAAAAAEEK

SEQ ID NO: 17789 - protein, 388 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRGNSEDIYAGIEWKADSADAKKVIKFLREEMGVKKIRFPEHCGIGIKPCSEEGTKRLVRAAIEYAIANDRDSVTLVHKGNIMKFTEGAFKDWGYQLAREEFGGELIDGGRWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKL

SEQ ID NO: 17790 - protein, 351 aa, Burkholderia pseudomallei K96243
MTLTIGGFTTAANAQQASAPPPQNLPRILVLATGGTIASTSDPRSAIGYNAGGITGDQLLASVPGLDKIASIKAEQISNVGSQDMNGKIWYQLAIRIKQAIDRNEVDGIVITHGTDTMEETGFFLDHVLSTSKPVVLVGSMRPGGSTSADGPMNLYEAAEVAASPQSVNRGVLMVMNDTINSPRWATKTNTTSVQTFQNPNAGPLGYVDAASIRYLSPAPTSHRKALELPSGGLPRVDIVYAHADMDATQIQDAVQHDAKGIVLAGVGDGNASKAALDAMEAAARKGIVVVRSTRVSSGFVNRNVEVPDDKSGFVASYDLNPQKSRVLAQLLIANGVTSPDKVQKAFQSTY

SEQ ID NO: 17791 - protein, 509 aa, Bordetella bronchiseptica RB50
MDLSDLKKLGLDVAYPFKEQYENYIGGQWVPPVGAEYFDNLSPITGQPFCRVPRSGAADIELALDAAHRARAAWARTSPAERANILLRIADRIEGQLPMLAVAESIDNGKPLRETTAADLPLAIDHFRYFAGCIRAQEGAISEIDANTVAYHFHEPIGVVGQIIPWNFPLLMAAWKLAPALAAGCVVVLKPAEQTPASILVLAELIGDLLPPGVLNVVNGYGKEAGQALATSKRIAKIAFTGSTPVGKHILHAAADNLIPATVELGGKSPNIFFDDVMDHDDEFLDKALEGLAMFALNQGEVCTCPSRILIQESIYERFIEKAIARVQSIKTGHPLDAGTMVGAQVSQVQMDKILSYIDIGRQEGAQCLTGGARNDMLPGGLDQGFYVQPTMLLGKNSMRIFQEEIFGPVAAVATFKDEEEAIAMANDTFYGLGAGVWSRDGARAYRVGRGIEAGRVWTNCYHLYPAHAAFGGYKQSGIGRETHKAALSNYQQTKCLLVSYSAKALGFF

SEQ ID NO: 17792 - protein, 434 aa, Chromobacterium violaceum ATCC 12472
MKQPHRQRKTVPSGGRPETETAAAMQPVHKSQKLANVCYDIRGPVLEHAKRMEDEGHRIIKLNIGNPAPFGFFAPDEIIEDVIVNLPAASGYSDSKGLFAARKAIMHYAQQKHLPNVAMDDIIVGNGVSELIVMAMQALLDNGDEVLVPAPDYPLWTAAVSLAGGKAVHYLCDEEQGWFPSIDDIRAKITPTTRAIVIINPNNPTGAVYPPALLQQIVDVARQHQLIIYADEIYDKVLYDAVRHTSIASLAPDLFVVTLNGLSKNYRACGYRAGWMILSGEKKHAKDYIEGLNMLASMRLCANVPSQYAIQTALGGYQSIDDLVAPGGRLARQRDLAHKLLTEIPGVSCVKPQGALYLFPRLDPKVYPIADDQQFILELLQQEKVLLVQGSGFNWIAPDHFRVVFLPNSDDLIEAIGRIARFLESYRKRHGAAE

SEQ ID NO: 17793 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPGLTDMVIFRGNSEDIYAGIEWKADSADAEKVIKFLREKMGVKKIRFPEHCGIGIKPCSKEGTKRLVRAAIEYAIANDRDSVTLVHKGNIMKFTEGAFKDWGYQLAREEFGGEPIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 17794 - protein, 474 aa, Mycobacterium smegmatis str. MC2 155
MTIMAPEAAAESLDPRDPLLRLSTFFDDGSVELLHERDRSGVLAAAGTVNGVRTVAFCTDGTVMGGAMGVEGCAHIVDAYDTAIEEQSPIVGIWHSGGARLAEGVKALHAVGLMFEAMIRASGYVPQISVVVGFAAGGAAYGPALTDVIVMAPDSKIFVTGPDVVRSVTGEDVDMVSLGGPEAHHKKSGVCHIVADDELDAYERGRRLVGLFCQQGHFDRSKAEAGDSDLHALLPDSARRAYDVHPLVHALLDEGVPFEEFQAKWAPSIVVGLGRLAGRTIGVIANNPLRLGGCLNSESAEKSARFVRLCDAFGIPLVVIVDVPGYLPGVDQEWGGVVRRGAKLLHAFGESTVPRVTLVTRKIYGGAYIAMNSRSLNATKVFAWPDAEVAVMGAKAAVGILHKKKLAAVEDPAEREALHEQLAVEHEKIAGGVDSAIEIGVVDEKIDPSHTRSKLTEALAEAPHRRGRHKNIPL

SEQ ID NO: 17795 - protein, 322 aa, Malus x domestica
ILPFKLPAIGPNDVRIRIKAVGICGSDIHYLKTMKCGDFQVKDPMVIGHECAGIVDKVGSEVKHLVPGDRVAVEPGISCAHCQQCKGGRYNLCPDMKFFATPPVHGSLANQIVHPADLCFKLPENVSLEEGAMCEPLSVGVHACRRANVGPETTVLIVGAGPIGLVSVLAARAFGAPRIVIVDMDDRRLAMAKSLGADGTVKVSTKMEDLDDEVAKIKEAMGSEVDVTFDCVGFNKTMSTGLNATRPGGKVCLVGMGHGVMTVPLTPAAAREVDVVGVFRYKNTWPLCLEFLRSGKIDVKPLITHRFGFTEKEVEEALEPVL

SEQ ID NO: 17796 - protein, 365 aa, Dehalococcoides sp. BAV1
MDFKLTVLPGDGIGPEVMDEGLKVLNAVAKKYKHTFKYQYGLIGGCCIDKEGVALSPAALAMCKKSDAVLLAAVGDPRFDDPKLPVHPEDGLLALRKGLGLFANIRPVKVAPSLVNSTPIKAEIVKGTDFIFIRELTGGVYFAKPKKRWTTPAGIRKATDSMTYSENEIERIVRVGFELAKNRKKKLVSVDKANVLLSSRLWRQIVIEVAKDYPEVKVEHVLVDACAMKLILAPTYFDVIVTENLFGDILTDEASMLAGSMGMLPSASLAGIPAKGTKTFGLYEPIHGSAPTIAKQNIANPIATILSIAMMLRYSCGLETEAVEIESAVDKVLAAGYATIDIFKEGNTKLGTAEMGNQITKMIGG

SEQ ID NO: 17797 - protein, 101 aa, Triticum aestivum
  misc_feature (76)..(76): Xaa can be any naturally occurring amino acid
  misc_feature (92)..(92): Xaa can be any naturally occurring amino acid
MAPTVMASSATSVAPFQGLKSTAGLPISRRSSSAGLSSVSNGGRIRCMQVWPIEGIKKFETLSYLPPLSTEALLKXQVDYLIRSKWVPCLEXFTRLGFVFR

SEQ ID NO: 17798 - protein, 395 aa, Exiguobacterium sibiricum 255-15
MKHFAPSIAIDRLPAPVFAELAQRIGAVKAAGHDVITLGQGTPDQTTPVHILDALKEAINDASNLQYPPFRGHDFLKQAVADFYQSEFGVNIDPASEVAILLGSKAGIVALPQTIVNPGEGVIVPDPGYPDYLSGAALAGAYPITLPLLAENAFLPDYTLLDTTDVERARMLFLNYPSNPTGATATAEAFEQTVSFADANDICVVHDLAYGGISFDGPTRSFLQTEGAKDVGIELFSLSKRFNMSGFRIAFAIGNPSVIASIETYQEHLYVSAFTPIQQAATVALSSDQTCVRELSALYEARRDALFGKLQEIGWDGPIPGGSFFVWLPVPSGYTSQSFTDHLLDEAHVAVTPGHFFGEYGEGYVRISLIADAERLVEAAERIGQLNLFRQTVAE

SEQ ID NO: 17799 - protein, 198 aa, Oryza sativa Japonica Group
MTQIGVYLKDILREMKELPIGDSNGTAEKSSNGAVDTTSCSDRDGSSSDLELDEDFTEEEVAVAKLVVTVASDALVVVKETIRFITCLLKISGNRSGANEEKVETMEQLLSCCRQAADQINDLGASVYPPQDLSEMKSSVKRLYGGANAMRREIRSLGGSPEGAFVALERFEKSLGALEVEIADDVANEMENLTISSS

SEQ ID NO: 17800 - protein, 155 aa, Zea mays
MPSLPLALPPAPALAPLPRRQGPRLLTDRSSLPTDRLVPAILSCKRRATAMQRGALLTRAVVARLYLVVLNIDTHKCWARDYYNNYAQFCWVGDSVHCASAIRSVACAGRQEREYEMTLKRTLQSICLLTVHPNTTTSVVLQVVGDDGSISFHMM

SEQ ID NO: 17801 - protein, 469 aa, Bacillus pumilus SAFR-032
MSKQQIGVVGLAVMGKNLALNIESRGFSVSVYNRSSSKTEEFLEESNGKNVVGTYSIEEFVQSLETPRKILLMVKAGAATDATIQSLLPHLEKGDILIDGGNTYYKDTQRRNQELAESGIHFIGTGVSGGEEGALKGPSIMPGGQKEAHELVKPILEAISAKVDGEPCTTYIGPDGAGHYVKMVHNGIEYGDMQLISESYFILKHVAGLSAEELHEVFSEWNKGELDSYLIEITADIFTKVDEETNQPLVDVILDKAGQKGTGKWTSQSSLDLGVPLPIITESVFARYISAMKDERVEASQLIEGPKPAQSAENKQELIEAVRKALFMSKICSYAQGFAQMKAASDEYNWDLKYGEIAMIFRGGCIIRAAFLQQIKEAYDRNPELKNLLLDPYFKDIAQSYQSSLRKVISLAVEQGVPVPSFSSALAYFDSYRTAVLPANLIQAQRDYFGAHTYERTDKEGIFHTEWMK

SEQ ID NO: 17802 - protein, 656 aa, Bdellovibrio bacteriovorus HD100
MAHLFEVGLDLPQAVRYQCTYGVFYLRPLPIPERSLMTPLTTVDNFESFGLSAPVMAAMADMGFTTPTPIQRQALPILLAGANDFIGLASTGTGKTAAFGIPLIENIDSTVKDTQALVLSPTRELALQVAEQLTLLGKKKGVRVVTIYGGASYRTQIDGIKRGAHIVVATPGRLVDFLEQKMIKLQSVKTVVLDEADEMLSMGFKEALETILSATQPDDSDSVRAACRTWLFSATMSSEVRRLTSTYLENPETVSVNKVGGTADTIEQVYYTVKNSYKTEVIGRLLQTLPEFYGIIFCQTKMEVAELADVLTQRGFPADSLHGDKSQQEREATLKKFKQRQVKVIVATDVAARGLDIKDLTHVVNHSLPWDSESYVHRIGRTGRNGQKGTAITLVNPEQLTLLRRVMQNTKAVLTKGVIPSADEVAGLKIKDVMDKVTSMDPEAVQLQLASDLIQDLIQAEDINFKELSKEELLARFIAAYFPNVFVKKDLMLDYMGDRVPRELLPRDPNDNRFTRGGRGNDRRDDRDDYRARRPFGGGRGASAPARGFRSEGARAEFSGGEQRAERTERPAFRDRPERTERPERAERPERSERAERAERSERSYRASASSDRPARAERSERSERPQRAETDRPERRGDHPGIKRFRGPKRQFREQ

SEQ ID NO: 17803 - protein, 399 aa, Chlamydomonas reinhardtii
MQRLHDSCVVMLSQDSFYRCLTDEERQNVGAFNFDHPSAFDVPLLMKTLQDLREGKSAEVPIYDFAKHSRSEETHTTGPADVIVVEGILVLAMQEVREMCNMKIFVDTDDDLRLARRIQRDVAHRGRDVASVLKQYTEHVKPMFDMYVAPSRRHADVIIPWGNRDNNLVAIDLIVEHIRTKLQQPDLCRVFPNFQIIPSNFQIQGMHTIIRDRETSKEDFVFYADRLNRLVVEAGLGFLPFTERSVITPTGNAYSGVGFARKLCGVSIIRSGEAMEAALRACCKGIKLGKILVHRHRDSSDVIYEKLPSDIADRHVMLLDPLLTTGGTAVKAIQILKDRGVPEDRILFLTIIAAPEGVHRVCSSFPGVKLLTSEVDEYVDKNYMLVPGAGSYGDRYFCE

SEQ ID NO: 17804 - protein, 428 aa, Oryza sativa Japonica Group
MMYMGTPRDYEFYVATRVMMRSLGRLGSDADRVVIASVDVPPRWVQALKDDGVKVVSVENLKNPYEKQGNFNMRFKLTLNKLYAWSLVSYDRVVMLDSDNIFLQNTDELFQCGQFCAVFINPCIFHTGLFVLQPSMDVFKNMLHELAVGRDNPDGADQGFLASYFPDLLDRPMFHPPVNGTKLEGTYRLPLGYQMDASYYYLKLRWSIPCGPNSVITFPSAPWFKPWYWWSWPVLPLGLSWHEQRRENLGYSSELPVVLIQALFYIGVIAVTRLARPSLSKMCYNRRMEKSTIVLLTTLRVVAAWSILAAYTIPFFLIPRTVHPLLGWPLYLLGAFSFSSIVINVFLLHPLAVLTTWLGIIGALFVMAFPWYLNGVVRALAVFAYAFCCAPLIWGSLVKTMSSLQILIERDAFRLGEPNQTAEFTKLY

SEQ ID NO: 17805 - protein, 489 aa, Bacillus pumilus SAFR-032
MAMNESFNDLAKWREKAFMGGGEKRAAAHRNKGKLSVRERLHELLDGGSFMEIQAFATGCMSEHVGDGVVTGTGLIHGRPVCVYAQDATVHGGSLGEIHAKKIVSLMDLAAKNQIPIIGLKDSGGARIQEGVVSLEGYGQIFKRNVLYSGQIPQISVILGSCAGGAVYSPALTDFVFMTEQTAHMFLTGPKVIEKATGETVCPDRLGGASVQHQTSGNVHYTGKDEKDVLKAVRTLLTYIPTKQQTVTDAETSKRDADDPGNILPKNPSRTYDVKQVVTAIIDSDSFFETQPCFSKNIVTGFARLQGASIGVVANQPKVLAGSLDLDAADKAARFIRFCDAFHIPILTLVDVPGFLPGEKAEHAGIIRHGAKLLYAYAEATVPKITVILRKAFGGAYVAMNSKGLGADFVYAWPAAEIDVMGKTFADEIVHPASREVETEPSVLKAAQAGLIDDIFMPSETRERLIRSFDLLRRKEEDRPLKKHGNMPL

SEQ ID NO: 17806 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPGLTDMVIFRENSEDIYAGIEWEADSADAEKVIKFLREKMGVKKIRFPEHCGIGIKPCSKEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLV

SEQ ID NO: 17807 - protein, 580 aa, Debaryomyces hansenii CBS767
MSSSPAANEYDALEVIGKGSYGTVRKVQEKSSGEIFVRKEIEYNSMNNQERNQLISELRILRELNHPNIVKYFRHDHIMQKKSIHIYMEYCDGGDLAQVISNFRKNKEMVPEEFIWQVLVQTLLALHRCHYGIDAKKVNLFSNPVDDKEPTIDSETVVIHRDIKPDNIFMLNSGKSIKLGDFGLAKMLTSQNDFAKTYVGTPYYMSPEVLMDNPYSPVCDIWSLGCVLFELCTLQPPFQAKTHLQLQSKIKQGIIPDLPGIYSSQLRSIIKECITVDPELRPSCYDLLETLSIRFLRKEMELKEINTNLNEFQKQLLTKNDELKKKESLLNNIERKIFAQREDLENEYNNMQKKCNSQKKQLEEELIEEFEMRKKSMDQEAKEVRLGYQREFKMVVEHEVQLRLKDILGKQKHQQQQQQQQQHLQQHQQQHQHQNQHQHPQYQQPQPYQELSRKKSDPLSSPSPSKATTRNTLYLANHYAAPNEHVVLPNKPKGPKELQLDDQSKLLSPQLTRRIPLKTRNSENSDYDSNGYYSDQYKSSPTRFLGNNYKKRVTDELERLSLEKRNIPEFEELYIRKNRH

SEQ ID NO: 17808 - protein, 218 aa, Methylococcus capsulatus str. Bath
MTQDELKRKVAEAALDYVKDVTILGVGTGSTVNHFIDLLADLKGGIEGAVSSSQASSERLKKIGIPVLDLNAAGTLDVYVDGADEVNAAKQMIKGGGAALTREKIVAEASRKFVCIVDETKCVDVLGKFPLPVEVIPMARSLVARRLVELGGTPVWRENCITDNGNVILDVHNLTITDPVELERRINDIPGVVCNGVFALRPADVVLIGSPSGVRTLP

SEQ ID NO: 17809 - protein, 461 aa, Neptuniibacter caesariensis
MNISLSKGQISAIILLPLCILSLLLGPAADYLNQQQLTAACLILGAIVLYATSAIPEHVTALIFMAVAMLLAVAPAETVFSGFYSTACWLIFAGLIIGIAINETGLAQRIAAGFSNHLDSSYLKLISGIVIMATLLGFLMPSSMGRAVLFIPIAMAVADRCGFKTGSNGQIGVALAAAFGCHVPTFAVLPANVPNMVMIGAAETIHNWTPLYAEYLFLHFPILGLLKGILIISLILWLYPDSPKRNHEATEQSRMSFNEYKLLFIVLITLGFWLTDSFHHISAAWIGLTAACVLLLPGIGLVSSKSLNNKFNIGSLIFVVGILGLGTLINHSGLGALAGDHLNNWLPLAPGEDLSNFISLAMTAFTTGIVTTLPGVSAVLTPFAEQLADKSGFSLQAVLMTQVLGFSTILFPFQSAPLMVGMQIAKVPIKHAAKLCFVLTPLTLFILFPLDYLWWQLLGWI

SEQ ID NO: 17810 - protein, 200 aa, Rickettsia prowazekii str. Madrid E
MSVFVGKTAPDFTAKAIMPNNNIDDKFKLSDYAAGDNIVLFFYPLDFTFVCPSEIIAFHNKLGEFTERRTKVIAVSVDSHFSHLAWKNTPHNKGGLGQVQFPMVSDITKDISSKYNVLNEDGIALRGTFLIDKDFIVRHMLVNDLPIGRDINYTLKVIDALTHHQKHGEVCPAGWHKGEEAITPSHEGIAHYLSSHAEKL

SEQ ID NO: 17811 - protein, 408 aa, Arabidopsis thaliana
MVAKPLYGVLSDVLYIGGARRVPYISVGVLLQGLAWGSLAIFPGAREVLPSLMAFILLSNLGASITEVSQDALVAEYGLRYQINGLQSYALMASAVGGILGNLLGGYCLLKTPPRILFLAFTALLSLQLIVSLSSKEESVNLPRIGEVTPEISSVLGIVKKQFLDLKGIVQVDEISQPLIWIVSSIALVPLLSGSVFCYQTQVLNLDPSVIGMSKVIGQLMLLCLTVVYDRYWKKLPMRALIHIVQLLYAFSLLFDYILVKQINLAFGISNTAFVLCFSSVAEILAQFKILPFSVLLANMCPGGCEGSITSFLASTLCLSSVVSGFTGVGMANMIGITSKNYSNLPAGILIQSLAALVPLWFIHYVPMLEPGFEREGKRAMSKKSRRNRRVGRVIGQESFAYRRERET

SEQ ID NO: 17812 - protein, 230 aa, Legionella pneumophila str. Paris
MSISQNIKKVRELITQTELSSNRQPNSVLLLAVSKEQSSELIREAFQQGIRHFGENYFQEAQEKILALKDLPICWHFIGPIQSNKTKGIAKYFNWVHSIDRNKTAKLLNQFRSEQLPPINVCLQINLAGETTKSGIPPEHAIDLALEVKQLPNLQLRGLMTIPPPQNNMQTQYDLFLKLNQLMESINKTLHLKMDTLSMGMSDDLVPAIKAGSTIVRIGRAIFGERKGKL

SEQ ID NO: 17813 - protein, 262 aa, Legionella pneumophila str. Paris
MNISFIGYGNMAKAIARNLQKQNKYSLSAASPSLSVGISKENIRTHYDNKEVAKDADVIILAVKPTQMCEVINEINPFISSGCLLISVAAGLTLTWFAKYCKKGQAVVRTMPNTPAIVGFAATSMIANEFVNEKQKKWAEQLFSSIGITDWVKDEEDMDTLTALSGSGPAYVFLFLEAMINAGVQLGLEETTAKHFAIQTFAGSIQLAQHSQLSLTELRKKVTSPGGTTAAALEILHGDFDALIYSAMKAAKQKAHELGKVE

SEQ ID NO: 17814 - protein, 387 aa, Vitis vinifera
MFIMSFFSQYVFIKLYKGHENKVGSIGFVFLVLFIMLVKFVYLIDAFCEIKLVAWVWFLCVCVAGGCSFWPFSLYCIRSCVNNSDTVSIGTAEKGSFDGKLTTSSNPDVKDIDSDDKDPQLCSLYAPEIYNNLHVAELNRRPCSNFMETVQRDITQSMRGILVDWLVEASEEYKLVPDTLYLTVHLIDWFLSQNYIERQKLQLLGITCMLIASKYEEICAPRVEEFCCITDNTYSRGEVVKMESQVLNYFGFKIFAPTAKTFLRRFLRAAQASYKNPSLELEYLGNYLAELTLIDYGCLKYLPSIIAASAVFLARWTLDQSGHPWNPTLEHYTRYKASDLKTAVFALQDLQLNTSGCPLNAIRGKYRQNKFKSVASLSSPKLLQTLF

SEQ ID NO: 17815 - protein, 543 aa, Bdellovibrio bacteriovorus HD100
MIHLSNITKQQGNKVLYRNGSFQINAGEKIGLVGPNGAGKTTIFRIIMGEEGIDGGTISKSDRTVIGYFSQNIEEMKGKSALEEVKSAVGNIGDMQVRMQECEAKLADPDLDPDEMMKILEVYGELQGEFERLGGYDLESRAAEILTGLGIGPDDYHRPSESFSGGWKMRIALAKILALNPEVLLMDEPTNHLDVESIVWLEEWLVNFKGAILMTSHDRDFMNRLVGKIVEIANKTITVYGGNYDFYEKERDIRKEQLIAAAKRQEDMLAKEEEFIARFAARASHAAQVQSRVKKLEKIDRIEIPDEEAEIKFEWPVPPRGGDEVVKLEGLSKIWKRDDGKEKLVFSGANALVKRLDRIAVVGVNGAGKSTLLKIIAGHADATEGKMTLGASINLGYFSQNSLDVLDPKMTIVDEVHSRIPNAGMGTVRSLLGAFKFSGEEAEKKISILSGGEKSRVVLACILAQPVNLLILDEPTNHLDIKSRELLLDAIKNFPGTVMIVSHDRHFLREVTTRVFEVDKNQIRIYDGDYEYYQLKKQQEQMA

SEQ ID NO: 17816 - protein, 347 aa, Rhodococcus sp. RHA1
MAGTMRAQRFHADTKTIAVEDVPIPEPGPGEVLVKVEFCGICHSDLSLIDGTFPTLLPEVTQGHEASGTIAKLGAGVTGWSEGDRVVPSAGRPCFGCRNCRRGDLTNCLNIQLMAFAYDGAWAEYTVAQAGGLTRIPDNVPFEQAAILADAVSTPFGAVVRTGKVVVGETVGVWGVGGVGTHIVQLARLVGAVPVIAFDINPAVRERALELGADYAFDSRDENLKEKVAEATGGRMLDVAFDAAGLKVTFEQALDCLTVGGRLVAVGLSAQEASVGTTAQFGLSQKQVLGHLGYKNVDIETLAELVSRGRLDLSRSISEIVPLEDVAKGIEKLANHEGDPIRILVKP

SEQ ID NO: 17817 - protein, 560 aa, Dehalococcoides sp. BAV1
MMSEMNNKQSAESLRVSTTGDIEVSTYLEIAREKSGAKSECIDSGEETLRESIVIFDFGSQYSLLIARRIREMHVYCELVSHDTPWEKIAHLNPRGFILSGGPSSVYEPEAPLAPAYIFESKLPVLGICYGMQAITQQLGGVVEHSDKREYGHALLHSNVINTELLADMPEPSPVWMSHGDRIEKLPAGFKSLAYTENCPVAVMGNESDIYGLQFHPEVVHSPHGKIILKNFVFNICKCHANWTMGNYIQESIQNIREQVGDGQVICALSGGVDSAVVASLIHKAIGDQLTCIYVNNGLLRREEADRTLHVFKNHMGMKIIYVDAIDRFLESLGGITDPEQKRKVIGSEFIKVFEDEACKLGQIDFLAQGTLYPDVIESVSSVSKASAKIKSHHNVGGLPAHMKLKLIEPLRYLFKDEVRLLGKELGLPDEMIWRQPFPGPGLAIRIIGEVTREKLEILRSADWIVMSEIKKAKMYHQVWQSFAILTDVKSVGVMGDFRTYGYLVAIRAVTSEDAMTADWAKLPYDLLSIISNRIVNEVKEVNRVVYDISSKPPSTIEWE

SEQ ID NO: 17818 - protein, 321 aa, Malus x domestica
ILPFKLPAIGLNDVQIRIKAVGICGSDVHYLKNMKLADFEVKEPMVIGHECAGIVEKVGSDVKHLVSGDRVAVEPGISCSRCQQCKGGRYNLCPDMKFFATPPVHGSLANQIVHPADLCFKLPENVSLEEGAMCEPLSVGVHACRRANVGPETTVLIVGAGPIGLVSVLAARAFGAPRIVIVDMDDKRLAVAKSLGADGTVKVSAKMEDLDDEVAKIKETMGAEVDVTFDCVGFNKTMSTGLNATRPGGKVCLVGMGHSMMTVPLTPAAAREVDVVGVFRYKNTWPLCLEFLRSGKIDVKPLITHRFGFTEKEVEEASLEF

SEQ ID NO: 17819 - protein, 488 aa, Oryza sativa
MGENVVGTYYYPPSAAAMDGVELGHAAAGSKLFDDDGRPRRNGTMWTASAHIITAVIGSGVLSLGWAIAQLGWVAGPAVMVLFSLVTYYTSSLLSDCYRSGDPVTGKRNYTYMDAVNANLSGFKVKICGFLQYANIVGVAIGYTIAASISMLAIGRANCFHRKGHGDPCNVSSVPYMIVFGVAEVFFSQIPDFDQISWLSMLAAVMSFTYSVIGLSLGTVQVVANGGLKGSLTGISIGVVTPMDKVWRSLQAFGDIAFAYSYSLILIEIQDTIRAPPPSESAVMKRATVVSVAVTTVFYMLCGSMGYAAFGDDAPGNLLTGFGFYEPFWLLDIANAAIVVHLVGAYQVFCQPLFAFVEKWAAQRWPESPYITGEVELRLSPSSRRCRVNLFRSTWRTAFVVATTVVSMLLPFFNDVVGFLGALGFWPLTVYFPVEMYVVQKKVPRWSTRWVCLQMLSVGCLVISIAAAAGSIAGVMSDLKVYRPFKGY

SEQ ID NO: 17820 - protein, 493 aa, Mesorhizobium sp. BNC1
MSTSARNRFPGVSFDPKALRSNLFIGGAWKEGATGNRIPVYDPSTGTVIAEVADAEVEDVMGAIDAAHEALPGWAATPPRHRSEVLRRCFELMIENRDMLAELISLENGKTLADAQGEVAYAAEFFRWFAEETVRLNGELYKAPSGANRILVQHQPIGVSVLVTPWNFPAAMATRKIGPALAAGCTVILKPATETPLTAYALAALCAEAGVPDGVVNVYTSSRSGKTVSAMLHDPRVRKLSFTGSTEVGRILLREAADKVISCSMELGGNAPFIVFDDADLSAALDGAMVAKMRNGGEACTAANRFYVQSGIADAFAKGLAERMKALAIGKGYETGSQCGPLINKDAVERISGLVEEAQSRGARVLAGGKALNREGYYFPPTVIDNVDPASAIMSEEIFGPVAPIIRFDSEDEVLSAANGTEYGLMAYVYTQDLSKGLRVSEKIESGMVGLNRGLVSDPAAPFGGVKQSGLGREGSHHGILEFTETKYIATNW

SEQ ID NO: 17821 - protein, 415 aa, Chlamydomonas reinhardtii
MSLLSAGRVLLDAVAQPGTSSDVLSPQELFAKAENTQALRIASIFVILAAGVLGGVPPLFLNIFRDQEGMLTLLVRSFAAGIILALPLVHIIPGKQGCGARAVEDMVGLGGIEYPLGGVCVLFGVALMVFLEHLAHIIMHGPHSHASAADSAAAAFPMLPSSGTDVEVGATACGAAKRASAQTSSNCEAADPSCGVLGDSSSVPMKPAMAVVVAEGKAAGEPGHSHVCVSRGSAGNWFSSTFPTNTQAASGSLRLKILAYMFELGCVFHSIIIGISLGVNTTGLVEVRALLIALSFHQFLEGISLASVLLRSGFSTRKGVTMILIYSLTCPVGIAVGMAIASSYDAESEAARAVQGTLNGVSGGMLLYISLVQLVAEDMGRFVPGSRSGGASARLLSFLALFLGASSMCILAIWA

SEQ ID NO: 17822 - protein, 408 aa, Rhodococcus sp. RHA1
MCNPRRHTDYAAVMPATPRNRTVQRLQPFASTIFAEMTALAVRHHAINLGQGFPDTDGPASMLDTARRAIADGLNQYPPGPGMPVLRQAVAADRLARYGLDHDPDSEVLVTVGATEAISAAILGLVEPGEEVVLIEPYYDSYAASVALAGAVRRSVPLARSGTKFVVDLDALRAAITPKTRMLVINTPHNPTGTVFTPEEIAAVAEVACEHDLLVLSDEVYEHLVFDGRTHTALATLPGMYERTVSVSSAAKTFNVTGWKIGWACGPAELIDAVRTAKQYMSFVGGGPFQPAVAHALSHEQQWVKELRDSLQAKRDVLYDALVASGLEVHSGGGTYYLCADITAIGERDGIDFCRRLPERIGVAAVPVSVFTDHPVPWNPLVRFAFCKQDHVLEEAARRLRTLGEPGS

SEQ ID NO: 17823 - protein, 313 aa, Arabidopsis thaliana
MSYSTIISNTSFLSLASKFTTRGSRLQCTVSMARSAVDETSDSGAFQRTASTFRNFVSKDSNSQFPAESGRYHLYISYACPWASRCLSYLKIKGLDDAISFSSVKPIWGRTKETDEHMGWVFPGSDTEVPGADPDHLNGAKSVRELYEIASPNYTGKYTVPVLWDKKLKTVVNNESAEIIRMFNTEFNHIAGNPDLDLYPSHLQAKIDETNEWIYNGINNGVYRCGFAKKQGPYEEAVEQVYEALDRCEEILGKHRYICGNTLTETDIRLFVTLIRFDEVSLCSPLQMQQETHKGVSEFVQLHERHFPDPRYE

SEQ ID NO: 17824 - protein, 505 aa, Limnanthes douglasii
MSETKPEKPLIATVKNTLPDLKLSINLKHVKLGYHYLITHGMYLCLPPLALVLFAQISTLSLKDFNDIWEQLQFNLISVVVSSTLLVSLLILYFMTRPRPVYLMDFACYKPDETRKSTREHFMKCGESLGSFTEDNIDFQRKLVARSGLGDATYLPEAIGTIPAHPSMKAARREAELVMFGAIDQLLEKTKVNPKDIGILVVNCSLFSPTPSLSSMIVNHYKLRGNIISYNLGGMGCSAGLISVDLAKRLLETNPNTYALVMSTENITLNWYMGNDRSKLVSNCLFRMGGAAVLLSNKTSDKKRSKYQLVTTVRSHKGADDNCYGCIFQEEDSNGKIGVSLSKNLMAVAGDALKTNITTLGPLVLPMSEQLLFFATLVARKVFKKKIKPYIPDFKLAFDHFCIHAGGRAVLDELEKNLQLSSWHLEPSRMTLYRFGNTSSSSLWYELAYSEAKGRIRKGERVWQIGFGSGFKCNSAVWKALKSVDPKKEKNPWMDEIHQFPVAVV

SEQ ID NO: 17825 - protein, 483 aa, Xanthobacter autotrophicus Py2
MTTSSTVTSKSASGKIVPVILAGGSGTRLWPLSRNSLPKQFLPLATENTMFQDTLLRAAPGAVFADPVVVANEEFRFFAQRQARAVGIDATVMLEPARRDSAPALIAAAVWVAETYGPETLVLALASDHVVLDPAGFVKTVEIGAEAARLGRIVTFGIEPTEPRTSYGYIRLGAQIDERGSYEVDSFVEKPDRATAERYVAAGYLWNSGNFLFPAGLLLKEADVFEPAIADAARAAVAEAKSDLGFLRLDPAAFKSSPSKSIDFAVLERTRHAAVVRGSFGWSDVGSWDALHEIGNQDERGNVTVGTVQLLDSSNSFVRSDGPLVTAIGLDGVSVIATEDAVLVMPSNRSQDVKALVSALKDSNRKEVEEHLTIHRPWGTYQTVCKGDRFQVKKIVVEPGGILSLQKHHHRAEHWVVVRGTAEVTVADRSYMVHENESTYIPIGSVHRLGNPGRIPLELIEVQTGSYLGEDDIHRFEDIYQRA

SEQ ID NO: 17826 - protein, 438 aa, Xanthobacter autotrophicus Py2
MRVTMIGAGYVGLVSGACFADFGHTVTCVDTHEGKIAALKRGEIPIFEPGLDDLVASNVKAERLFFTTSLAEGVADAEAVFIAVGTPSRRGDGHADLSYVHQAARDIASAMTGYTVIVTKSTVPVGTGDEVERIIRETRPDAEFSVVSNPEFLREGAAIIDFKRPDRIVVGTDEERAKEVMTNLYRPLFLNQSPLLFTSRRTAELIKYAANAFLATKITFINEISDLCEKVGGNVQDVARGIGLDNRIGSKFLHAGPGYGGSCFPKDTLALIKTAQDYDAPIRIVETVVSVNDQRKRAMARKVITALGGSVRGKTVGVLGLTFKPNTDDMRDAPSIAIITALQDAGATIRAHDPEGVEQAKMVLSNVDYVDSPYQAADGADALVIVTEWDAFRALDLKRIQSMMAQPVVVDLRNIYRPEEMASLGFRYSSVGRGLADL

SEQ ID NO: 17827 - protein, 350 aa, Oryza sativa Japonica Group
MASKILVFLLAINLLFFTTANACGCACGKCPTPPPPALPPPPPPTPTTPSYHNKCPVNTLKFGACADVLGAISGEVGQVPAQPCCSLISGLADLEAAVCLCTAIKANVLGVVVNIPVKLSLLVNYCGKKFNKAIYLRRRRAGTVAVAISYHIISVTVEYQMLINKLEKTDGVIVGERRCSNPSGKKQQGGRVRSSSAQQMAPIRPKPLGSPKRCHHGLAGVKCGAATTRTQIGYNPQSSTVSGLSLRPLLQPPSRSRRLPRPQASVPLYAQRASSSLPLASRMARTGCSDIKTFSYADSQTQRCSLLPTVLPGRFAVSSVVREKAWSGLDAGEAFEQRKSSRLSDGMMEP

SEQ ID NO: 17828 - protein, 489 aa, Saccharomyces cerevisiae
MELLKLLCLILFLTLSYVAFAIIVPPLNFPKNIPTIPFYVVFLPVIFPIDQTELYDLYIRESMEKYGAVKFFFGSRWNILVSRSEYLAQIFKDEDTFAKSGNQKKIPYSALAAYTGDNVISAYGAVWRNYRNAVTNGLQHFDDAPIFKNAKILCTLIKNRLLEGQTSIPMGPLSQRMALDNISQVALGFDFGALTHEKNAFHEHLIRIKKQIFHPFFLTFPFLDVLPIPSRKKAFKDVVSFRELLVKRVQDELVNNYKFEQTTFAASDLIRAHNNEIIDYKQLTDNIVIILVAGHENPQLLFNSSLYLLAKYSNEWQEKLRKEVNGITDPKGLADLPLLNAFLFEVVRMYPPLSTIINRCTTKTCKLGAEIVIPKGVYVGYNNFGTSHDPKTWGTTADDFKPERWGSDIETIRKNWRMAKNRCAVTGFHGGRRACLGEKLALTEMRISLAEMLKQFRWSLDPEWEEKLTPAGPLCPLNLKLKFNENIME

SEQ ID NO: 17829 - protein, 159 aa, Zea mays
  misc_feature (50)..(50): Xaa can be any naturally occurring amino acid
  misc_feature (83)..(83): Xaa can be any naturally occurring amino acid
GSSLVEHDKLELATSVLIKGQENGVCLMLPFDLDDADKLGPDASSELSRXDHDLKLSDACMGLDLRPYPMSGLSCGLQSTQTXSWNGPMAALEFDRLADATSAMAKKLSQLSGTAFTTIVGGGDSIGAADIVGVCHSMTHISTGGCASLELLDGNELPR

SEQ ID NO: 17830 - protein, 563 aa, Bordetella bronchiseptica RB50
MPHSVACLDLRVIALLEAKRAGLLRRAHWLPNIVSGLIVGVVALPLAMAFAIASGAKPEQGLYTAIVAGLLVSLCGGSRVQIAGPTGAFIVILAGITAQHGVAGLQLATLMAGCILLALGAARLGAIIKYIPAPVIVGFTAGIGVIIWVGQWKDFFGLPSPAGTHFHEKLWQLVHSLPQLHLATTALAALSLALLLANNRLPYLRRVPGPLVALVVATTLQAVLGLDGVATIGSAFGGIPQGLPSWQWPEITVSRVIELIGPAFAIAMLGAIESLLSAVVADGMAGTRHDSNQELVGQGLANIVAPLFGGFAATGAIARTATNIRNGGTSPLAGVVHCITLLLMVLLLAPLAENVPLAALAAILFVVAWNMSDAPHFVRMIKRAPRADVAILLVTFVLTVFADLVVAVNIGVVIAILHFLRRMASSVQVQAQSPAELGDELGHRGYGPLPDDVLVYAVEGPLFFGAAENFERALAATHTDPRTLIIRLRWVPFIDITGLQALEEVITDLQRRGVRVILSGANPRVKAKLHRAGLVGLAGADNVFDRFEDAVLSCRAPAAPATA

SEQ ID NO: 17831 - protein, 554 aa, Pichia guilliermondii
MSYNQNYNQDFNNNSYGSYGNSYNNNSYGQNNYGGSYGGNSYGGGRGGSRGGFRGGRGGGFGGRRVDERVELTTPEWDLDSLPKFEKNFYSEHPDVSARSESEVQSFRKEHDMKCVGTDIPKPITSFDEAGFPDYVLNEVKQQGFPKPTAIQCQGWPMALSGRDMIGIAATGSGKTLSYCLPSIVHINAQPLLGPGDGPIVLVLAPTRELAVQIQQECSKFGASLRIRNTCIYGGAPKGQQIRDLARGVEICIATPGRLIDMLETGKTNLRRVTYLVLDEADRMLDMGFEPQIRKIVDQIRPDRQTLMWSATWPKEVQTLTRDYLNDPIQVTIGSLELAASHTITQIVEVLSEFEKRDRLVKHLETATADKEAKVLIFSSTKRACDEITSYLRADGWPALAIHGDKQQNERDWVLREFKTGKSPIMVATDVAARGIDVKGISYVINYDMPGNIEDYVHRIGRTGRAGTTGTAVSLFTEANSKLGGDLCKIMREANQTVPPELLRYDRRSFGSHIRYGRGGGRGGWGGRGRGGRGRGRGGFQSGSNGAPMGNRRF

SEQ ID NO: 17832 - protein, 334 aa, Saccharomyces cerevisiae YJM789
MKCTIPEQQKVILIDEIGGYDVIKYEDYPVPSISEEELLIKNKYTGVNYIESYFRKGIYPCEKPYVLGREASGTVVAKGKGVTNFEIGDQVAYISNSTFAQYSKISSQGPVMKLPKGTSDEELKLYAAGLLQVLTALSFTNEAYHVKKGDYVLLFAAAGGVGLILNQLLKMKGAHTIAVASTDEKLKIAKEYGAEYLINASKEDILRQVLKFTNGKGVDASFDSVGKDTFEISLAALKRKGVFVSFGNASGLIPPFSITRLSPKNITLVRPQLYGYIADPEEWKYYSDKFFGLVNSKKLNIKIYKTYPLRDYRTAAADIESRKTVGKLVLEIPQ

SEQ ID NO: 17833 - protein, 263 aa, Triticum aestivum
PTNFALDHHPCPSPPPTTSARRHRRPATASPDAPRAPPSAPCAAADSPRGPAPGGEATAAVSAVTASAKRDPRDCRVRRHTISVFVGDESGMINRIAGVFARRGYNIESLAVGLNKDKALFTIVVSGTDRVLKQVIEQLNKLVNVLNVEDLSKEPQVERELMLIKLNVEPDQRADVMFVANVFRAKVVDISENSLTLEVTGDPGKIVAAQRNLRKFGIEEICRTGKIGFEAIRNLALQTLPAMCNVYIPPYCTIAPFGIFGTN

SEQ ID NO: 17834 - protein, 452 aa, Mesorhizobium loti MAFF303099
MKTRVAVIGAGPSGLAQLRAFKSAADKGADIPEIVCFEKQSDWGGLWNYTWRTGLDEHGDPVHGSMYRYLWSNGPKECLEFADYTFEEHFGRPIGSYPPRAVLWDYIKGRVEKSGLRKWVRFNSPVRMVTFSDETKKFTVTAHDRTNDVTYSEEFDNVVVASGHFSVPNVPYFEGFATFNGRILHSHDFRDAMEFKGKDILIIGRSYSAEDIGSQCYKYGAKSITSSYRSKPMGFKWPDNWKEVPLLQKVVGKTAHFKDGTSKDVDAIILCTGYLHSFPFLTDDLKLKTANRMWPLDLYEGVVWEKNPKLSYIGMQDQFYTFNMFDAQAWFARDVIMGRIKLPSAKAMAEHSAKWRAREETLEDAEQMIWFQGDYTKELMDQTDYPGFDVEAVNQTFMEWEHHKAEDIMGFRDHAYRSLMTGTMAPLHHTPWLQALDDSMESYLEVKGVAAE

SEQ ID NO: 17835 - protein, 376 aa, Neptuniibacter caesariensis
MSEQMIKSRAAIAWGPNQPLSIEEVDVMPPQAGEVLVRIVATGVCHTDAFTLSGEDPEGIFPAILGHEGGGIVEAVGEGVTSLQVGDHVIPLYTPECGECKFCKSGKTNLCQKIRETQGKGLMPDGTTRFYKDGEPIYHYMGCSTFSEYTVLPEISLARVNKEAPLEEVCLLGCGVTTGMGAVMNTAKVEEGATVAIFGLGGIGLSAVIGATMAKASRILAIDINDSKFELAKQLGATDCINPKEFDKPIQEVIVEMTDGGVDYSFECIGNVDVMRSALECCHKGWGESVIIGVAGAGQEISTRPFQLVTGRVWRGTAFGGVKGRSELPEIVERYMAGEFKLNDFITHTMGLDKINEAFDLMHEGKSIRSVIHYDR

SEQ ID NO: 17836 - protein, 501 aa, Hordeum vulgare
MDRAIMPSALGSGLAGSVKLKYVKLGYQYLVNHFLTLLLVPVMAATALELARLGPDELLTLWRSLHLDLVHILCSAFLVVFVATVYFMSRPRPVFLVDYCCYKPSPSFRVPFTTFMEHIKLISNNDKSLRFQTRILERSGLGEETCLPPANHYIPPNPSMEASRAEAQLVIFNAIDDLVRRTGIKPKDIDILVVNCSLFSPTPSLSAMIINKYKLRSNIRSFNLSGMGCSAGLISIDLARDMLQVHPNSNALVISTEIITPNFYHGSRRDMLLPNCLFRMGAAAILLSNRRREARRAKYRLVHVVRTHKGADDRAYRCVYEEEDDEGHSGISLSKELMAIAGEALKSNITTMGPLVLPMSEQLLFFFRLVGRKVINKKWKPYIPDFKLAFEHFCIHAGGRAVIDELQKNLELSPRHVEASRMTLHRFGNTSSSSLWYELAYIEAKGRMRKGDRVWQIGFGSGFKCNSAVWKCLRTVNTPTDGPWDDCIQRYPVHIPEVVKL

SEQ ID NO: 17837 - protein, 416 aa, Solibacter usitatus Ellin6076
MSTLSSTPTAASFDVEKIREDFPVLKQKVHGKPLVYLDSAATAQKPLAVIDAIRRFHEVDCANIHRGVHELSQRSTAAYEETRAKAKRFLNARSKDELIFVRGTTEGINLVTSSWGRRNVKEGDEIIVSAMEHHSNIVPWQMLCLDTGANLRVIPMNERGELIMEEYEKLLNPRTKMVAVAHVSNALGTINPVRQIIEMAHNVGALTLIDGAQAVPHAKVDLQALDADFYTFSGHKIVGPTGIGILYGKTKLLNAMPPYQGGGDMIKVVTFEKTTYADLPYKFEAGTPNIAGGIGLGAALDYVTALGIEQIAAYEHQLLEYGTEQLSGIPGLRLIGTAKEKASVLSFVIEGIHPHDIGTILDKQGIAVRTGHHCAQPVMDFFNVPATTRASLAFYNTFGEIDALVGGLKKVKEIFS

SEQ ID NO: 17838 - protein, 509 aa, Methylococcus capsulatus str. Bath
MLQKYIEKILRARVYDVAQETPLDPAPGLSRRLDNTVLIKREDLQPVFSFKLRGAYNKIASLTPEARAAGVIAASAGNHAQGVALAAQRLGIRAVIVMPCTTPHIKVDAVRNRGGEVVLHGDAYDEAYEHALELARDQCLTFVHPYDDPEVIAGQGTIGMEILRQHQDAIHAIFVPVGGGGLIAGIAAYVKFVRPDIRVIGVEPVDSDCLHRALKAKRRVILKQVGLFADGVAVKQVGKEPFHLAHQWVDEVVTVDTDEICAAIKDIFDDTRSIAEPAGALGIAGLKKYVAETGIKNACLVAIESGANINFDRLRHVAERAEIGEKRELLLAVTIPERPGSFLEFCRVLGRRNITEFNYRFFDEKAAQVFVGLPVASGAIDRESLVREFERQGFGVLDLTGNELAIEHIRYMVGGHAPKLLDEQVYSFEFPERPGALLRFLSIMGGRWNISLFHYRNHGAAFGRVLMGIQVPKPERKAFREFLEAIGYAFKEETQNPAYRLFAGGSERG

SEQ ID NO: 17839 - protein, 197 aa, Physcomitrella patens subsp. patens
MESDDDESQADQEGPCVKFNEKELGPLVSLKEQLEKDKEDESLRRWKAQLLGVASEDAPDGFVEPEVNVLSLGVIAKGRPDSELPLPLGTNSRGYTFSLKEGSTVALRYSFTVRNNIVSGLTCMNTVWKAGLQVDQTRDMMGTFAPQQEAYVHVTEEEVTPSGPLARGAYTARKRFIDDDGRVHLDLEYSFEIRKEW

SEQ ID NO: 17840 - protein, 370 aa, Legionella pneumophila str. Paris
MINKSAILALADGTVYEGLSVGATGDSVGELVFNTSMTGYQEMLTDPSYARQIITLTTAHVGNTGCNMEDMESTKVWAAGLVMRNCTAIPSNYRAEQSFPDWLSKNGVVAISGIDTRALTLKLREKGSIGACISTNVEKPEIAVAKAKSFAGLQGADLALEVTRQTIERWHEGRGMWSLDKQPQQLHVVAYDFGVKHNILRILHDKGCHITIVPAKTSAEEVLAMNPNGVFLSNGPGDPQACDYAIKATQVFLDNNIPLFGICLGFQILALACGGITKKMKFGHHGSNHPVVETTGKKRVFITSQNHGFAVDEDSLPNCLEVTHRSLFDNSLQGIKHKTKPAFGFQGHPEASPGPHDIDILFNEFVNLMK

SEQ ID NO: 17841 - protein, 473 aa, Bacillus anthracis str. Ames
MMNQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTDTTEVDSL

SEQ ID NO: 17842 - protein, 309 aa, Bacillus anthracis str. Ames
MQCIETNNLQQLLEQVKPYTKKGKLATYIPELGNANPDDLGIAIFHKETEYIHAGNSQTLFTLQSISKVITLALALLDRGEEYVFSKVGMEPTGDPFNSIIKLETTSPSKPLNPMINAGALAITSMLAGKDNEEKMERILHFVREITDNPTINYSSKVANSELETAYLNRSLCYYMKQNGIIDCDIEELMDLYTRQCAVEVNCIDLARIGLIFAMDGYDPYKKKQIIPKHITKICKTFMVTCGMYNESGEFAIRVGIPAKSGVAGGIFGCVKGEMGIGIFGPALDANGNSIAGFKILELLSAQEGWSIF

SEQ ID NO: 17843 - protein, 410 aa, Arabidopsis thaliana
MGSVSLKIGDGTARFRRTSICSSAVNLLMLFSVVTTNLFALYAFSSHSQANSPLLHSSNNISLVSQHLSLILREIDSSQRKLAQMEKQMLGYESIDISRPNIVPELKLFLQRHQLPLGKDSRTGITEMVSSVGHSCGKSTDLLSQYMSYKVFDRCPDDWSLGQKLILRACEPLPRRRCLAKTVQKQDLSKSPDSLWRSVSNKSVNWSGLGCKSFDCLKGKKLSKECVGCFDLGVEKDRFVKVKGKNDFLIDDVLGLGSGKIRIGFDISGGSGTFAARMAEKNVTVITNTLNNGAPFSEFIAARGLFTLFLSLDHRFPFLDNVFDLIHASSGLDVEGKAEKLEFLMFDLDRVLKPRGLFWLDNFYCANDEKKKELTRMIERFGYKKLKWVIGEKADAQVYLSAVLQKPVRA

SEQ ID NO: 17844 - protein, 534 aa, Arabidopsis thaliana
METPTMKPDTVLILDYGSQYTHLITRRIRSLNVFSLVISGTSSLKSITSYNPRVVILSGGPHSVHALDAPSFPEGFIEWAESNGVSVLGICYGLQLIVQKLGGVVVEGESKEYGKMEIEVKGKSEIFGSESGGEKQMVWMSHGDEAVKLPEGFEVVAQSAQGAVAALESRKKKIYGLQYHPEVTHSPKGMETLRHFLFDVCGVSADWKMEDLMEEEIKVINKTVASDEHVICALSGGVDSTVAATLVHKAIGDRLHCIFVDNGLLRYKEQERVMDTFERDLHLPVTCVDASERFLSELKGVVDPETKRKIIGGEFINIFDQFAQELEKKHGKKPAFLVQGTLYPDVIESCPPPGTDRTHSHTIKSHHNVGGLPKDMKLKLIEPLKLLFKDEVRELGRILNVPVGFLKRHPFPGPGLAVRVLGDVTQGNALEVLRQVDEIFIQSIRDAGLYDSIWQAFAVFLPVRSVGVQGDKRTHSHVVALRAVTSQDGMTADWFNFEHKFLDDVSRKICNSVQGVNRVVLDITSKPPSTIEWE

SEQ ID NO: 17845 - protein, 183 aa, Coprinopsis cinerea okayama7#130
MIRFDALPPEVMQAMCTPMHQILAPAASPTSPGQFSGSLYLGSLAAVMDKELLRQHNITHIVHVLDAPWLPLSDNEGFNGYKISILDHDAEDLRPHLESACNHIDKALRGGKNVLVHCQQGVSRSASIVIAYLIRNHGMTFDNAHSLLKRKRPCVKPNPGFVKALQEWEAFWKRPNPMRRFTS

SEQ ID NO: 17846 - protein, 254 aa, Clostridium thermocellum ATCC 27405
MLNQFSRTEILFGKEAMKKLELATVAVFGIGGVGGYTVEALVRSGVGNFVLVDDDKVCLTNLNRQIIATRKTIGQYKVDVMKERILDINPKANVTVHRCFFLPENSDQFDFASYSYIVDAIDTVTAKIELVMKAKEFGVPIISAMGAGNKIDPTQLKVADIYKTSVCPLARVMRYELRKRGIKNLKVVYSTEEPRKPVEDIAISCRTNCVCPPGTERKCTDRRNIPGSTSFVPSVAGLIIAGEVIKDIIGDING

SEQ ID NO: 17847 - protein, 398 aa, Zymomonas mobilis subsp. mobilis ZM4
MNIYEYQAMALLNERGVSVVPGYMAANVEEAVKAAEQLSSPPYVIKSQILAGGRGKGYFRESPKEGGGVRLVSDIAAVKKQAESMLGRHLVTAQTDDQGIPVEKLLITEAVSIAREFYLSLLVDRQTGRVTFVASPEGGMDIETVAKEKPEAIHRIAIDPATGFQPHHGRMIGFALGLSGDVFKQGIKLAASLYKAFTTSDMSLLEINPLVETNDGKLLPVDAKISFDDNALFRHPDIAALGEAGASDPLEQEARQAGLSYIKLDGSIGCMVNGAGLAMGTMDIIQLHGEMPANFLDVGGGASKEKVAAAFRIILSDPSVKGILVNIFGGIMRCDILAEGIIAAARELDITVPLVVRLEGNNVNEGKAALVSSGLPIITASDLGDAAQKIVAAIRQTA

SEQ ID NO: 17848 - protein, 380 aa, Vitis vinifera
MSGTAGQVICCKAAVAWEAGKPLVIEEVEVAPPQAMEVRLKILYTSLCHTDVYFWEAKGQTPLFPRIFGHEAGGIVESVGEGVTDLKPGDHVLPIFTGECKDCAHCKSEESNLCDLLRINTDRGVMIHDGKSRFTIKGKPIYHFLGTSTFSEYTVVHVGCVAKINPLAPLDKVCVLSCGISTGLGATLNVAKPTKGSTVAVFGLGAVGLAAAEGARIAGASRIIGVDLNPKRYEGAKKFGVTDFVNPKDHEKSVQEVIVEMTGGGVDRSLECTGNVNAMISAFECVHDGWGVAVIVGVPNKDDVFKTHPINLLNERTLKGTFFGNYKPRSDIPAVVEKYMNKELEVEKFITHSVPFSEINKAFEYMLKGEGLRCIIHMEP

SEQ ID NO: 17849 - protein, 380 aa, Vitis vinifera
MSSTAGQVIRCKAAVAWEAGKPLVIEEVEVAPPQVMEVRLKILFTSLCHTDVYFWEAKGQTPLFPRIFGHEAGGIVESVGEGVTDLQPGDHVLPVFTGECKECRHCKSEESNMCDLLRINTDRGVMLSDNKSRFSINGKPVYHFVGTSTFSEYTVIHVGCVAKINPAAPLDKVCVLSCGISTGLGATLNVAKPSKGSSIAIFGLGAVGLAAAEGARIAGAARIIGIDLNPKRFNDAKKFGVTEFLNPKDHDKPIQEVIAEMTDGGVDRSVECTGNVNAMISAFECVHDGWGVAVLVGVPNKDDSFKTHPVNLLNERTLKGTFFGNYKPRSDLPSVVEKYMNKELEVEKFITHEVPFAEINKAFEYMLSGDGLRCIIRMDA

SEQ ID NO: 17850 - protein, 382 aa, Vitis vinifera
MSNTAGQVIKCKAAVSWEAGKPLVIEEVELAPPQANEVRIKILFTSLCHTDVYFWEAKGQKPAFPRIFGHEAAGVVESVGEGVTDLKPGDTVLPVFTGECKECRHCKSEESNMCDLLRINTDRTVMLSDGKSRFSAKGKPIYHFLGTSTFSEYTVAHVGSVAKINPAAPLDKVCVLSCGISTGLGAAINVAKPKKGSSVAVFGLGAVGLAAAEGARISGASRIIGVDLNASRFEQAKKFGVTEFVNPKDHDKPVQEVIAEMTDGGVDRSIECTGSVAAMISAFECVHDGWGVAVLVGVPNRDDSFKTHPINLLNERTLKGTFFGNFKPRTDLPRLVEKYVNKELDLQLEKFITHEVSFSDINKAFDYMLKGEGLRCIIRMGA

SEQ ID NO: 17851 - protein, 256 aa, Nocardia farcinica IFM 10152
MDKDSFRKLFDLSGRTAIVTGGTRGIGLAIAEGFACAGANLVVASRKPEACEQAAARLRELGAQAVGVPTHLGEIDSLRALVDTAVSAFGGIDIVVNNAANALAQPLATMAPEAVDKSFGVNVQGPLFLVQAALPHLRASAHAAVLNLGSVAALQFAPGLSMYAAGKAALLSFTRAMAAEFAADGIRVNAMAPGAVNTDMVRKNPPEFIAAMAQAPLLRRIAEPDEMVGAALLLCSDAGSFITGQTFLVDGGTVAR

SEQ ID NO: 17852 - protein, 487 aa, Nocardia farcinica IFM 10152
MTDREGALLATAPHQLFIGGEWVDATGGATFAVHDPATGEIVREVADATAEDAVRALDAAVAAQESWAATAPRTRGEILRRAWELVQERAEDLALLMTLEMGKPLAEARGEVTYGGEFLRWFSEEAVRIHGRYGLNPEGTGQMIVSQRPVGPCYFITPWNFPFAMATRKIAPALAAGCTVVVKPPQLTPLTTLFFTGLLAEAGLPAGVVNVVTSTSSRRVSAPIIADSRLRKLSFTGSTEVGRQLIAQAADNVLRVSMELGGNAPFVVFEDADLDKAVEGALAAKFRNIGQACTAANRFIVHEQVAEEFAARVTERVAAMKIGRGTEDGVTIGPLIDDDAVAKAHELVTDATARGAVVRTGGERIDGPGSFYRPTVLTGVTEGSAILREEIFGPVLAIATFTTEDEAVRLANNTEYGLVSYVYTRDLARGHRMIDKLETGMMGLNAGVVSNAAAPFGGVKQSGVGREGGFEGIHEFLSTKYTLIPTS

SEQ ID NO: 17853 - protein, 352 aa, Neurospora crassa
MSSAQRGGARKISFNVSEQYDIQDVVGEGAYGVVCSAVHKPSGQKVAIKKITPFDHSMFCLRTLREMKLLRYFNHENIISILDIQKPRSYETFNEVYLIQELMETDMHRVIRTQELSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPNTSELALDLLEKLLAFNPVKRITVEEALKHPYLEPYHDPDDEPTAPPIPEEFFDFDKHKDNLSKEQLKQLIYQEIMR

SEQ ID NO: 17854 - protein, 500 aa, Nocardia farcinica IFM 10152
MADSAGHHVPAELPDRIRHYIDGAFVDSVDGDTFDVLDPVTNETYVQAAAGKKADIDRAVAAARKAFTEGPWPKLLPRERSRVLHRIADLVESRDARLAELESFDSGLPITQALGQARRAAENFRFFADLIVAQSDDTYKVPGRQINYVNRKPIGVAGLITPWNTPFMLESWKLAPALATGNTVVLKPAEFTPLSASLWAGIFEEAGLPQGVFNLVNGLGEEAGDALVKHPEVPLISFTGESRTGQIIFANAAPHLKGLSMELGGKSPAVVFADADLDAAIDATIFGVFSLNGERCTAGSRILVQREIYDEFVERYAAQAERVKVGYPHDPATEVGALVHPEHYAKVTEYIEIGKSEARLVAGGDRPAEFPTGNFVRPTVFADVKPDARIFQEEIFGPVVAITPFDTEEEALELANGVKYGLAAYIWTNDLKRAHNFSQAVEAGMVWLNSNNVRDLRTPFGGVKASGLGHEGGYRSIDFYTDQQAVHITLGKVHNPTFGK

SEQ ID NO: 17855 - protein, 126 aa, Triticum aestivum
  misc_feature (36)..(36): Xaa can be any naturally occurring amino acid
  misc_feature (46)..(46): Xaa can be any naturally occurring amino acid
  misc_feature (96)..(96): Xaa can be any naturally occurring amino acid
  misc_feature (102)..(102): Xaa can be any naturally occurring amino acid
  misc_feature (108)..(108): Xaa can be any naturally occurring amino acid
  misc_feature (125)..(125): Xaa can be any naturally occurring amino acid
MAATTHAPSPSPSLSFLLSRPRSAAPQLRLRPAAHXRVRCATDAAXPAATNKPRRAADEDIREEAARHRAPANGFSAWYEPFPPGPGGAGTDERYXLDEIVXRSSSGXLLDVRHDMDALARQAGXY

SEQ ID NO: 17856 - protein, 422 aa, Legionella pneumophila str. Paris
MHIHKIQAREILDSRGNPTIEADVILTTGIIGRASVPSGASTGSREACELRDNDPKRYAGKGVQKAVKHVNNEINQALQGLSVEDQENLDRILCQLDNTENKSHLGANAILATSLACARARALSLNQPLYITLNQGDMMTMPVPMMNILNGGAHADNNVDIQEFMIMPIGAPDFPVALQMGTEIFHVLKSVLKKQGLNTAVGDEGGFAPNIQSNRQALDLLSEAIEKAGFRLGEDIVFALDVAASELFNEGFYHMYSENQKFDSHQLIEYYANLISSYPIVSIEDGLDEKDWSGWKQLTTHLGNKVQLVGDDLFVTNPKILREGIAQGIANAILIKVNQIGTLSETRQAIKLAYDNGYRCVMSHRSGETEDTFIADLAVASGCGQIKTGSLCRTDRTAKYNQLLRINELASLPYAGKNILKR

SEQ ID NO: 17857 - protein, 184 aa, Xanthobacter autotrophicus Py2
MGFWQTVKADMKAATGHSRLGRLPTVFLFNPPFAAVFLHRVAAHLYRSRLRRLGIAIWGWNVTRTSCHINLEAEIGPGLLLPHPAAIVIGSGVRIGTNVTIYQSVTLGRVASSPIYPAVEDGAVLYTGAVVIGPVTIGRSATIGASSVVIKDVPDGGVVVGNPGRVIRIATPTDALTAQAAARP

SEQ ID NO: 17858 - protein, 430 aa, Xylella fastidiosa 9a5c
MNFHSTRTTAPAATLSQAIAAGLAPDGGLYVPECLPSLGDLDHSADFINTATALLTPFFAGDPLEVHVPSICAEALDLPAPLLPLATPEDYVLELFHGPTAAFKDFGARFLAACLTRLRRDAERPLTILVATSGDTGAAVAAAFHRQPGLRVVVLYPDGRVSPRQAHQLGCFGDNVHTLRVAGVFDDCQAMVKQALNDTSLQTAVPLSSANSISLGRLLPQMSYYAHAALTHRASTGRPLNLIVPTGNLGNALAAILARALGVPLGQIVLATNANHVLPDYFSGAHYRPQPSVATLANAMDVGAPSNFERLRWLYRGDDAALRAAFTAYSVDDIAIRQTITARHRRYDEIFCPHTATAVFVLEHLRTQGVAGNWAVVATAHPAKFEQVVEPLIGTTVPVPAALDSLLQRPARDEPLAPEYPALRHMLLAT

SEQ ID NO: 17859 - protein, 315 aa, Legionella pneumophila str. Paris
MHWFAQAPANIALIKYMGKKDENSNLPDNSSLSYTLSNLLSSVKLEKLPTKKDIWEPLSIPGAPEFNLSVEAQKRFIDHLVRLKEYFGYVGGFLIQSSNNFPHSSGLASSASSFAALTKCASIALSELTQKPLPSIDEQAQLSRLGSGSSCRSFYAPWALWTGDKVSAIDLPYKDLLHQVIVISSQEKEIPSRVAHKLVKTSPFYETRSERAEANLKLLLNAFENKDWTSIYQICWHEFLDMHQLFKTCEKPFSYITDNTLHILSVIEKFWNEKGDGPVVTMDAGPNVHLLYRSDQTDLARQFKSDHLVGNYDVL

SEQ ID NO: 17860 - protein, 345 aa, Exiguobacterium sibiricum 255-15
MQNKTILITGIAGFIGFHAARRFMAEGYRVIGLDEVNDYYDPTLKEARLMELDPNRYTFYRVSLEDATAINRIFETEQIDLVLHLAAQAGVRYSIDRPDVYITSNIVGFLSILEACRHHPVEQLIYASSSSVYGSNTKMPFATTDAVDHPLSLYAASKKANELMAHTYSSLYGIKTTGLRFFSVYGPWGRPDMALFKFTEAIANGQPIDLYNYGEMGRDFTYVDDIIESIYRLMQTEPAADPAFDQENPLPDRSNVPYRVFNIGSHSPIRLNEFVSLIEERLGKKAIKHEMPLQAGDVPESFADVESLFETIGYRPQTTIEAGVHAFIDWYEQHYRLKEEVQDGA

SEQ ID NO: 17861 - protein, 828 aa, Xylella fastidiosa 9a5c
MSTVETPVYVPPTVVHKFGGTSVADADCYRHVARLLLAREETVQVTIVSAMKGVTDTLIALAEQAANHSPDWQALWQQTRTRHCDAAQALLGEHAGTLQNWLNTRFNELHEMLVALSVIRMLPSEVLDRLQGLGEVYSAQLLGQYLQAQGEDCVVLDARQVLVVSPGEFGAEVDWATSAQHLAHWRMQHPQRRVVVTGFVASDRTGRAITLGRNGSDYSGAIFAALFEADELHIWTDVDGVMSADPRVVPDAVQLDALSYDEACELAYFGAKVVHPQTMSPVMKRGVPIIIRNTFQPGHPGTRITADSVVSGSVKGLTLSPGLAVLNLEGTGLIGVPGTAERVFAALRNARLSVVMISQGSSEHSICCVVHQTEAERARDALLYAFAHELAIGHVQRVQLTNNISVLAAVGDGMAGHLGVAARLFESLRRAHVNILAIAQGSSERNISVAIDSQQATKALRAAHAAFWLSPQTFSIGVIGPGHVGEALLDQLCAAQQQLLSKANLDLRLRAIVSRRRMLLDERGLGSDWRHAFAAVPEAVDLDAFTAHLQAAHLPHAVIIDCSGSAEVADRYADWLAAGIHVVTPNKQAGSGPLHRYHAIRAAADASGARFRYEATVGAGLPVITTLRDLMDTGDSVTSIEGIFSGTLAWLFNKYDGSVPFSQLITQARAMGYTEPDPRDDLSGVDVARKLVILARDAGRDISLEDVAVESLVPETLCQLSVADFMARLNEVDATFAERLAAAKQRGCVLRYVAQLSPGHVPSVSLIELPSDHAFVNLRLTDNVVQFTTRRYSENPLVVQGPGAGPEVTAAGVFADLLRVAAGEGARL

SEQ ID NO: 17862 - protein, 511 aa, Burkholderia sp. 383
MSAIPKSDPSGSSANPPKLHRALKARHLTMIAIGGSIGTGLFVASGASISQAGPGGAMVAYMAIGLMVYFLMTSLGEMAAFMPVSGSFATYGAKYVDEGFGFALGWNYWYNWAVTIAVELVAAQLVMHYWFPDVPGVWWSAAFLGVMFLLNALTVRGFGEAEYWFALIKVVTVVAFIGVGLLMIFGILKGAPSNGWGNLTIGDAPFAGGLPALMGVAMIAGFSFQGTELIGVAAGESENPRTTIPRAVRQVFWRILLFYVFAIFVIGVLIPYTDPNLLKTDVTDIGVSPFTLVFRHAGLAFAAGVMNAVILTAVLSAGNSGMYASTRMLYNLATEGRAPKIFAKLSRGGVPRNALYATTAVGALCFFTSLYGDKTVYLWLLNTSGMTGFIAWLGIAVSHYRFRKGYVKQGYSLDQLPYQSKWFPFGPLFAFVLCLVIALGQDYQAFLANRIDWAGVAATYVGIPLFLVVWLGFRFLKKSRLVRYEDMEIAPWIAAGRGAQQQPVANRETAG

SEQ ID NO: 17863 - protein, 334 aa, Xanthobacter autotrophicus Py2
MRYLITGTAGFIGFHLAKRLLDEGHFVVGYDGMTKYYDVALKEKRHAILARSNGFKAVIAALEDKDALEKAAELAEPDVIVHLAAQAGVRYSLENPRSYIDSNLVGSFNVIDLASRFKPKHLLLASTSSVYGSNEKVPFAESDKADEPMTIYAATKKSMEVMAHSYSHLHKIPTTAFRFFTVYGPWGRPDMALFKFVDAIRNDRPIEIYGEGKMSRDFTYIDDLIEGIVRLIGVPPDEANRVTAEGVIDTLSHHAPFRIVNIGGGQPVALMRFVETIEESMGKPAVRKMLPMQQGDVPRTFAAPDLLVALTGFKPQIEIEVGVRRFAEWYQEHY

SEQ ID NO: 17864 - protein, 208 aa, Xanthobacter autotrophicus Py2
MSRAHLSQERKGMTVSETPLQKIKADLRHYASSERRGVSTAFVFRMFLLTPGFQFVFANRLQEIVVRIPLIGRLLRRIIWWATCLIFSSEIALAAKVGGGLYVPHPYGIVVGAATIGRNLRLLQNVTIGRKSSVDPRDPVIEDDVQISAGAVLLGPITIGEGAVVGANSVVLKDVPAGALAIGIPARIIPAAVPEVVAGADPLVASAL

SEQ ID NO: 17865 - protein, 620 aa, Saccharomyces cerevisiae YJM789
MLNGEDFVEHNDILSSPAKSRNVTPKRVDPHGERQLRRIHSSKKNLLERISLVDNERKNTSPDPALKPKTPSKAPRKRGRPRKIQEELTDRIKKDEKDTISSKKKRKLDKDTSGNVNEESKTSNNKQVMEKTGIKEKREREKIQIATTTYEDNVTPQTDDNFVSNSPEPPEPATPSKKSLTTNHDFTSPLKQIIMNNLKEYKDSTSPGKLTLSRNFTPTPVPKNKKLYQTSETKSASSFLDTFEGYFDQRKIVRTNAKSRHTMSMAPDVTREEFSLVSNFFNENFQKRPRQKLFEIQKKMFPQYWFELTQGFSLLFYGVGSKRNFLEEFAIDYLSPKIAYSQLAYENELQQNKPVNSIPCLILNGYNPSCNYRDVFKEITDLLVPAELTRSETKYWGNHVILQIQKMIDFYKNQPLDIKLILVVHNLDGPSIRKNTFQTMLSFLSVIRQIAIVASTDHIYAPLLWDNMKAQNYNFVFHDISNFEPSTVESTFQDVMKMGKSDTSSGAEGAKYVLQSLTVNSKKMYKLLIETQMQNMGNLSANTGPKRGTQRTGVELKLFNHLCAADFIASNEIALRSMLREFIEHKMANITKNNSGMEIIWVPYTYAELEKLLKTVLNTL

SEQ ID NO: 17866 - protein, 641 aa, Erythrobacter sp. NAP1
MSLSPSTPLLDTIPTPDELRKLKPEQLRQLADELRAEMIDAVSVSGGHLGSGLGVVELTVAIHYVFNTPDDKLIWDVGHQCYPHKIITGRRDRIRTIRQGGGLSGFTKRAESEYDPFGAAHSSTSISAALGFAIANKLNDKPGRGIAVIGDGAMSAGMAYEAMNNAAQAGNRLVVILNDNDMSIAPPVGGLSAYLARMVSSSEYLGLRSLASKAVKKMSRRLHDALGKAEEYSRGMVTGGTLFEELGFYYVGPIDGHNLDHLIPVLENVRDTSEGPVLIHVVTEKGKGYKPAEESADKYHGVPKFNVVTGEKQKGSAGAPAYQNVFGDTLADLADTDKRICAITAAMPSGTGVDRFAQRHPDRSFDVGIAEQHGVTFAAGLAAQGMRPFAAIYSTFLQRAYDQVVHDVAIQNLPVRFAIDRAGLVGADGCTHAGSFDITYLATLPNMVVMAAADEAELVHMTYTAVEYDEGPIAFRYPRGSGVGVPLPETPQKLEIGKGRLVREGSKVAILSLGARLEEAKKAADQLEAKGLSTTVADMRFAKPLDEDLIARLMRTHEVVVTIEEGAIGGLGAHVLTYATDEGLTDNGLKVRTMRLPDTFQDQDSPDKQYEEAGLSAPHIVDTVLKALKHNSTSIEEEARA

SEQ ID NO: 17867 - protein, 232 aa, Yarrowia lipolytica CLIB122
MAKRTAKPTAKSAKITAFPWPKSLLDNDPSKSYKVHTETILKDQIYVIHGFLPAKVCNDLVQTIVKTDADDTHTFKMETTPLTKRKDYAARVNDRGAVEDTGICNYLWHQLEPIIESDPELSEFKSAFGLNPNIRMYRYTPGQFFDQHYDEAVRCKVGSTVCTTRWTLLLYLSECQGGQTMFYEDGGKSYEVQPTNGSVLLHKHGEDCLLHEGREVTAGEKWILRSDIAWKN

SEQ ID NO: 17868 - protein, 258 aa, Bacillus licheniformis ATCC 14580
MGKTIVFKCGGSVIRELSDEFFQNLKDLTESGWKIALVHGGGPDITKMLKKLNIRTEFVNGQRKTTKAVLEVAEMVLSGSINKFFVAELTKHGLPAVGVSGKDGGLLLADYLNEKEYGQVGRIKKVNGQMAEALMEKGFIPVIAPLSMTDGCETLNVNADLAASAVAAALRADKLMFVTDVKGIMKNEEMLKELTPEDIESLIAEGVISGGMIPKVHSAKEALTDEVEEVMIVSGKGSFLTKDDFIGTKIIKQKEAVS

SEQ ID NO: 17869 - protein, 294 aa, Burkholderia thailandensis E264
MLKVTKAVFPVAGLGTRFLPATKASPKEMLPVVDKPLIQYAVEEAIAAGITEMIFVTGRSKRAIEDHFDKSYEIEAELEARGKEKLLELVRSIKPSHVDCFYVRQPEALGLGHAVLCAEKLVADNPFAVILADDLLDGDPPVMKQMVDVFDHYHSSVIGVEEIPPEDTKSYGIVDGKEWEDSIIKMSAIVEKPAPEVAPSNLGVVGRYVLKPRIFDHLRALKPGAGGELQLTDAIQALLADEQVLAYKYRGTRFDCGSKLGYLKATVEFALRHPEVKTEFEAYLRSRSETRHDA

SEQ ID NO: 17870 - protein, 385 aa, Bacillus licheniformis ATCC 14580
MSHLFQTYSRWNINIKKAKGTIVQDEKGNAYLDFVQGIAVCNLGHCPDSVTAALKKQLDDVWHVSNLFQNELQEKVAQLLAKNSAGDLVFFCNSGAEANEGAVKLARKHTKKTKIVTFQQSFHGRTYAGMAATGQEKIKHGFGPMLEGFHYLPYNEPKAFAELQDEKDIAAVMLEPIQGEGGVIPASREFLQSVQDFCRDKQALLIIDEVQTGIGRTGKAFGYEHEGLSPDIVTVAKGLGSGFPVGAVIGKKELSEAFSPGSHGTTFGGNMLAMAAANATLETIFDRSFLEEVSAKGAFLHQQLKDKLQFPLVKDIRGKGLIAGIECKEPVQPLIEALQKEGLLVLPAGPNVIRLLPPLTVAKSEIKAAVEKLKDVMANHSAVKQ

SEQ ID NO: 17871 - protein, 354 aa, Bacillus licheniformis ATCC 14580
MEGYLVLEDGTSFSGELDGLDGCTGEVVFFTGMTGYQEVLTDPSYKGQIIVFTYPLIGNYGINGSDAESKQPQVRGVVVYEACDRFSHHQATESLREYLAKWDVPLLSHVDTRAVVQHIRAKGTLNARLTKQKDDIPAPRQLENYAAQVSGQNENGAFGEGNTHIALIDFGYKKSIASSLANRGCKVTVVPYQEMDGIAKLNPDGIVLSNGPGDPKAILPYMDALRGIISSYPTLGICLGHQLIALAFGSDTYKLPFGHRGANHPVMDKETGRVFMTSQNHSYVVDRDTISENEFSVRFHHVNDGSVEGLMHKTLPVLSVQFHPEAHPGPAESEWIFGEYLQKLNEARREIAHA

SEQ ID NO: 17872 - protein, 399 aa, Neptuniibacter caesariensis
MFEGLHAVPQDPILAMLASYREDTHPQKIDLGIGVYKNDQGDTPIMRAVQVAEARLLATETTKSYTAPAGSPVYNERVAKLVFGSDHPVLNDKRVVSAQTPGGCGALRMAAEFLRGCNEDSKVWVSTPTWANHMPLLGGAGLEICMYPYYDHDNKNIDFQAMLDALESAVAGDIVLLHGCCHNPSGADLNKEQWHAIADLMERKGLIPFVDMAYQGLGAGIDEDAYGLRMLAARFPEMVAATSCSKNFGLYRERTGTLFIVAATPEQAANAGSQLFSKIRSHYSMPPSHGAAIVETILGDTELSQTWLDELAVMRNRIQGLRQSLVAKIRDSAIDRDFSFIEQQFGMFSFLGITSAQVEALRSQHSIYMIDSSRMNVAGLNDECMDYFVSALGEVLRAS

SEQ ID NO: 17873 - protein, 468 aa, Shewanella oneidensis MR-1
MSNDFQFIEVGRKDPTKHPAAKRSTQFIEIYQPFAQAQVSEQADRCLDCGNPYCEWKCPLHNYIPNWLKLAQQGRIMEAADLVHETNTLPEICGRVCPQDRLCEGACTLNADFGAVTIGNVEKYITDTAIAQGWRPDMSKVTPRKEKVAIVGAGPAGLGCADILARNGVKAVVFDKYPQIGGLLTYGIPAFKLDKAVMATRRTVLEGMGIEFKLGVTVGKDVAFNQLLEEYDAVFLGMGTYTAMKAGLEGEDAQGVYQALPYLIGNTHHLMGSTSPDMPYLNLAGKRVVVLGGGDTAMDCVRTAVRQGASSVICAYRRDEANMPGSRREVQNAREEGVNFLFNRQPVAIKTQDGKVLGVECVETQMGKADASGRQRAEAIVGSEQLLEADAVIIAFGFQPSPAPWFADYGIELDQWGRVKASKQADNPFQTTNPKVFAGGDMVRGSDLVVTAIAEGRDAAQGILNYLD

SEQ ID NO: 17874 - protein, 2576 aa, Bdellovibrio bacteriovorus HD100
MFKAGTYLKHISTALLALMLTSCMDASLSPLLSENQILRKITVESGKTVILEEGIGHQITLGVETPSVPGVTLKPEDLGWTLNDEDGDFEASNGTLLVQPGITSVSFIIKATRDAVIESDETFELRFTGERFEGLDNNVISFVVKDKTTRAKVTAAATLDFGPQMKDTVIERSVTFQNTGDAPAQGLTLGTLSAPFSFKGGSFPGNGGTCSSTLNGHTSCSVVITYSPTEVNTHSQTLTWNYTNPDIADNGSLGISGLGVEVAAVLGGRPANPSNVEDLDITVSGTNVTHYRYKVGPQGSTDCAVSSGYSTEAAVGAKITDDLAALANQNLKICVVGKDSNNFWQPFTAATTYNWNYDTIRPSVVISQKAGQTDPTNTLPMRFSLVFSEALAESSLTDADVSFTGSALVNTHTLTKIDSTHYELTVSGVDNNGVIQPIINADKFSDLAGNLNTVSTSSDNQVTYDTSAPSLPTSLSWIQTSPTKVTPAAAIWTLSDSTDIAEQKIQYYKDASCLLLEGTAISLSTSATTRNFAGADGETYTYNLTVIDTSGNVSVSACSTALTMDRTAPTVASFNPVTSVRSSLPASVTVTFSEAMLQSAVENATNWGISCSAGANVSIAGVSAASATSAVVNLTVTTLPANAEVCTLTAKTTLTDLAGNALSAAGTVQYTLDLPGTVVSVTSSLANGSYKAAQVVPVSVQFTENVTVAGGTPELLIETGSTDRVATYISGTGTNTLVFQYTVQAGDNSADLDYESVNALTLAGATLKDSFGNDMILTLPAPGAAGSLAANKNIVIDTQAPDAFVIAGVTGGTDSTQDEWLTNGSTGTVHWAAAAGSTQYLVEIRSSDASASVCAQQTVATTSHTFTGCTLSNGTQYTARISARDAVGNSTAATNNDFVFNVNTSAVIATITGQPTGKTNQTTLNIDVAGADVQTYRYKVGPAASTNCAVATDYSGDIAIATNITDSVNGLGNTDIKVCVIGKNSASVEQALTSATTATWTQDLAAPTLTINQKAGQADPTNAVPVEFTIVASEAIANFAVADITQSGTASGITWSLTTSDNITWSLKATAITGAGTLIPSITANKVTDAAGNNNTASTSTDNQITYETTKPSLTINQKAGQTDPTNTLPVEFTVVFTEAVNASTFTAADITQGGTASGITWNLSTSDNITWTLQATAITTAGTLIPSITAGKVSDPAGNTNNASTTTDSTVTYDITAPANATSLAWQQTSPTNTTSLVASWSKSTSTDLASQKVRFYTGASCDTYTGTENAATSSATTSNFTGVNGTTYTYQVISLDAAGNSITSVCSSAIVIDTTVPTVTTVTSNKANGAYTVGDVIDVRITFSENVTVTGTPLIALNTTPARSASYASGTGTNTLVFNYTVQATDTAADLNYAATTSLTVASATIRDAAANNATLTLPATGAAGSLGTNKNIVIDTTAPSITTFTVTNTTPTNSTTFNITSAVSGSPATYCIMENNTAVASCTWTAGASLPATFTVTTVNEAKTLYAWVKDAAGNVSAMASSASITFDNTPPTATLSGQPTGSSAKYALNIDVNGSDVVAYKYKLGVAGSTDCTVATGYSASEISSSTNITDNISALANGSIKVCVVGKDTAGNWQTYATATAVTWTKNSPAIQFSATTSSVSEYNDPTLTVAVSIPSAVDIAVSVSYTYSNGSAPSATMGSDYTATNGTATIAAGSTSVNISIPILDNSTEEYDETFKITLSGPVGGSLGANTVHTVTITDDEAPPLVTIQDVYVVEGSSTSLMATLSHPTDKGSVSINWTRDTCTGTDCATVGTDYTMPTTSGTASVASGATSVTFGSLTTINNAADELYKRIPIKITGITGGTSYISNADIFINDNDSPAGKDAVDVVAGDNHTCALTSNGNVYCWGHNGAAPLGQGHYYPSSSPLLVPLAAPAMGIASLYNNVCAVLNTGALYCWGQGSHGTYPGGGFTGTSSISTRLTPTLVTGMNSGVTQVSIGWGNSCAIQNGAVYCWGIKEGGILGDPATASPTTAPVAIPSLNSGVTKISSGQFHACAIKSGGLYCWGQNSNGEVGVGSTTLVGTPTAINGLGTVTDVWTGYYGTCAKNNSNQVYCWGNNSDNQLLSNTTADVTSPLLMAELAGATDIYFGIQFCAALSGDLHCKGRNYFGEAGINQPTGTSVIPLTPVVGGSGGVTAVAGSTGAHTCFVRSGQVYCTGFSGFGQHGDQQPLQSNAHVLSPKFSGASSISIFTEHACGIFSGAVKCLGDSYYSKTGNLLTDRIYQAPTQVKNLTSGATKLVSSSTGTCAVVSGGVQCWGRNFIRASGSTSGNPNIPAGLSSGATDLAMSFGSTVCAIKAGKLYCWGQVDIIPYLDLAVDFYYAPVEITAAGSNNVSVTLGRHHACVLKTDKTVWCTGYNAHGQLGQGDTTDRISLHQVPGLTNVDELQASSYGTCARIGTTSIKCWGQITGNGTNTNQKTPVDIGSFTNVTRLISGYTNHCAINNGAAYCWGFNRYDQHGLNDYQTNEYHFSPTALTTLNAIGTVTDLEVRGAYGICGKIGTNWYCSGIDTNSELGTNRKPFRLAPVSMGPFPN

SEQ ID NO: 17875 - protein, 286 aa, Streptococcus thermophilus CNRZ1066
MITLKSAREIEAMDRAGDFLASIHIGLRDLLKPGVDMWEVEEYVRRRCKEENVLPLQIGVEGSIMDYPYATCCSLNDEVAHAFPRHYILNDGDLLKVDMVLSEPIDKSVLDVSKLDFDNVAQVKKYTESYAGGLADSCWAYAIGTPSDEVKNLMEVTREAMYLGIEQALVGNRIGDIGAAIQEYAESRGYGVVRDLVGHGVGPTMHEEPMVPNYGVAGRGLRLKEGMVLTIEPMINTGTWEIDTDLETGWAHKTLDGGLSCQYEHQFVITKDGPVILTSQGEERTY

SEQ ID NO: 17876 - protein, 364 aa, Arabidopsis thaliana
MSDLSPDLVGEILTRVPMTSLISVRCTCKMWNALSKEGIFFKAARKQFMGFTMMDSRVCSMKFDLQGIRNNEHDFVDPCIKQIAKLDQIEVSKVLQCDGLLLCVGQTRFIKPRKRFNKLEWYALGYDNNHNYKILMNYDTGHLFGYEIYDFSSDSWRVLDVSPDCHIPFHQQSVSLNGNTYFLAQEKIIVEGEEEEVVDEIEKFLLCFDFTTERFGPRLPLPFHSDVLETVAISCVRDDQLAVLYQRFETWEIWVTTKIDPTAVSWSMFLSVDMEPPTGCQFDDEAGSFFIDEENKVAVFFNSDLFNPRVENRNRRYPTAYIIGQDGYFKSATLREAPDLVKPDPYVYCCPLVWSSYAPSLVQL

SEQ ID NO: 17877 - protein, 395 aa, Alkaliphilus metalliredigens QYMF
MAFSLAMIMVLGLVFSKLFTKVKLPGLLGMLVLGILLGPYGMDWLHEDLLTISGDLRKIALIIILLRAGLGIKRKTITKIGITAIKFSFIPVLFEGFAIMFLGSYILNISLIEAGILGFIIAAVSPAVIVPQMLDFIDQGKGQEKGIPTLILAGASIDDVVAITIFSAFLGMYGGANINITTQILSIPISIILGILMGLVVALGLIYLFSHYHLRDTKKVLIMLGAAITLTTLENALEGVVPMAGLLGVMAIGFIILEKTPSVAQRLSSKLNKIWVLAELVLFVLVGAAVNIYVALDAGFVGVIIISVGLLARSLGVYASLIGTNFNLKEKLFCIIAYIPKATVQAAIGAVPLAAGVEHGELILALAVLSIILTAPLGAIGIKIAGERFLDEEGT

SEQ ID NO: 17878 - protein, 301 aa, Zymomonas mobilis subsp. mobilis ZM4
MSATYAPDRILLEKAETLSEALPYIQRYAGKIFVVKYGGHAMGNPDAAQDFAEDIVLLKAIGIHPVVVHGGGPQIGKMLKALGVESQFIDGLRVTDNETAKIAEMVLSGAINKDIVSWIGRAGGRAVGISGKDAKLVEVEKVKKIRKNSTDGQDENIDLGFVGRPVSVDRRLIDTLTQSGMIPVVAPIGVGADGETYNINADTMAGALAAGLEAARLFLLTDVAGVLDADKKLLRTLTPSQIDSLTKADVISGGMIPKLETCIESVKSGVDAAVILDGRVPHSILIELFTEQGAGTLVKLD

SEQ ID NO: 17879 - protein, 616 aa, Arabidopsis thaliana
MSAIYLLRKISTKTPSRFHRSLFFSTFSKDSPPDLSRTTSIRHLSSSQRFVSSSIYCFPQSKILPNRFSEKTTGISVRQFSTSVETNLSDKSFERIHVQSDAILERIHKNEEEVETVSIGSEKVVREESEAEKEAWRILENAVVRYCGSPVGTVAANDPGDKMPLNYDQVFIRDFVPSALAFLLKGEGDIVRNFLLHTLQLQSWEKTVDCYSPGQGLMPASFKVRTVALDENTTEEVLDPDFGESAIGRVAPVDSGLWWIILLRAYGKITGDFSLQERIDVQTGIKLIMNLCLADGFDMFPTLLVTDGSCMIDRRMGIHGHPLEIQSLFYSALRCSREMLSVNDSSKDLVRAINNRLSALSFHIREYYWVDIKKINEIYRYKTEEYSTDATNKFNIYPEQIPPWLMDWIPEQGGYLLGNLQPAHMDFRFFTLGNFWSIVSSLATPKQNEAILNLIEAKWDDIIGNMPLKICYPALEYDDWRIITGSDPKNTPWSYHNSGSWPTLLWQFTLACMKMGRPELAEKALAVAEKRLLADRWPEYYDTRSGKFIGKQSRLYQTWTVAGFLTSKLLLANPEMASLLFWEEDYELLDICACGLRKSDRKKCSRVAAKTQILVR

SEQ ID NO: 17880 - protein, 376 aa, Sorghum bicolor
MASYTSTSGQFAVGKVAAANQDDETCMHALKLLGGLAVPFTIKAVIELGIMDLLLAADRAMTAEALTAALLCPAPAPAAAAAMVDRMLRFLASHGVVRCATESEELGSDDGKSCRRYAAAPVCKWFARGGGVESVVPMGFWMTSTTNMETWHNIKDGVLAGETPFDKAYGMPVFEYLGANGTMNTLFNEAMASHSMIITKRLLEVFRGFENYSVLVDVGGGNGTTMQMIRSQYENISGINYDLPHVIAQASPIEGVEHVAGNMFDNIPRGDAIILKWILHNWGDKECVKILKNCYTALPVNGTVIILEYILPETPEETLASQLAFDFDLGMMLFFGASGKERTEKELLELAREAGFSGDYTATYIFANVWAHEFTK

SEQ ID NO: 17881 - protein, 410 aa, Blumeria graminis
MSDMQGRKVFKVFNQDFVVDERYNVTKELGQGAYGIVCAATNISTQEGVAIKKVTNVFSKKILAKRALREIKLLQHFRGHRNITCLYDMDIPRPENFNETYLYEELMECDLAAIIRSGQPLTDAHFQSFIYQILCGLKYVHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHVLGTPNEETLARIGSPRAQEYVRNLPFMAKRPFAQIFPNANPDALDLLNRMLAFDPASRISVEEALEHPFLQIWHDVSDEPCCPTTFNFDFEVTDDVGEMRKMILDEVARFRHHVRVQPGMQSPSNDPSVPTLQTSVAWGSEDPRPQENNDQEITGLERDLTVGLDR

SEQ ID NO: 17882 - protein, 498 aa, Zymomonas mobilis subsp. mobilis ZM4
MIFGRVKPLDAILETAKKKSLHRSLGAFQLTMLGIGAIIGTGIFVLTAEAAQKAGPGMMLSFIIAACVCGVAAFCYAEMAAMVPVSGSAYTYSYAVMGELVAWMVGWALILEYAVAASAVSVGWSGYVVGLIEHLTGSHLPASVLVFTKGPFNGGIINLPAAFIALLIMSLLIRGTKESATASAILVVIKITALSLFIFLAIPAMKMENFHPFAPLGFSGISAAAASIFFAYVGFDAVSTAAEETKDPQRNMPIGLVGSLAICTLFYMLVSAGVIGGVGAQPVFDAAHQHALPAGSSEMAAACSTLKDSHVVCSNEALAWSLRKIGWNKVGNLIALAAGFALPSVILMMIFGQTRIFFVMSRDGLLPGFFAKVHPRFKTPYIVTVMTGLAVATFSAFFPVGILADISNAGTLFAFAMVAIAVLVLRHTDPKRHRPFKTPCVYLIAPLAALGCLYLFVSLPLMTLKMFFGWTVVGLVVYFLYGYRHSNIARNISDDEEA

SEQ ID NO: 17883 - protein, 374 aa, Sorghum bicolor
MVLISEDSRELLQAHVELWNQTYSFMKSVALAVALDLHIADAIHRRGGAATLSQILGEIGVRPCKLPGLHRIMRVLTVSGTFTIVQPSAETMSSESDGREPVYKLTTASSLLVSSESSATASLSPMLNHVLSPFRDSPLSMGLTAWFRHDEDEQAPGMCPFTLMYGTTLWEVCRRDDAINALFNNAMAADSNFLMQILLKEFSEVFLGIDSLVDVAGGVGGATMAIAAAFPCLKCTVLDLPHVVAKAPSSSIGNVQFVGGDMFESIPPANVVLLKWILHDWSNDECIKILKNCKQAIPSRDAGGKIIIIDVVVGSDSSDTKLLETQVIYDLHLMKIGGVERDEQEWKKIFLEAGFKDYKIMPILGLRSIIELYP

SEQ ID NO: 17884 - protein, 425 aa, Yarrowia lipolytica CLIB122
MDSRKLALLCSFLVASGCGTMYVYSAYAPQLATRLHFNASESQIIGLCGTVGVSLLGIAAGIIIDKYGTTTPIVLGGVFLMLGYSLITLCYIKSIESVLLCALALMAAGFGSGMSFVASIKVCALNYPENRGTASSIPLAAFGLSAFLFSTIAGIFFPGNTQGFLILLTVLTSSLSLVLVPFVRVIPAVSHAEDEALLDDGCSSSSCESVDIYGVSLFKSIDFWKHFLIIGCIAGCGQMYIYGCGYVIRALVGPDVETSGVQSFHVAMISLLSFCGRLLSGSISDVLTRYQYSRLWMIFISLALGLVGSFLATVVTEISFLWMVSLSFGLSYGFCYGVYPTIIAEMFGMTYFSQNWGYSGSSAVFSAYFFTTTFGKVFDSHSKGDVCYEGVNCYKSAFNMAFYVFAVFVVMILYMIHNNYQKFKQ

SEQ ID NO: 17885 - protein, 414 aa, Saccharomyces cerevisiae
MSEAQETHVEQLPESVVDAPVEEQHQEPPQAPDAPQEPQVPQESAPQESAPQEPPAPQEQNDVPPPSNAPIYEGEESHSVQDYQEAHQHHQPPEPQPYYPPPPPGEHMHGRPPMHHRQEGELSNTRLFVRPFPLDVQESELNEIFGPFGPMKEVKILNGFAFVEFEEAESAAKAIEEVHGKSFANQPLEVVYSKLPAKRYRITMKNLPEGCSWQDLKDLARENSLETTFSSVNTRDFDGTGALEFPSEEILVEALERLNNIEFRGSVITVERDDNPPPIRRSNRGGFRGRGGFRGGFRGGFRGGFSRGGFGGPRGGFGGPRGGYGGYSRGGYGGYSRGGYGGSRGGYDSPRGGYDSPRGGYSRGGYGGPRNDYGPPRGSYGGSRGGYDGPRGDYGPPRDAYRTRDAPRERSPTR

SEQ ID NO: 17886 - protein, 153 aa, Zea mays
  misc_feature (134)..(134): Xaa can be any naturally occurring amino acid
MSAANQLAALVSNMYATGLLDDQFQQLQLLQDPSAPDFVSEVVTLFCQDGERIIEELAKLLEKPNVDFDRVDAFVHQLKGSSANIGAQKVKNTCIQFREFCQQKSRDGCLKVLETMRINFYELRGKFQTMLQDXYMCSLMQLERQVNGFPPNK

SEQ ID NO: 17887 - protein, 316 aa, Bacillus licheniformis ATCC 14580
MSTVNIGATREINLSGKDFLSLKDFSKEEIVYLLKEAAAMKRNKIQDIFKGKTLAMIFEKSSTRTRVSFEAGMAQLGGNALFLSSKDMQLGRGETIADTAKVLSRYVDAIMIRTFEHEKVEELAKHAEIPVINGLTDLFHPCQALSDLLTIQEMKGTLKGLKAVYVGDGNNVAHSLLIGCAKVGCDITVASPKGYEPNQDVVKLAETFAEESGAAVTITNDPVSAVQQADVIYSDVFTSMGQEEEAEERMKIFAPYQVNGTLVSHAKPDYIFLHCLPAHREEEVTAEIIDGPNSAVFQQAENRLHVQKALLKALLS

SEQ ID NO: 17888 - protein, 181 aa, Saccharomyces cerevisiae
MSISESYAKEIKTAFRQFTDFPIEGEQFEDFLPIIGNPTLFQKLVHTFKTHLEEKFGKEKIDFIAGIEARGLLFGPSLALALGVGFVPIRRVGKLPGECASITFTKLDHEEIFEMQVEAIPFDSNVVVVDDVLATGGTAYAAGDLIRQVGAHILEYDFVLVLDSLHGEEKLSAPIFSILHS

SEQ ID NO: 17889 - protein, 531 aa, Campylobacter upsaliensis RM3195
MILLIDNYDSFVYNIKLMLERLSNDEIKVVRNDKISLGEIKTLNPSHIILSPGPKHPKDSGICLEIFKERLEIPVLGICLGHQALGLSFNAKIKRLQNIAHAKSSTLSTKKESILFKNLPKNFNIMRYHSLEVVELDENLEALAYSEDGILMAMQHANLPYFGIQFHPESYFSEYGLQIFSNFLNENKKEIKQDKNLNQYLHKLGENIALESEDFKNICEFIMSKEYEPLQIAALLILITEKSLNQKSLSAFVQNILRYSKTFSDESEMIDICGTGGDGFKSINVSTAVAFILASLGVKVAKHGNRAVSSSSGSSDVLEALQIPVPASLEEGLKLLEEKNLNFFHAPFFHPLVGELREIRSKLGIRTVFNVLGPLLHPNLKLKYQLMGNYHAPVHRLLAEVLKSLGRKHALVVRGNDGMDELSICDESKIIELKDNEIYEYNIAPEQFGFKRAFHSEILGSSPENNAKDLELILSAKLKGAKFDIVVLNAMFALYTANKAASPLQAKDVILEALNSGLVYEFFKAYQNDKA

SEQ ID NO: 17890 - protein, 183 aa, Halobacterium sp. NRC-1
MTHILVVDNHGQFTHLEHRLLRDMDGVTVDLTDNTTPPADIDADGLVLSGGPTMADIGHCREYLTLDVPILGVCLGHQLIADELGGRIEAGDYGGYADVTVSISDADDPLVGSLAPDTRVWASHADEVVAVPDGFTITAESDICGVEAMGDTDRDLYGVQWHPEVAHTEEGEAVFENFVAICE

SEQ ID NO: 17891 - protein, 500 aa, Prosthecochloris aestuarii DSM 271
MNISIQQTWQREWFSNIRGDLLAGLVVALALIPEAIAFSIIAGVDPKIGLYASFCIAIVVAVTGGRPAMISAATGAMALLMVSLVRDHGLQYLFAATILTGILQVAAGYLKLGSLMRFVSRSVVTGFVNALAILIFMAQLPELFDVTWHVYAMTAAGLAIIYLFPYVPVLGKNIPSPLVCIVVVTAATIWLGLDIRTVGDMGQLPDTLPVFLWPEVPLNLETLQIILPYSAALAVVGLLESMMTATIVDDLTDTPSDKNRECKGQGIANIGAGLLGGMAGCGMIGQSVINVKSGGRGRLSSFIAGLFLLIMVVFLGDLLKQIPMAALVAVMIMVSIGTFSWDSLLNLTKHPLSTNIVMVATVIVVVATHNLAIGVFVGVLLASLFFASKVGHFMIIRTEMNEALQKRTYVVTGQVFFASADKFVEAFDFKEVLRCVVIDLTHAHFWDISAVAALDKVVVKFRREGTHVDIIGMNEASTTIVDRFGVHDKPEEVEKILAGH

SEQ ID NO: 17892 - protein, 437 aa, Paenibacillus macerans
MHIVVVGLNYRTAPVEVRERFSFAEKDMPQALQELLRTKSVLEGVIIATCNRTEIYVVVDRLHMCGYFIRSFMERWFGVPREEFTRHLYMYEDEQAVRHLFRVACGLDSMVLGETQILGQVKSAFLLSQRQKGTGTWFNMLFKQAVTLGKRAHSETAIGQSAVSISYAAVELGKRIFGSFSGKRVLILGAGKMSELTAKHLSGGGADEVIVANRTYARAQELAAKFDGTPCTMQEAMERLADVDILISSTGAEGIRDHVGQVERSMKRRPDRPLFMIDIAVPRDIEPEIGVLENVFLYDIDDLEGIVENNLEMRRAEAVKIDKMIEEEMQVFANWLQTLGVKPVIRALQEKAAHIHESTLDSMFNKLPELDERQRKVIRRLTKSILNQMMHDPINRIKEMAGGKQGAEALEMFTQIFALEKHLEAGAPVGRGKRRLP

SEQ ID NO: 17893 - protein, 252 aa, Mesorhizobium loti MAFF303099
MMTNLSGKVVLLTGGLGSLGRAQAAALARAGARVLLLDRPENAEGPGIAAELAAANKGTIVYVGCDLNQLAEAEAAVKALADKEGTIDILINNAALIINRPFEEFSLGEYEDQIRVNSSAAFALARACAPGMKKKGQGRIVNFCSVTLNGRWDGYVPYVASKGAMLGLTKSLARELGSHGITVNAVSPGAVVSEAEERVFGERLEEYNDWILANQCLKRRIEPQHIANLVLFLVSPASDMISGQNINIDGGW

SEQ ID NO: 17894 - protein, 280 aa, Streptococcus agalactiae NEM316
METYTLSNTLNIPKIGFGTWQLTEGEEAYKAVTHALKVGYTHIDTAQIYGNEHSVGRAIRDSGLARESIFLTTKIWNDKHDYHLAKASIDESLQKLGVDYIDLLLIHWPNPKALRENDAWKAGNAGTWKAMEEAYKEGKVKAIGVSNFMKHHLEALFETAEIKPMVNQIILAPGCAQEDLVRFCKGNDILLEAYSPFGTGAIFENESIKAIAEKYGKSVAQVALRWSLDNGFLPLPKSATPKNIEANLDIFDFQLNEDDITTLIQLDSGIKPKDPDNVSF

SEQ ID NO: 17895 - protein, 462 aa, Streptococcus agalactiae NEM316
MSKNNNDHTQKSENGMVRGLENRHVQLIAIAGTIGTGLFLGAGRSISLTGPSIVLVYAITGAFMFFMMRAIGEMLYQDPNQHTFINFITKYLGPGWGFFSTLSYWISLIFIGMAEITAVGEYVQFWFPEWPSWIIQIVFLAILSSINLIAVKAFGETEFWFAMIKVIAILGLIATGIFMVLTNFDTGHGYHASISNITNHFEWFPKGKLNFFMAFQMVFFAYLAIEFVGVTTSETANPRKVLPKAIQEIPMRIILFYAGSLLAIMAIFPWQQLPVNESPFVTVFKLAGIKWAAALINFVVLTSAASALNSTLYSTGRHLFQLANESPNTLTKALKLDQLSRQSVPSRAIIASAVIVGASALISVLPGISDAFSLITASSSGVYISIYVLIMIAHWKYRKSPDFMEDGYKMPAYKILSPITLLFFLFVFVSLFLQDSTYIGAIGATIWIIGFGLYSHFKHKSH

SEQ ID NO: 17896 - protein, 744 aa, Shewanella oneidensis MR-1
MLNTLRDITQAVASAHSLETALEVLVSSTKAAMETQCCSVYILEQQELVLSATDGLEKSAVGRVRMPLTQGLVGLAAEREEAVNLADARLHPRFKLFPEVAEEEYRAFLAVPIIYQKAVVGVIVVQQASARQFSEGEEAFLMTLAAQLAMAIRGLKQKAQVSSLHQQILFQGTSASSGIAIAHAFVLGGEISLEQPDIRCEDIVLESNRLVAAMGRCKEAIGALSQRFDREQDEEVASIFNALQLLLDDASLGGEYAREVLLGWEAESAVSRVSLRYIQQFLAMEDPYLKERASDIRDLGQKVLRQLIEPERLELEPDKPVILVTKEADATMLAEFPRQKLAGIVTELGGVNSHAAILARALGVPAITGVEQLLSADIDQKLLVVNASRGQLMVSPSPAIVSEYRSLISAQKALQRQYAQELTLPSVMLDGKRIRLYLNAGLLSGVASEIAEGADGIGLYRTEIPFMLQQRFPSESEQVKVYQQVLSAASGRPVVMRTLDVGGDKPLPYFPIKEDNPFLGWRGIRLSLDHPELFLVQLRAMLQAGAEGKQLSILLPMVSNLDEIDQALAYLEQAHVELKNDVNSNIKMPRIGIMLEVPAMLYQLDEVAKRVDFVSVGSNDLTQYLLAVDRNNPRVSSLFDSYHPGILRALHQARLDCEYHHLDISICGELAGEPMGAILLVAMGYHQLSMNQGSLARINYLLRRVSGEDLAQLLAQALSLSNGFQVRELVKEYLTLQGLVTILN

SEQ ID NO: 17897 - protein, 293 aa, Exiguobacterium sibiricum 255-15
MSKVRKAIIPAAGLGTRFLPATKAMPKEMLPILTKPTIQYIVEEAVASGIEQIIIVSGRSKRAIEDHFDHAPELENILRQKGKLDLLKEVDASTTMAEIHYIRQKEPKGLGHAIWSARHFIGDEPFAVLLGDDIIVSEEPGLKQLMDQYEELDASVVGVRQVPIEDTHRYGIIDPLNQTGRRYQVRQFVEKPVQGTAPSNMAIIGRYILTPAIFEYLATQEAGTGGEIQLTDAIERLNGQEDVYGYEVEGKRFDVGEKMGYVETTLAFALEDAEIQADVRQLLKRYVESWEQE

SEQ ID NO: 17898 - protein, 421 aa, Oryza sativa Japonica Group
MQERCRVLLRFADLIEQHADEIAALETWDGGKTLEQTTGTEVPMVARYMRYYGGWADKIHGLVVPADGPHHVQVLHEPIGVAGQIIPWNFPLLMFAWKVGPALACGNAVVLKTAEQTPLSALFVASLLHEAGLPDGVLNVVSGFGPTAGAALSSHMGVDKLAFTGSTGTGKIVLELAARSNLKPVTLELGGKSPFIVMDDADVDQAVELAHRALFFNQGQCCCAGSRTFVHERVYDEFVEKARARALQRVVGDPFRTGVEQGPQIDGEQFKKILQYVKSGVDSGATLVAGGDRAGSRGFYIQPTVFADVEDEMKIAQEEIFGPVQSILKFSTVEEVVRRANATPYGLAAGVFTQRLDAANTLARALRVGTVWVNTYDVFDAAVPFGGYKMSGVGREKGVYSLRNYLQTKAVVTPIKDAAWL

SEQ ID NO: 17899 - protein, 273 aa, Triticum aestivum
  misc_feature (207)..(207): Xaa can be any naturally occurring amino acid
AYLGDTLEQVCTKKQAATGPEFPGYRRPTRPVLEKAAGPAAGGGTGAGLGLDAQSMETLARWIPGWGLDAATLPLAVDLNRATDSETKAARTLTRDEGFDFRAAHWGELHRRLHEALPAAATVHWGHQFLSFEVSDLDDGGGIRGGVVATARLLGTGETVEVAGDLLVAADGCTSSIRRRFLPDLKLKYSGYCRWRGVFDFTGKESXASSPGSRRPYPKLGKLPCTSNLTEKDSRPCSYEVARGNTGSNWVVGKFNRPQKPRSFLGGRLAGNQ

SEQ ID NO: 17900 - protein, 377 aa, Zea mays
MKEEGGGGDAGFVRADQIDLKSLDEQLERHLTRAWTMEKRKEEASAGAGAGARQHQQSRRPRREDWEIDPAKLVVKGVIARGTFGTVHRGIYDAHDVAVKLLDWGEDGHRSEQDIAALRAAFSQEVSVWHKLDHPNVTKFIGAIMGARDLNIQTENGHIGMPTNICCVVVEYLPGGALKSFLIKNRRKKLAFKVVVQIALDLARGLSYLHSKKIVHRDVKTENMLLDKTRTVKIADFGVARLEASNPSDMTGETGTLGYMAPEVLNGNPYNRKCDVYSFGICLWEIYCCDMPYPDLSFSEVTSAVVRQNLRPEIPRCCPSSLSNVMKRCWDANPDKRPEMAEAVSMLEAIDTSKGGGMIPVDQRPGCLACFRQYRGP

SEQ ID NO: 17901 - protein, 402 aa, Glycine max
  misc_feature (258)..(258): Xaa can be any naturally occurring amino acid
RYNVGDGFHVIAAHTDSPCLKLKPKTASCKCNYSMVNVQTYGAGLWYTWFDRDLSVAGRVILRTGHNSFVHKLVKVDRPILRIPTLAIHLDRTVNLDGFKPNLETHLLPLLSMKPEDTSLESNSKEKNSALSSKAHHHRLLMQVLSDELNCDVDDIVNIELNVCDTQPSCLGGGNNEFIFSGRLDNLASSYCALRALIDSCESPGDLASENAIRMVALFDNEEVGSGSVQGAGAPTMFQAMRRIVGDLTNNYVSEGSXFERTIRQSFLVSADMAHGVHPNFMDKHEELHRPKLQRVLVIKHNANQRYATSGITPFLFKEAGKIHNLPTQEFAVRNGMGCGSTIGPILASGVGIRTVDCGIAQLSMHSIREICAKEDIDIAYKHFKAFYQSFSSVDKMLTVDT

SEQ ID NO: 17902 - protein, 137 aa, Zea mays
  misc_feature (18)..(18): Xaa can be any naturally occurring amino acid
MESTFIMIKPDGVQRGLXIGEIISRFEKKGFYLKALKLVNVERSFAEKHYADLASKPFFQGLVDYIISGPVVAMVWEGKSVVTTGRKIIGATNPLASEPGTIRGDFAVDIGRLDLSPIFVSYGFQSPLFMHWLCLDA

SEQ ID NO: 17903 - protein, 528 aa, Candida albicans
MAIVETVIDGINYFLSLSVTQQISILLGVPFVYNLVWQYLYSLRKDRAPLVFYWIPWFGSAASYGQQPYEFFESCRQKYGDVFSFMLLGKIMTVYLGPKGHEFVFNAKLSDVSAEEAYKHLTTPVFGKGVIYDCPNSRLMEQKKFAKFALTTDSFKRYVPKIREEILNYFVTDESFKLKEKTHGVANVMKTQPEITIFTASRSLFGDEMRRIFDRSFAQLYSDLDKGFTPINFVFPNLPLPHYWRRDAAQKKISATYMKEIKSRRERGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSVSFNSSDEVDYGFGKVSKGVSSPYLPFGGGRHRCIGEQFAYVQLGTILTTFVYNLRWTIDGYKVPDPDYSSMVVLPTEPAEIIWEKRETCMF

SEQ ID NO: 17904 - protein, 387 aa, Bdellovibrio bacteriovorus HD100
MATQDDYSLLAPGPVNIHPEVRKALALPMIHHRTPEFDKILKKVLTQIKTVFQTEQDVYLLTSTGSGGMEALLVNTLSPGDKVIAIVSGKFGERWADMAAHFGASVLTINAPWGEAVKVSDVEELLQKNPDTRAVLCQACETSTAVAHPIEALGKITQKYPDTLFLVDAITALGAYPLPMDAWGIDGIVAGSQKAFMLPTGLSLLSFSKKAWRFIPDAKCPRYYFDIRKEKKANAAGETFYSSNVALIRALDVVLTLISQQGLEKLFHDIHRRAEFTRIFGLKLGFTLYAQSPSNSVTALLVPPQMDGQKIRLHLEEVHNITIMGGQDQAKGRIIRVGHMGYIQDHELIRLVECLGHTLRHFDSDFMSLEHISNITTEAKNWLEQNP

SEQ ID NO: 17905 - protein, 341 aa, Chlamydomonas reinhardtii
MAAAQTPPLPVVDPVSNYEKLHRIGEGTYGVVYKARDRTTGEIVALKRVRFDRSRDGVPVTSVRELRVLQACHHPNIVQLKKVVTGSQADSVFLVFEYCDHDLGRLLDSMTPPGGGGGSGGAGRRPFSISEVKGLMRQLLEAVSFLHDHWIVHRDIKLSNLLYTHTGHLKLCDFGLASRTGHVCPKRDRTPNVVTLWYRAPEVLLGSEEYDESIDLWSCGAILAELLTGEPLFPAASEAEALNMMANLLGAPGERIWPGMSALPNAAKFVFPAQPYNFLRRHMTASCSAGGGGLSEAGLALLNGLLTYDPARRITARQALRHEWFQEKPYLKQPGDMPTFP

SEQ ID NO: 17906 - protein, 509 aa, Mycobacterium smegmatis str. MC2 155
MTATPEVDLPNPYTGTGTIHNPATGAVAGEVRWTDPADVPRIAAGLREAQKEWEARGPKGRAKVLARYAVWLGDHRDEIEKLLIAETGKSAVDAAQEVPLILMILSYYIKTVEKAMAPEKRPAPLPFLSIKKIEVHYRPRAVVGIIAPWNYPVANAMMDAIGALAAGCSVLLKPSERTPLTAEVLLRGWLDSGAPEVFALAQGARAVSEAVIDNSDYIQFTGSSATGAKVMERAARRLTPVSLELGGKDPMIVLEDADIELAANAAVWGAMFNAGQTCVSVERVYVLESVYDQFVAATVRAVENLKMGAGEGYDFGSLIDAGQVDITERHVNEALEKGAKALTGGKRPEDGGSFYPPTVLVDVDHSMSCMNEETFGPTLPIMKVSSVEEAVRLANDSPYGLSASVFSKDTERAKKIALQLDCGAVNINDVISNLMCTTAPMGGWKTSGIGARFGGVDGVRKFCKQETVVAPRTSVGAGGTYYNNSHKALARMNRLMTKLALARPRRTAK

SEQ ID NO: 17907 - protein, 304 aa, Mesorhizobium sp. BNC1
MKTDFQHRHLLSIGECMVEFAPNGAGGYAMNFAGDTFNAAWYARRLLPGGFEVSYLTAVGRDDISAEMLAFMRDQGIDTSFVARDDERTVGLYVVQLQDGEPRFTYWRDRSAARRLAHDAAALSGLSAEMVIHFSGITLAILPPENRQRLLDSLAAARAAGATISFDTNMRPRLWRGNAELRYWTMRAADVADIVLPSFGEESQAFGDAHPEDTAERYAAAGAATVVVKNGAGPVLAVDGPVRLRLNPVPAVPVDSTAAGDSFAGAFLAALMQGKALDNAVRDAMSVAARVVQSRGALVPVGVD

SEQ ID NO: 17908 - protein, 329 aa, Cucumis sativus
MGLPKMAAIVVVVALMLSPSQAQLSPFFYATTCPQLPFVVLNVVAQALQTDDRAAAKLIRLHFHDCFVNGCDGSILLVDVPGVIDSELNGPPNGGIQGMDIVDNIKAAVESACPGVVSCADILAISSQISVFLSGGPIWVVPMGRKDSRIANRTGTSNLPGPSETLVGLKGKFKDQGLDSTDLVALSGAHTFGKSRCMFFSDRLINFNGTGRPDTTLDPIYREQLRRLCTTQQTRVNFDPVTPTRFDKTYYNNLISLRGLLQSDQELFSTPRADTTAIVKTFAANERAFFKQFVKSMIKMGNLKPPPGIASEVRLDCKRVNPVRAYDVM

SEQ ID NO: 17909 - protein, 198 aa, Oryza sativa Japonica Group
MAASLLRSGHRLRLLRHGSLSWASFSAAAAEELIDVRKLPTDYDASTFDPTAPSRPPPSDRVWRLVEDVSSLTLAESAALSALLLRRLDVPAPPIAILNSAAGLGGGGGAGAAGAAGEKAGGAAAAEKTVFELRLEAFDAASKIKVIKEIRSFTDLGLKEAKELVEKAPAVIKGGVSKEEARTIIDKMKAVGAKVVMD

SEQ ID NO: 17910 - protein, 489 aa, Marinobacter sp. ELB17
MSHSIPRLQNFIHGHFFANHTGEVFPVVNPATGKVIYEVEIADESVQQAAIESARAGFIEWAAMPAVQRSRILLKAVALLRERNDELAAIEVLDTGKPLQEAQAVDIVTGADSIEFFAGLAPSIEGNQQDLGGDFYYTRREPLGICAGIGAWNYPLQIACWKSAPALACGNAMIFKPSEETPMGATKLAQIYIEAGVPAGVFNVVQGAAEVGSWLTHHSEIAKVSFTGEVGTGKKVMAAAATTVKSVTMELGGKSPLIIFDDADLENAISAAMVGNFYTQGEICTNGTRVFVHEDIYPKFMERLLERTRNNILPGDPMNPKTNFGALISDKHRKLVLSYIAKGVAEGATLRHGGHAFEPEDSKGGYFVEPTIFTDCTDDMAIVREEIFGPVMSVLTFTTENEVIDRANATETGLAAGVFTNDIRRAHRVVHQMQAGICWINSYGASPAEMPVGGYKLSGIGRENGRETISHYTQLKAVYVGMEDIDAPF

SEQ ID NO: 17911 - protein, 443 aa, Heliobacillus mobilis
MFIFVVGLNHKSAPVEVREKLSFTEAQLSEALHKLQGMAGIEGCCILSTCNRTEIYGASTDMEKGMTAVKRFVLEWGQLQPQDFSKYFYVHTLYDAIRHLFRVASGLDSMVLGETQILGQVRTAYQRSCNEDCSNGIVNTWFQQAITVGKRVRTETGIDQHPVSISYTAVELAEQVLGGLKGRTAMVLGAGKMSVLTLKHLVAEGVDKIIIANRSVEKAEELAKSCGGEAISFADVNHRLEEADILISCTAATHYVIRKSMVEQVMDRRGGKPVFFFDIAVPRDIDPEVAQVPGTHLYDIDAMQHVIDRNLAERRKCAAEAEIIIEHEINQFMRWLNSLFVIPTIVGLKNKGNQIKEKELDRALCKLKHLSEKEKKLVGSLASSIVNQLLHDPITQLRHYAASPEGHLYSEILQNLFCLDVPGQRQKHVVVHYPAVEQRQNRA

SEQ ID NO: 17912 - protein, 489 aa, Medicago truncatula
MNVFDGNKFLNTLLLLITTLIAAKLISSFIIPKSKKRLPPILQGWPIIGGLLRFLKGPIILLREEYPKLGGVFTLKIFHKNITFLIGPEVSAHFFKAPESDLSQQEVYQFNVPTFGPGVVFDVDYSVRQEQFRFFTEALRVNKLKSYVNQMVSEAEDYFSKWGSSGEVDLKYELEHLIILTASRCLLGREVRDKLFDDVSALFHDLDNGMLPISVLFPYLPIPAHRRRDNARKKLAEIFANIISSRKIADKSEDDMLQCFIDSKYKDGRPTTESEVTGLLIAALFAGQHTSSITSTWTGAYLLCNKQYLSAVEEEQKNLMEKHGDRVDHDVLAEMDVLYRCIKEALRLHPPLIMLLRSSHSDFSVTTREGKEYDIPKGHIVATSPAFANRLPHIFNDPDKYDPDRFAVGREEDKAAGAFSYISFGGGRHGCLGEPFAYLQIKAIWTHLLRNFELELVSPFPEIDWNAMVVGVKGKVMVRYKRRELSVNQ

SEQ ID NO: 17913 - protein, 479 aa, Medicago truncatula
MEPNFYLSLLLLFVTFISLSLFFIFYKQKSPLNLPPGKMGYPIIGESLEFLSTGWKGHPEKFIFDRMRKYSSELFKTSIVGESTVVCCGAASNKFLFSNENKLVTAWWPDSVNKIFPTTSLDSNLKEESIKMRKLLPQFFKPEALQRYVGVMDVIAQRHFVTHWDNKNEITVYPLAKRYTFLLACRLFMSVEDENHVAKFSDPFQLIAAGIISLPIDLPGTPFNKAIKASNFIRKELIKIIKQRRVDLAEGTASPTQDILSHMLLTSDENGKSMNELNIADKILGLLIGGHDTASVACTFLVKYLGELPHIYDKVYQEQMEIAKSKPAGELLNWDDLKKMKYSWNVACEVMRLSPPLQGGFREAITDFMFNGFSIPKGWKLYWSANSTHKNAECFPMPEKFDPTRFEGNGPAPYTFVPFGGGPRMCPGKEYARLEILVFMHNLVKRFKWEKVIPDEKIIVDPFPIPAKDLPIRLYPHKA

SEQ ID NO: 17914 - protein, 310 aa, Idiomarina baltica OS145
MNTHFLTGNELTQSQLIQLIDTAIEQKSQPQKFTQSLAGKSIVTLFEKPSLRTRLSLDVGIQRLGGHCVYLDEQNGQLGQRETIADYAKNLSCWCDAIVARVNHHATLQELAKHASVPVINSLCDQFHPCQALADSLTLVEHYGDVSGKALSYWGDGNNVARSLALYGCLLGMHVTLVTPAGHGLSATDIDQLNQAGIGSVKQVHDPEACVQSDVVYTDTWVSMGQQQSLDEVKATFMPYQVNAALIKRLGANAVMHCQPAHRDYEITSEVMDSDDSLCLKQAENRLFAQNALLHLLLNPKNTLTLQHAS

SEQ ID NO: 17915 - protein, 247 aa, Idiomarina baltica OS145
MNVIKLGGRVLDDPQGLTTLFQHIAQQQNLEPTLIVHGGGQQVDDLFAKLNLSVVKYHGLRVSMAEQMPLIVGALAGTVNKQLLGMAIKQTLKPVGLTLFETGLRVQQGQPELGMTGHCIEPFEVSELLLTLLEQKHLPIVSCVGFDSRGQWLNVNADEAAAGLAKALSATLTFVSDVPAVLDDQQQPIAQLDSDSIEQLIQSGTLMGGMRLKVEQALNVAQFLQKQVRICGCSCDTRHHSGTLINP

SEQ ID NO: 17916 - protein, 297 aa, Burkholderia thailandensis E264
MDLVVRSPRLPQPGETLAGRSFAQAAGGKGGNQAVAAARLGAQVAMLGRVGSDAHGAALRAGLVAEGIDCGALSVSTTATTGVALIVVDDASQNAIVIVAGSNGEVTPEAIAEHDAAIAAADVLICQLETPGDAVRAALAAGRRLGKTVVLNPAPAVGPLPADWLPLVDYLIPNEIEAAALTGSPVRDPASAEAAARALAAAGARNVIVTLGGQGAVALTADGVARHYPAPRVTPVDTTAAGDTFIGGFAARLAAGDTPHDAIRFAQRAAALSVTRAGAQPSIPTLAELDAFAPDPA

SEQ ID NO: 17917 - protein, 340 aa, Prosthecochloris aestuarii DSM 271
MDSQTLSSVAKAIVAPGKGVLAADESTPTIRKRFDSIQVESTEENRQQYREILFTAQNIERSIGGVILFDETLRQSAKDGTPFPTLLSKRGIVPGIKVDKGAKALALYAGEKITEGLDGLRERLLEYKELGAQFAKWRAVIGIDERDIPSPFGIRANAHALARYAALCQELDIVPIVEPEVLMDGSHDIERCEVVTSQVLEAVFAELDAHHVLFEGMLLKPNMVIAGMQCSRQAGVEEVAEATMRCMTRYVPAAVPGIVFLSGGQSAEKATAHLNAMNATGPYPWEVSFSYGRALQAPVLAAWKGEENNAFAAQHALSKRCRLNGLARDGAYAQEMEQEA

SEQ ID NO: 17918 - protein, 704 aa, Zea mays
MEAQTDSAPGGGDDLAIMREQCRTLEESISTRREAQLDLIGSLQHLVPDLVPSLEQSLRLIAAFNGRPFVPTLYPNASVHVQNPNLKPQHRRALPGPARSTRLKTSPGSSPASAAARCAGTSGGIHAVRTMVAVCLLELVPFAEIDAAALARRLQSETSSASEAERAALADLAAELGGSAPAAVALALRRIAEDSGGLQIEEAFIGGKQMTMVWAIDRSKLLKELPESASVLQIQPPPTPQVVPLDTDTNIIPRPPPLQQSDMWGNPMPPMFPRPRGMTMPRIPPGLMPLQRPFMAPGAVIPMGGGPVPSSTQLKLRTEEDDLKDLELLLNKKTYREKQNTKTGEELLDLIHRPTAKETAVAAKFKTKGGSQLKEYCTNLTKEDCRRQTGSFVACDKVHFRRIIAPHTDTNLGDCSFLDTCRHTKTCKYVHYELDQTPDVPQMMAGAIAPPRQIKPQRAEYCSEIELGESQWINCDIRNFRMDILGQFGVIMADPPWDIHMELPYGTMADDEMRTLNVPTLQTDGLIFLWVTGRAMELGRECLELWGYKRVEEIIWVKTNQLQRIIRTGRTGHWLNHSKEHCLVGIKGNPLVNRNIDTDVIVAEVRETSRKPDEMYAMLERISPRTRKLELFARMHNTQAGWLSLGNQLNGVRLVDQGLRARYKAAYPDVEVQPPSPPRTSTPMDVDQSSSQKVAALDGGERPA

SEQ ID NO: 17919 - protein, 294 aa, Cucumis sativus
MTVEFGVKRAIETDIRAGAKLIRFHFHDCFVQGCDGSVLLEDPPGFETELNGLGNLGIQGIEIIDAIKAAVEIECPGVVSCADILAQASKDSVDVQGGPSWRVLYGRRDSRTANKTGADNLPSPFENLDPLVKKFADVGLNETDLVALSGAHTFGRSRCVFFSGRLSNFSGSGQPDPTLDPTYRQELLSACTSQDTRVNFDPTTPDKFDKNYFTNLRANKGLLQSDQVLHSTQGAKTVEIVRLMALKQETFFRQFRLSMIKMGNIKPLTGSQGEIRRNCRRVNDLGSETGHDVM

SEQ ID NO: 17920 - protein, 202 aa, Triticum aestivum
  misc_feature (145)..(145): Xaa can be any naturally occurring amino acid
  misc_feature (150)..(150): Xaa can be any naturally occurring amino acid
QAIYLHIPALPPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEXKKEYXPYVRIIGFDNMRQVQCVSFIAFKPPGCEESAPPSPAHSRQAIYKVPLQFCQL

SEQ ID NO: 17921 - protein, 70 aa, Triticum aestivum
  misc_feature (54)..(54): Xaa can be any naturally occurring amino acid
MVNAIKGLFISCDIPMAQFIVNMNASMPASEKFIVHILDPTHMFIQPNMGDYIXSKMAEFRDQNSYEKPT

SEQ ID NO: 17922 - protein, 109 aa, Narcissus pseudonarcissus
MQGAIQAILSRGNVLKRAVLQHVRIINPALQPSILSRSESVSSAQLEEHGFESTTVSDVLKSKGKSADGSWLWCTTEDTVYDAVKSMTQHNVGALVVVKPGEEKGIAGI

SEQ ID NO: 17923 - protein, 359 aa, Zea mays
MGVYLSTPETDKLSENGENDRLKFGLSSMQGWRATMEDAHSALLDLDSETAFFGVFDGHGGRVVAKFCAKYLHGQVLKSEAYSTGDLGTAVHRAFFRMDEMMQGQRGWRELSALGDKINKFSGMIEGLIWSPRGSDSNNQQDDWASEEGPHSDFAGPTCGSTACVALIRNTQLVVANAGDSRCVISRGGKAYNLSRDHKPELAAERERIMKAGGFIHMGRVNGSLNLSRAIGDVELKQNKFLPPEKQIVTANPDINVVELCDDDDFVVVACDGIWDCMSSQQLVDFIHERINTESSLSAVCERVLDRCLAPSTIAGDGCDNMTMILVQFKKPVDRNKKAEAAGQSASNVDEAKSRVAEE

SEQ ID NO: 17924 - protein, 461 aa, Coxiella burnetii RSA 493
MTTAKSGTTIEIIGAVVDVEFPRHAVPKVYDALQVDENNLTLEVQQQLGDGVVRTIAMGSTEGLKRDIAVKNTEKPIEVPVGKETLGRIMNVLGEPIDELGPINSKEKLPIHRPAPSFIEQSGATELLETGIKVVDLLCPFAKGGKVGLFGGAGVGKTVNMMELIRNIAIEHSGYSVFAGVGERTREGNDFYHEMKESNVLDKVALVYGQMNEPPGNRLRVGLTGLTLAEAFRDEGRDVLLFIDNIFRYTLAGVEVSALLGRMPSAVGYQPTLAEEMGALQERITSTKKGSITSIQAVYVPADDLTDPSPATTFAHLDATVVLSRQIAERGIYPAIDPLDSTSRQLDPLIIGEEHYRVARGVQETLQRYEELKDIIAILGMDELSEDDKRAVRRARKIQRFLSQPFFVAEVFTGAPGKYVSLQDTIRGFKGIINGEYDELPEQAFYMVGSIEEAVEKAKSL

SEQ ID NO: 17925 - protein, 408 aa, Kluyvera ascorbata
MADSSPERRFTRIDRLPPYVFNITAELKMAARRRGEDIIDFSMGNPDGATPPHIVEKLCTVAQRPDTHGYSTSRGIPRLRRAISRWYQERYDVEIDPEDEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVNALARIKSYHDYGTFTPLQVAAIAALEGDQQCVHDIAAQYKRRRDVLVKGLHEAGWMVDMPKASMYVWAKIPEQYAHMGSLEFAKKMLQDAKVCVSPGIGFGDYGDTHVRFALIENRDRIRQAIRGIKAMFRADGLLPSEHKSAG

SEQ ID NO: 17926 - protein, 196 aa, Zea mays
MALSALISTLLAAAIWCAAYLAAAISSAFWDSHSPLPNPNLPPVAHPTSSFVGPTILATSPADSLRSTRPRVTMGYAQLVIGPAGSGKSTYCSSLYDHCQTVGRTIHIVNLDPAAEHFDYPVDMDIRELISLDDVMEEIGLGPNGGLIYCMEHLEDSLDDWFDEQLENYLDDDYLVFDCPGQIELFTHVPVLRNFV

SEQ ID NO: 17927 - protein, 314 aa, Debaryomyces hansenii CBS767
MSEINILTIFRSTKVLKFYNGQEIPATGLGTWQSKDEEVYNAVLAALKIGYKHIDTAACYGNEEPIGRAIRDAGVKREDIFITTKVWGTDHTRVEQALNTSLQKLGLDYVDLYLMHWPVPLNPNGNHPLFPTLPDGNRDISQDWDFTKTYNLMQKLLDLGKTKSIGVSNFSVTNLKKLLNAPTTTVKPVVNQVELHPYLPQHKLLQFAKENDIVLESYSPLGSTDSPLLSDEVVVKIAEKNKVSPATILISWALWRGTVVLPKSVSAHRIESNFNVIDLPDADGKELDDLHKLRGIRRLVLPNWAPVVVFDSDE

SEQ ID NO: 17928 - protein, 456 aa, Marinobacter sp. ELB17
MSFKIAILGAGPSGLAQLRAFEAARDAGADIPEIVCYEKQSDWGGLWNYTWRTGLDAYGEPVHSSMYRYLWSNGPKECLEFADYSFEEHFGRPIPSYPPRAVLRDYIMGRVAKSNVRQYIHFNTAVHWVDHNEATDKFAVTVRDLKQDELSTEEFDHVIVATGHFSTPNVPYFEGLEQFPGRVLHAHDFRDACEFKGKDLLLIGSSYSAEDIGTQCHKYGAKSVTFSYRSQPMGFEWPESFTEVPLLTEVIGKTAHFKDGSSKKVDAIILCTGYQHHFPFLPNELTLTTHNRMYPEGLYKGIVSLPNPKLIFLGMQDQYYTFNMFDAQAWYARDVMLGRITLPASDAMAADSREWVARELKLADPVDEIDFQAAYIQDLLEPTDYPAFDVTAVADIFKQWEHDKEEDILGYRNKSYRSTLTGTLAPVHHTPWMDAMDDSLDAFLKVKQTQPAKETV

SEQ ID NO: 17929 - protein, 344 aa, Prosthecochloris aestuarii DSM 271
MTSSMPHPTKETIVKKRDFLGFQPLDAGKIIELFDFSAFIKAKRLDRTAASKYKPIEGKTVAMIFNKPSLRTRVSFELGIHELGGYAVNLDGKSIGVNSREAVEDIAQLLSRYNDAIVARLHEHSVIEDLAANATIPVINALTDLSHPCQILADAFTLYEKGLWKEGVKIVFVGDGNNVANSWIELAGILPFHFVLACPQNEEYMPDTTLLEEARRNSGSTIEIVHDPMEAAKNADVLYTDVWTSMGQEDEVAERLKAFSSYQINSAMLRQSKPSAVVMHCMPAHRGQEISAEVMDGPQSIIMDEAENRLHVQKALLVKLLNHEEYRKFHLTHRLEHVAKNLKH

SEQ ID NO: 17930 - protein, 243 aa, Helicobacter hepaticus ATCC 51449
MSEKQEQIVNMFNDIAPSYDRANRVMSLGIDVSWRKEACKKAYEALGKDEIQCVLDVACGTGDMLLHWHNEAQKAHKHITQMRGIDPSSGMLDVARKKLTPFFTSDTLMLDIGEAKALCVESQSVDILSIAYGLRNVVELDKALDEFVRVLKSGGVLVILEFMNNKPRGLLDIFMRFYTRKILPVVGGIISRNYGAYKYLPNSIEGFVSSEELANKLLQRGVKSYFIKGYSANISTLYVGVKV

SEQ ID NO: 17931 - protein, 547 aa, Streptomyces coelicolor A3(2)
MRKARKAHGDKVILDDVTLSFLPGAKIGVVGPNGAGKSTVLKIMAGLEQPSNGDAFLSPGYTVGILLQEPPLNEEKTVLENVQEGVAEVKGKLDRFNEIAEQMATDYSDALLEEMGKLQEELDHANAWDLDAQLEQAMDALGCPPGDWPVVNLSGGEKRRVALCKLLLEAPDLLLLDEPTNHLDAESVNWLEQHLAKYEGTVVAVTHDRYFLDNVAGWICEVDRGRLHGYEGNYSKYLETKATRLKVEGQKDAKRQKRLKDELEWVRSNAKGRQAKSKARLARYEEMAAEADKMRKLDFEEIQIPPGPRLGNVVVEVNNLSKAFGEKVLIDDLSFTLPRNGIVGVIGPNGAGKTTLFKMIQGFEEPDSGEIKVGDTVKISYVDQSREHIDPKKTLWAVVSDELDYINVGQVEMPSRAYVSAFGFKGPDQQKAAGVLSGGERNRLNLALTLKQGGNLLLLDEPTNDLDVETLSSLENALLEFPGCAVVVSHDRWFLDRVATHILAYEGESKWFWFEGNFESYEKNKVERLGADAARPHRATYKKLTRG

SEQ ID NO: 17932 - protein, 302 aa, Prosthecochloris aestuarii DSM 271
MSNVMNDLCRDSHPGMKERQLAIGQVLIEALPYIRQFEGKTFVIKYGGAAMIDDVLKNAFAQNVTLLRKVGINVVVVHGGGNAITNTADSMGLHTTFVHGKRVTDRKMIDVVQMTLAGKVNQDIVRLISGHGAKAVGVSGLDARTIQAEPCTEAAHLGLVGEVASVNTEYLDLLCQAKLIPVIAPIGFDNEGNIYNINADDAASGIAIALKAEKLIYVSDVEGVHCGDRILKSVCKSEAADLIEQGIISGGMIPKSLSAYRTLDAGVGKVHLIDGRFVHSLLLEIFTNAGVGTQFVSEKESQ

SEQ ID NO: 17933 - protein, 503 aa, Medicago truncatula
MELQNPFSNIIFMLSFLILLVLFKIVQRWSFNNSTTKLPPGPWKLPLIGNIHQISGSSPPHHLFKKLAEKYGPLMHLKLGEVPYVVVSSPEMAKEIMKTHDITFCDRPNVLLPRVFTYNARDIAFSTYGELWRQLRKICVVELLSAKRVQSFSFIREEEVSDLVKSISANEGSIVNLSKSIFSMTYGIVARSAFGKKNRHQQLFKSTIEEALGLLGEICIADLYPSIKILQKGSRVKTRVERLQGEIDRIFARHQSMIIETITVKQARMKDLVDVLLKVQHENVHSQQPLTDENIKSVIQDLFIAGSETSSGIVLWAMSEMIKNPIVMEEAQVEVRRVFDKKGYVDETELQQLTYLKCVIKETFRLHPTVPLLVPRESRERCEINGYEIPAKTRVAVNVWAIGRDPKYWVEAESFKPERFVNSSIDFKGTDFELIPFGAGRRMCPGIAFALPNVELPLAKLLYHFDWKLPNGMSHQELDMTESFGLTVGKKHDVCLIPITRRP

SEQ ID NO: 17934 - protein, 512 aa, Medicago truncatula
MEPVQLLELPSWVTLFATFVILLLFSRRLRRHKYNLPPGPKPWPIIGNLNLIGSLPHQSLHGLTQKYGPIMHLYFGSKPVIVGATVELAKSFLKTHDATLAGRPKLSAGKYTTYNYSDITWSQYGPYWRQARRMCLLELFSAKRLESYEYIRKQEMHDFLHKLFNSKNKTILVKDHLSTLSLNVISRMVLGKKYLEKTDNAVISPDEFKKMLDELFLLNGILNIGDFIPWIHFLDLQGYVKRMKTLSKKFDRFMEHVLEEHIERRKNVKDYVAKDMVDVLLQLAEDPNLEVKLERHGVKAFTQDLIAGGTESSAVTVEWAISELVRKPEIFKKATEELDRVIGKDRWVEEKDIANLPYVYAIAKETMRLHPVAPFLVPREAREDCKVDGYDIPKGTIVLVNTWTIARDSEVWENPYEFMPERFLGKDIDVKGHDFELLPFGAGRRMCPGYPLGIKVIQTSLANLLHGFNWTLPNNVKKEDLNMEEIFGLSTPKKIPLEIVVEPRLADHLYSL

SEQ ID NO: 17935 - protein, 336 aa, Phaeodactylum tricornutum
MSINVGINGFGRIGRLVMRAAQKNPNIKIVAVNDPFIPVEYMEYMYKYDTVHGRADSVVKANKEAGTITVGENEIKVFGEMDPSKIQWGSAGADYVVESTGVFTTTEKASAHMVGGAKKVVISAPSGDAPMFVMGVNQEKYESSMDVVSNASCTTNCLAPLAKVVNDEFGLKEGLMTTVHAVTATQQTVDGPSQKDWRGGRAACYNIIPSSTGAAKAVGKVIPALNGKLTGMSFRVPTANVSVVDLTCRLDKGAPYATICAAIKAASEGPMKGILGYTDEDVVSSDFISDTHSSIFDQKAGIALTDDFVKLVSWYDNEAGYSTRVLDLIAHMESQK

SEQ ID NO: 17936 - protein, 497 aa, Medicago truncatula
MLSLLLLVLCLTFPLLLFFQKRRRSLNEPHPPGPRGLPIIGNLHQLDNSILYLQFSKLSKIYGPIFSLQLGLRSAIVVSSAEIAKEIFKNNDQVFSNRPVLYGQQKLSYNGSDIAFSQYSDFWREIRKLCVIHIFSAKRVSYYSSIRKFEVKQMIKNISNHAASSNVTNLSEILTSLYSTMICRIAFGKRYEEQGIERSKFHGMLHEFEALMTAFFVSDYITFMSWIDKLRGLHGRLDRNFKEMDAFYQEVIDEHLDPNRQNTDGEFIVDVLLELMKQRLFSTDLTFDHIKGVLVDMLVAATDTTSATIVWAMTALIKNPRVMKKVQEEIRGSRVKKDFLDGDDLQNFVYLKAVIKETLRLYLPAPLLLPRETREKCIVGGYHIPAKTIVYVNAWSIHRDSEIWKDPEEFYPERFLESSINFLGHDFELIPFGAGRRICPGISVAVASLELTLANLLYSFDWELPHGLVKEDIDTEMLPGITQHKKNHLCLVAKVPM

SEQ ID NO: 17937 - protein, 580 aa, Aspergillus nidulans FGSC A4
METTTTTLAEYLFKRLHQLGVDSIFGLPGDYNLQLLDYVAPSRLHWIGSCNELNAGYAADAYSRVKGIGALVTTFGVGELSAVNAIAGAYAERAPVVHVVGTPVRESQESRALIHHTFNDGEYKRFDRMQEHITVAQAILTDHRSAPAEIDRVLQQCLLHSRPVRIAIPLDMVSLRVPKMALEHKICVPLPCRQPQLEDKALKAILDRMYSAKKPVILVDGEVRSAKIMEEVEHIVKSTEWPTFTSGFGKSLVDETLPNVYGVFTPRYKDFIDSSDLVLCFGPHFSNTNSYLYQTVPQQHKTIFFHPTSVQIDSEIIRDLPANHFLPQLIGHLEVAKLNRYTCNFDHPSSVAPPDVQASDLVTQAGGFWHRMSSFFQEGDIILAETGTASYGANEFRLPPKTRLFKAVTWLSIGYMLPATLGASLAQHDLIARSEYHDFLEARSILFIGDGSFQLTAQELATIIHRKLNVIIFLINNDGYTIERAIHGRNQGYNNITPWRYLKGLEFFGAPTEGEYAAHTWQVRTWGDLEKVLTDERMIKGKGVRMVEVFMDRLDVPPPLDRILEMQIERENGVQCDKPQ

SEQ ID NO: 17938 - protein, 500 aa, Medicago truncatula
MVSYLHTLLALPLLVFFLFMKYKTNIKNSSSSTFPKGPKGLPIIGNLHQLDTSNLHLQFWNLSKIYGPLFSLQIGFKKAIVVCSSKLAQEILKDHDHDVSSRPPSHGPKTLSYNGIDMIFSPYNDCWREIRKICVVHFFSSKKISSFAHVRKSEVKLMIEKISNHVCSSKISNLSEVLMSVSSSIVCRIAFGKSYEHEGGEKSRFHGLLNETQAIFLSFFVSDYIPFMGWVDKLTGAIARVDNTFKALDEFFEQVLKEHLNPNNRKKDDEEKDIVDVLLELKNQGRLSIDLTNNHIKAVVMNLLVAATDTSAATSVWVMTGLIKNPRAMKKAQEEIRNIKKEFIDEDDIQKFVYFKAVIKETLRFYSPAPLAPRETSKSFTLNGYKIEPKTSVFVSIWSIHRDPETWKDPDEFYPERFLNNDIDFKGQNFEFIPFGAGRRICPGIPLGIATVEMITANLLNSFDWEMPEGMTKEDIDTEGLPGLARHKKNHLCLVAKNHM

SEQ ID NO: 17939 - protein, 387 aa, Thermoproteus tenax
MIPKTMKLYEYEAKEIFAKYGVKIPPGKLALSPQEVRKIAEEIGKPVVLKAQVTVAGRGKAGGIKVAKSPQEAEELAKQMFGMNIKGLTVRKIYVTEYVEVEREMYLSLIIDRASRRYLFLASPIGGVDIEEIAKREPEKIKRVYVDPFEGLKDFHIRGIVSWLGVKAGTQQWEQAAGIVKAMYKAMTELEAELVESNPLAVTKSGDVIPLDARIIIDDNALYKHPDLEKAYEEDPRDVTEFERYAQRIGFNYVELDGDIGIIGNGAGLTMSTMDLVYHYGGRPANFLDIGGGASREVVKEALKVLLRHPRVKVIFINIFGGITRADEVAAGVEGALNELGNAGKKIIVRMKGTNEELGRQMLAKIGVPLYESAEEAAQKAVELARI

SEQ ID NO: 17940 - protein, 489 aa, Spinacia oleracea
EDNHSTVEDDAANYDFDLFVIGAGSGGVRAARFSANLGAKVGICELPFHPISSEVIGGVGGTCVIRGCVPKKILVYGASFGGELEDAKNYGWELNEKIDFNWKKLLQKKTDEIIRLNNIYKRLLSNAGVKLYEGEGKIVGPNEVQVTQLDGTKLSYSAKHILIATGSRAQRPNIPGQELAITSDEALSLEEFPKRVVILGGGYISVEFASIWRGMGADVNLCFRKELPLRGFDDEMRAAVARNLEGRGVNVHPRTTLTELVKTDGGVVARTDHGEEIEADVVLFATGRSPNTKRLNLEALGVELDRTGAVKVDEYSRTSVPSIWAIGDVTNRMNLTPVALMEGTCFAKTVFGGQNSKPDYSNIACAVFSIPPLAVVGLSEEQAIEQASGDILVFTSSFNPMKNTISGRQEKTIMKLVVDAETDKVLGASMCGPDAAEIMQGIAIALKFGATKAQFDSTVGIHPSAAEEFVTMREPSRRVPGAGKPKTNL

SEQ ID NO: 17941 - protein, 498 aa, Pisum sativum
MARKMLNDGEPDLKKGEEQGKVYDFDLFIIGAGSGGVRAARFSSNFGAKVGICELPFHPISSETIGGVGGTCVIRGCVPKKILVYGASYGGELQDARNFGWELNENVDFNWKKLLQKKTDEINRLNGIYKRLLSNAGVKLFEGEGKIASPNEVEVTQLDGTKLSYSAKHILIATGSRAQRPNIPGQELGITSDEALSLEEFPKRAVILGGGYIAVEFASIWRGMGSSVNLVFRKELPLRGFDDEMRAVVARNLEGRGINLHPRTNLAQLIKTEDGIKVITDHGEELIADVVLFATGRSPNSKRLNLEKVGVEFDKAGAIVVDEYSRTNIPSIWAVGDVTNRLNLTPVALMEASLFAKTVFGGQASKPDYNDIPYAVFCIPPLSVVGLSEEQAVEQTKGDVLIFTSTFNPMKNTISGRQEKTVMKLVVDAQTDKVLGASMCGPDAPEIVQGIAIAIKCGATKAQFDSTVGIHPSSAEEFVTMRSETRRVTGGVKPKTNL

SEQ ID NO: 17942 - protein, 143 aa, Narcissus pseudonarcissus
KIEMDLEGKPSLMGYRMPAEWEPHQQCWMGWPERPDNWRENARFGQHAFVEVASAISQFEPVTICVSSAQYTTACHLLQNKPNIRIVEMSMNDSWFRDSGPTFVVLDRESSSGYEVHPVAGIDWIFNSWGGTEEGCYSDWSLD

SEQ ID NO: 17943 - protein, 500 aa, Nocardia farcinica IFM 10152
MVRFPAAATGKITIMTTVRTRIPARLDRLPWSRWHWMIVVGLGSVWIIDGLEVTVVGSVAGRLSEPGSGLPISAAQVSGLAAAMYVAGACVGALLFGWLTDRYGRKRLFIITLAVYLAATALTALSFSVWWFVLCRFFTGLGIGGEYAAINSAVDELIPSKYRGRVDIVINGTYWLGASGGALLSVAALNPELFAPNIGWRLMFGIGVVFGLLVLVVRRHVPESPRWMFIHGRDRQAEELVDGIEEQVRRDTGAELPEVEEIVQVRQRRSTGFGEIASVMFRRYPRRSALGLSLFIGQAFLYNAVTFNFAVILGRSFDVPADRAGYYYAVMCLGSFFGPLLLGRYFDTVGRKPMITASYLGSGLLLLLTAVLLVRGDLTAVTLTACWAIVLFVASCGASSAYLTVSEIFPMETRAMAIAFFYAIGTAAGGIAGPLVFAELTGDGDPGRTALAFAIGATMMILAGLVELVLGVRAEQRSLESIAAPLSFQSDEPDTAGVRR

SEQ ID NO: 17944 - protein, 214 aa, Zea mays
NILIENLHSSFHQFVYPHSHSCLAYVFSERTDAFVPILFTYQSCCVCISTYHSPFRPFRCCQVICNTYVCVTQGDKVSIIADASSYIKELKQKIAKLSQEMASSSPQHATTGVCQQQPSSSSVSVGVLLDKKGRFLVSVFMDESCGPPPAGLLASVLEAFDDIGLTVLEARATCAGSFRLEAVGEEVVVDGGLIIDAHAVEQAVVQAIKNCPAN

SEQ ID NO: 17945 - protein, 561 aa, Acinetobacter calcoaceticus
MTTLKITGMTCDSCAAHVKEALEKVPGVQSALVSYPKGTAQLAIEAGTSSDALTTAVAGLGYEATLADAPPTDNRAGLLDKMRGWIGAADKPSGNERPLQVVVIGSGGAAMAAALKAVEQGAHVSLIERGTIGGTCVNVGCVPSKIMIRAAHIAHLRRESPFDGGIAATVPAIDRSKLLAQQQARVEELRHAKYEGILDGNPAITVVHGEARFKDEQSLVVRLNDGGERVVAFDRCLVATGASPAVPPIPGLKESPYWTSTEALVSDTLPERLAVIGSSVVALELAQAFARLGSQVTILARNTLFFRDDPAIGEAVTAAFRAEGIKVLEHTQASQVAHVDGEFVLTTGYGEIRADQLLVATGRAPNTRSLALEAAGVAANAQGAIVIDKGMRTSTPHIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSGRLIGVQAVAPEAGELIQTAVLAIRNRMTVQELADQLFPYLTMVEGLKLAAQTFSKDVKQLSCCAG

SEQ ID NO: 17946 - protein, 1194 aa, Sporothrix schenckii
MAEEQQMQQILKKIDIEKVFLGKAIEMRKAANSDNADVLSKLDSAVHSARRHLEYYEDMLRQVQVRRLGQGVDNMSLGSGGSNSPAPGSLRPRSTDLRNEAGGAPPTPPPKDSASSWGDTSTLNSQNYAASTYSQHGVQSPSNYSDSPADTAVVKTRPNYTKLDLIKYDTPYMGPRIQHMLSQIQFKLDVEEQYLKGIEKMVQLYQMEGDKKSKADAASKKVESKQKIVLLKQALKRYEELHIDVDSGDTPDDDSVNVPNMRKPLSGNLSIRIMAVKDVDHAPTGRFSRGPDTFVAVKVEDNVAARTRLSRTDRWESEFHSVDVDKANEIELTVYDKPGEYAIPIGMLWVRISDIAEEIRRKRIEAEINSSGWVSADKMSAAPNRVPPAQFPMNPQGQFGAQQNAQGGPLSPQNPHGGGFDGVGAHAAHLSPEPITGWFNLEPTGQIQLNLNFVRQNKDRRPLDLGLGRKGAIRQKKEEVHEMYGHKFVQRQFYNIMRCALCGDFLKGGAGMQCEDCKYTCHIKCYSSVVTKCISKSNAETDPDEEKINHRIPHRFQPFGNYTANWCCHCGYLLPFGKKSCRKCSECGLTAHSGCAHLVPDFCGMSMAVANQILEGIRTQKQRQKQSTNLGDRTLRPGKPNLISQQGGYGSQSAAPSPYGPGVASTQATEAAKVMYANQPPPQRPQHPDRTASASSSAAAAAAAASMAMSGSGAKAGTGPQAQASQDSWRHDPGNYGDSYDPQSVQQQQQSYGNAPQQRKYNPADYINVGQYPATRQQPGQMQHAQQQPVTIQQQQQQQQQIYQQPQPQPLQQQPPQAPVQVKTQQSEPPVSLPPVSSTAVDVTGPGVKKPLPSATDPGTGQRIGLDNFNFLAVLGKGNFGKVMLAETKRSNRLYAIKVLKKEFIIENDEVESIRSEKRVLLVANRERHPFLTNLHACFQTETRVYFVMEYISGGDLMLHIQRGQFGTRRAQFYASEVCLALKYLHENGVIYRDLKLDNILLTLDGHIKIADYGLCKEDMWYGSTTSTFCGTPEFMAPEILLDKKYGRAVDWWAFGVLIYQMLLQQSPFRGEDEDEIYDAILGDEPLYPIHMPRDSVSILQKLLTRDPDQRLGSGPTDAQEIMSQPFFRNINWDDIYHKRVQPPFLPTIKNPTDTSNFDSEFTSVTPVLTPVQSVLSQAMQEEFRGFSYTADFV

SEQ ID NO: 17947 - protein, 161 aa, Streptomyces coelicolor A3(2)
MSGKGAPELSVRNVGDLRVAVIASQWHDKVMDGLVDGALRALHELGIDEPTLLRVPGSFELPVVAKVLAGRGYDAIVALGVVIRGGTPHFDYVCQGVTQGLVQVSVETGVPVGFGVLTCDTEEQALDRAGIEGSSEDKGHEAVTAAVATAATLRSVSEPWR

SEQ ID NO: 17948 - protein, 288 aa, Oryza sativa Japonica Group
MEGKEEDVRLGANKFSERQPIGTAAQGSDDKDYKEPPPAPLFEPGELKSWSFYRAGIAEFMATFLFLYITVLTVMGVNNSTSKCATVGIQGIAWSFGGMIFALVYCTAGISGAHINPAVTFGLFLARKLSLTRALFYMVMQCLGAICGAGVVKGFQKGLYETTGGGANVVAPGYTKGDGLGAEIVGTFILVYTVFSATDAKRNARDSHVPILAPLPIGFAVFLVHLATIPITGTGINPARSLGAAIIYNRGHAWDDHWIFWVGPFIGAALAAIYHQVVIRAIPFKSRS

SEQ ID NO: 17949 - protein, 532 aa, Coxiella burnetii RSA 493
MLSLKSVSIAQGTKTLIEKINFSIFEKHRVGIVGSNGCGKTSLFEVIQGRLEPSAGEAQLAKGVRLASLAQEVRASSVSAIHYAISGDTELSRVMEKLNEAEQKEDYETVMECHNKLHALDGYSAEARAAKILNGLGFSAEEVYLPVKHFSGGWRMRLSLAKCLFTPSDLLLLDEPTNHLDMEAIIWLETFIKHYPGAVLMVSHDRDFLDNTVTHIAHIENQQFKLYTGNYSSFEMERAQRIALQNAQYKKQQMQIAHMMKFVDRFRAKASKAKQAQSRLRAIEKMEIIKPIYEKSPYQFKFMPPAKMSNPMLTLKRVDLGYDNQVVIKQVSFNIMAGERIGLLGLNGAGKSTLIKGLRGELTPLRGSINRPSQLVIGYFAQHQVDYLPLEGSPLSLLSRENSERENSESEGKLIAYLGSFGFNRDQSLSPVKQFSGGEKARIALALIIWRRPNLLLLDEPTNHLDLEVRQALAFALQEYEGALLLVSHDRHLMRTLVNELYLVEGGTVKTFEGSVEDYQGRVDCSNGDSGL

SEQ ID NO: 17950 - protein, 429 aa, Streptomyces coelicolor A3(2)
MSTAPILYSPDGPEDLVLDPVEQAVADIAAGRPVVVVDDENRENEGDLVIAAEKATEEIVAFMMTECRGLICAPMEGEELDRLRLPQMVDDNTESMKTAFTVSVDAGAAHGVTTGISAADRATTLRLLAGGTAEPGDLVRPGHVFPLRARPGGVLVRNGHTEAAVDLARLAGLRPAGAIVEIAGEDGRMLRLPELIPFARKHGLTIISIEDLIAYRRSAEPTVRREAEVRLPTKHGEFTAYGYRSTVDGVEHIALVHGEIGDGEDVLVRVHSECLTGDVFGSQRCDCGPQLDASLDRIQAEGRGVVVYLRGHEGRGIGLMSKLRAYELQERGRDTLDANLELGLPADARDYGAGAQILADLGVRAVRLLTNNPDKSDALERHGITVTGREPMPVQAGEHNLRYLRTKRDRMGHDLPWLDTTPVSTCGNQ

SEQ ID NO: 17951 - protein, 507 aa, Xylella fastidiosa 9a5c
MTIHNFDLLVVGGGINGTGIARDAAGRHLSVCLCEQHDLASHTSSASTKLIHGGLRYLEYYEFALVSKALAEREILLRQAPHIVRPLHFVLPHQPHLRPTWMIRAGLLLYDHLGFSRRTLPRSRRLNLAKHPTGQPLKQELHTGFMYCDAQVQDARLVVLNAMDAAQRGARILTRTRCVRTRRDGAHWLTELEDAQGRHEQIRTRAIVNATGPWAVTFLDHIAQQPHQHTLRLVKGSHIVVPRLFEHEHAYIFQQPDRRIVFAIPYEQHFTLIGTTDVDYVADPANPHIDAAETMYLCNAVNAYFRQQITPEDVLWSYSGVRPLLNDGHNNASKVTRDYQLEILGNSAPLLNVFGGKLTTYRKLSEEAVNQLCVALDHPYRAWTANGPPLPGGEHHDIAALQNTLRQHRPWLPTATAQRLIHNYGTCAETLLGSATNLHTLGIHFGADLYQAEVDYLRTHEWACSAEDILWRRSKLGLHLDAHGTQRLEDHLRSCSRIPDHADTTTQ

SEQ ID NO: 17952 - protein, 276 aa, Zea mays
  misc_feature (192)..(192): Xaa can be any naturally occurring amino acid
MPRPEFQAPPDVFYNESEARKYTTSSRIIEIQSRISERALELLALPNDGVPKLLLDIGCGSGLSGETLTEHGHHWIGYDISKSMLDVALERETEGDLLLADMGQGLGLRPGVIDGAISISAIQWLCNADKSSHDPRLRLKAFFGSLYRCLARGARAVLQFYADNVKQSEMIVTFAMRAGFAGGVVVDWPHSXTSLPKGKGENGEGCSDDDDNESSGEDGDRTVGIYERNRPKKRQKTKKNGKGKDWLLRKKEQMRRRGHDVPADTKYTGRKRKGYF

SEQ ID NO: 17953 - protein, 177 aa, Halobacterium sp. NRC-1
MANLWEDLETGPDAPDVIYAVVECLKGERNKYEYDKDIPGVVLDRVLHSNVHYPSDYGFIPQSYYDDGDPFDVLVLVEDQTFPGCVIEARPVALMEMDDDGEQDDKVIAVPEEDPRYDDVEDVDDLTDQQKAEIAEFFETYKNLEADKETAVLGWGDAQAAKDAIEHAQDLYDEQFA

SEQ ID NO: 17954 - protein, 440 aa, Helicobacter hepaticus ATCC 51449
MQEKMEVQYMVVSFSHKNVDIATREKLSFSQEEIVPFLQEINVCDSIRESILLCTCNRVELYVSMIDKKRAREHIYECFCTHKNIALEDIKNIALMRLNQYAIYHIFSVASSLDSLVIGETQITGQLKLAYKLAFENALCAKDMTRLMHFAFKCAASVRKETDISAHSVSVASTAVRMAEQKLALCDKTLENLPVLVIGSGEMGRLACKHLQNANAQITLVSRTKENARKLALELDSSINIESWEHLEQLLGQYEVLFSATSAPNCIIQSKMVQVSQKQRWWFDLALPRDIENIQMENLHIFCVDDLEEIVQEHKNAREDSAKKAQKILERYSVEFFKWLQTLGIDPIIKHIRYLAKQSALKELDRAVKKGFLPASYQQNVEKILHGAFNTFLHQPTIRLKQASENPQGDPIIEAMKNVFDISDDVVMLNGYKCEKDTIF

SEQ ID NO: 17955 - protein, 412 aa, Saccharomyces cerevisiae
MSELHALLTFPERPISQSYYVPKLQHFLKSGIPATYTLEQVAAFEHEEKNRNGDKEFRESTDDNKTSNTTPLHVLARSLPLDIKDEELQVVMDMMNILFEYGAGWNFIDYEDKTVGDLFLERNQSRESPLYRRLVEAGVSAELLLRKLNGGDVEFLDTDELIGIEPEESVQTAVDGQKEESVGSDDDATAANQQVYLKTELEYKDDALITKENKDGVMMDWETKIMELASETLFPDPEATNSATILNIGFGMGIIDTFIQARKPYRHYICEAHPDVLAKMKMDGWYEKDNVVILEGRWQDTLNNLLDKGEVFFDGIYYDTFSEHYQDILDLYDVVVGLIKPEGVFSFFNGLGADRSLCYDVYKEIVEIDVATYGMKCDYTRYSLDEQLPDWNDVKRSYFNCNYYYHPRITFA

SEQ ID NO: 17956 - protein, 547 aa, Shewanella sp. ANA-3
MLSLASSQTEQAEAQASQSKPGTSALEKSQLAQSYLQKILLSSVYDVAKVTPLSSLNKLSARLGCQVFLKREDMQPVHSFKLRGAYNRIAQLSQAECQRGVVCASAGNHAQGVAMSAASRGVDAVIVMPETTPDIKVDAVRRLGGNVVLHGQAFDQANGFAMEMAKLEGRVYIAPFDDEAVIAGQGTIAQEMLQQQRDLEVVFVPVGGGGLIAGIAAYYKAVMPQVKIVGVEPEDAACLKAAMEAGEPVTLAQVGLFADGVAVKRIGTEPFRLAKWFVDEVVTVTSDEICAAVKDIFEDTRAIAEPAGALSLAGLKKYVSTNAAGESGKGEKVAAILSGANVNFHSLRYVSERCELGEQKEAVLAVKVPERPGSFLRFCELLEKRVMTEFNYRFSSRDMAVVFAGIRLTKGHGELEQIINTLEDNGFEVQDLSGDETAKLHVRYMVGGHPPEPLEERLFSFEFPEHPGALLKFLTTLQSKWNISLFHYRNHGAAFGRVLAGFEVPEGDALPFQQFLTELGFVYQEETQSPAYQLFLNAGKGKKSLPL

SEQ ID NO: 17957 - protein, 336 aa, Odontella sinensis
MSINIGINGFGRIGRLVMRAAKGRSDINVVAVNDPFIPVNYMEYMYKYDTVHGKCGQEVSHDAEANTLTIDGKDVKVFGEMDPSKIQWGSAGADYVIESTGVFTSTEKASMHMKGGAKKVVISAPSGDAPMFVMGVNQEKYESSMDVVSNASCTTNCLAPLAKVINDEFGLKEGLMTTVHAVTATQQTVDGPSQKDWRGGRAACYNIIPSSTGAAKAVGKVIPELNGKLTGMSFRVPTANVSVVDLTARLDKGASYETICAAIKEASEGKMKGILGYQDEDIVSSDFIGDTHSSIFDEKAGIALTDDFVKLVSWYDNECGYSNRVLDLIKHIESDS

SEQ ID NO: 17958 - protein, 377 aa, Shewanella sp. ANA-3
MLPAPHFSAFNPPRRILMGPGPSDVYPEVLAAQARPTVGHLDPLFVGMMDELKSLIQYAFQTKNEMTMAVSAPGSAGMETCFVNLVEPGEKVIVCRNGVFGERMRQNVERVGAIAVLVDNEWGTPVDAAAVEAALKANPDAKFLAFVHAETSTGALSDAKTLCALAKQYGCLSIVDAVTSLGGVELRVDEWGIDAIYSGSQKCLSCVPGLSPVSFSPNAVEKLKNRKTPVQSWFLDQSLVMAYWTSAGGKRSYHHTAPVNALYALHESLRLLAEEGLENAWKRHQDMHLVLRAGLEKLGLKFVVAEASRLPQLNAIYIPEGVDDAAVRARLLKDYNLEIGAGLGALAGKAWRIGLMGFGARRENVALCLRALEEVLN

SEQ ID NO: 17959 - protein, 214 aa, Streptomyces coelicolor A3(2)
MRTEENEDVIVAPSPAVQVRARVEVPIDVPGLGPRASTMVSFDGLHDGREHVALLMPGWEKKSDPLVRVHSECLTGDVFGSQRCDCGPQLHEALAMCSHEGGIILYLRQEGRGIGLYNKFDAYLLQDGGLDTFEANAVLNFSHDLRDYRVAAEMLSALGVPRIRLLSNNPEKGNQLRSHGVVISDVVATGTFVNENNQAYLTAKRERAGHALEV

SEQ ID NO: 17960 - protein, 665 aa, Phaeodactylum tricornutum
MGRDRRLITISRFFSSGMDSRQHDGTRLQPARHQAFPLKFSKFLSTSPLSQGDKKVSLIVGIGTNCATTKAFTIMNLSLLALTFALGHAFVPPSFLASPSSRKVLSSSRSASVAANAADVLAKTTSSSSTPSSLMPKETTVAAVPKVAQRWRKSTKQVVTLGPASSNKEMIEKLFLAGADVFRLNFSHGSQEQKKELLIMIREVEEKYSHPIGILGDLQGPKLRVGEFSKPEGEFLELGQSFRLDLDNAKGDNKRVQLPHPEIIKASELGHALLVDDGKVKLVVTAKGDDYLECRVDVAGMIKDRKGVNTPDSVLEISPLTPKDRSDLEYMLGIGVDWVALSFVQTPADMVEIHALIDEKLPSGQFKPAVMAKIEKPSCFYDDNLQRIVGLCNGIMVARGDLGVECPPEDVPLLQKEIIDECRNQGRPVIVATQMLESMIEVPTPTRAEASDVATAIYDGADAIMLSAESAAGKFPEESVAMQQRIINRVEGDKHYRSYLKQNEPDPENTPTDAIITAARQVAKTIGAKSIVCFSLRGSTVLRASKSRPGVPILALCPFKETSRQLALSWGVYSDLPKAGSYGYTVSEEDMFNYDRPMVEKSTDDFDLVLKNACRAALKKGLVSDPDDLLVVTAGLPFGTPGAANIIRVVPAAGPSCWDGVCRVD

SEQ ID NO: 17961 - protein, 506 aa, Medicago truncatula
MNKNMSPLILLPFALLLFFLFKKHKTSKKSTTLPPGPKGLPFIGNLHQLDSSVLGLNFYELSKKYGPIISLKLGSKQTVVVSSAKMAKEVMKTHDIEFCNRPALISHMKISYNGLDQIFAPYREYWRHTKKLSFIHFLSVKRVSMFYSVRKDEVTRMIKKISENASSNKVMNMQDLLTCLTSTLVCKTAFGRRYEGEGIERSMFQGLHKEVQDLLISFFYADYLPFVGGIVDKLTGKTSRLEKTFKVSDELYQSIVDEHLDPERKKLPPHEDDVIDALIELKNDPYCSMDLTAEHIKPLIMNMSFAVTETIAAAVVWAMTALMKNPRAMQKVQEEIRKVCAGKGFIEEEDVEKLPYFKAVIKESMRLYPILPILLPRETMTNCNIAGYDIPDKTLVYVNALAIHRDPEVWKDPEEFYPERFIGSDIDLKGQDFELIPFGSGRRICPGLNMAIATIDLVLSNLLYSFDWEMPEGAKREDIDTHGQAGLIQHKKNPLCLVAKKRIECV

SEQ ID NO: 17962 - protein, 356 aa, Hypocrea virens
MSRSNPPNNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDTLSKEQLKQLIYQEIMR

SEQ ID NO: 17963 - protein, 513 aa, Phaeodactylum tricornutum
MTASQTKITASGPELRGANITLDTIMKKTDVSTRQTKIVCTLGPACWEVEQLESLIDAGLSIARFNFSHGDHEGHKACLDRLRQAADHKKKHVAVMLDTKGPEIRSGFFADGAKKISLVKGETIVLTSDYSFKGDKHKLACSYPVLAKSVTPGQQILVADGSLVLTVLSCDEAAGEVSCRVENNAGIGERKNMNLPGVIVDLPTLTDKDIDDIQNWGIVNDIDFIAASFVRKASDVHKIREVLGEKGKGIKIICKIENQEGMDNYDEILEATDAIMVARGDLGMEIPPEKVFLAQKMMIRQANIAGKPVVTATQMLESMITNPRPTRAECSDVANAVLDGTDCVMLSGETANGEYPTAAVTIMSETCCEAEGAQNTNMLYQAVRNSTLSQYGILSTSESIASSAAKTAIDVGAKAIIVCSESGMTATQVAKFRPGRPIHVLTHDVRVARQCSGYLRGASVEVISSMDQMDPAIDAYIERCKANGKAVAGDAFVVVTGTVAQRGATNLMRVMYA

SEQ ID NO: 17964 - protein, 514 aa, Medicago truncatula
MLEIQGYVVLFLLWFISSIFIRSLFKKSVCYKLPPGPPISFPILGHAPYLRSLLHKSLYKLSNRYGPLMHIMLGSQHVVVASTAESAKQILKTCEESFTNRPIMIASENLTYGAADYFFIPYGNYWRFLKKLCMTELLSGKTLEHFVHIREDEIKCFMGTLLEISKNGKPIEMRHELIRHTNNIISRMTMGKKSSGMNDEVGQLRKVVREIGELLGAFNLGDIIGFMRPLDLQGFGKRNKDTHHKMDVMMEKVLKEHEEARAKEGAGSDRKKDLFDILLNLIEADDGAESKLTRQSAKAFALDMFIAGTNGPASVLEWALAELIRNPHVFKKAREEIDSTVGKERLFKESDIPNLPYLQAVVKETLRMHPPTPIFAREATRSCQVDGYDVPAFSKIFINAWAIGRDPNYWDNPLVFNPERFLQSDDPSKSKIDVRGQYYQLLPFGSGRRSCPGSSLALLVIQATLASLIQCFDWVVNDGKSHDIDMSEVGRVTVFLAKPLKCKPVPHFVPFSSA

SEQ ID NO: 17965 - protein, 126 aa, Yarrowia lipolytica CLIB122
MSEPNPKAFPLADAALTQQILDIVQQATHLRQLKKGANEATKTLNRGISEFIIMAADAEPIEILLHLPLLCEDKNVPYIFVPSKVALGRACGVSRPVISASVTSNDASQLKDQIIQMKDKIERLLI

SEQ ID NO: 17966 - protein, 478 aa, Debaryomyces hansenii CBS767
MLLKGIYLFISLLVLSLARTVTVTSTRDYRVGLSTLFNEGNIQTTVTNSRASDSSDDLSSAAQTTAVTGCHLHGSEQFCIDGEGNEGSIIPGPSKTEDSPSSYTGCHSHEEDTFCLNSDGDEVQFVKDTESSSSSTSTSSGGKNCHFHAGVEHCVADGESEHGASAETCERVDRDYDIPLRIGLLFVILVTSAIGSFGPIVLTSFFKFKLDGVIITILKQFGTGIIISTAFVHLMTHADLMWGNSCITLGYESTATSITMAGIFLTFLIEYLGNRLIGWRSQKSSKRLIGRGNPEKANDITEETISPASTHNHDGPVLVNDEFSCVVMEAGIVFHSILLGITLVVAGDSYFITLFIVIMFHQMFEGIALSTRIVELPNTKLLKKLLMAGVYALVTPVGMAIGIGTLNKFNGNDPSTIIALGTLDSFSAGILIWTGLIEMWAHDWIFGNLATASFLKTSIALVSLIAGFIVMSVLGKWA

SEQ ID NO: 17967 - protein, 297 aa, Halobacterium sp. NRC-1
MRVAILGCGYVGCALARRLLAAGHDVVGVCRSPDSLDAVRETGATAVRADVTDAASLAAVPDADAVVFAASSGGRGADAAREVYVDGLRTVVEQFGGRDDPPEQLVYTSSTGVYGDHDGDWVDEETPLDPTTEKTAALVDAERVALTDASEHGLDPTVVRFAGLYGPDRYRLTRYLDGPVTEGYLNMIHRDDAAGVVAFALTDADADVLLAVDDDPVSKWAFADWLADEAGVPQPAKQTVAERIAAGDLSTPAERRLRTSKRCSNARLTELGYSFAHPTFRSGYQAAIRAHERGEYK

SEQ ID NO: 17968 - protein, 543 aa, Phaeodactylum tricornutum
MSLSQSSDVPILAGGFITLDTVKHPTNTINRRTKIVCTIGPACWNVDQLEILIESGMNVARFNFSHGDHAGHGAVLERVRQAAQNKGRNIAILLDTKGPEIRTGFFANGASKIELVKGETIVLTSDYKFKGDQHKLACSYPALAQSVTQGQQILVADGSLVLTVLQTDEAAGEVSCRIDNNASMGERKNMNLPGVKVDLPTFTEKDVDDIVNFGIKHKVDFIAASFVRKQSDVANLRQLLAENGGQQIKICCKIENQEGLENYDAILQATDSIMVARGDLGMEIPPAKVFLAQKMMIREANIAGKPVITATQMLESMINNPRPTRAECSDVANAVLDGTDCVMLSGETANGPYFEEAVKVMARTCCEAENSRNYNSLYSAVRSSVMAKYGSVPPEESLASSAVKTAIDVNARLILVLSESGMTAGYVSKFRPGRAIVCLTPSDAVARQTGGILKGVHSYVVDNLDNTEELIAETGVEAVKAGIASVGDLMVVVSGTLYGIGKNNQVRVSVIEAPEGTVKETPAAMKRLVSFVYAADEIPGNAD

SEQ ID NO: 17969 - protein, 539 aa, Phaeodactylum tricornutum
MGTYPAGVCYAVVYLNGRYRSYLVLTITGARLDHSLLPTMFQGPACWSEEGLGQLMDAGMNVARFNFSHGDHEGHGKVLERLRKVAKEKKRNIAVLLDTKGPEIRTGFFADGIDKINLSKGDTIVLTTDYDFKGDSKRLACSYPTLAKSVTQGQAILIADGSLVLTVLSIDTANNEVQCRVENNASIGERKNMNLPGVVVDLPTFTERDVNDIVNFGIKNKVDFIAASFVRKGSDVTNLRKLLADNGGPQIKIICKIENQEGLENYGDILEHTDAIMVARGDLGMEIPSSKVFLAQKYMIREANVAGKPVVTATQMLESMVTNPRPTRAECSDVANAVYDGTDAVMLSGETANGPHFEKAVLVMARTCCEAESSRNYNLLFQSVRNSIVIARGGLSTGESMASSAVKSALDIEAKLIVVMSETGKMGNYVAKFRPGLSVLCMTPNETAARQASGLLLGMHTVVVDSLEKSEELVEELNYELVQSNFLKPGDKMVVIAGRMAGMKEQLRIVTLDEGKSYGHIVSGTSFFFERTRLLDFND

SEQ ID NO: 17970 - protein, 563 aa, Idiomarina baltica OS145
MSDEQKRPLYIPYAGPSLLETPLLNKGSAFSKEERAAFNLTGLLPPRYESIEEQAERAYMQYKSFETPLNKHIYLRAIQDNNETLFYRLLTDHLEEMMPIIYTPTVGDACEKFSDIYRSSRGLFISYSERDQLDDILRNATKQKVKVIVVTDGERILGLGDQGIGGMGIPIGKLSLYTACGGISPAYTLPVMLDVGTNNEKLLNDPMYMGARHKRINQEQYDEFLEKFIKAVTRRWPGVMLQFEDFAQPNAMPLLRRYRDEVCCFNDDIQGTASVTVGTLLAACRQKGKKLSEQKVVFVGAGSAGCGIAEQVMIQMVAEGLSEEQAKKQIFMVDRYGLVVDSMSDLRDFQQALAQPIDSLKDWQYSGDYPSLLDVIHCAEPDVLIGVSGQAGLFTEQVITTMARYVEQPIIFPLSNPSKHVEAHPHDVIKWTQGKAIVATGSPFGEVEWEGTTYPIAQCNNSYIFPGIGLGVIAVKATRVSDEMFRVASKTLAKASPSANGKNKNLLPGFTELAQLSKDIAFAVAKVAQEEGVALEIDDEVLKQRIEKNFWSPEYRHYKRVSI

SEQ ID NO: 17971 - protein, 593 aa, Zea mays
MDQYEVLEQIGKGAFGSALLVRHKAEKKKYVLKKIRLARQTDRTRRSAHQEMQLIATVRNPFIVEYKDSWVEKGCYVCIVIGYCEGGDMAEAIKKVNGNHFSEEKLCKWLVQLLMALDYLHANHILHRDVKCSNIFIARDQSIRLGDFGLAKILTSDDLASSVVGTPSYMCPELLADIPYGTKSDIWSLGCCIYEMAALRPAFKAFDMQALISKITKSIVSPLPTRYSGSFRGLIKSMLRKSPEHRPSAAELLKHPHLQPYVLQVQLKSSPSRTTSPIYQALTDKVKKMTFVSDTADSARRRAARRSSLGSERTVTFCKPSPERNSVSSTRSIKEYTTTTQSARELSVGSSLQVDDEVTSKAVVTKTAGVLRTPSKSRAPASKTLVAARSRLDPPKTSYARTNRAELDSRTPLSKSSARTARRASLPLAAYRAPSGRAASVLNQLDSPDVSVNAPRIDRIAEFPLASSEDPLAPGHDVSCSTPPFINRSITKDKYTVQVLHRGDGDNASDSSGRNATAASSGGSNDSRQQRFDTSSYQQRAEALEGLLEFSAQLLQQERYEELGILLKPFGPEKASPRETAIWLTKSFKETAS

SEQ ID NO: 17972 - protein, 399 aa, Prosthecochloris aestuarii DSM 271
MAKILEGSAMKFFNKWGIPVPNYVVVMDPNRLAQLGEANKWLRESKLVVKAHEAIGGRFKLGLVKLGLNLEEAVEASREMIGRKIGTAEIRQVIVAEMLDHDEEYYVSIAGNPDGAELLLSSKGGVDIEDNWDTVQRIHIPIDETPSLEALTDLATKAGFGDQEIAERVAKIASRLILCYDNEDAQSIEINPLVIRKSDMRFAALDAVMNVDWDARFRHPDWDFKPVSEIGRPFTEAEQQIMDIDSRIKGSVKFVEVPGGEVALLTAGGGASVFYADAVVARGGSIANYAEYSGAPPDWAVEALTETLCQLPNIKHIIVGGAIANFTDVKATFGGIINGLRESKANGYLDGVKIWVRRGGPNESEGLAAISKLKDEGFDIHVYDRNIPMTDIVDMAMNV

SEQ ID NO: 17973 - protein, 559 aa, Alcaligenes sp.
MYLNITGMTCDSCATHVKDALEKVPGVLSALVSYPKGSAQLATDPGTSPEALTAAVAGLGYKATPADAPSTSARGRLLGKALGWLGGGDKAGGDGDGLHVAVIGSGAAMAAALKAVEQGANVTLIERGTIGGTCVNVGCVPSKIMIRAAHIAHLRRESPFDGGIAATVPAIDRSKLLAQQQARVDELRHAKYEGILDDNPAITVLHGEARFKDDQSLAVRLNDGGERVVAFDRCLVATGASPAVPPIPGLKESPYWTSTEALVSDTIPERLAVIGSSVVALELAQAFARLGSKVTILARSTLFFREDPAIGEAVTAAFRAEGIKVLEYTQASQVAHVDGEFVLTTGYGEIRADQLLVATGRAPNTRSLALEAAGVAANAQGAIVIDKGMRTSTPHIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSGRLIGVQAVAPEAGELIQTAVLAIRNRMTVQELADQLFPYLTMVEGLKLAAQTFSKDVKQLSCCAG

SEQ ID NO: 17974 - protein, 561 aa, Pantoea agglomerans
MTTLKITGMTCDSCAAHVKEALEKVPGVQSALVSYPKGTAQLAIEAGTSSDALTTAVAGLGYEATLADAPPTDNRAGLLDKMRGWIGAADKPSGNERPLQVVVIGSGGAAMAAALKAVEQGAQVTLIERGTIGGTCVNVGCVPSKIMIRVAHIAHLRRESPFDGGMPPTSPTILRERLLAQQQARVEELRHAKYEGILDGNSAITVLHGEARFKDDQSLIVSLNEGGERVVMFDRCLVATGASPAVPPIPGLKESPYWTSTEALASDTIPERLAVIGSSVVALELAQAFARLGSKVTALARNTLFFREDPAIGEAVTAAFRAEGIEVLEHTQASQVAHMDGEFVLTTTHGELRADKLLVATGRTPNTRSLALEAAGVAVNAQGAIVIDKGMRTSSPNIYAAGDCTDQPQFVYVAAAAGTRAAINMTGGDAALDLTAMPAVVFTDPQVATVGYSEAEAHHDGIETDSRLLTLDNVPRALANFDTRGFIKLVIEEGSGRLIGVQAVAPEAGELIQTAVLAIRNRMTVQELADQLFPYLTMVEGLKLAAQTFSKDVKQLSCCAG

SEQ ID NO: 17975 - protein, 548 aa, Pseudomonas fluorescens
MTEITVNGMTCTSCATHVKDALEKIPGVNAAVVSYPESRAQVMADTAVSHNQLLAAIAALGYQGSIRVGDFKDEPKIRDALEGAGLHIAIIGSGGAAMAAALKAVEQGATVTLIERGTIGGTCVNIGCVPSKIMIRAAHIAHLRRESPFDGGIAATVPAIDRSKLLAQQQARVDELRHAKYEGILDGNPAITVLHGEARFKDDQSLVVRLNEGGEREVTFDRCLVATGASPAVPPIPGLKESPYWTSTEALVSDTIPARLAVIGSSVVALELAQAFARLGSQVTILARSTLFFREDPAIGEAVTAAFRAEGIEVLEHTQASQVAHVNGEFVLTTGHGELRADKLLVATGRAPNTRSLALDAPGVTVNAQGAIVIDQGMRTSNPNIYAAGDCTDQPQFVYVAAAAGTRAAINMTGGDRALNLTAMPAVVFTDPQVATVGYSEAEAHHDGIETDSRTLTLDNVPRALANFDTRGFIKLVIEEGSGRLIGVQAVAPEAGELIQTAVLAIRNRMTVQELADQLFPYLTMVEGLKLAAQTFNKDVKQLSCCAG

SEQ ID NO: 17976 - protein, 373 aa, Thermoproteus tenax
MDTCKTEEWRKLRNAGKACPHRGQSVEENLELWDKMLRGDFREGESVLRVKTDLTHPDPSVRDWVAFRIIDVERNPHPLVGAKYHVWPTYNFAVSIDDHLMGVTHVLRAQEHSVNTVKQSFVFKHFGWTQPVTIHFGRLKVEGGSLSKSKLKALKLRYDDITMPTLAGLRSRGIQPEAIWELILSVGIKPSDATVSLANLFSINRKILDPKADRYMFVPEPVKLVINLPKRIVAKIPVHPSFPERGHREYELGPGEVSLYISRKDAELGSFRLMELANVVVRRKEGDVYYGEVVGYTIDEAREAKMPIIQWTPDNSREAVVIRPVAAGKKAVERGLIEPGAETLREGDIVQFLRYGFVKLASRDTMEFIYIHE

SEQ ID NO: 17977 - protein, 557 aa, Shewanella putrefaciens
MILLSIEGMTCPSCVAHVKEALDAIEGVNKVEISYENARATITTNGGVSVTVLIGAIEALGYIAKESTGTAKEITSPNDCCDNENASNTESNQTQHVAIIGTGSGAFACAIKAAEGGAKVTLIEGADVIGGCCVNVGCVPSKILIRAAQLAQQQRNNPFTGLENHAPQLSRALLTQQQTARVEELRAAKYQNILETNPALSLLKGWAQFKNANTLIVRKNDGTEQAVHADKILIATGSTPTIPPIDGLTETPYWTSTEALFAQELPQHLVVIGSSVVALEIAQAYRRLGSEVTILARHTLLYREDPLLGEKLTGCFEKEGIRVLNSTQATKVTHDGSQFTLETNAGDLRCDRLLVSTGRHANTCQLNLGAVGVTTNKKGEIVVNERMETNVPGIYAAGDCCNMPQFVYVAAAAGSRSGINMTGGYAKLDLSTMPAVIFTDPQVATVGLTEEQANAQDIETDSRVLEMENVPRALANFETDGFIKLVTEKATGRLIGAQILAHEGGELIQSAALAIRNRMTVTELADQLFPYLTMVEGLKLCAQTFNKDVKELSCCAG

SEQ ID NO: 17978 - protein, 509 aa, Salinibacter ruber DSM 13855
MPFQRRLSPNTRPPLALFVAVDSVMPDPTADSSSEANEEVLTGNVLKIVLLSLSAALGGFLFGFDSGVINGTVEAIQSDFGAGEVVTGFNVASMLLGSAVGAFFAGNLADKVGRRPTLILTALAFMVSAWGSGAAGGSVPFVAARLIGGLAVGAASILAPAYISEIAPSSIRGSLATLQQLMIVVGLFVAFLNNYLIAQAAGSAANAFWMGFDAWQWMYWMELIPASVFFLSLLAIPESPRYLVAANREEEAASVLDSLGTATNVKEKLADIRSTLNDERRPRLTDVIQEHTGRIHPLLWAGIGLAALQQLTGINVVFYYGGTLWQAAGFTEASALLTNVVNGSVNVVFTFVAIALIDRVGRRPLLLVGSIGQALMLGVMAYVFATAAQGGAGGIEMQGNQGVVALVAANAYIAFFAFSWGPVMWVMLGEMFPNRFRGAALSICGLVQWLSNFLVTWTFPILLGSIGLGISYGIYAAFGVVAFVFVKLFIDETKGRSLEDMSREADAAA

SEQ ID NO: 17979 - protein, 236 aa, Oryza sativa
  misc_feature (68)..(68): Xaa can be any naturally occurring amino acid
  misc_feature (80)..(80): Xaa can be any naturally occurring amino acid
  misc_feature (89)..(89): Xaa can be any naturally occurring amino acid
LVTDNLVEDLLSDFEFELQPPYLLYRNAAQEVNGIWFYNQQDCDAVAGVFGRILNAYAKGPPKPKGPXTESELREIEAVXSAAIDGPLXSSSSTVLVSNAPDESLTDYFSGAVNVGNVSITPMVGRTHQPIESVAFSQVPMIIPFGWGPTHSQWGVPFQGAGIRVSKQMCPGLDHLNGSPSMSQNSQNKYSGATLQGHYLCEPFPSILGSSRRFTLRCGKPRGFHILLIGAHKETF

SEQ ID NO: 17980 - protein, 434 aa, Shewanella oneidensis MR-1
MTSYQILCILSALALVTSVASSRLHKLQETVAITALALGTSLLLLLGGKALGGNVYGYFVAGLEKLDFQALLLNGMLGFLLFAGALQIRLKILRHQKWEILILAFVGTLLSTFIVGGLLYYLAPMFGLPLALSHCLLFGALISPTDPIAVLAILKKMGAPEDIAIQVEGESLFNDGIGLVIFVAISHLAFSTEPLTFTQISLLFVQEALGGVLYGAVLGLLLHHFFRYCEEETQLMLVTLLIPTAGYVMAAELGVSGPLAMVSAGIIIGNYSVPKFFARQERVKLYTFWSLIESFFNALLFLLLGLLLLLVTFKAPLWWFMLLAIPLVLTARAVSVFLPYMGFRLVKSYNPYAESILIWGGLRGGLALAMAMSLPKGIIIDSQPGVELHELVLVMTYAVVVFSILIQGSSMTGLIRRSNAVVTRPDSHTTQESR

SEQ ID NO: 17981 - protein, 420 aa, Galdieria sulphuraria
MFVGIHLLDSFGKSLVQLEVDGALCAGAVEKFLVAYRQHNAHPPPIIETERVVLYSVVFATTPSLRLLAVSNKRKNAMANLAFCRKLANLIEAYAVPVSFIEHITGATKEEDRLVLALIESRECVLNCFLIIMYSLLFSFPQDLPLEVLYIWKEYVAKETTIFKRLKKSFERSSYLEPTEIPVLKEARKNDTSLVSLQEALSKVSWRPPGLFYNRNEVFTDITEHLECIYSSSGKEILSQVHGTLVLHNFTSGMPECRMLINSKLTKQSQVIPHKGNPDTDLRGIAGVVGVSSESITLDDVRYHPCVDLKLVEELDALSFVPPDGTFTLLEYRSSKSKSPLLVEGIGYFKERGMEATLELKVKSNLSNQMKLFEWKAEQVTVTVELPQRPYQVKSSSNGGKVEMVQRTKMVYLGIEESCF

SEQ ID NO: 17982 - protein, 671 aa, Shewanella oneidensis MR-1
MQKPQPLNHTREQITQLDNDLLSLLAERRRLSLEVARSKEVDVRPIRDTQREKELLARLVTAGREKGLDAHYVISLYQSIIEDSVLNQQAYLHGRANPETQKQQYCIAYLGARGSYSYLAASRYCQRRQVEMLDLGCQSFDEIVQAVESGHADYGFLPIENTSSGSINEVYDVLQHTSLSIVGETTIEVSHCLLGKPGSKLSEIKTVYAHPQPISQCSRYLSQHKALRLEYCSSSAEAMEKVNQSPDNSAAAIGSAEGGALYQLESIESGLANQKINQSRFIVVARKAVAVPEQLPAKTTLIMATGQKAGALVEALLVLKAHQLNMSKLESRPIPGTPWEEMFYLDIDANISSEAMQQGLKQLERITRFIKVLGCYPCETVTPTQLSNSQLLIEPNTSKAEVLSEVSTKQSPYRYSKAYKAQASEIHCGPFTIGAGHIGAIAKVTLSKSLLHLESSHAAAHIALSAFEHKIKQLKEVGFQAVILEGCQQLASKEAIIPKLRQTLHQYDLLCVIAIEQAADMPLATEHADMLFLTGKQMFNQALLTQAGTLPIPLFLERNDMASYEEFLAATETILSQGNQQLILCDSGIRTYNNANLPTLDLASLILIKANSHLPIVINPCYAINEDALVLQTQGIKQLKADGIVLNYALEEDKAHHSLALMGEVVRELYR

SEQ ID NO: 17983 - protein, 446 aa, Bacteroides thetaiotaomicron VPI-5482
MGDPKAFLNIPRQEAGYRPVSERITDYSQVEQTLNTNSRKLQASRCMDCGVPFCHWACPIGNKQPEWQDALFKGKWKEAYEVLSSTCDFPEFTGRICPALCEKSCVLKLSCDQPVTIRENEAAIVEAAFREGYIQVQHPQRNGKKVAVVGAGPAGLVVANQLNLKGYTVTLFDKDEAAGGLLRFGIPNFKLDKNVIDRRMKILAAEGIQFEMGVEIDVNHLPEGFDAYCICTGTPTARDLSIPGRELKGIHFALEMLAQQNRILEGQTFPKDKLVNAKGKKVLVIGGGDTGSDCIGTSVRQGATSVTQIEIMPKPPVGHNPSTPWPQWPVVFKTTSSHEEGCTRRWCLTSNQFLGKNGKVTGVEVEEVEWTPATDGGRPTMNLTGKKEVIEADMVLLAMGFLKPEQPKFAENVFLAGDAATGASLVVRAMAGGRKAAADIDHYLVK

SEQ ID NO: 17984 - protein, 587 aa, Corynebacterium efficiens YS-314
MMTAQNHLVDTTTRSVPPDMKNRAADSDDLSSFGYEQQLQRNLGRFASFAAGFSFVSILTTIFQLFGLGFGFGGPAFFWTWVAVFIGQYMVALCFAELAARFPVSGAIYQWSRRMGGEFIGWFAGWFMILAQIVTAAAAAIALQVVLPNIWSGFQIIGDDPTLTSPSGAANAVLLGSVLIVLTTVINCIGVRWMSYVTTIGVVCELVGVVAIIGVLFAHAQRGPQVVFETNWTGDSSGYIGAWIASALMAAYVMVGFGSAGELAEETRNPRAVAPKTIRQALSVSALGGGLLILGALMAAPSLTDGRLSVEGLPYVLNTVLESPWGTVLLIDVAIAILICTLAIQTAASRLMFSMARDHRLPASRMLSRVNTTTGTPILPSIVVGVACILILLINVGNDALFATITSVCIILIYLAYLLVTAPLLLRRIQGWPYDRGTSTDANGKQLFTLGRWGLPVNICAVVYGTVMVVNLSWPRAEIYNPSGDTPIMQWAGPIAVGAVIILGLMAFPRNRAHPHPVALESPRNSHTAAAPPATMTITPDPTDVVTGTEATGIHAESARTSTRTSTGTSTGAVVPQSAIPDRSTHF

SEQ ID NO: 17985 - protein, 388 aa, Bacteroides thetaiotaomicron VPI-5482
MRNVTLILDDGSRFSGKSFGYEKPVAGEVVFNTAMTGYPESLTDPSYAGQLMTLTYPLVGNYGVPPFTIEPNGLATFMESEKIHAEAIIVSDYSSEYSHWNAVESLGDWLKREKVPGITGIDTRELTKILREHGVMMGRIVFDDEIVGEIDNGQLTMDNYAAVNYVDRVSCKEIISYLPDGTSQCFPLSTSIAQLNSQLLTFNSQLKKVVLVDCGVKTNIIRCLLRRGVEVIRVPWDYDFNGLEFDGLFISNGPGDPDTCDAAVQNIRKAMANEKLPIFGICMGNQLLSKAGGAKIYKLKYGHRSHNQPVRMVGTERCFITSQNHGYAVDNNTLGADWEPLFINMNDGSNEGIKHKKNPWFSAQFHPEAASGPTDTEFLFDEFVNLLK

SEQ ID NO: 17986 - protein, 413 aa, Coxiella burnetii RSA 493
MPLLVCGINHQSAPLTVREKLVFTPERTPLALQSLLAEKAVNEALLLSTCNRTEIYTTVDEAATILRWLSKQPQLSGIDLRSFCYARRDIEMVRHVMRVGSGLDSMVLGEPQILGQMKQAYLLARRIGAVGSELGRLFPAVFAATKRIRSETAIGANPVSIAYAVVQLAKRIFSHLNQCQILLIGAGETIELVFSHLYNQGARHFFIANRTLTRAKQIAEPYHAQAIRLSDIPTYLPKVDIVISATMSQLPLVGKGAVESALRQRKRRPLFMADLALPRDIEPETAQLEDVYLYNIDDLQTLIAQNRQTREAAAKQAEAMVEMQAIHYMRQLQVHKAGDTIRRFRERVEMLRDQELEKALAHFQRTNDPKAVIAHFAHNLTNKILHQPTTKLRQAAYEDQVQLLLSAKELFDL

SEQ ID NO: 17987 - protein, 341 aa, Pseudomonas aeruginosa
MMSRYEELRKELPAQPKVWLITGVAGSIGSNLLETLLKLDQKVVGLDNFATGHQRNLDEVRSLASEKQWSNFKFIQGDIRNLDDCNNACAGVDYVLHQAALGSVPRSINDPITSNATNIDGFLNMLIAARDAKVQSFTYAASSSTYGDHPGLPKVEDTIGKPLSPYAVTKYVNELYADVFSRCYGFSTIGLRYFNVFGRRQDPNGAYAAVIPKWTSSMIQGDDVYINGDGETSRDFCYIENTVQANLLAATAGLDARNQVYNIAVGGRTSLNQLFFALRDGLAENGVSYHREPVYRDFREGDVRHSLADISKAAKLLGYAPKYDVSAGVALAMPWYIMFLK

SEQ ID NO: 17988 - protein, 350 aa, Bacteroides thetaiotaomicron VPI-5482
MSMDNHIVIMAGGIGSRFWPMSTPECPKQFIDVMGCGRTLIQLTADRFDGVCPRENVWVVTSEKYIDIVREQLPEIPESNILAEPCARNTAPCIAYACWKIKKKHPNANVVVTPSDALVINTGEFRRVVEKALRFTDNSSAIVTLGIKPTRPETGYGYIAAGDQIMTDKEIFTVDAFKEKPDRETADRYLAEGNYFWNAGIFVWNVRTITSVMRVYAPGIAQIFDRIFPDFYTEKENETIKKLFPTCEAISIDYAVMEKAQEIYVLPASFGWSDLGTWGALRGLLPQDKSGNATVGADVRLYESKNCIVHTSEEKRVVIQGLDGYIIAEKDNTLLICKLDEEQRIKEFSK

SEQ ID NO: 17989 - protein, 296 aa, Bacteroides fragilis YCH46
MNSIIVGMGEALWDVLPEGKKIGGAPANFAYHVSQFGFDSRVVSAVGNDELGDEILEIFREKQLKHQLERVNYPTGTVQVTLDNGGVPCYDIKEGVAWDNIPFTDDLKRLALSTRAVCFGSLAQRDEVSRATINRFLDTMPDMEGQLKIFDINLRQNFYTKEVLRESFRKCNVLKINDEELIIISRMFGYPGIDLQDKCWILLAKYNLKMLILTCGTNGSYVFTPGTVSFQETPKVPVADTVGAGDSFTAAFCSSVLKGKSIPEAHRLAVEVSAYVCTQSGAMPVLPEALRNRLND

SEQ ID NO: 17990 - protein, 141 aa, Burkholderia xenovorans LB400
MAIERTLSIIKPDAVAKNVIGQIYTRFENAGLKIVASRMVHLSRADAEKFYAVHAARPFFKDLVDFMISGPVVVQALEGENAILKHRDLMGATDPKKAEKGTIRADFADSIDANAVHGSDAPETAAVEIAFFFPQVNVYSR

SEQ ID NO: 17991 - protein, 421 aa, Chlamydomonas reinhardtii
MPLLSMFKALPAVAAAGALAAVSGAGYLLTQQQQLDYRQLRLVWEALHERAVMLALAPHLAHPLPILTPCYKWWEVPYYWAGLKAYDLVAGRRSLNPDGKVVGAVVQDRLGQEPAFEVYARVVMNTTGCFSDQVRHMSQPDAPDIIQPSSGAHVTLPAWYAGTHSNGLIIPKTKDGRVVFMIPFLGHVIAGTTDSRCAVTARPTASSQEVGFILEALQDYLDIQVRPSDVLSTWSGIRPLAADPRAKDTQNTVRDHVIIEESDGMITVSGGKWTTYRRTARLPLLGGAGYSHTLPQQLAQEHGRAAGAGRGSGSGRVVIDEATAAHLAQAYGSRAGRVLQTAEDRGLGSRLVVYAVRHEYCHTPEDFLARRTRLAFLDARAALSALPRVVDIMAAECGWDAARRSAMSAAARDYLRGTMLS

SEQ ID NO: 17992 - protein, 243 aa, Ipomoea batatas
MSAPPCVAEVKVESYVFPATAKPPGTAKTLILGGAGARGLNIDGKFVKFTAIGVYLEADAVPSLAVKWNGKSAEELTDSVQFFRDIVTGPFEKLTRITMILPLSGKQYSEKVSENCVAFWKAAGMYGDAESKAIEKFNDVFSDQMFPPGASIFFTQSPHGSLTISFSKEGSMPEIASAVIENKPLSEAVLESIIGSKGVSPEAKQSLAVRLSELFKNGVNGGDAITGKVGCENDAIPQTVVSK

SEQ ID NO: 17993 - protein, 465 aa, Yersinia pseudotuberculosis IP 32953
MSDQQEGAELKRGLKNRHIQLIALGGAIGTGLFLGIAQTIKMAGPSVLLGYAIGGFIAFLIMRQLGEMVVEEPVAGSFSHFAYKYWGHFAGFASGWNYWVLYVLVAMAELTAVGIYVQYWWPEIPTWVSAAVFFLAINAINLANVKVYGEMEFWFAIIKVIAIIAMILFGGYLLISGRGGPEATVTNLWAQGGFFPNGIMGLVMAMAVIMFSFGGLELVGITAAEAEDPAKSIPKATNQVIYRILLFYIGSLAILLSLYPWGKVVEGGSPFVLIFDALDSNSVATVLNIVVLTAALSVYNSCVYCNSRMLFGLAKQGNGPKILLKVDGRGVPVIAIAVSAFATAFCVLINYLLPGRAFELLMALVVSALVINWAMISLAHLKFRAAKNRQGVIPKFKAFWYPFGNCLCLLFLTGILVIMFLTPSIRISVILIPVWVVVLAIGYILKNQSQRQNQQLSASSRKATK

SEQ ID NO: 17994 - protein, 263 aa, Candida albicans
MPKNTLYVTGFSRESKAADLAPDFEKYGELVRLDIPPPRSDDGEKYAFVEYKDAESCERALELDGKTLPYSIKDGLVVQVARSDPYRVRQQFSGPRGGYRDGGYGGRGGYRDGGYGGRGGYRDGGYGGRGGYGGGRGGGYGGYRDGGRGGYRDGGRGGYGGYRDGGRGGGYGGYRDGGRGGGYRDGGYRDGGYRDGGRGGYGGGRGGYDRDREEGRGGYDREEDRGGYERDEGREPRVEERRYSRSPSRSPPRRDRSRSPERY

SEQ ID NO: 17995 - protein, 517 aa, Achlya bisexualis
MLARSLRSRAVRSFARGLSNKPSKNDAFSMTKIVGTVGPVSENAKTTQELTNAGLKIMRINFSHATYDEAHLRMSHLRASKGVHAKHTGKEFNVRAVLLDTQGPEIRGGAFPEKKINLTKGDMITLTTDVQYKEASTKDMLYVTYEQLPATVKVGDTVLLDDGLISLTVKSIDVASGQVRCLIENSEVLGSRKGVNLPGLVVDLPALTAKDKQDVEFGVEHDMDFIAVSFVRKPEDVNDVKDFVNSVMPKYWPAGHPAPLIISKIENYEGVSNFDRILEVSDGIMVARGDLGVEIPMQEVLTCQKDMVSKCNAAGKPVIVATQMLESMIRNPRPTRAEILDVGNAVLDGADAVMLSGEVAQGKWPVESVKTMMSVIKEADAYVKREQYKKEALSQKEAVACAVATTAKSLHAAMIVVMTASGEVARLVSKHKPSVPVMCYTTSQKVGRQLQIHRGLYPIVAPTPCKMNLQEAISTAKKLGWLHNGDQVVMLSSETPTGVVGQQYIMRVATVGEDIAH

SEQ ID NO: 17996 - protein, 524 aa, Yersinia pseudotuberculosis IP 32953
MSIEINVPDIGADEVEVTEIMVKVGDTVEAEQSLITVEGDKASMEVPSPQAGVVKEIKIAVGDKVATGSLIMVFDATGAAAAPVKAEEKPAAPAQAAAPAASAAKNVEVPDIGDDEVEVTEVMVKVGDKVDAEQSLITVEGDKASMEVPAPFAGIVKEIKISTGDKVKTGSLIMVFEVEGAAPAAEAAPAQQAAPVAPAPAAAPAAKAESKGEFAENDAYVHATPVIRRLAREFGVNLAKVKGTGRKGRILREDIQAYVKDAVKRAEAAPAAAGGGLPGMLPWPKVDFSKFGEIEEVELGRIQKISGANLSRNWVMIPHVTQFDEADITEVEAFRKQQNIEAEKKKQDLKITPLVFLMKAAAKALEEFPRFNSSISEDGQKLTLKKYINIGVAVDTPNGLVVPVFRDVNKKGIVELSRELSVISKKARDGKLTASDMQGGCFTISSLGGIGGTAFTPIVNAPEVAILGVSKSSMKPVWNGKEFAPRLMLPLSLSFDHRVIDGAAGARFAAYIATIMADIRRLVM

SEQ ID NO: 17997 - protein, 506 aa, Achlya bisexualis
MAGAINLHKQGVELEAIMGDNEGQTRRSKIFCTIGPACWSVEKLTELIDAGMNVARFNFSHGDHKTHSEVLNRLRTAIASRPHRHVAIMLDTKGPEIRTGFLATEDKKVHIEKDSIIEFTTDYEFLGDETKLACSYEDLPTSVKVGGPILVADGSLVLEVTEILETGVKARALNSATLGERKNMNLPGAKVTLPTLTERDEDDLINWGLVQGVDFIAASFVRCGQDIDNIRAVLGPRGRAIKIIAKIENQEGLENFDDILEKTDGIMVARGDLGMEIAPEKVFLAQKMMIRKANIAGKPVVTATQMLESMIHNPRPTRAECTDVANAVLDGSDAVMLSGETANGDYPVEAVRMMHKTCLQAEGAIHYDELYQALRNSVLETNGKMSTQEAIASSAVKTAIDMGAKMIVVLTETGTTARLIAKYRPACPILVLTALGETARQCEGFLKGSYCRVMGSMIGTDSILYRATDLGKQFGWIKKGDAVVAIHGMMEARSGSTNMLKVLVCD

SEQ ID NO: 17998 - protein, 546 aa, Medicago truncatula
MSTNIDNLWIFALASKCTQENIAYSLLIMALLWITMTFFYWSHPGGPAWGKYYYSSNYSTTKTNNKNNLNSSTKPSTTTSSSIFIPGPKGYPLFGSMNLMSSSLAHHRIASTAKTCKATRLMAFSLGDTRAMVTCNPDVAKEILHSSVFADRPIKESAYSLMFNRAIGFAPYGVYWRTLRKISTNHLFSPMQIKSSGPQRSEIATQMIDLFRNRHLHGGFCVRDVLKKASLNNMMCSVFGQRFKIDEVNERMMELSGLVEQGYDLLGGLNWGDHLPFLKDFDVQKIRFSCSELVPKVNRFVGSIISDHRADKNQTNKDFVHVLLSLQEPDKLSDSDMIAVLWEMIFRGTDTVAVLIEWILARLVIHPDVQKKVQTELDEVASGESCAITEEDVAAMVYLPAVIKEVLRLHPPGPLLSWARLAITDTTIDGYHVPAGTTAMVNMWAISRDPDVWRNPLEFNPERFVSEGAEFSVLGSDLRLAPFGSGRRSCPGKNLGLATVTFWVAKLLHEFEWLPLDEVNGVDLTEVLRLSCEMANPLTVQVRPRR

SEQ ID NO: 17999 - protein, 633 aa, Saccharomyces cerevisiae
MSSNNNTNTAPANANSSHHHHHHHHHHHHHGHGGSNSTLNNPKSSLADGAHIGNYQIVKTLGEGSFGKVKLAYHTTTGQKVALKIINKKVLAKSDMQGRIEREISYLRLLRHPHIIKLYDVIKSKDEIIMVIEYAGNELFDYIVQRDKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGAAGLIKRMLIVNPLNRISIHEIMQDDWFKVDLPEYLLPPDLKPHPEEENENNDSKKDGSSPDNDEIDDNLVNILSSTMGYEKDEIYESLESSEDTPAFNEIRDAYMLIKENKSLIKDMKANKSVSDELDTFLSQSPPTFQQQSKSHQKSQVDHETAKQHARRMASAITQQRTYHQSPFMDQYKEEDSTVSILPTSLPQIHRANMLAQGSPAASKISPLVTKKSKTRWHFGIRSRSYPLDVMGEIYIALKNLGAEWAKPSEEDLWTIKLRWKYDIGNKTNTNEKIPDLMKMVIQLFQIETNNYLVDFKFDGWESSYGDDTTVSNISEDEMSTFSAYPFLHLTTKLIMELAVNSQSN

SEQ ID NO: 18000 - protein, 614 aa, Bacillus licheniformis ATCC 14580
MEHTSVSSLVVVLIIAFLTPILLHRFRLSIPVVVAEIIMGLIIGKSGFDLVAQHDTWLETLSMLGFIFLMFLSGLEIDFSVFEKGKKKQLLPSGKEAPNTFKTASVIFIAVFILSLGLSYSFVMAGFIDNAFLMTLIISTISLGVVVPTLKEERLMKTNIGQIILLVAVIADLVTMILLAVFASIYGDENSNMWLLMILFAAGVVLYIFGRVFKKRPFVEVLSKGTIQIGTRAIFTLIIVLVALSESLGAENILGAFLAGVLVSLLSPNKELVQQLDSFGYGFLIPIFFVMTGVKLDIWSLFGNPKILVMIPLLFVALLISKVVPVLFLKKWYDMKTVLASGFLLTSTLSLVIAATTIGERIGIIDAQMSGALILVAVITCIITPTGFKKLMPKTESEKEKKTITFIGANQMTLPVTLELSPEDYHVRILHVRQEKKEEKLADPVFDVEVLPDYEYETLQSFGVFQTDILVVATGSEERNTGIALYAKEQKVARIIASADSPDAESRLKENGIDTFSILLSTKTLLRALIEAPGVMKLLTNQDASLYQINMSNERFDGVLLREFPFTGDVIFVRIFRGVDSIVPHGDTRLQMGDRLIATGSREYIAELKKTLGD

SEQ ID NO: 18001 - protein, 506 aa, Medicago truncatula
MEPWFIVLVTLCIIFLIRAILSLFTTTIPLPPGPLHIPIITNFQLLQKSISQLEPFLKTLHAKHGPIITVHIGSRPSIFINDHTLAHHVLVQNSSIFSDRPTALPTSKMLSSNQHNINTAYYGPTWRTLRRNLASEMLHPSKLKSFSEIRKWVLRTLINRLKTASESELTDSIKVMPHFKYAMFSLLVFMCFGERVNDEKISDIERVQRKIMLNFGRFNKLNFWPKVTRILLRNQWEEFLKLLKDQEDVLLPLIRARKQVKESKLNNINTVVSYADTLLELEWPEEKRKLSENEMVNLCSEFLNGGTDTTSTSLQWIMANVVKYPEVQGRLVEEIREVMGGDENGEKEEVKEEDLQKLRYLKCVVLEGLRRHPSGKFPLPHAVKEDVVLDGYLVPKNGTVNFLLAEMALDRRVWEDPLEFKPERFLKDETFDITGSKEIKMMPFGAGRRICPGLNLALLHLEYFVANLVWNFDWKVPEGGHVDLTEIQEFTMVMKNPVQVHISPRI

SEQ ID NO: 18002 - protein, 477 aa, Thermoproteus tenax
MILWPMPDVVVVNPATEEVLAVLPSASREEVRRAIDEAEDAFYRWSELPLRERAKLLRRAADLIEADDTLINTLVAESGKPIRDARAELRRAIEIFRASAEEAKYILEGKIPRVDAYDYPLANENRIAMEVREPMGVVAGALSYNNPASTFAHKIAPVIAAGNTVIAKPSSHTPLTALKMAQILQKAGVPQGVVQVVVGSGEEIFNEFVDNPKVVGISFTGSTAVGLQVAAKAAGRGKKFMIAPGGSDPAIVFADADLEAAASIIARARFENAGQNCNATKRVFVERKVYDKFLDILRRKIAAIKVGDPMDESTEMGPVISDKMVKAMEGIVADAVEKGGKLLYGGRRMQRKGYFFEPTLVAFDGRPPEAKAFREEVFGPVLPVAPFEDEREAVELANWTQYGLQSAVFTSDYKRAFRVARAIKAGAVMINDSTRVRFDALPYGGVKMSGLSAGWREGVRSTMLLFTEIKYYVLNIA

SEQ ID NO: 18003 - protein, 509 aa, Medicago truncatula
MELETLLSLLLFSAPLVWFLFLATKKQSKFQKTPSSTAIPKTYPIIGSVFSIYANFHRRVHWISDILQTIPSSTFILHRSFGSRQVFTANPAVVQHILKTNFPCYRKGLTLKRSVGDFLGDGIFSADGETWKFQRQISSHEFNTKSLRKFVETVVEVELNDRLLPILSEASKNQTVLLDFQDILQRFTFDSICRIAFGFDPEYLHSSLPKTMFVKAFDDSSLISSVRFNAAIPLIWKVKKILNIGIERRLKEAVAEVRGLATRIVREKKKELKEKATLESVDLLSRFLSSGHSDESFVVDIVISFILAGKDTTSAALTWFFWLLSKHSHVENEILKEITGKSEIVSYDEVKDMVYTHASLCESMRLYPPVPVDTKEAAYNDVLPDGTFVKKGWRVAYHIYAMGRSEKIWGLDWAEFRPERWLSQDEDGKWSFIGMDPYSYAVFQAGPRVCLGKEMAFLQMKRVVAGIMRQFRVVPAMDKGVEPEYIAHLTSLMKGGFSVRIEKRSHKDQ

SEQ ID NO: 18004 - protein, 350 aa, Aspergillus nidulans FGSC A4
MQAVVFKGPLKVALEQRPIPTIQDPTDAIVKVRYTALCGSELHVFRGHQPSGTDFIMGHEFTGEIASVGSSVSKFKPGDKVVSPFTVSCGDCFYCSHNTSSRCAKCQLYGSVVLDGAQADYVRVPLADSTLVSAPEKIDEKKLVMMADILPTGFFAAKNAFSGLDESIIKESTVILFGCGPVGIFALISALEYKPKHLIAIDSVPSRLELAKSLGAEPWNFATDSEGLKNRVKELTDGRGADVAIEVVGHSDALRMAFDMIRPWGKISSVGVHNGEIPWTGNEAYGKNLQLQMGRCPVRSIFEDALKLLEKKQDSIEFMVQDIRPLSQALQAYDDFNQMRSQKVIFEAGK

SEQ ID NO: 18005 - protein, 1515 aa, Candida glabrata CBS 138
MPASISSSIISKERKDDADTTSNSYADSVHSYENINRDDNEQQPVSTQLSRHLTQILSEEGGKERLESMARVISTKTKAEMDKFEVNDMDFDLRMLLNYLRNRQLEQGIEPGDSGVAFKNLTAVGIDASAAYGPSVEEMLRDTGKLPLTLINKLRRKKDSVPLRNIIQNCTGVVESGEMLFVVGRPGAGCSTLLKCISGETSELVSVDGEFSYDGLDQEEMMKNYKGYVIYCPELDFHFPKITVKETIDFALKCKTPRVRIDRMTRKQYVDNIRDMWCTVFGLRHTYATKVGNDFVRGVSGGERKRVSLVEAQAMNASIYSWDNATRGLDASTALEFAQAIRTATNMMNNSAIVAIYQAGENIYELFDKTTVLYNGKQIYFGPAKKAVQYFENMGWIKPPRMTSAEFLTSVTVDFENRTLDIKPGYEDTIPKSGFEFEEYWLNSPEYQELLRHYDDYHARHPAEETRERFDTAKKQMLQSGQRESSRYVVNYWSQVWYCMIRGFQRVKGDSTYTKVYLSSFLIKGLIVGSMFHKIDNKSQSTTAGAYSRGGLLFYVLLFASVTSLAEIANSFSTRPIIVKHKSYSMYHISAESLQEIITELPTKFVAIIVLSLVTYWIPYLKFEAGAFFQYILYLFTVQQCTSFIFKFVATITKDGVTAHAIGGLWVLMLCVYAGFVLPLGEMHHWIKWLHFLNPLTYAFESLVSTEFHHREMLCSQLIPSGPGYENVSVANQICNAAGAIKGHMFVNGDTYIDRQYHFAYRHAWRSWGVNIVWTFGYIVFNVILSEFIKPVSGGGDLLLYKRGHMPEFGTENADARVASREEMMETLNGPDVDLPKVIAAKDVFTWNHLNYTIPYDGATRQLLSDVFGYVKPGKMTALMGESGAGKTTLLNVLAQRINMGVITGDMLVNSQSLPASFNRSCGYVAQADNHMAELSVRESLRFAAELRQPRSVPLEEKYEYVEKIIALLGMQNYAEALVGKTGRGLNVEQRKKLSIGVELVAKPSLLLFLDEPTSGLDSQSAWSIVQFMRALADSGQSILCTIHQPSATLFEQFDRLLLLKKGGKMVYFGDIGENSSTLLNYFERQSGVKCGISENPAEYILNCIGAGATASASADWHDLWQQSPECAAARAELDELHKNLLSRPVTEDPELVTKFAASYTTQMKCVLRRTMIQFWRSPVYIRAKFLECVSCALFVGLSYIAVNHSVGGATEAFSSIFMLLLIALAMINQLHVFAYDSRELYEVREAASNTFHWSVLLLCHYVVETGWSTLCQFMCFICYYWPAGYSGRASHAGFFFFFYVLIFPMYFVSYGLWILYMSPDVPSASMINSNLFAAMLLFCGILQPKEKMPGFWRGLMYNVSPFTYVVQALVGPLVHDKKVVCNKNEFAIMDPPAGQTCGEYLRTYIGNNSGYLVNPQATSNCNYCPYSVQDEVVARFNVKWSYRWRNFGFMWVYICFNIFAMLSCYYIMRVKVWSLKSVLDFKKWFNGPRKDRHEKDKSIFEKKPGDEEKVKQKF

SEQ ID NO: 18006 - protein, 373 aa, Pyrococcus furiosus DSM 3638
MIVLKFGGSSIKYDFEEATNLALSLFEDDAVIVVVSAIKGITDKLILYSQTLDKTIATKIASEYVSFAKSHGIDPVILKPYLDELFNLPDLPEEALRDYILSLGEVLSAVIFSASIGGKFVPSWDIFEAEGNFGNAFIDIKSSKKKFKRVFEVLEEGYIPVIPGFTAGKDGYILTLGRGGSDYSGVAAGVLGKAKLVAIMSDVEGIYTADPKLVPSARLIPYVSYDEIIISSKHGMRALQWKAAELAKEYKIPVLFGRTRNWRMGTLMSERSSGMPLMTYKDGLLLVNVTEEIKYPIIAEGPFWKLYKVSQEEGIHLMRELHTKLFQPSFIQYSVYKSSENGQKTQEFNEKISIEQGENRKIYYSEEEVNLPG

SEQ ID NO: 18007 - protein, 363 aa, Thermoproteus tenax
MEAAILEKYNSELVIEEVDVEPPKSGEVALRVKAAGVCHSDLYVLEGATPVPPPLVPGHEAVAEVIEVGPDVQGLSRGDLVVTSFIWPCGRCRNCARGHENLCERFSEVRLKGVLLDGTTRLRRRKSGEPLRIFLGGLWAQEAVVPASAVAKLPPRLANRPELAMLGCAFLTAYGAVVNSGSVQPGDTVAVIGTGGVGLAIVQVARAVGARVIAVGRNPEKLKLAAEMGAEVVNARDGDAVAEVRKLTDGRGADVVVEAVGSEQTVEQAIDMASTGGRVVLVGLMGLGKKAPLHVARVVRGGISVIGSYGARPRVDLPKVIGMVERGLLRPELMARDFYKLEQINEAVEALRSGRSIRPIVLP

SEQ ID NO: 18008 - protein, 156 aa, Salinibacter ruber DSM 13855
MPTHLEGDLVVDGHRFALVVGRFNEHVTEDLLGGALDTLERHGADLDEVTVVHVPGSWEIPVAAQKCARTGDYDAVICLGAVVRGETPHFDYVCSGATSGTMQTSLDTEVPVLFGILTTDTVDQAIARAGSKAGNKGREAAEAAIEMATLMPKLEG

SEQ ID NO: 18009 - protein, 394 aa, Pyrococcus furiosus DSM 3638
MVLKCVVCGREYPEDEVRYRCECGGLLEVVIDLDKVDTSIFNGKEIKLWKYESWLPVKKRVSLEEGGTPLYRLLNLESDLGVKELYAKNEGANPTGSFKDRGMTVGVSKALELGMDKVICASTGNTSASLAAYAAKAGIKAYVLIPSGKIALGKLAQAIIYGARVVPIKGNFDDALRVVVETSKELGIYMLNSINPFRLEGQKTIAYEIYDQLGKVPDNVILPVGNAGNISAIWKGFKEMYEAGVIDELPRMIGIQAEGASPLAKAWKEKRKFQPEESPETIASAIRIGNPANWIKAWRAVEESGGLFESVSDEEILRAQKLLASREGLFVEPASAASLAGLIKLLESGEISRNESYVLITTGHGLKDPNIVIKNFQVPEPIDPTLEAFKEVIE

SEQ ID NO: 18010 - protein, 142 aa, Salinibacter ruber DSM 13855
MATERTLAILKPDCVRKEKVGEVLRRIQDAGFQLCAMKMITMSKAEAEGFYAVHEDKPFFDDLTDFMSSGPCVPVVLEKENAIADFRELIGATDPDEAAEGTIRSDFAGSIQENIVHGSDSPSNGQKEAGYFFPEHEIVANT

SEQ ID NO: 18011 - protein, 410 aa, Pyrococcus furiosus DSM 3638
MFRLRDFEYYNRTVFLRVDLNSPMSNGKIISDARFRAVLPTIKYLIESGAKVVVGTHQGKPYSEEYSTTEEHARILSELLNMHVEYVEDIFGKYARERIKAMKPGEVIVLENLRFSAEEVKNATIEECEKTFFVRKLSQVIDLVVNDAFAAAHRSQPSLVGFARIKPMIMGFLMEKEVDALTKAYESEEKPRVYVLGGAKVDDSLKVAENVLRKEKADLILTGGLVGQLFTLAKGFDLGRENIKFLEKKGILKYVDWAEKILDEFYPYVRTPVDFAIDFKGERVEIDLLSDEKRLFDEYPILDIGSRTVEKYREILLKARIIVANGPMGVFEREEFAVGTIGVFKAIGESPAFSVIGGGHSIASIYKYNITGISHISTGGGAMLTFFAGEKLPVLEALKISYEKFSNLLS

SEQ ID NO: 18012 - protein, 520 aa, Triticum aestivum
  misc_feature (96)..(96): Xaa can be any naturally occurring amino acid
  misc_feature (103)..(103): Xaa can be any naturally occurring amino acid
  misc_feature (125)..(125): Xaa can be any naturally occurring amino acid
MGNRTSRHRRAAADQPATAPPPTAQPKPQPPPKPQTAPAPAPTPEAGQVAMGRVLGRPMEDVRATYTFGRELGRGQFGVTYLVTHKGTGQRFGCKXSMATRKXSNGDDLEDFSTGRWRSVGHLTXHRNIVELRGAYEDRHSVNLIMELCEGGELFDRIIARGHYSERAAALLCREMVSVVHSCHSMGVFHRDLKPENFLFLNNKEDSPLKATDFGLSVFFKHGEQFKDLVGSAYYVAPEVLKRHYGAEADIWSAGIILYILLSGVPPFWADNEDGIFEAVLLGHIDFSSDPWPSISNGAKDLVKKMLRQDPKERLTAAEILNHPWIREDGEAPDKPLDITVISRMKQFRAMNKLKKVALKIVAENLSEEEITGLKEMFRSLDTDNSGTITLEELRSGLPKLGTKISESEITQLMEAADVDGNGTIDYSEFVSATMHMNRLEKEDHILKAFEYFDKDHSGYITVDELEEALKKYDMGDDKTIKDIIAEVDTDHDGRINYQEFVAMMRNNSPEIVPNRRRMF

SEQ ID NO: 18013 - protein, 342 aa, Xylella fastidiosa 9a5c
MYRRWLYGCAGLWFLWRLPMTVLVTGAAGFIGAHVCRALAARNDTVVGLDNYNAYYDPQLKRDRVTALCPDVHIRTLDLTDRERCAALFNEVQPDQVVHLAAQAGVRYSIENPHAYVDSNLVGFLNVLELCRHCRVQHLVYASSSSVYGDSATPPFSEQQRVDQPRSLYGATKVANEVMAYSYAQLYGLRATGLRFFTVYGPWGRPDMAPLIFSRAVLEGRPIEVFNHGRMERDFTFINDIVAGVIGALDAPGEQAVPHRLFNLGNHTPVPLEHFINVIEQAAGRPADKHYKPMQLGDMMATMADIAAARAAFGFEPVTSIEIGMPQVVEWCRHYFDVRAAT

SEQ ID NO: 18014 - protein, 425 aa, Oryza sativa
RRARGEATEPKRAMAGGVVIGVAPPAAAEEPEPHVERLPADLLAHVLSLIPSFHDLSMAGGVSRRWRRAVERSLAGRRRMSFAGQRTGDDSTARFVRAAVNLRDLDICWGCQITDQGLIRISTADCVKNLTSISLWGLAGITDNGVIQLVSRAHSLQHLNIGGTFITDESLYAVAKSCINLKSIIVWSCRHVTEAGLVALVGGCRRLECINVGGMRVPPESFAGLLAIRPALQIRSIPQILNANVQPQGGAAGAKRNRGLAARDRSRSGGARWRSGTATVPHIGRAVPRRTRITAVRHRGGLRDRACATGGLRDRPCGTAVDCGTGRGKLGPARWVCGTVAVPEQGAVARAGSAEPWRSRALVLRNRSGRAHWFVHGDDAAALACAAMDAATAEQQQCQDFLLRSKSRCLGPAASRLTIRPHQVP

SEQ ID NO: 18015 - protein, 671 aa, Yersinia pestis KIM
MNPFIVADAESCIGCRSCEVACVVAHHEGQFPDKPEYFTPRVKVFKGDQCATAVFCHHCEDAPCASTCPNGAIVELNNRVQVIQEKCIGCKTCMIACPFGMMTVVTETVQPASHRLADVYRRTEAQKCDLCLDQPDGPACIKTCPTQALTLVDQQYLLHQQQQKRQHMALNEHNGRLFSRAVVQAASASSNKSIRDATPVNLLQRPRAPRLEPKKIPLAERKTGFAEIYLPFTESQIHEQAERCLECGDKTICQWTCPLHNAIPKWISLAHQGRIHEAAELSHQTSSLPEVCGRVCPQDRLCEQSCTLNDHDGAVTIGQIERHITETALATGWRPDLSQVKPSGKRVAIIGAGPAGLGCADILVRNGITPVVFDRYPEIGGLLTFGIPAFKLEKSVMTRRREIFTEMGVEFCLNTEIGRDITMENLLHDFDALFLGVGTYRSMRSGLENEDAQGVYDALPFLIGNTQHLMGYTANGAHPYVSMQDQRVVVLGGGDTAMDCVRTSLRQGASRVVCAYRRDEKNMPGSKREVKNAREEGAEFMFNLQPMSIVVDESGQVTGIKMVRTEMGQADAQGRRQALPITGSEHLIPADAVIMAFGFSPHRMSWLAEHNVVLDKQGRVVAPTISGYPYQTSNPKIFAGGDIVRGADLIVTAIAEGRKAAESIAYYLNVL

SEQ ID NO: 18016 - protein, 461 aa, Glycine max
MSMSLSLLRIFSSPHLSTSLFFPTPTLSSLCPSFLSKLPNAPSPLIVLCHRDASASKQGHLGVPESAERDSGSEEDDDAVEQPMRASYDDDEDEEEGALSSLVFPERWDVLGLGQAMVDFSGMVDDNFLKNLGLEKGTRKVVNHEERGRVLQAMDGCSYKAAAGGSLSNTLVALARLGSRSEKVPAINVAMTGSVGSDLLGGFYREKLRRANVQFLSAPIKDGTTGTVIVLTTPDAQRTMLAYQGTSSTVNYDASLANAVSKTNILVVEGYLFELPDTIKTITKACEKARSNGALVAITASDVSCIERHFDDFWEIIGNCVDLVFANGNEARALCNFEAKESAASAARYLSHFVPLVSVTDGPTGSYIGVKGEAVYIPPSPCVPVDTCGAGDAYASGILYGLLRGISDLRSIGSLAAKVAATVVGQQGTRLRISDAVKLAESFEFQLDSSSVGTDHNISSV

SEQ ID NO: 18017 - protein, 157 aa, Spiroplasma citri
MDKFNINEKMKRTKIITTIGPSTHSPGAIEELFKTGMTTIRLNFSHGDHAEQGARIVWAREVSAKIGKPISVLLDTKGPEIRAGIMKGGKQEIVAGATVTIYSLPTEYQNREGTGTEITVSYDMSQDLKVGDVVLVDDGKLQLNVTGIKPGIIETKA

SEQ ID NO: 18018 - protein, 496 aa, Streptomyces coelicolor A3(2)
MLDQGAPPPHDASAVPPSPGLAARLMRRKPVERLVAEGGQGEGGSLRRSLGLWQLTMISIGATLGTGIFVVLGEAVPKAGPAVTLSFVIAGLTALFSALSYAELAGTIPVAGSSYSYAYATMGELVAWICGWCLVLEYGVSVAAVAVGWGEYLNELLDGTIGVTLPAALSAPPGDGGIFNLPALIVVLLAMTFLLGGARESACANTIMVVVKIAALVLFCAIGVQGFRSGNYEHFMPLGMAGVSAAGATLFFSYIGFDAASTAGEEAKNAQRDLPRAIMLSLVIVTVLYVLVAAVAVGAKPWRTFTDSEASLAQIMTDVTGQSFWGTLLAFCAVVAIASVVLTVLYGQTRVLFAMSRDGLVPKVFSKVHPKTGAPRANTLIVSLFCGVLAAAVPLGQLADATSIGTLFAFALVNVAVVVLRRTRPEMRRTFRVPLSPVLPALGFGLCVWMMGSLSTVTWVVFGVWMAVGLVFYFVYGHRRSRLATPVPSEARTHQK

SEQ ID NO: 18019 - protein, 345 aa, Candida albicans
MSTDHHSHPVEGHQFKKIFNRLSGQPESYSRKQNYTFGKTLGAGSFGIVRYARDNSTDEEVAVKIILKKALKGNESMIIDEMQLLEQLNNPHIVGFRDWFESKDKFYLVTQLATGGELFDRIVQKGRFTEHDASLVVLQMLEALEYLHNKDIVHRDIKPENILYLTSKDDSPIVLADFGIAKRLQNPNEKLTSSAGSFGYAAPEVILGTGHGKPCDIWSLGVVTYTLLCGYSPFRSENVQDFINEVKHNNAVIFHADYWKDVSKDARRFIIKALQFNPDNRPTATELLNDPWLVSIAKEYKETDLLPNFKQGFDAKKKFRQAIELVKLNNRIKKLKEWQTDEDDD

SEQ ID NO: 18020 - protein, 326 aa, Erythrobacter sp. NAP1
MTKLMPPEWAPQDWLWIGFPHLAEEWPGWLAPAQEQIAAFASAVAESGQEVRLLVRDADNGARAKSLVSDKVTLERRTYGDIWLRDTGPLIVSDGGSRSAVRFGFNGWGGKYLMPGDPTIGEELARDAGLPVQNSTMILEGGALDGDGTGLVATTEQCLLNPNRNSGMTREEIEAELKEMLGFDRVLWLGDGLLCDHTDGHVDNLARFVGPNQLVVPHATGDDDPNAAIYADAKARAEAFGVEVVTIPSPGLIERDGMIEPASYVNFAITSNLVVVPTFGSPHDEEGVAAIAELFPDRDTVGLPGDAVLAGGGGFHCASQQMPSAG

SEQ ID NO: 18021 - protein, 228 aa, Streptomyces coelicolor A3(2)
MAAQINPSILSADFARLADEAKAVEGADWLHVDVMDNHFVPNLTLGVPVVESLARATDTPLDCHLMIEAPDRWAPQYVEAGAGSVTFHAEAAAAPVRLAREIRAKGARASMALKPATPVEPYEDLLPELDMLLIMTVEPGFGGQAFLDIMLPKIRRTRELIKKHGLELWLQVDGGVSAATIERCADAGADVFVAGSAVYGASDPAEAVRALRTQADAATAEASWSCDH

SEQ ID NO: 18022 - protein, 437 aa, Triticum aestivum
  misc_feature (402)..(402): Xaa can be any naturally occurring amino acid
  misc_feature (433)..(433): Xaa can be any naturally occurring amino acid
MGQKDSKPSYNSGNSANGYNSRYANTPSSYSPRYASSAGNNMQQPEAQARLQRKYSRIGDDYRSVSQVTEALAQAGLESSNLIVGIDFTKSNEWTGKISYNRRCLHDIGNTPNPYEQAISIIGRTLSAFDEDNLIPCFGFGDASTHDQEVFSFYPENQPCNGFEEALERYREIVPTLRLAGPTSFAPIIETAIGIADSTGGQYHVLLIIADGQVTRSVDTQSGQLSPQERDTIDAIVKASHFPLSIVLVGVGDGPWDMMHKFDDNIPARSFDNFQFVNFTEIMSKSIAADRKEAEFALSALMEIPTQYKATLDLQLLGRRQGIPPRVPLPPPTRTPYSRSTSFDQQSGVYSRSSSFGQQTSGFQQSDSFKQRQHAATRRPDSHPSESSESTLSCAICMDKSXDLAFGCGHQTCYDCGGKLVRCPMCQKHITTXIRLY

SEQ ID NO: 18023 - protein, 228 aa, Candidatus Kuenenia stuttgartiensis
MDAYKKYLAEFVGTFALVFIAAGAVCADFYLKQSGGQGFGLLGISIAYGVVVIAVIYAMGYVSGSHINPAVTISFWITKRMEPNTAIMYIISQIGGAILGGFALRTIFPDALSSIHLGTSTLAAGVSIERGILMEFIISFLLIFTIYGTLVDKRASGGFAGLAVGLVVLFGSLVGGTISGGAMNPVRVFGPAIASGQFTNHYVWWIGPILGGIAAGIVYDKLFAERKK

SEQ ID NO: 18024 - protein, 174 aa, Burkholderia xenovorans LB400
MTIYKLGDAAPTIHESVFVADSASIIGNVTLEENASVWFGATIRGDNELITIGKGSNVQENAVLHTDPGFPLTVEPNVTIGHQVMLHGCTIKEGSLIGIQAVVLNGAVIGRNCLVGAGAIVTEGKVFPDNSLILGAPAKVVRELTGADIANMQRGAATYAERREYYKAQLVRIG

SEQ ID NO: 18025 - protein, 80 aa, Glycine max
VKQLNDLLTEKNKDTGWDVPIHVDAAIGGFIAPFLYPELEWDFRLPLVKSINVSGHKYGLVYPGVGWVIWRSKDDLPEEL

SEQ ID NO: 18026 - protein, 208 aa, Saccharomyces cerevisiae
MFTPIDQAIEHFKQNKFVIVMDDAGRENEGDLICAAENVSTEQMAFLVRHSSGYVCAPMTNAIADKLDLPLLRTGMKFESNDDDRHGTAYTITVDVAQGTTTGISAHDRSMTCRALADSSSTPKSFLKPGHICPLRAADGGVLQRRGHTEAGVDLCKLSGLSPVAVIGELVNDDEQGTMMRLNDCQAFGKKHGIPLISIEELAQYLKK

SEQ ID NO: 18027 - protein, 402 aa, Helicobacter hepaticus ATCC 51449
MFDEIEFDKIKRLPKYVFAAINEIKLEMRRNNEDVIDFSMGNPDGATPEHIIQKLCEAAQKGKNQGYSVSRGIYKLRLAICNWYKRTYGVELDPESEACVTMGSKEGYVHLVQAIANPGDNAIVAEPAYPIHYYAFILNGANVSTFGLKWNEQMELDVEDFFINIKRVLKEVMPRPKFVVVNFPHNPTTIVVYREFYERLVAFAKQERFYIISDIAYAELCFDGFKTPSILEIEGAKDVAVESYTLSKTYNMAGWRVGFVVGNKKIIQALQKIKSWIDYGIYTPLQIAATIALEGDQSCVKDIKNTYEKRMEILIKSFGEAGWEMKKPKASMFIWAKLPECVGDMGSLEFSKRLLKEAKIAVSPGVGFGDYGEGYVRIALIENEKRIRQAARNLKSFLKQFQ

SEQ ID NO: 18028 - protein, 427 aa, Burkholderia xenovorans LB400
MSAIVDIIGREILDSRGNPTVECDVLLESGTMGRAAVPSGASTGSREAIELRDGEAGRYGGKGVLKAVEHINTEISEAIMGLDASEQAFLDKTLLELDGTDNKSRLGANAMLAVSMAVAKAAAEEAGLPLYRYFGGSGAMQLPVPMMNIVNGGAHANNSLDIQEFMIVPVSQPTFREALRCGAEVFHALKKILSDRGMSTAVGDEGGFAPNFGSNDECLSTILQAIEKAGYRAGEDVLLALDCAASEFYHDGKYQLAGEGLQLSSTEFTDYLANLADKFPIVSIEDGMHESDWAGWKTLTDKLGKKVQLVGDDLFVTNTRILKEGIEKGIANSILIKINQIGTLTETFAAIEMAKRAGYTAVISHRSGETEDSTIADIAVGLNAGQIKTGSLSRSDRISKYNQLLRIEEDLGDIASYPGKSAFYNLR

SEQ ID NO: 18029 - protein, 222 aa, Idiomarina baltica OS145
MSASDKLKQQAAQAAIKYVEKGAIVGVGTGSTVNFFIDELAKIKDDIEGAVSSSDASTERLKQHGIEVFELNNAPEVPVYIDGADEIDEHGQMIKGGGAALTREKIVAAVAKKFVCIADESKLVGRLGTFPLPVEVIPMARSYVAREIVKLGGDPVWRQGVTTDNGNWILDVHNFDILNAVELEEQLNNVVGVVTNGLFAARSADVALLATSEGVKELTWGN

SEQ ID NO: 18030 - protein, 150 aa, Triticum aestivum
  misc_feature (72)..(72): Xaa can be any naturally occurring amino acid
  misc_feature (118)..(118): Xaa can be any naturally occurring amino acid
MAAAALRARLNNLVTSMFATGMLDENFHQLQSMEEDGTAARGYVADMINLFIKDTKRILNDIAGLLSQPVVXDYDMVDVLVRQLKGSSYSVGAKKVNLSCMQFRRFNEPRSKERCLMXALALAWSEFCDVRSKFEAMMQLEEQIATYGPK

SEQ ID NO: 18031 - protein, 325 aa, Thermoproteus tenax
MAEGRCSQGKEPAEAMISLVALGEPLIQLNAVTPGPLRYVAYFEKHVAGSEANFCIAATMAGARCSLIARVGDDEFGRNIVEYLRGRGVDVSHVKVDPGAPTGIYFVQRHFPVPGRSRLIYYRKGSAGSRVGPDDVDSSLISSADAVHSTGITLALSDSANRAVHKAFGEAKRRTFDTNIRPALWPDLAAARRAILDVLNYGVDVLVTDPDDTQILLGVRDPEEAYRKYRELGVQTLVYKLGAEGAYVFWNGGSYFRDALKVAVEDPTGAGDAVAGYFVALYLSGVDPRRALDLAVAASALVVGVRGDNEALPSPREAEELLKAL

SEQ ID NO: 18032 - protein, 469 aa, Burkholderia thailandensis E264
MQTESNGRPGAGGGAARPALQQTLGTWQLWGIAVGLVISGEYFGWSYGWASAGTLGFVVTALFVAAMYTTFIFSFTELTTSIPHAGGPFAYARRAFGPAGGYLAGVATLVEFVFAPPAIALAIGAYLHVQFPGLEPKHAAMGAYLVFMALNIVGVQIAATFELVVTLLAIFELLVFMGVVSPGFAWSNFMKGGWAGADHFSAGAFHGMFAAIPFAIWFFLAIEGVAMAAEEAKNPKRSIPIAYVAGILTLVALAIGVMVFAGGAGDWTRLANINDPLPQAMKYIVGANSGWMHMLVWLGLFGLVASFHGIILGYSRQIFALAREGYLPEWLAKVHPRFKTPYRAILAGGVVGIVAIYSDELIQFGGQTLTANIVTMSVFGAIVMYIVSMAALFKLRRAQPRMERPFRAPLYPFFPAFALVAALVCLGTMVYFNALVASIFVAFVALGYGYFLATRAQRAAAPADALLEE

SEQ ID NO: 18033 - protein, 376 aa, Arabidopsis thaliana
MSDETTSSPSPAPAKKKQNLGWMEWMRGWSSVFGEILFQRITASHLENPLPLPSVNDLTCVVTGSTSGIGRETARQLAEAGAHVVMAVRNTKAAQELILQWQNEWSGKGLPLNIEAMEIDLLSLDSVARFAEAFNARLGPLHVLINNAGMFAMGEEQKFSEEGYEQHMQVNHLAPALLSVLLLPSLIRGSPSRIINVNSVMHSVGFVDPDDMNVVSGRRKYSSLIGYSSSKLAQIMFSSILFKKLPLETGVSVVCLSPGVVLTNVARDLSRILQALYAVIPYFIFSPQEGCRSSLFSATDPQIPEYWETLKNDDWPVCPFISQDCRPANPSEEAHNTETAQRVWKKTLELVGLPLDAVEKLIEGENIQCRYGAQHE

SEQ ID NO: 18034 - protein, 315 aa, Rhodococcus sp. RHA1
MPSDYPVVPKRHAKVHILRQRGTSGPGPRLDSLMGFNNAQSPVPTVTLNDGNSIPALGFGVWQVPDDESHAAVIEALKAGYRSIDTAKIYENETGVGRALADSGIARDELFVTTKLWNEDQGYDSTLRAFDASLNRLGLDYVDLYLIHWPEPSADRYVDTFKAFQKIKADGRARSIGVSNFTPETLDRLIAETGEVPAINQVELHPRFNQADLRAFHTGKGIATEAWSPLGQGTVLEDESIAKIAAAHGKTTAQVIIRWHLQIGNVVIPKSVTPERIAANFDVFDFELTPDEINTVGSLTRADGRIGPDPDTLGA

SEQ ID NO: 18035 - protein, 433 aa, Shewanella oneidensis MR-1
MRFESFSFCPEILRAISDCGYQKMTPIQQQAIPAIRRGQDVLASAQTGTGKTAAFALPILQKMVENPSETLKSNTRVLILTPTRELAAQVAENVEAYSKYLNFSVLTIYGGVKVETQAQKLKRGADIIVATPGRLLEHLTACNLSLSSVDFLVLDEADRMLDMGFSADIQKILQAVNKKRQNLLFSATFSSAVKKLANEMMIKPQVISADKQNTTADTVSQVVYPVEQRRKRELLSELIGKKNWQQVLVFTATRDAADTLVKELNLDGIPSEVVHGEKAQGSRRRALREFVSGKVRVLVATEVAARGLDIPSLEYVVNFDLPFLAEDYVHRIGRTGRAGKSGVAISFVSREEERTLADIEKLIGQKIRRITVPGYEVGSRDLLLKQLQTRRSFAKKQQRQDNVSEQMIAEKSMQGRRVKMKVGQAPSKAKKLK

SEQ ID NO: 18036 - protein, 212 aa, Secale cereale
MDAADAGSPRFGHRTVCSEPPKRPAGRTKFKETRHPLYRGVRRRGRLGQWVCEVRVRGAQGYRLWLGTFTTAEMAARAHDSAVLALLDRAACLNFADSAWRMLPVLAAGSSRFSSAREIKDAVAVAVVEFQRQRPFVSTSETADGEKDVQGSPRPSELSTSSDLLDEHWFSGMDAGSYYASLAQGMLMEPPAARAWSEDGGEYSGVHTPLWN

SEQ ID NO: 18037 - protein, 729 aa, Bacteroides fragilis YCH46
MQRAKKNYLIYAVMLLLFGALIYMAIEEGDRFSHHAVASSTVAEDTPFTMFCQFVTDNLHHPLSILLIQIIAVLLMVRLFGFLFKHIGQPGVIGEIVAGIVLGPSVLGYFFPDVFQALFPPESLTNLELLSQVGLVLFMFVIGMELDFSVLKNKINETLVISHAGILVPFFLGIVASYWIYEEYAAAQTAFLPFALFIGISMSITAFPVLARIIQERNMTKTSLGTLAIASAANDDVTAWCLLAVVIAIAKAGTFASALYAIGLTALYIIIMFMVVRPFLKKVGEVYANQEVINKTFVALILLILIISSTLTEIIGIHALFGAFMAGVVMPPSIGFRKVMMEKVEDIALVFFLPLFFAFTGLRTEIGLINSPALWGVCLLLITVAVAGKLGGCAVAARLVGESWKDSFTIGTLMNTRGLMELVALNIGYEMGVLPPSIFVILVIMALVTTFMTTPLLHLVERVFARREERLSAKLKLVFCFGRPESGRSLLSIFFLLFGKKMKAAQVVAAHFTVGTDLNPLNAEQYARDSFSLVDEKASELGLSVENRYRVTDKLVQDMIRLARKERPDMFLLGAGSKYRPDTAGSNGVLWLSLFRDKIDDVMEQVKCPVAVFVNRGYSGSSPVSFVLGGVIDAFLLTYLESMLEGGAQVHLFLFDTDDEAFRQSTDPILAKYSSQIRTQPFSGAANLTSAAKDGLLVMSHLSYTKLSEEEEVFRDLPSLLVIRRPKKG

SEQ ID NO: 18038 - protein, 268 aa, Secale cereale
MDVADIASRSGQQQQGHRTVSSEPPKRPAGRTKFHETRHPLYRGVRRRGRVGQWVCEVRVPGIKGSRLWLGTFNTAEMAARAHDAAVLALSGRAACLNFADSAWRMLPVLAAGSFGFDSAREVKAAVAVAVVAFQRKQIIPVAVAVVALQKQQVPVAVAVVALQQRQVPVTVAVVALQKLQVPVAVAVVALQKKQIILPAACLAPEFYMSSGDLLELDEEQWFGGMDAGSYYASLAQGMLVAPPDDRARPENGEQSGVQTPLWSCLFD

SEQ ID NO: 18039 - protein, 292 aa, Erythrobacter sp. NAP1
MSQKPIKKAVFPVAGLGTRFLPATKAIPKELLPIVDRPLIQYAVDEAREAGIEQMIFVTGRGKTAIVEHFDVAYELEDTMSERGKDMSVLDPTRATPGDIITVRQQVPLGLGHAIWCARAIVGDEPFAIFLPDELMIGKKGGTGCMKQMVDAYEKTGGNLISVLEVPMEEVSSYGVIAPGAQNGALTEVTGLVEKPPVAEAPSNKIVSGRYILQPEVMRVLEDQEKGAGGEIQLTDAMAKMIGDQPFHAVTFDGNRYDCGSKLGFVEATLALALEREDMGGEVRAMAQKLLG

SEQ ID NO: 18040 - protein, 481 aa, Sinorhizobium meliloti 1021
MAENYDVIVVGSGPGGYVTAIRSAQLGLKTAIVEREHLGGICLNWGCIPTKALLRSAEILDHANHAKNYGLTLEGKITANVKDVVARSRGVSARLNGGVAFLMKKNKVDVIWGEAKLTKPGEIVVGAPSKPAVQPQNPVPKGVKGEGTYTAKHIIVATGARPRALPGIEPDGKLIWTYFEAMKPEEFPKSLLVMGSGAIGIEFASFYRSMGVDVTVVELLPQIMPVEDAEISAFARKQLEKRGLKIITDAKVTKVEKGANDVTAHVETKDGKVTPIKADRLISAVGVQGNIENLGLEALGVKTDRGCIVTDGYGKTNVAGIYAIGDVAGPPMLAHKAEHEGVICVEKIAGVPGVHALDKGKIPGCTYCDPQVASVGLTEAKAKELGRDIRVGRYSFGANGKAIALGEDQGLIKTIFDKKTGELIGAHMVGAEVTELIQGFVVAMNLETTEEELMHTVFPHPTLSEMMKESVLDAYGRVLNA

SEQ ID NO: 18041 - protein, 545 aa, Mesorhizobium sp. BNC1
MSAYARALDALRQHRRETEDFDLRQAFGADPDRFSRCSAALDDMLLDYSKCAVSDETLALLDKIAEAAGVIERREEMFSAKRINVTENRAVLHTALRNDSTRPVMLDGKDVMPDVEAVLAAMSTFSEGIRSGTIKAATGKSFTDVVNIGIGGSDLGPAMATLALAPYHDGPRLHYVSNVDGAHIHDTLKALDPDTTLFIIASKTFTTIETMTNAGTARSWIAEKLGQDAVGSHFAAVSTALDKVAAFGIDESRVFGFWDWVGGRYSLWSAIGLPIMIAIGPENFRRFLDGAELMDRHFREAPSRENLPMMLGLIGFWHRVICGYPARAVIPYDQRLARLPAYLQQLDMESNGKRVTFEGESVTVPTGPLVWGEPGTNGQHAFFQLLHQGTDIIPVEFMIAARGHEPELKHHHDLLIANCLAQSEALMKGRTLQEAKAQLLAKGMSEAEADKLAPHRVFPGNRPSVTIIYEKLDPFTLGRLIALYEHRVFVEAALFRINAFDQWGVELGKELATELLPVVEGKKDASGRDSSTAGLVAQIAALRDS

SEQ ID NO: 18042 - protein, 397 aa, Dehalococcoides sp. VS
MENLTIRDLDFSGKKALVRVDFNVPINEETGGINDDSRIRAAIPTIDYLLDHQAKVILCSHLGRPDGEVVESMRLAPVAKRLSEILRQEVFTVSDCIGDEVIAKVNSLEDSQVLLLENLRFHPEEEANDPVFAKKLANLADIYVDDAFGTAHRKHASIVGVAKYLPAVAGLLLEKELHALGKVLEHPPRPFMILLGGAKVSDKVGMLENVMDKVDTILIGGGMAATFLKAQGLEIGDSLIDDSLDTAKMLMDKAKSKNVKIILPDDVLVTFDKIGPEAKAENVSVENIPHTAKIVDIGLLTITHFTKHLEKCKTVFWNGPMGIYEIPQFSEGTRAMVNTMTRLHGTTIIGGGSTAEIVTELNIASKMSFVSTGGGASLKFLSGEKLPGVEVLAKKNE

SEQ ID NO: 18043 - protein, 437 aa, Coprinopsis cinerea okayama7#130
MGWNYWYNWTIILPAELSAASVLVGYWAPPEQLSPAIWITVCMVIVVVINLLGAGAYGEAEFIFASIKVLTIVGLIILGIVLDLGGGPNRDRIGFRYWKDPGPFVQYRGIPGAKGRFLGWWAVLTQAAFSFIGTEIVAIAAGEAKNPRRNLPRAIRRVYVPTSPTTGILLFYILGTAIIGLLVPSNEPSLNLGDGTAASSPFVIAIQNAGIKGLPSLINACLLTSAWSAATSDLYTSSRALYGLARAGNAPKIFLKTTNNGMPYVSVIFNASFSVLAYMGIQQGSGRVFAWFANMTAVAGLLTWFGIGVTYLRFYAGMKAQGMDRSKLPFSSSLQPYAAIYATCFCFLICLLSGWAVFLDGNWQTDTFVTNYFPLALFPILYAGARWYYRTPVVKPENMDFVSNLAEIEADCYEDPPARNKAEAFWQWLSVSRFYTK

SEQ ID NO: 18044 - protein, 647 aa, Dehalococcoides sp. VS
MSTGLEISIPHNLEMSKLLDTINSPSDLKKLTLDELNELAAQIREELVNRVTLNGGHLASSLGVVELTIALHRVFESPKDKIIWDVGHQSYAHKLLTGRREQFATLRQHGGISGFTCRDESPHDPFGAGHASTSISAGLGMAVARDLAKADYSVISVIGDGAISGGMSFEAINNAGHLHTKFIVILNDNGMAISPSTGALSKFLNNVRFDPRFEFAKRGAKQTITNMPFGKAVWAFTKSIKHKFEKSMLPGSLWEELGFIYLGPVDGHNIRELEAALKRAKDFESQPVLIHMITQKGKGYDDAEADAVKYHGISPKSGGLKSGHGQSYSQVFGQTLHKIMSDNPQVVAITAAMTDGCGLGEVAADFPDRVFDVGICEQHAVTFAAGMATQGYIPVVVIYSTFLQRSFDQIIHDVCLQKLPVVFAIDRGGIVGDDGKTHQGIFDLSFMSLIPDMIVAAPSDENDLQHLLYTAVNSGKPFAIRYPRGFGEGVEMENGLHNIPIGQNEVLSTGSEIAILATGKSVAFSREALEILAESSIKPTLVNNRYISPLDKELVIKIARNHKYLITVEENVISGGLGSRINTILAEAGLVNSIKVANIAIPDKFVEHGNQSLLRAKYGLDGKGIAQKILSTVDNPGEIKHQQILCP

SEQ ID NO: 18045 - protein, 840 aa, Xanthomonas oryzae pv. oryzae KACC10331
MASAPSGTIDTGRPLARPFAAIVLRNAGGELFGSAGHFHPQLHVIGHPLRIQQVGLDCRAHRTAWLGDMRAIVEAALRRQRLHIRKTAFGQILFAGRLELAHAGRVDQTRTGRQRNQRAVRGGVTAARIVFAHPIGLHLLGAQQGVGQGRFARTGRAHQYRRTAIAQPRPQRSHAGRILGIDRAQRNVLRLQLFQHRQRILGMFGLIGLGQHHHRLRTAAAHQQQIALDATRIEVRIQPAHDEHRIDIGRDHLLVVMRAGRPPLDRSAPRQQRHDALALHQHPIAHRRPLMAGEARPLPLRQRLGLEAGLRRIGHHIAGAVLLHHPRRQRLRMRGEDCLPGRLFRRPRPGPADGLEGGVIGGDVAHGAILAGWPQRLVQSGPAGRLTRHLTSLPMQACPLVIFPIPCQVSRLQPARRMSTAPQKPLAIRERLSEVRYEIRGELARRARELEAQGRKLIKLNIGNPGAFGFRAPEHLQRAIADDMGRTDPYTHQQGLLEAREAVAKAYARRQHPDAHPDRIFIGNGVSELIDLSLRALLNPGDEVLVPSPDYPLWSAATILNDGRPVYYRCAPENGFQPDPVEIETLVSSRTRAIVLINPNNPSGASYSRALLERIVAIATKHNLLLLVDEIYDQVLYDGAAFVPVAPLAGAHPCITFSGLSKVHRACGWRVGWALLSGDQARINDLRNAMDLLGALRLCANVPGQYAIDAAVNGPDTISALCAPGGRLYETRRAVIEACAASEHLSLVAPAGALYAFPAVVGAAARNFDDHAFALDLMNKEGVLVVPGSSFNVPYRHHFRVTLMPEASVMRDVFARIDRALARRAEAVTKVVPLKSRSVA

SEQ ID NO: 18046 - protein, 491 aa, Prosthecochloris aestuarii DSM 271
MGKVKGFLEYRREVPSDREPLERIKDWKEFHEHMTDEALGDQGARCMDCGTPYCHTGFMLSGMTSGCPIHNLIPEWNDYVYKGFWHEAYDRLMKTNNFPEFTGRVCPAPCEGSCVLGIIQPPVTIKNIECSIIEHAFKQGWVEPKKIAVRTGKKIAVVGSGPAGLAAADQLNKAGHSVTVYERDDRIGGLLMYGIPNMKLDKEAVVQRRVDLMEQEGVVFVVNTEIGVDFPAEKLTEEYDAVLLCTGATRPRDLDVEGRSLNGVHFAMDFLRESTKSVLTGGQPEISAKACDVIVIGGGDTGTDCVASSIRQGCKSVVQLEILPQPPLERQADNPWPEWPKTLKVDYGQEEAAALQGDDPRRYSMMTKKLIGDADGNLTGIEVSKVEWVKDDGRFMPRPVAGTEEILPAQLVLLAMGFLGPEDGALKALEVEQTERSTIKASYDDFSTSRQKVFAAGDARRGQSLIVWAINEGRAAAREVDRFLMGDTNLP

SEQ ID NO: 18047 - protein, 113 aa, Triticum aestivum
  misc_feature (16)..(16): Xaa can be any naturally occurring amino acid
  misc_feature (34)..(34): Xaa can be any naturally occurring amino acid
  misc_feature (38)..(38): Xaa can be any naturally occurring amino acid
  misc_feature (58)..(58): Xaa can be any naturally occurring amino acid
  misc_feature (61)..(61): Xaa can be any naturally occurring amino acid
  misc_feature (63)..(63): Xaa can be any naturally occurring amino acid
  misc_feature (66)..(66): Xaa can be any naturally occurring amino acid
  misc_feature (69)..(69): Xaa can be any naturally occurring amino acid
  misc_feature (78)..(78): Xaa can be any naturally occurring amino acid
  misc_feature (80)..(81): Xaa can be any naturally occurring amino acid
  misc_feature (83)..(83): Xaa can be any naturally occurring amino acid
  misc_feature (85)..(85): Xaa can be any naturally occurring amino acid
MKMNIANPTTACQKKXEIDDDMKLRNLYDKRISXEVVXDLLLEEFEGYIFKIMSGCDXQGXPXKQXVLXPGRGRLLLXRXXSXFXRGHGRAGLSPQASLSPLALPLSKKKGLG

SEQ ID NO: 18048 - protein, 247 aa, Prosthecochloris aestuarii DSM 271
MIKLVLLRHGESQWNRENRFTGWRDIDLSEKGLAEAANAGVLMKEEGLTFDIAYTSVLKRAIRTLWNALDTMDLLWVPVEKTWRLNERHYGSLQGLNKTETAQLHGEEQVLVWRRSYDTPPPPLEKTDERYPGNDPRYASLSSEEIPVAECLKDTVARFLPYWHETIAPQIKAGKKVLIVAHGNSLRALVKYLDNISEEDIVGINIPTGIPLVYELDDDLKPIRHYYLGDQEAAAKAAAAVANQAKG

SEQ ID NO: 18049 - protein, 328 aa, Bacillus licheniformis ATCC 14580
MTSVLVTGGAGYIGSHTVLELTKQNRSVVVLDNLSTGHREAVSGVSFYEGDIADAALVKAIIKHHDVDAVIHFAAKSLVSESIEKPEIYFRENTLKSCAFFETAIKEGVNNIVFSSTAAVYGIPEKAPIKEAAPLSPVNPYGESKLMIEKYLHWVGKTHGVKWAALRYFNAAGAALNGAIGEDHDPESHLIPLVLQTALGQRKQLSIFGEDYSTPDGTCIRDYIHVLDLASAHLAALDGLYEDRLKQNVYNVGTGAGHSVKEIIETAENMTERSIAAKTDERRAGDPPVLVADSRTLVEDTGWKPQYSDLQTIIQSAWQWHKAHPDGF

SEQ ID NO: 18050 - protein, 296 aa, Bacillus licheniformis ATCC 14580
MKVKKAVIPAAGLGTRFLPATKAQPKEMLPIVDKPAIQYIVEEAVQSGIEDILIITGRNKRSIEDHFDRSVELEQNLLAKGKNDVLKEIREIADMANIHYIRQKEPIGLGHAVLSAKHFIGDEPFAVLLGDDIMVSETPALRQLLEVYEEYQTEVIGVQPVDPADVSKYGIIQTSAQKNKVYQIDDLVEKPTVKDAPSNIAVMGRYVLRPSIFPVLEQTKRGAGNEIQLTDALREICREQSMYARKLKGSRFDIGDKLGSFKASTEIALMRDEMRPKLLAYLESVLKKEAQKGAWQ

SEQ ID NO: 18051 - protein, 390 aa, Prosthecochloris aestuarii DSM 271
MNIHEYQGKDILRKFGVSVPKGIVAFTAEEARQAAEQLFEEQENPVVVVKAQIHAGGRGKAGGVKLAKSPDEVFDIARQMIGCTLVTHQTGPEGKEVRRLLVEEGMNIEKEFYVGITLDRATSQNVLMVSTEGGMEIETVAEETPEKLLKIQIHPLQGLQGFQARQAAFFLGLEGDKFKNTVKFITALYKAYTAIDASIAEINPLVITKEGKVMALDAKINFDSNALFRHKDFLELRDISEEDPFEVEASKSNLNYVRLDGNVGCMVNGAGLAMATMDMIQLAGGKPANFLDVGGSASPETVEEGFKIIMSDKNVKAILINIFGGIVRCDRVAGGVIEAAKKVGLDMPVIVRLEGTNAEIAQKMLDESGLNLIAANGLREAAQKVNEALS

SEQ ID NO: 18052 - protein, 884 aa, Arabidopsis thaliana
MKIHLLLAMIGTFVVIIGAQDQEGFISLDCGLPSDESPYDDSFNGLTFTSDSTFIQTGKIDSVDKDLNINLSKQYLTLRYFPEGKRNCYSLDVKRGTTYLIVVSFVYGNYDGLNRDPNFDIHLGPNKWKRIDLDGEKEGTREEIIHKARSNSLDICLVKTGETLPIISAIEIRPLRNNTYVTQSGSLMMSFRVYLSNSDASIRYADDVHDRIWSPFNGSSHTHITTDLNINNSNAYEIPKNILQTAAIPRNASAPLIITWDPLPINAEVYLYMHFAEIQTLEANETRQFDVILRGNFNHSGFSPTKLKVFTLYTEEPMKCGSEGCYLQLVKTPNSTLPPLINAIEAYSVIEFSQLETSLSDVDAIKNIKNTYKLNKITWQGDPCLPQDLSWESIRCTYVDGSTSPTIISLDLSKSGLNGSIPQILQNFTQLQELDLSNNSLTGPVPIFLANMKTLSLINLSGNNLSGSVPQALLDKEKEGLVLKLEGNPDLCKSSFCNTEKKNKFLLPVIASAASLVIVVVVVALFFVFRKKKASPSNLHAPPSMPVSNPGHNSQSESSFTSKKIRFTYSEVQEMTNNFDKALGEGGFGVVYHGFVNVIEQVAVKLLSQSSSQGYKHFKAEVELLMRVHHINLVSLVGYCDEGEHLALIYEYMPNGDLKQHLSGKHGGFVLSWESRLKIVLDAALGLEYLHTGCVPPMVHRDIKTTNILLDQHLQAKLADFGLSRSFPIGNEKNVSTVVAGTPGYLDPEYYQTNWLTEKSDIYSFGIVLLEIISNRPIIQQSREKPHIVEWVSFMITKGDLRSIMDPNLHQDYDIGSVWKAIELAMSCVSLSSARRPNMSRVVNELKECLISETSRIGEGRDMESKGSMEFSRDIYNEVIPQAR

SEQ ID NO: 18053 - protein, 270 aa, Secale cereale
MDVADIASPSGQQEQGHRTVSSEPPKRPAGRTKFHETRHPLYRGVRRRGRVGQWVCEVRVPGIKGSRLWLGTFNTAEMAARAHDAAVLALSCRAACLNFADSAWRMLPVLAAGSFGFGSPREIKAAVAVAVIAFQRKQIIPVAVAVVALQQQQVPVAVAVVALKQKQVPVAVAVVALQQLHVPVAVAVVALQQQQIILPVACLAPEFYMSSGDLLELDEEHWFGGMDAGSYYASLAQGMLVAPPDERARPENGEQERRPDAAMELFVRLI

SEQ ID NO: 18054 - protein, 543 aa, Corynebacterium efficiens YS-314
MTISSPLIDVANLPDINTTAGKIADLKARRAEAHFPMGEKAVEKVHAANRLTARERLDYLLDEGSFIETDQLARHRTTAFGLGNKRPATDGIVTGWGTIDGREVCIFSQDGTVFGGALGEVYGEKMIKIMELAIDTGRPLIGLYEGAGARIQDGAVSLDFISQTFYQNIQASGVIPQISVIMGACAGGNAYGPALTDFVVMVDKTSKMFVTGPDVIKTVTGEEITQEELGGATTHMVTAGNSHYTAATDEEALDWVQDLISFLPSNNRSYAPVEEFDEEDGGIAENITADDLKLDEIIPDSATVPYDVRDVIQCLTDDGEYLEIQADRAENVVIAFGRIEGQSVGFVANQPTQFAGCLDIDSSEKAARFVRTCDAFNIPIVMLVDVPGFLPGAGQEYGGILRRGAKLLYAYGEATVPKITVTMRKAYGGAYCVMGSKGLGADINLAWPTAQIAVMGAAGAVQFIYRKELMAADAKGLDTVALAQSFEREYEDHMLNPYLAAERGLIDAVILPSETRGQIARNLRLLKHKNVSRPARKHGNMPL

SEQ ID NO: 18055 - protein, 547 aa, Staphylococcus epidermidis ATCC 12228
MTQNSYKIPIQGMTCTGCEEHVTEALEQAGAKDVSADFRRGEAIFELSDDQIEKAKQNISAAGYQPGEEESQPSENSVDFNRDGDYDLLIIGSGGAAFSAAIKANENGAKVAMVERGTVGGTCVNIGCVPSKTMLRAGEINGLAQNNPFTGLQTSTGAADLAQLTEQKDGLVSQMRQEKYIDLIEEYGFDLIRGEASFIDDKTIQVNGQNITSKSFLIATGASPAVPEIPGMNEVDYLTSTSALELKEVPQRLAVIGSGYIAAELGQMFHNLGTEVTLMQRSERLFKTYDPEISEAIDESLTEQGLNLITGVTYQKVEQNGKSTSIYIEVNGQEQVIEADQVLVATGRKPNTETLNLESAGVKTGKKGEVLTNEYLQTSNNRIYAAGDVTLGPQFVYVAAYEGGIVANNALGLAKRKIDLRFVPGVTFTNPSIATVGLTEQQAKEKGYDVKTSVLPLDAVPRALVNHETTGVYKLVVNAQTQKLIGAHIVSENAGDVIYAATLAVQFGLTIEDLTDSFAPYLTMAEGLKLAALTFDKDVSKLSCCAG

SEQ ID NO: 18056 - protein, 168 aa, Triticum aestivum
  misc_feature (149)..(149): Xaa can be any naturally occurring amino acid
  misc_feature (167)..(167): Xaa can be any naturally occurring amino acid
MGSASAASLPTSAGAGENLVLILDFGSQYTHLITRRVRQLGVLSLCVSGTAPLSSLAGLRPRAVVLSGGPHSVHADGAPSFPEGFLDFAAGAGAHVLGVCYGMQLLVQTLGGAVEPGVRQEYGDMEVEVTAPSSALYGEQGKRQSVWMXHGDEVVRLPEGFEVVARXV

SEQ ID NO: 18057 - protein, 218 aa, Salinibacter ruber DSM 13855
MYESGDDAAINERPWKGAEYIEMGRQNVSPNILLSRTMIKPFLGVEPTHDDTNYIAETAALVGDVILGRDASIWHHCTLRGDVNWIRVGPETNVQDHTVVHVTHGTAPADIGARVTIGHGAIVHGCTVEDEVLVGMGATILDHAVIGRHSIVGAQALVTKGTRVPPRSLVLGQPAEVVRTVTDEEVAGIRDGADNYLRYADVHAGTERPAENPWYDPV

SEQ ID NO: 18058 - protein, 380 aa, Streptomyces coelicolor A3(2)
MTTSTRGAHRTPAVLVLEDGRIFRGRAYGAVGATFGEAVFSTGMTGYQETLTDPSYHRQVVVMTAPHVGNTGINDEDMESRRIWVSGYVVRDPARVPSNWRSTRSLDQELAAQGVVGISGIDTRALTRHLRERGAMRVGIFSGNALPDEGTMLAEVRQTPEMSGADLSAEVATTEAYVVPAIGEKKFTVAAVDLGIKGMTPHRMAERGIEVHVLPATATVDDVYAVEPDGVFFSNGPGDPATADHPVSVMQGVLERGTPLFGICFGNQILGRALGFGTFKLKYGHRGINQPVQDRTTGKVEVTAHNHGFAVDAPLDQVSDTPYGRAEVSHVCLNDNVVEGLQLLDRPAFSVQYHPEAAAGPHDAAYLFDRFVNLMEGQRA

SEQ ID NO: 18059 - protein, 559 aa, Legionella pneumophila subsp. pneumophila str. Philadelphia 1
MCSIGEYLAKRLEELNISEYFAIPGDYNLILLDEVLKNEKIKMINCCNELNAGYAADGYARVKGVSALFVTYSVGGLSVVNAVAGAYAENLPILVISGGPNTNSIQDAEILHHTLATEDNLYVRDIFSRITAHVVCIRKPEQAAMQIDEAIAIAIAKKKPVYIEIACNIANYPISKPTQRAFNTYKISDSSSLAAAVEHAAEKLNSALKPSLIVGSKVRHCNAINSVSELAKCTGYAMAAMPDAKGFISEQHPNFIGIYWGPVSSSGCAEIIDSSDAYLLIGPNENDYTTVGYVWGINPHKSIKTTKGGVIIGETVYTNIFMNDFLRELSKKLKFNDASYKAYKRIAEETVVYPELDQPDAPLSSRYLFGQIQKMLSDKKALLAETGDSWFNCMRLSLPEGCPFEIQMQYGSIGWSVGALLGMQAALHNQKRVIACIGDGSFQMTAQEISTMIRYGYKPIIFLMNNACYTIEVQIHDGPYNVINNWRYAELVNVFRGEQSNAKSFVVKTNKELLTAIKQAEKTDALCFIEVFLDKDDCNKNLLEWGSRVANYNSRPPRR

SEQ ID NO: 18060 - protein, 500 aa, Streptomyces coelicolor A3(2)
MTNIVNHWIGGKTAEGASGTYGPVTNPATGEVTTKVAFASVDEVDAAVAAAREAYLTWGQSSLAQRTSILFRFRALLDAHRDEIAELITAEHGKVHSDALGEVARGLEIVDLACGINVQLKGELSTQVATRVDVSSIRQPLGVVAGITPFNFPAMVPLWMFPIAIACGNTFVLKPSEKDPSAAVKVAELLSEAGLPDGVFNVVHGDKVAVDRLLEHPDVKAVSFVGSTPIARYIHTTASANGKRVQALGGAKNHMLVLPDADLDAAADAAVSAAYGSAGERCMAISAVVAVGAVGDELVEKIRERAEKIKIGPGTDPSSEMGPLITKAHRDKVASYVAGAAAEGCEVVLDGTGYTVDGHEDGHWIGISLLDRVPTTAKAYQDEIFGPVLCVLRADTYEEGVALINASPFGNGTAIFTRDGGAARRFQLEIEAGMVGVNVPIPVPVGYHSFGGWKDSLFGDHHIYGNDGTHFYTRGKVVTTRWPDPADAPAGVDLGFPRNH

SEQ ID NO: 18061 - protein, 275 aa, Picea sitchensis
MEMEGEDYEEHPPAPLLDSLELKLWSFYRAVIAEFVATLLFLYITMTTVVENKQSKGTCGGVGLLGEAWAFGGMIFVLVYCISGISGGHVNPAVTFGMFLARKVSLPRAVLYVVAQCLGAVCGTALVRGIQGSFYASNGGGSNSVSPGYSKGSALLAEIIGTFVLVYTVFSATDPKRKARDSHVPVLAPLPIGFAVFLVYLATNSITGTGINPARSFGPAVIYGHKKPRDDLWIFWIGPLIGAAVATVYHRYLLRAGAFGSKNLGSLRSHPASAI

SEQ ID NO: 18062 - protein, 530 aa, Helicobacter hepaticus ATCC 51449
MNNLGYLLNVKVKRMDNASLIQQSEESPSVTIKQGLKSKHKQDTQGFDVFGLKDFVLKGIREAGFSTPSPVQSQSIPIILQGKDLIAQAQTGTGKTAAFAIPILNTLNRNKDIEALIITPTRELAMQISEEILKLGRFGRIKTICMYGGQSIKRQCDLLEKKPKAMIATPGRLLDHLQNGRIAHFSPQIVVLDESDEMLDMGFLDDIEEIFKFLPNTRQTLLFSATMPEPIKALAMKILNEPAFVKITPTDVTNQDIEQQYYIINEGERDEAIVRLIETQNPTKSIIFTRMKKEADALAIRLANRGFKAIALHGDMEQRDRREAIKAFRENKIEILVATDVASRGLDISDVSHVFNYHIPLNPESYVHRIGRTGRAGKKGVAVTLATPLEYKDLSKIKQITKAKLKLCEIKQEYSDDAFSQELSHTKISDKSVAIYEKLKDKIDTTQLCLKLISLHLEKNSSLKIGLSKEQIAKLEENYESEQPKKSNKKFVGNTRSATKGNLRGGKGSKNNKRYDNIDRSQPYTNSIWG

SEQ ID NO: 18063 - protein, 266 aa, Picea sitchensis
MAGLFDRQAREYANGRPQYPPQLFSLIAKHSPHRRLAWDVGTGSGQAALALSEIFERVIATDVSEQQISYAPRRPNITYTVTPRQMSLEELESTVGAEGSVDLVTVAQALHFFDLHTFYGQVKHVLRKPGGVFAAWCYNREAVVNPSVDRVFQDLYRASDPFWTPARQLVDSEYTTIDFPFRSVAQEGSEGEESTTAPIKFWAKKELGFEGYLSLIRSWSAYQIAKGKGVELLDDQIVARLKQAWGGSDEDVKTVSWPVFLRIGVV

SEQ ID NO: 18064 - protein, 524 aa, Oryza sativa Indica Group
MPSAHPLPASSQATTATTAWATRTLTSTRSVGRTPTLSTPHAPGPYTSSTNAEAIATQPYPLTDKWATNLHPGPITSHRIATSALHQQRMKQAAAAAQQQQMMQQALLMQQQQAAAVAAAAQQQQAPLFPPHHPHPGLLAAPQIEPIVSGNLPPGFDSSTCRSVYVGNIHLQVTDSLLHEVFQSIGPVEGCKLIRKEKSSFGFVDYYDRRSAAIAIVSLNGRQLFGQPIKVNWAYASTQREDTSGHFNIFVGDLCPEVTDAALFAFFAGFTSCSDARVMWDQKTGRSRGFGFVSFRNQQDAQNAINELNGKWLGNRQVRCNWATKGANAGEEKQNTDSKGMIELTNGSSEGGKDNANEDGPENNPQYTTVYVGNLPHDVNSNDVHRFFHSLGVGSIEEVRVTRDKGFGFVRYSTHEEAALAIQTGNGQLIGGRQIKCSWGSKPTPPGTASAPLPPPAPAPFNPGMSATDLLAYERTLALSKMAANPALMSQHAALKQAAAMGMGAGASQAIYDGGYQSANAVFY

SEQ ID NO: 18065 - protein, 137 aa, Burkholderia xenovorans LB400
MAYSDKVLDHYENPRNVGSFAKDDDAVGTGMVGAPACGDVMKLQIRVGADGIIEDAKFKTYGCGSAIASSSLVTEWVKGKTLDQAMSIKNTQIAEELALPPVKIHCSILAEDAIKAAVADYKQRHGEAVVADEKQHA

SEQ ID NO: 18066 - protein, 329 aa, Yarrowia lipolytica CLIB122
MTSNSIKILSGDINQGLAEKVAARLGLPLAKINIFRDSNRETSITIGESVRDEDVYIICQVGCGEVNDRILEMLIMINACKTASARRITAVLPNFAYARQDRKDKSRAPITAKLMANMLQTAGCNHVITMDLHASQIQGFFDVPVDNLYAEPSVVNYLKSEIMHNVNGQPGDHTNTIIVSPDAGGAKRAAALADRLDLNFALIHKERARANEVSRMVLVGDVKDKVCVLVDDMADTCGTLAKAADTLFEHGAIKVIAIVTHGILSGRAIEIINNSKLDRVVCTNTLDLQTKMDQCPKLGIIDISGVLAESIRRLHNGESVSYLFRNVPL

SEQ ID NO: 18067 - protein, 245 aa, Oryza sativa
  misc_feature (81)..(81): Xaa can be any naturally occurring amino acid
MSAYCGKYKDELIKNAAYIGTPGKGILAADESTGTIGKRFASINVENVEENRRSLRELLFTTPGALQHLSGVILFEETLYXERCAYVTEKVLAACYKALNEHHVLLEGSLLKPNMVTPGSESKKVSPQLIAEYTVRALQRTVPAAVPAIVFLSGGQSEEEATVNLNAMNKLSTKKPWALSFSFGRALQQSTLKAWGGKTENVVKAQKAFITRCKANSEATLGTYQGDAVLGEGASESLHVKDYKY

SEQ ID NO: 18068 - protein, 244 aa, Zea mays
MAAADETRPLLVAISLAVAACCLAQLAVGDTNGVYEPCSDARIQRGDGFTFGVVFAGYNAFFSGNTQLSPCDRRLNLAASGQLAVFRPKVDEISLLTINTTTGFNPASAGGFMVAFAGRKYAARSIPIFVSNTSVTVSSFTLVLEFNKGRLQNLHWKKDGCGACSGKSNFVCLGKQTCAIRTQSCKSQGPVDCSVGIQLAFSGTDKHESVLNSWYEVSNLRQYSLYGLYSNLKDTLSGQFNKIF

SEQ ID NO: 18069 - protein, 579 aa, Halobacterium sp. NRC-1
MRNAKIVCTLGPATNDDASVRALADAGMTVARINASHGDAAARRELIETTRAVDAQTDKPLAVMLDTQGPEVRTAPIDDDGTIHIETGSDVAFVEGDTATPDRIGISTSIAAAEPGDTVLLDDGRIEADVDRVAGDTVHATVVSGGSLGSRKGVNVPGVELDVDVVTEKDRRDLALAAELDVDYVAASFVRDADDVLAVNRVLESHGADIPIVAKIERAGAVENLDGIIDAAQGVMVARGDLGVECPMEDVPMIQKRIIAQCRDAGVPVITATEMLDSMVHARRPTRAEASDVANAVLDGTDGVMLSAETAVGDNPTRVVETMDRIVREVEGSAEYSERQEQAVPTADGTAKTDALARSARYLARDIDASAVVVASESGYTARKAAKFRPSVPVVCATPSHDVRRQLALNWGVHANYAAVAEGDATTVVERAVQAAVDSGVVASGDTVVVLVGMMTELEGASTTNTLKVHVAAETLSTGRAVVDGRTTGRTYRADSGDLSDAPENAVVLLAHGFDGEFDGDLSKIGAIVSADAGLTGYPAVIARELDVPMVGDVDVDAVPAGDLVTVDGERGVVYEADQ

SEQ ID NO: 18070 - protein, 288 aa, Medicago truncatula
MTSSLFSSSASLSTYYHLIFTVLAFLLSALIFFLTQKTKSKHHNLPPGPQGWPVVGNLFQVARSGKQFQDYVKDMKAKYGSIFTLKMGTRTMIIITDAKLVHEAFIQKGALYASRPPENPTRNIFSANKFTVNAAVYGPVWKSLRRNMVQNMLSSTRLKEFKSVRDKAMDKLINRLKVNAENNNGVVIVVRDARFAVFCILVVMCFGLKMDEEKLERIDQVMKNVLITLDPRIDDFLPILSVFFSKQRKRALEVRKEQVEFLVPFIEQRRRAFQNPGSDQTATTFSYL

SEQ ID NO: 18071 - protein, 486 aa, Triticum aestivum
  misc_feature (98)..(98): Xaa can be any naturally occurring amino acid
  misc_feature (188)..(188): Xaa can be any naturally occurring amino acid
  misc_feature (244)..(244): Xaa can be any naturally occurring amino acid
  misc_feature (349)..(349): Xaa can be any naturally occurring amino acid
  misc_feature (388)..(388): Xaa can be any naturally occurring amino acid
  misc_feature (407)..(407): Xaa can be any naturally occurring amino acid
MVKICCIGAGYVGGPTMAVIAVKCPAIEVVVVDISKPRIDAWNSDKLPIYEPGLDEVVKACRGRNLFFSTDVEKHVAEADIIFVSVNTPTKTRGLGAXGKAADLTYWESAARMIADVSKSDKIVVEKSTVPVKTAEAIEKILTHNSKGINYQILSNPEFLAEGTAIEDLFKPDRVLIGGRETPRGQEXAFRLLKEVYAHWVPEENIITTNLWSAELSKLAANAFLAQRISSVNAMSALCEATGXANVSEVSYAIGKDSRIGPKFLNASVGFGGSCFQKDILNLVYICECNGLPEVANYWKQVIKINDYQKSRFVNRVVSSMFNTVSSKKVAVLGFAFKKDTGDTRETPXAIDVCKGLLGDKAHVSIYDPEVTEEQIQRDLAMNKFDWXDHPMHLQPTSPSAIKQVSXVVWDAYEATKGAHAVCILTEWNEFKELDYQKIFDNMQKPAFVFDGRNVVDAEKLREIGFIVYSIGKPLDAWLKDMPAIA

SEQ ID NO: 18072 - protein, 438 aa, Salinibacter ruber DSM 13855
MSTRTPAHRVSLSTALQDGLAPDGGLYVPERFPTLGPEAFAGCTTIEAVAERLLRPFAEGDGLADVLPGICEAMFGFPVPLREIGRGTSVLELFHGPTAAFKDVGARFLADSLARLNEGAAQPLTILVATSGDTGAAVAAAFWKKPNVEVVVLYPKGKVSDRQEQQLTGWSDNVQTVAVRGVFDDCQTLVKEAFQDEAWQERLRLSSANSINIGRLLPQMTYYAYASLRHWRAHGTRPNVIVPSGNLGNGLACLYARECGLPIGEVVFATNENRPVTHYLETGEYEAFETQETLATAMDVGNPSNMERLRHHYSGSGGAEALHDAIGAERVTDEQIERHVRQGPEAWDTVWDPHTATAVEAREHLDPDDEHEWILVATAHPAKFPEVVEPLVGHAVDVPEPLAEVMARSHPVPEVDPTLSAVADVVFEDRRPDATEHA

SEQ ID NO: 18073 - protein, 598 aa, Zea mays
MGGEVPEPRRLSRALSFGCGGVPEEALHLVFGYMDDPRDREAASLVCRLWHRIDALSRKHVTVGFCYAVEPARLLARFPRLESLALKGRPRAAMYGLIPEDFGAYAAPWVAELAAPLDCLKALHLRRMTVTDEDIAVLVHARGHMLQALKLDKCSGFSTDALRLVARSCRSLRTLFLEECIIEDEGSEWLHELAVNNSVLVTLNFYMTELKVEPADLELLAKNCKSLISLKMGDCDLSDLIGFFQTSKALQEFAGGAFFEVGEYTKYEKVIFPPRLCFLGGLTFMGKNEMPVIFPYSTMLKKLDLQFTFLTTEDHCQLIAKCPNLSVLEVRNVIGDRGLEVVAATCKKLRRLRIERGDDDPGQEEQGGVSQIGLTAVAVGCRELEYIAAYVSDITNGALESIGTFCKNLYDFRLVLLDKQKKITDLPLDNGVRALLRNCVKLRRFAFYLRPGGLSDVGLGYIGLYSGNIQYMLLGNVGESDNGLIQFATGCTNLRKLELRGCCFSERALAVAVLQMPSLRYIWVQGYRASRTGQDLMLMARPYWNIEFAPPIPESAYRVMADGQPCVDTHAQVLAYYSLAGRRPDCPQWLVTLHPASL

SEQ ID NO: 18074 - protein, 110 aa, Vitis vinifera
MESSRGPGGIQQLLAAEQEAQHIVNAARSAKMARLKQAKEEAEKEIAAYRAQVELEFQKKLAESSGDSGANVKRLEQETQAKIHHLKTEAGRISHDVVHMLLKHVTTVKN

SEQ ID NO: 18075 - protein, 498 aa, Haemophilus somnus 129PT
MNFINGKQVASKGTKAWPIYNPATGEQIRQVMMSTAEEVNEAVEVAQKAFPAWAATSPLRRARVMFKFKQLLERDWDDLARLITEEHGKVFSDAQGELTRGLEVVEFACGIPHLVKGEFSEQAGRGIDIHSAMQPLGVCVGITPFNFPAMVPMWMFPIALACGNTFILKPAKADPSLSIRLAELLKEAGLPDGVFNVVHGDRQDNEILLRDPRVKAVSFVGSTTAAAHVHAIGSAHGKRVQALGAAKNHGLVMPDVDIEATANALLGAAFGAAGERCMALPLAVTIDDETADKLVAALKPKVEALRYGPGLTKEGEKENDFGPLITRQHRDNVKRYVDIGVSEGATLVVDGRDKFPVGYENGFFIGGCLFDHVTPDMTIYKEEIFGPVLGIVRAKNFQEAMKLINEHQFGNGAAIFTNNGAAAREFAYQVQAGMVGVNVPIPVPMAFHCFGGWKESAYGALNAYGPDGVRFYTKMKTVTTRWPEKDLSSQAAFSMPTL

SEQ ID NO: 18076 - protein, 267 aa, Vitis vinifera
MAKDIEVAGHGDLTLKDYHDPPPAPLGHHCRVRGHPFVPLRYCNQTDPYHHGNECNGVGILGIAWAFGGMIFILVYCTAGISGGHINPAVTFGLFLARKVSLVRAVMYMVAQCGGAICGCGLVKLFQDIYYIRYGGGANELASGYSIGTGLAAEIIGTFVLVYTVFSATDPKRNARDSHVPVLAPLPIGFAVFMVHLATIPITGTGINPARSLGAAVIYNQPKAWSDHWVFWAGPFIGAAIAAFYHQFILRAGAVKALGSFKSSSHM

SEQ ID NO: 18077 - protein, 274 aa, Taxodium distichum
VEQQGIGAKDYIDPPPAPLVDFEEFKLWSFYRALIAEFIATLLFLYITIATVIGHKRTAANCGSVGILGIAWAFGGMIFVLVYCTAGISGGHINPAVTFGLFLARKVSLPRAVLYMVAQCLGAICGVGLVKAFQKSFYDMHGGGANSVAQGYSKGTGLGAEIIGTFVLVYTVFSATDPKRSARDSHVPVLAPLPIGFAVFMVHLATIPITGTGINPARSFGAAVIYGHDKIWDDQWIFWVGPFLGAFAAAFYHQYILRAAAIKALGSFRSNPNV

SEQ ID NO: 18078 - protein, 255 aa, Haemophilus somnus 129PT
MARRPLVMGNWKLNGSKAFTKELITGLKDELNAVSGCDVAIAPPVMYLAEAETALVSSDIALGTQNVDLNKQGAFTGDISTEMLKDFGVKYVIIGHSERRQYHHESDEFIAKKFGVLKDAGLVPVLCIGESEAENEAGKTEEVCARQIDAVMNTLGVEAFNGAVIAYEPIWAIGTGKSATPAQAQAVHAFIRGHIAKQSQAVAERVIIQYGGSVNDANAAELFTQPDIDGALVGGASLKASAFAVIVKAAAKAKN

SEQ ID NO: 18079 - protein, 478 aa, Erythrobacter sp. NAP1
MGKDTGFLELDRRERDYLAPEERLNNYREFVVQPSDDVLAAQASRCMDCGIPYCHNGCPVNNLIPDWNHLVYEQDWRNALDLLHSTNNFPEFTGRICPAPCEASCTLNIVDQPVTIKSIECAIVDRGWQEGWVTPQVPEKKTGKSVAVVGSGPAGMACAQQLARAGHSVTLFEKSDRIGGLLRYGIPDFKMEKHLINRRCVQMEAEGVTFKTSKEVGVDISFKNLQENFEAVVLAGGSEDARQLAIPGAEMPGVRLAMEFLTQQNKRNAGDDEQRAAPRGTLKATGKHVVVIGGGDTGSDCVGTSNRQGAASVTQLEIMPKPPEKEDKALTWPDWPLKLRTSSSHEEGVERDWAVLTKRVVGDGVAVTGLECARVEWVDGQMREIVGSEFTLKADLILLAMGFVGPKKAGLLEQAGVDLTDRGNVGANTENYRTNVENVFACGDMRRGQSLVVWAIREGRQAARAVDEALMGASELPR

SEQ ID NO: 18080 - protein, 452 aa, Arabidopsis thaliana
MEQKMESASDLGKLFIGGISWDTDEERLQEYFGKYGDLVEAVIMRDRTTGRARGFGFIVFADPSVAERVIMDKHIIDGRTVEAKKAVPRDDQQVLKRHASPMHLISPSHGGNGGGARTKKIFVGGLPSSITEAEFKNYFDQFGTIADVVVMYDHNTQRPRGFGFITFDSEESVDMVLHKTFHELNGKMVEVKRAVPKELSSTTPNRSPLIGYGNNYGVVPNRSSANSYFNSFPPGYNNNNLGSAGRFSPIGSGRNAFSSFGLGLNQELNLNSNFDGNTLGYSRIPGNQYFNSASPNRYNSPIGYNRGDSAYNPSNRDLWGNRSDSSGPGWNLGVSVGNNRGNWGLSSVVSDNNGYGRSYGAGSGLSGLSFAGNTNGFDGSIGELYRGSSVYSDSTWQQSMPHHQSSNELDGLSRSYGFGIDNVGSDPSANASEGYSGNYNVGNRQTHRGIEA

SEQ ID NO: 18081 - protein, 107 aa, Lilium longiflorum
RAAPAQASMVAPFVGLKSSSAFPVTQKPATGLPTLPSNGGRVQCMKVWPIVGKKKFETLSYLPTLPVEALLKQIEYLIRSGWVPCLEFSLVGFVSRDYHQSPGYYDG

SEQ ID NO: 18082 - protein, 906 aa, Aspergillus oryzae
MRSGNPAEAFPGQGTLVKESSTLINQVLVSDPSVDIEREQVRQAGTSVSPSTDGTPTPGLGLVGSDGVDDGGRGGLRSRHDYNENSIKRKETTFGQYILGQTLGEGEFGKVKLGWKRDGSIQVAIKLIRRESLGSNPSRLPKIYREISILRDLSHPNIVRLHEMVETDKHIGIIMEYASGGELFDHILNNRYLKDNSARRLFAQLVSGVGYLHKKGIVHRDLKLENLLLDRNRNIIITDFGFANTFDPLDELGEEIEYNLTNKEFVKRMRLDKPNAKGLRRGDLMQTSCGSPCYAAPELVVSDSLYTGRKVDVWSCGVILYAMLAGYLPFDDDPANPDGDNINLLYKYIVTTPLTFPEYVTPHARDLLRRILVPDPRKRADLFEVARHSWLNEYSHIVSHITSSTTKVADIATTTVSHGTTLSGHVRCLPANSLPRSEQPKEAPSLGRSASVREPPKTYQSTVPSLGALVHHAGNISQEQPAESSKTPRDTKRRTVQVEYVAPSSQTTRGEGMGSATAGPSSAAETAEHVPTGARSNSRDAETVSPTSGVPQDAPMAPSAQAGDSKAQRPQSGHLPRSTSDSTALTGAGTMPQPHSMRPTTGASMSSFNTGRLPSRGSYGQPVAPTVAATNAHGRLAQPKSKQYVISNPIPQDPSQPAAASIGRPSTQALPAKFNTTPRQEPPKGHKRSNTVSGIGEKLFGRSGSIFGGRGGQANARQKSGKRYPPTSMKDPYGGDMPRMSMDSRRSMQYGSNRKTSETGGESRPRRFSLLPASFSLKGLSSSRSQTPDEESQVDRSTDNRAQQKPSTGELRPRARATSHGTQDAIGVMPEGAPADEVFVQDEPINYQALSRPTRGASVLQKNHRKFADAYEYERDSSHHSGSSGAARKVMDFFRRRAKSRAADDR

SEQ ID NO: 18083 - protein, 491 aa, Coprinopsis cinerea okayama7#130
MAEPTGDIGLIGLAVMGQNLILNMNDKGFNVVAYNRTTSKVDHFLANEAKGTNIQGAHSVQELVAKLKRPRKIILLVKAGSAVDDFIKQLEPHLEAGDIIIDGGNSHFPDSIRRTKELEAKGLLFVGSGVSGGEEGARYGPSLMPGGSTAAWPAIKDIFQKTAAQVNGEPCCDWVGETGSGHYVKMVHNGIEYGDMQLIAEAYDILKRGLGLDEDEIADIFLKWNKGVLDSFLIEITANILKFKDDDGEHVVNKILDKAGQKGTGKWTAIAALDAGTPVTLIGEAVFARCLSAIKEERVRASKIISGPAKEPFRGDKKQFIDDLEQALYASKIISYTQGFMLMRETAKELGWHLNYAGIARMWRGGCIIKSVFLGDITAAYTKNPELESLLFDDFFNKAVHNAQAGWRRIIAQAVLWGIPTPAFSTALAFFDGYRSEIVPANLLQAQRDYFGAHTFRVLPGKENERFKAGEDIHVNWTGRGGNVSASTYNT

SEQ ID NO: 18084 - protein, 363 aa, Salmonella enterica subsp. enterica serovar Typhi str. CT18
MSKNYHIAVLPGDGIGPEVMAQALKVMDAVRSRFDMRITTSRYDVGGIAIDNHGHPLPKATVEGCEQADAILFGSVGGPKWENLPPESQPERGALLPLRKHFKLFSNLRPAKLYQGLEAFCPLRADIAANGFDILCVRELTGGIYFGQPKGREGSGQYEKAFDTEVYHRFEIERIARIAFESARKRRRKVTSIDKANVLQSSILWREIVNDVAKAYPDVELAHMYIDNATMQLIKDPSQFDVLLCSNLFGDILSDECAMITGSMGMLPSASLNEQEFGLYEPAGGSAPDIAGKNIANPIAQILSLALLLRYSLDADEAATAIEQAINRALEEGVRTSDLARGAAAVSTDEMGDIIARYVAEGV

SEQ ID NO: 18085 - protein, 430 aa, Coprinopsis cinerea okayama7#130
MGMGGAAEAPRRAHLYVGNLSPRVTEYMLTEIFAVAGPVQHVKIIPDRNYQHGGLNYGFVEYMDMRAAETALQTLNGRKIFDTEIRVNWAYQGQQNKEDTSGHYHVFVGDLSPEVNDEVLGKAFSAFGTLSDARVMWDMNSGKSRGYGFLAFRDKTDAEQAIATMNGEWLGSRAIRVNWANQKTQGGAPGGGARPSAGGGAPAPVNFQGGPLTYEQVLAQTAPYNTTVYVGNLVPYTTQADLIPLFQSIGYLSEIRMQADRGFAFVKLDTHEHAAQAIVQLQGQMVHGRPIKCSWGKDRADGGVAQPAGAVSPAAAAPYGSMPMYGMPQPNTYGQYGFPGFPGFPGQAAGAPGAAGPASPGMPQANTAAGLGLAAGAQPGAGDPNAAGQQGQAQWGGADPSTYYSNYWGGYYGQQVAGQQGDAQMQQGPA

SEQ ID NO: 18086 - protein, 335 aa, Picea sitchensis
MEETPSSLPIVFESPGLRIYEDGTVERLIDRGTVPPSTQDDNFDEEKEGVASKDVLLDPQTGVFVRLYLPRLEVTDVKQKVPILVYFHGGAFCIESAASPGYHSYLNKVATEAKVIGVSVEYRRAPEHRLPAAYDDCFGVLEWLARQAEVAEGVPIDPWLASHADFSKVFVAGDSAGGNIVHQVCIRASARNWDGLCLQGAILVHPFFAGEERIECELGTGAEVEGFVKLVDGIWSISLPEGADRDHPFCNPDGPRSPALSTLAFPRTLVFVAEKDFLRDRGILYYEALKKAGKVVDFVITEGENHDFHLLNPKSENALLMMKRISDFMDSSSDY

SEQ ID NO: 18087 - protein, 122 aa, Triticum aestivum
  misc_feature (41)..(41): Xaa can be any naturally occurring amino acid
  misc_feature (52)..(52): Xaa can be any naturally occurring amino acid
  misc_feature (59)..(59): Xaa can be any naturally occurring amino acid
  misc_feature (81)..(81): Xaa can be any naturally occurring amino acid
  misc_feature (91)..(91): Xaa can be any naturally occurring amino acid
  misc_feature (93)..(93): Xaa can be any naturally occurring amino acid
  misc_feature (97)..(97): Xaa can be any naturally occurring amino acid
  misc_feature (105)..(105): Xaa can be any naturally occurring amino acid
HSERRSLMGESSEFVGEKVAYALAQGLKVIACVGETLEQRXEAGSTMEVVAXNKTKAIXGKIKDWANVVFPVIEPSCWAIXGTGKVSTPVXGXQEVXHPNPLRDXLPRPIVSPLLLASTPYY

SEQ ID NO: 18088 - protein, 603 aa, Burkholderia xenovorans LB400
MSLVEVKVPDIGDFKDVDVIEVNIKPGDVIENEQALMTLESDKASIEVPSDTAGTVREVRVKAGDKVSQGTVIALVETSGEAAPAKDAPKAPAKEAEKAPAQAEAKPQAAEAPAAAPAKAAAPAPQAGSYSGSADIECDMLVLGSGPGGYSAAFRSADLGMKTVLVERYSTLGGVCLNVGCIPSKALLHTALVIDEAEALGAHGITFAKPQIDLDKLRDFKSGVVRKLTGGLAGMAKMRKVEVVTGNGAFVDPYHMEVQTEGGKKVVKFKQAIIAAGSEAVKLPFIPEDPRVVDSTGALELRQIPQRMLVIGGGIIGLEMATVYATLGAKIDVVEMLDGLMAGADRDLVKVWEKYNSKRFANVMLKTKTTAAEAKDDGIHVSFEGEKAPAEAQRYDLVLVAVGRTPNGKKIGADKAGVAVTDRGFIDVDKQMRTNVPHIFAIGDIVGQPMLAHKAVHEGHVAAEAAHGEKAYFDALQIPSVAYTDPEVAWAGKTEDQLKAAGIKYGKAVFPWAASGRAIANGRDEGFTKLLFDEETHRVIGGGIVGLNAGDLISEVCLAVEMGADATDIGKTIHPHPTLGESIGMAAELYEGVCTDLPPQKKK

SEQ ID NO: 18089 - protein, 555 aa, Burkholderia xenovorans LB400
MSQAIEVKVPDIGDYKDIPVIEVLVKAGDTVEKEQSLVTLESDKATMDVPSSAAGVVKEVKVKVGDNVSEGSLIVVLEGAEGGAAAPAPAPAAAPAAAPAPAPAAAPAAAPAPAPAASGGGLQEVKVPDIGDYKDIPVIEVAVKVGDRVEKEQSLVTLESDKATMDVPSSAAGVVKEVKVKVGDTVSEGSVIVVVEAEGGAAAPAPAPKQQAVEQPSDAPATPSPAPAAPSALAQAPVIPAGEGGARHASHASPSVRKFARELGVDVTQVQGTGPKGRITQADVTAFIKGVMTGQRAAPAGAAAPAAAGGGELNLLPWPKIDFTKFGPVDPKPLSRIKKISGANLHRNWVMIPHVTNNDEADITELEALRVQLNKENEKAGVKITMLAFVIKAVVSALKQFPTFNASLDGDNLVFKQYFHIGFAADTPNGLVVPVIRDADKKGLIDIAREMAELSKAARDGKLKPDQMQGGCFSISSLGGIGGTNFTPIINAPEVAILGLSRGATKPVWDGKQFVPRLILPLSLSYDHRVIDGAAAARFNAYLGAILADFRRVIL

SEQ ID NO: 18090 - protein, 836 aa, Xanthomonas oryzae pv. oryzae KACC10331
MMLPAALSSVGIAGGMQGRFRVEPHSAPRTPRCSMRSPCRADSCATGPCSGRRVEFSSPAPSRHTQPMSTDDFKQAALDYHRQQPAGKIKVTATKPMLTQRDLSLAYSPGVAFACEAIVDDATQASELTARGNLVAVITNGTAVLGLGNIGPLASKPVMEGKGVLFQKFAGIDVFDIEISENDPDKLVDIIASLEPTFGGINLEDIKAPECFIVERKLRERMNIPVFHDDQHGTAIIVGAAVLNALVVTGKKIEEVKLATTGMGAAGISCVNMLVSLGLKPENILALDRDGVIHTGRTDLDPDKQRYARDTDKRTLAEIVEGADIFLGLSAAGILKPEMVASMARQPVIFALANPNPEITPEAAKAVRPDCIIGTGRSDYPNQINNVLCFPYLFRGALDVGATGINEEMKIACVKAIAAMARREASDLGAAYGGETPSFGPEYLIPRPLDPRLLVELSSAVAQAAMDSGVATRPITDMEAYRDKLGQFVYRTSLMMKPVYDRARADKQRVVYAEGEEEVVLRAVQNVVDEGLAFPILIGRPDVIEARIERMGLRLTAGVDFEITNILDDPRFNDYWQYYHALTERRGVTVTAAKELMRSRPTLIAAVMVARGEADAMLSGVVGRFHKKLGYARSVIPLEPRVSSTSAMTGVINQLGVFFFLDTHVQEDPTVEQVVEATLQAAYRLKLFGIEPNIALLSHSNFGSHDSRDALKMRQVREALLKRKPELNIDGEMQGDTAWDEALRKQIMPNSTLKGRANLFVLPNLEAANIAYNLVRVFTDGVAIGPILMGISKPVHILTTSATSRRVMNMTAIAAVDAQIRKLLEAEKGGADKSND

SEQ ID NO: 18091 - protein, 295 aa, Idiomarina baltica OS145
MNIKQFTAEVRSAVDNRLNQLIESHIASSSLKEAMAYGVLLGGKRIRPYLTMAVAELCGAETNDALDAACAVELIHAYSLIHDDLPAMDDDELRRGHPTCHIKFGEATAVLAGDALQTLAFEVLSTNLETKLSSQRRIAMIQHLASASGAKGMCFGQALDLDATGRAIDELELEKIHRHKTGALIRASAALGVLAGNDESQQYLDHFCDFASWIGLAYQVYDDILDVVGNTEVMGKPQGSDEAHHKATYVALLGLDGASEKLLSLHQQALLSLNKIPYNTQKLETFSEILLKRDH

SEQ ID NO: 18092 - protein, 220 aa, Dehalococcoides sp. VS
MYENITRSVKDILAELPPDVVLEAAVKKRQPSEILAAIDAGIKIIGHNYLTEAEETYPLIGDKAEWHFIGKLQSNKCKKIVRRFSVVETVDSIEIASELNRRAAEIDKILSVFIEINSGREKQKSGVLPEETVELAKRISCLSNLKLTGLMTMGPALEAPEELRTIFRLTKIKFDEIASMGLPNTELQFLSMGMSGSYKVAVQEGANLVRLGTRIFGPRP

SEQ ID NO: 18093 - protein, 615 aa, Idiomarina baltica OS145
MTKLLDGIEYPTDLRKLPTHQLNALCEEVRAYLLDSVSRSSGHLASGLGTVELTVALHYVYNTPKDKLVWDVGHQAYPHKILTGRKKALHTIRQKDGLHPFPWREESEYDVLSVGHSSTSISAALGMAVAAQRSGSNEKVVSIIGDGAMTAGMVFEAMNHAGDIKPDMLVVLNDNDMSISENVGALNQHFARLLSGRFYTKIREQGKKLLKPLPPIHHLASRAEEHMKGMMAPGTIFEELGFNYIGPIDGHDVDTLVETLRNMKHLRGPQLLHVVTQKGKGYRPAEADPIGYHGVPKFDPSLSKLPAKKPGIPSYSEVFGDWLCDHAQDDAKLMAITPAMREGSGMVKFSKLYPEQYFDVAIAEQHSVTYAAGLAIAGLKPVVAIYSTFLQRAYDQVIHDVALQNLDVLFAIDRAGIVGADGPTHQGAFDLSYLRCIPNMVVMTPSNEQECRDMLYTGYCHQGPAAVRYPRGSGTGVTLREHDKLLTLGEANIIRQGNDVAILNFGTLLPEAIAVAEDINATVVDMRFVKPLDKQVAIDCARRHQLVVTLEENAIAGGAGSAVNEALANSGINTQVLNIGLPDEFIKHGSQDEVKQEIGLNATAIKSRIQDYLNS

SEQ ID NO: 18094 - protein, 566 aa, Coccidioides immitis RS
MSLRPKPGAARAAQNQQVIKDLLKLNCNKTCADCKRNKHPRWASWNIGIFICIRCSGIHRGMGTHVSRVKSVDLDSWTDEQLQSVVRWGNARANKYWEAKLPPGHVPSEAKIENFIRTKYESKRWVMDGPIPDPSTLDGDGDEDVPLAVVQEKAKLERSASHQATSTLARPSPPAQQQSINLFDDDAPAPPTRPKTTDIPGTHAPTKSSQPAAAPKQGKPGDSLLGLDFFGTSQPTTASRPSSTPSGPPTTGPSRPDLKQSILSLYASTPKPQPASQHDRTTSFGSSPSFQSPHKPQNDAFGGLTDAFSGLSFSSSVSSPPKKETSFSVFDSLTSQKSSSSVPQTMSPAPASTGSGLLDIASPKPGKKPSQGKSPSISTGSTGRAFDLIGATMGSTKSTKTPPTASNDILDLFSSPPATTSPPAVSPPKPNEMNSIFNLSSSKPQTITQSPPSNAATTTSMLSSVNIDPWGGNAWASTDPSPPTTQPTSMMRVPDTLTANDIGSGWGASSGLGGSSAPKPTPTVTADEDFGGWTSAVPTETSTSAPKAKTTGGFSGNDDLFSNVWE

SEQ ID NO: 18095 - protein, 154 aa, Idiomarina baltica OS145
MHIIEGGINAPGKKFAIIVSRFNHFVVESLLQGAVQTLKQYGQVADDDITVVRVPGAYEIPVTAKRLAESDKFDAIIAVGAVIRGGTPHFDFVAGESNSGLGRVAMEFGLPVAFGIITTDTLEQAIERSGSKAGNKGSEAALSALEMVNVLDKI

SEQ ID NO: 18096 - protein, 529 aa, Salinibacter ruber DSM 13855
MAELEAAPNTARELLFGDEWEYAPAPQSADHVRLDDRYGPFIDGEFREVDEYFPSINPATEEPLAEVGLADEAVVDEAVGAARTAYESHWRDLPGKERAKYIYRIGRMIKEKSREFAVLESMDGGKPIRESRDMDIPLVAAHFFHYAGWADKLEYALPGPGRPRSLGVCGQIIPWNFPLLMAAWKLAPALATGNTVVLKPAETTPLTALKLAEVIQEAGLPPGVVNIVQGAGEVGSALVEHPDVDKIAFTGSTGVGKHIQKQLAGTKKRLTLELGGKGANIVFEDAPIDQAVEGIVDGIYFNQGHVCCAGSRLLVQESVAEEVTRKLRDRIATLRVGDPLDKNTDIGAINSKPQLEKIRRLVDVGEREGADKFQPECNLPDDGFWFPPTFFTNVTQSHRIAQEEIFGPVLSVTTFRTPEEAVERANNTEYGLASGIWSDKGSKLFSISQALKSGVVWGNTYNKFDPASPFGGYKESGFGREGGMHGLLPYLERPSQSWQPQTPTNGSPSTKPASSTSAGASPEPKADDT

SEQ ID NO: 18097 - protein, 138 aa, Coccidioides immitis RS
MEYPDTRTEDEWRAILSPEQFRILRRKGTEAAFTGEYDKHKPTSGVYHCAGCNAPLYKAEHKFTSGCGWPAYFDCIPGAVTRHEDRSFGMTRTEIVCSNCGGHLGHVFKGEGYPTPTDERHCVNSISLKFSNKKGEGK

SEQ ID NO: 18098 - protein, 292 aa, Triticum aestivum
  misc_feature (196)..(196): Xaa can be any naturally occurring amino acid
MASIAPSSSSVAVLRRQPVQFLGGSDVSKQAKGSVSYSFPTNSRNANMKSLGLKIAASLKKNSGFPADGCLENDDTLSLKSTSVRAQDHPTTNSVIPVDSVVAAEIISTDLSCVVDTLSNEEDDAELDLDSPTEGFSSISEAIEDIRQGKLVIVVDDESRENESDLILAASLVTPEAMAFIVRHSTGIVCVSMKEXDLERLNLPLMVSTKENEEKLCTAFTITVVCYYCYSYLSIILRSYGVIWATISLLLVKSMDMACFSLAFLFLCKSKNAQIRWSVVQAQINSTSFMFV

SEQ ID NO: 18099 - protein, 390 aa, Thermus caldophilus
MRTLLDLDPKGKRVLVRVDYNVPVQDGKVQDETRILESLPTLRHLLAGGASLVLLSHLGRPKGPDPRYSLAPVGEALRAHLPEARFAPFPPGSEEARREAEALRPGEVLLLENVRFEPGEEKNDPELSARYARLGEAFVLDAFGSAHRAHASVVGVARLLPAYAGFLMEKEVRALSRLLKDPERPYAVVLGGAKVSDKIGVIESLLPRIDRLLIGGAMAFTFLKALGGEVGRSLVEEDRLDLAKDLLGRAEALGVRVYLPEDVVAAERIEAGVETRVFPARAIPVPYMGLDIGPKTREAFARALEGARTVFWNGPMGVFEVPPFDEGTLAVGQAIAALEGAFTVVGGGDSVAAVNRLGLKERFGHVSTGGGASLEFLEKGTLPGLEVLEG

SEQ ID NO: 18100 - protein, 420 aa, Triticum aestivum
  misc_feature (237)..(237): Xaa can be any naturally occurring amino acid
  misc_feature (246)..(246): Xaa can be any naturally occurring amino acid
  misc_feature (262)..(262): Xaa can be any naturally occurring amino acid
  misc_feature (284)..(284): Xaa can be any naturally occurring amino acid
  misc_feature (292)..(292): Xaa can be any naturally occurring amino acid
MMIARGCLLRSKAESIVKHVASGGSWHGLHSFSEASARGFSSEPSLQAHSTEEIGFKGHGMLAPFTAGWQSTDVHPLVIDRSEGAYVYDINGKKYIDALAGLWCTALGGSEPRLVKAATEQLNKLPFYHSFWNRTTKPSLDLANDVLSMFTAREMGKVFFANSGSEANDSQVKLVWYYNNAMGRPDKKKFIARSKSYHGSTLISASLSGLPALHQKFDLPAPFVLHTDCPHYWRFHXPDETEEEFXTRLANNLENLILKEGXENIAAFIAEPVMGAGGVILPPXTYFEKIQXVLKNSGVLLIADEVITAFGRLGPMFGCDMFIIQPDLVSVAKALSSAYMPIAAILVSPEIADVVHSQSSKLGSFAHGFTYSGHPVACAVAIEALKIYKERNITEHVNKIAPRFQEGIKAFSGSPIVGEV

SEQ ID NO: 18101 - protein, 332 aa, Staphylococcus epidermidis ATCC 12228
MKNLRNRNFLTLLDFTQKEMEFLLNLSEDLKRAKYAGIEQQKMKGKNIALLFEKDSTRTRCAFETAAYDQGAHVTYLGPTGSQMGKKESTKDTARVLGGMYDGIEYRGFSQRVVEDLAKYSGVPVWNGLTDEDHPTQVLADFLTAKEVLKKPYNEINFTYVGDGRNNVANALMQGAAIMGMTFHLVCPKELNPTDELLNRCNDIADKNGGEILITDDIDEGVKGSDVIYTDVWVSMGEPDEVWEKRIKLLEPYRVTKELMKKTGNPHTIFEHCLPSFHDTETIIGKQIQEKYGLTEMEVTNEVFESEQSVVFQEAENRAHTIKAVMVATLGE

SEQ ID NO: 18102 - protein, 81 aa, Arabidopsis thaliana
MVGGGAPQRGSAAATASMRRRKPAGGSSSAGGGAGTMLQFYTDDAPGLKISPNVVLIMSIGFIAFVAVLHVMGKLYFVKSK

SEQ ID NO: 18103 - protein, 473 aa, Staphylococcus epidermidis ATCC 12228
MDENKLGKTSLIGLVIGSMIGGGAFNIISDMGGQAGGLAIIIGWIITAIGMISLAFVFQNLTNERPDLDGGIYSYAQTGFGDFIGFSSAWGYWFAAFLGNVAYATLLMSAVGNFFPIFKGGNTLPSIIIASILLWGVHFLILRGVETAAFINSIVTVAKLIPIFLVIICMIVVFNFSTFKSGFYGMTSGSVGVFSWGDTMAQVKSTMLVTVWVFTGIEGAVVFSGRAKSKKDVGTATVIGLISVLVIYFLMTVLAQGVIQQNQISKLANPSMAQVLEHIVGHWGSVLVNIGLIISVLGAWLGWTLLAGELPFIVAKDGLFPKWFAKENKNKAPVNALIITNILVQLFLISMLFTDSAYQFAFSLASSAILIPYTLSAFYQVKYTIQNKSKANLKQWIIGIIASIYTIWLVYAAGLDYLLLTMLLYIPGLLVYSYVQRDNNKHLTKLDYTLFIFIIVLAIIGIVRLITGNISVF

SEQ ID NO: 18104 - protein, 381 aa, Triticum aestivum
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECKNCKMCNSGKTNLCGKVRGATGVGVMMSDRKSRFSVNGKPIYHFMGTSTFSQYTVVHDVSVAKINPQAPLDKVCLLGCGVSTGLGAVWNTAKVEAGSIVAVFGLGTVGLAVAEGAKSAGASRIIGIDIDAKKFDVAKNFGVTEFVNPKDHDKPIQQVLVDLTDGGVDYSFECIGNVSIMRAALECCHKGWGTSVVVGVAASGQEIATRPFQLVTGRVWKGTAFGGFKSRSQVPWLVEKYMNKEIKVDEYITHNMNLTDINKAFDLLHEGGCLRCVLAMEH

SEQ ID NO: 18105 - protein, 164 aa, Salmonella enterica subsp. enterica serovar Typhi str. CT18
MMRRILSVLLENESGALSRVIGLFSQRGYNIESLTVAPTDDPTLSRMTIQTVGDEKVLEQIEKQLHKLVDVLRVSELGQGAHVEREIMLVKIQASGYGREEVKRNTEIFRGQIIDVTPTLYTVQLAGTSDKLDAFLASLRDVAKIVEVARSGVVGLSRGDKVMR

SEQ ID NO: 18106 - protein, 250 aa, Coxiella burnetii RSA 493
MNETEKSTHFGYQTVPTDQKTDKVKHVFESVAAKYDLMNDLMSLGIHRWWKDFAITQCRLRTGQRILDLAGGTGDLAKRISPLVGDEGEVVIADINAAMLNVGRRRLLDQGIFRNIQFIQADAEKLPFPNNFFDRIVIGFGLRNVTNQLAALQSMHRVIKPGGFVVILEFSKPTLAPLKAVYDAYSFQLLPRLGKLVAKDEESYRYLVESIRMHPDQEALLSKMTDAGFEDCDYHNLSGGIVAVHRGYKF

SEQ ID NO: 18107 - protein, 275 aa, Sinorhizobium meliloti 1021
MVAKTELRHTESLEAIDPIWDSLREEARLAAERDPMLAAFLYSTVVNQHSLEDCVIYRICERLDHPDLQASLLHQTFAEMLEDWPEWGAVLRVDIQAVYDRDPACTRFMEPVLYFKGFHAIQTHRLAHWLWNRGRKDFALYLQSRSSSVFQTDINPAARIGRGIFLDHATGLVVGETAVIGDNVSILHGVTLGGTGKEGSDRHPKIGNGVLIGAGAKILGNIHIGHCSRVAAGSVVLKAVPPKSTVAGVPAKVVGEAGCSEPSRQMDQILASFDI

SEQ ID NO: 18108 - protein, 338 aa, Shigella boydii
MSILVTGGCGYIGIHTVYTLISQGYSVVVLDNLTNSTMEPLRRVEFMTNRSIPFYEGDVGSERLLEEIFIEHHITSIIHFAGLKSVSESILNPVEYYLNNVAQTLSLLNAMIKNNIKDLIFSSSATVYGKPENCPITESENTGGTTNPYGTSKYIMELILSDVCKAYHDLNITVLRYFNPIGAHESGNIGEHPNGVPNNLFPYLTQVAIGAHPYLNVLGSDYPTPDGTGVRDYIHVMDLAEAHVKALLRNTSCPGLKTYNLGTGKGYSVFDIIREFEVVTGVKIPYKVMPRRNGDVAECWSDSSKANKELQWTAKRDLKDMIRDAWHWQSKNPHGYDS

SEQ ID NO: 18109 - protein, 694 aa, Dehalococcoides sp. VS
MLFALYLIRDVMRRDSGTPAMQDIAGRILEGAVAFLRRQYRTIAILAIVAAVAVGAVVGLLGGERGLEAYGITGFGIAWRTALAFMAGALCSGISGIIGMYISVKSNLRCAAAAAKGGLSEAVTVAIRGGAVSGFLIVALSLLGVAGIYYMYGGNPEVTPHLIIGFGFGASFVALFAQLGGGIYTKAADMGADLVGKVEAGIPEDDPRNAAVIADLVGDNVGDCAGRGADLFESTAAENIGAMILGITLYLATGNAAWVLFPLVVRAFGILASIIGIMFVRGKDNESPMNALNRGYFTAVGLSIIGIFIANQTIGGDLWLFGAGVIGILTSVAMVFITQYYTEFRYNPVKEIANASRTGPATNIVSGTAVGLETAMPTAITIGAALLLSYWMGGQTGIAGGAVFGTAAATMGMLMTCPFILAMDTFGPITDNANGVIEMAGVGGKVRKITDHLDAVGNTTKALTKGYALASAGLAAFLLFEAYLERVAFLRGETEMMAVDLSRIEVFVGGLLAVALVFFFSAVAIKAVGKTASKIIEEVRRQFKADPGILAGTSRPDYARAVDITAAAGLREMIFPGLLPVLSPIILGIFLRVTGYDSAMAIAGFLMVGTIGGIMMAAYLNNAGGAWDNAKKYIETGEMLEKDGSPVMKHTVTHAATVVGDTVGDPFKDTAGPSIHVLIKLLSTITLVLAPLFI

SEQ ID NO: 18110 - protein, 429 aa, Mesorhizobium sp. BNC1
MTREPELKRPFRRRGRVSKAVGPVVRAAGNFCVGEICAVSRSNGDPILAEVVGFDQGEAILTPYGGTAGISHNSTIEPLMSTFEVPVGEELTGRVIDAMGKPIDAGPSVTSCAFYPGHRTAPNPMLRPTIDRPFILGVRVLDGALTCGEGQRMGIFAAAGGGKSTLVSLMVRFAEYDRCVIALIGERGREVREFLEHQLGPTGLAKSIVVVATSDRPAIEQVKAAYTATALAEFHRDRGERVLLIMDSLTRFARAQRQIGLAAGEPPTRRGFPPSVFELLPGLVERAGLSGDGSITAFYTVLVEGDDMNEPVADEVRSLLDGHIVLSRKLAEAGHYPPVDVITSTSRILSRIVSPDHLEAVHKARGLMSKLQEIELLLKIGEYSKGADALADEALARRTALDAFLRQGVNEFSSFEETVIALKRAVGHA

SEQ ID NO: 18111 - protein, 241 aa, Xanthomonas oryzae pv. oryzae KACC10331
MGIRSMPAAVPLQRIPNFQSPIPSPTMSEAKRLAAEKAIDYVEDGMIVGVGTGSTVAYFIDALGHIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDVVLTDNGNVVLDVHNLQITDPVALERSLNQIPGVVCVGLFARRPADVVIVGGEPPRVL

SEQ ID NO: 18112 - protein, 159 aa, Glycine max
MVSRVHKRTALYRSIQQLRSITNSHARRKTSVILDASKYIRGLKQKLQELNQLAVAAAQKDIEYGPVMPMLKVEPQEEGFMIKVLSQRSCQGLLAFILEAFERLGLVVLQARASCVESFCLEAFGIKESNEDTRLVDTQVVEQVVSKAINDWRKVTKQC

SEQ ID NO: 18113 - protein, 332 aa, Zea mays
MMGGFLSRVLLLAFGYAYPAYECYKTVELNKPEIAQLIFWCQYWILVALLTVLERFGDFTISWLPFYSEAKLMFFVYLWYPKTKGTTYVYGTFFKPYISQHENEIDRNLLELRARATDTVVLYFQKAASAGQSTFFDVLKYVAAQSPSQKSRQRLHRESQQPPQQQQPQVQVQQAQPQKQAAPVMRRASSIAARQAAMAQQSQETKPISSSPKIKRQTSARSGSVASTKPPVAASALKPGGSPKKGEVKPAADPVQTPTTGADSPKPEPSAPSLPGAEGVDKMAIDEASGDALEGAEELDPALEEETPMEETIRVTRAKLRRRTATEDPAGN

SEQ ID NO: 18114 - protein, 320 aa, Dehalococcoides sp. VS
MENRASEPNTRKGCGIASNITELIGNTPLVRLNKIGSGLKAEIILKLESFNPTHSAKDRPALHMIEKAEQEGKLSPGGIIIESTSGNTGIALAAVCAAKGYRLMLTMPENFSVERRRLLRLLGAELVLTPAELGMQGAIEKASELKSRLPQAFIPNQFENPANPESHYRTTAEEIWWDTDGRIDILVAGVGTGGTLSGTARGLKAAKPSIQIVAVEPAESPVISGGKPHSHLIQGIGAGFIPRILSLEMIDKVIRVPGEEAVKMALRLASEEGIMAGISSGAALWAALETAKQAENSGKLIVAIMPDSGERYLSSLPLGD

SEQ ID NO: 18115 - protein, 172 aa, Zea mays
MSSSNCPSPLPTVTKLQVDSVTFPPSVISPASSNPLFLGGAGVRGLDIQGKFVIFTVIGVYLDPVSVPSLSVKWKGKTTEELTESVPFFREIVTGSFEKFIKVTMKLPLTGQQYSEKVTENCVAIWKSLGIYTDSEAKAVERFLEVFKDETFPPGASILFALASKGSLTVAF

SEQ ID NO: 18116 - protein, 516 aa, Penicillium digitatum
MDLVPLVTGQIKCIAYYTTGLVLASIVLNVIKQLVFYNRKEPPVVFHWIPFIGSTVAYGMDPYQFFFASRAKYGNIFTFILLGKKTTVYLGVEGNEFILNGKLKDVNAEEIYGKLTTPVFGSDVVYDCPNSKLMEQKKFIKYGLSQEALESYVPLIADEISSYIKSSPSFKGQSGTIDLVPAMAEITTFTAARTLQGEEVRSKLTTEFGKLFHDLDLGFTPINFMLPWAPLPQNRKRDRAHRRMREIYVDIIQARREAGEEANDNGRDKTKGTDMISNLMRCVYRDGTPIPDKEIAHLMITLLMAGQYSSASISCWILLRLASQPEMTEKLFAEQVNNLGADLPPLQYKDLDKLPLHRNVIKETLRLHSSIHTLMRKVKNPMPVPGTDFVIPPSHTLLSSPGVTARDERHFRDPLRWDPHRWESRVEAEDSSDTVDHGYGAVSKGTRSPYLPFGAGRHRCIGEKFAYLNLGVIIATLVREFRFFNPEGMEGVPDTDYSSLFSRPMQPATVRWEVRS

SEQ ID NO: 18117 - protein, 516 aa, Penicillium digitatum
MDLVPLVTGQIKCIAYYTTGLVLASIVLNVIKQLVFYNRKEPPVVFHWIPFIGSTVAYGMDPYQFFFASRAKYGNIFTFILLGKKTTVYLGVEGNEFILNGKLKDVNAEEIYGKLTTPVFGSDVVYDCPNSKLMEQKKFIKYGLSQEALESYVPLIADEISSYIKSSPSFKGQSGTIDLVPAMAEITTFTAARTLQGEEVRSKLTTEFAKLFHDLDLGFTPINFMLPWAPLPQNRKRDRAHRRMREIYVDIIQARREAGEEANDNGRDKTKGTDMISNLMRCVYRDGTPIPDKEIAHLMITLLMAGQHSSASISCWILLRLASQPEMTEKLFAEQVNNLGADLPPLQYKDLDKLPLHRNVIKETLRLHSSIHTLMRKVKNPMPVPGTDFVIPPSHTLLSSPGVTARDDRHFRDPLRWDPHRWESRVEAEDSSDTVDYGYGAVSKGTRSPYLPFGAGRHRCIGEKFAYLNLGVIIATLVREFRFFNPEGMEGVPDTDYSSLFSRPMQPATVRWEVRS

SEQ ID NO: 18118 - protein, 662 aa, Papaver rhoeas
MASITTNLKNPLPLSSSFNSSKPLFSKSNLLSIPTKFISSRPLHITNSSYRNQSNKPKAITTETPISTTHTTSVSPPPFVSRYKDDEPRKGADVLVEALEREGVTNVFAYPGGASMEIHQALTRSSSIRNVLPRHEQGGIFSAEGYARASGLPGVCIATSGPGATNLVSGLADALLDSIPIVAVTGQVPRRMIGTDAFQETPIVEVTRSITKHNYLVLDVEDIPRVVKEAFFLATSGRPGPVLIDVPKDVQQQLVVPKWDTPMKLPGYMSRAPKSPEHNLLEQVVRLISESKKPVLYVGGGCINYSEELRRFVDLTGIPVASTLMGLGAHSCTDVLSLQMLGMHGTVYANYAVDKADLLLAFGVRFDDRVTGKIEAFASRSKIVHIDIDPAEIGKNKQPHVSICADMGVALKGLNKLLEEKMSKLKLDFVSWREELMEQKKNYPLSYKTFGEAIPPQYAIKVLDELTEGKAIISTGVGQHQMWAAQWYKYRGPRQWLTSAGLGAMGFGLPAAIGAAVAKPEAIVVDIDGDGSFMMNVQELAAVRVENLPVKILLLNNQHLGMVVQWEDRFYKANRAHTYLGNPAKDTEIFPDMLKFAEACDIPAARVTKVSELRAAIQKMLDTPGPYLLDVIVPHQEHVLPMIPAGGSFNEVIIEGDGRTKY

SEQ ID NO: 18119 - protein, 340 aa, Pyrococcus furiosus DSM 3638
MYDELFKKIKEKAKFVDEKLLSLIPEKEPKILYEAARHYPLAGGKRVRPFVVLTATEAVGGEWEKAIYPAVAIELIHNYSLVHDDIMDMDETRRGRPTVHKVWGINMAILAGDLLFSKAFEAISRAEIPPEKKARVLETVVKASNELCEGQAMDLEFEKRDTVTIEEYMRMISGKTGALFDASAKVGGIVGTDNEEYINALSTWGRNVGIAFQIWDDVLDLIADEEKLGKPVGSDIRKGKKTLIVAHFFENADEKDKQKFLKVFGKYAGDVKGEGIIEEDIKAEVMEAIDLLKKYGSIDYAANIAREMVKKANEALKVLPESEARKDLELLARFIVEREY

SEQ ID NO: 18120 - protein, 203 aa, Solanum demissum
MDILGNLYIDPLPLVIPTTTSSTTFDNNSNEKVMLLLASKIPKRRGDRKKFHETRHPVYRGVRWKNFEKWVSEVRVPAKKSRIWLGTFPNAEMAAKAHDVAVMALKGRSACLNFADSTWRLPVPASAAVKDIQKAAAEAAEAFRVSESLERENSEEVVINNDDHYVVDSGWRLVIPASAVARDIQKAVAEAFCPSESSKGEYF

SEQ ID NO: 18121 - protein, 439 aa, Salinibacter ruber DSM 13855
MQFSMEIAVIGTGYVGLVSGTCFAEMGHDVTCVDIDEEKVAQLSSGELPIYEPDLEKYFERARSEGRLHFTTDLAEGIDGAKVIFFALPTPPGEDGSADLTYVKQAAGDVADLFASGTLQGPKQRIVVNKSTVPVGTGEEVEEVFAERSLEHGTDVAVVSNPEFLREGSAVEDFMKPDRVVIGTEIEWAAEEMERLYEPFVRQGNPILTVDRRSAEMIKYAANSLLATRISFMNEIANVCERVGANVDKVRLGISKDHRIGAHFLYAGIGFGGGLLPEGREGAGPEGRGGRLRAEGAGGHPRRQRLAAAAPGDRGERALRRRPLRQEDRGVGPVLQAGDRRHTGGALPCNHPRATGRRRRGRRVRSGGDGDHPRDLRGPDRVRGGDVRGARRGRRADHLHRVARVSAAGPGQSEKSSRPADCLRRAEPVRPGPDGGDGL

SEQ ID NO: 18122 - protein, 366 aa, Vitis vinifera
MGTQILRRLLGSPNSSRAFSSFNRSFSSSDSSSNLIRATLFPGDGIGPEIAEAVKQVFRAADVPIEWEEHYVGDQIDPRTQSFLTWESLESVRQNGVGLKGPMATPIGKGHRSLNLTLRKELNLYANVRPCYSLPGYKTRYDDVDLITIRENTEGEYSGLEHQVVRGVVESLKIITRQASLRVAEYAFHYAKTHGRERVSAIHKANIMQKTDGLFLKCCREVAEKYPEIKYEEVVIDNCCMMLVKNPALFDVLVMPNLYGDIISDLCAGLIGGLGLTPSCNIGEGGIALAEAVHGSAPDIAGKNMANPTALMLSAVTMLRHLKLHDKADQIQNAILNTISEGRYRTADLGGSSTTTDFTKAICDHL

SEQ ID NO: 18123 - protein, 301 aa, Pyrococcus furiosus
MDTEKLMKAGEIAKKVREKAIKLARPGMLLLELAESIEKMIMELGGKPAFPVNLSINEIAAHYTPYKGDTTVLKEGDYLKIDVGVHIDGFIADTAVTVRVGMEEDELMEAAKEALNAAISVARAGVEIKELGKAIENEIRKRGFKPIVNLSGHKIERYKLHAGISIPNIYRPHDNYVLKEGDVFAIEPFATIGAGQVIEVPPTLIYMYVRDVPVRVAQARFLLAKIKREYGTLPFAYRWLQNDMPEGQLKLALKTLEKAGAIYGYPVLKEIRNGIVAQFEHTIIVEKDSVIVTQDMINKST

SEQ ID NO: 18124 - protein, 356 aa, Glycine max
  misc_feature (144)..(144): Xaa can be any naturally occurring amino acid
MHSKAALLSFLANKCSKIQTHTLSPMALNNGVPATGTGLIVSFGEMLIDFVPTVSGVSLAEAPGFLKAPGGAPANVAIAVSRLGGKAAFVGKLGDDEFGHMLAGILKENGVRADGITFDQGARTALAFVTLRADGEREFMFYRXNPSADMLLKPEELNLELIRSAKVFHYGSISLIVEPCRSAHLKAMEVAKEAGCLLSYDPNLRLPLWPSPEEARKQILSIWEKADLIKVSDVELEFLTGSDKIDDESALSLWHPNLKLLLVTLGEHGSRYYTENFKGSVDAFHVNTVDTTGAGDSFVGALLSKIVDDQSILEDEPRLREVLKYANACGAITTTQKGAIPALPKEEDALKLIKGA

SEQ ID NO: 18125 - protein, 242 aa, Candida albicans
SAPTFTNFSRNEERVKMNRMRLRIAERLKESQNTAASLTTFNEVDMSNLMDFRKKYKDEFIEKTGIKLGFMGAFSKASALALKEIPAVNAAIENNDTLVFKDYADISIAVATPKGLVTPVVRNAESLSILGIEKEISNLGKKARDGKLTLEDMTGGTFTISNGGVFGSLYGTPIINMPQTAVLGLHGVKERPVTVNGQIVSRPMMYLALTYDHRVVDGREAVIFLRTIKELIEDPRKMLLLE

SEQ ID NO: 18126 - protein, 337 aa, Shigella flexneri 2a str. 301
MSGFYHKHFLKLLDFTPAELNSLLQLAAKLKADKKSGKEEAKLTGKNIALIFEKDSTRTRCSFEVAAYDQGARVTYLGPSGSQIGHKESIKDTARVLGRMYDGIQYRGYGQEIVETLAEYAGVPVWNGLTNEFHPTQLLADLLTMQEHLPGKAFNEMTLVYAGDARNNMGNSMLEAAALTGLDLRLVAPQACWPEAALVTECRALAQQNGGNITLTEDVAKGVEGADFIYTDVWVSMGEAKEKWAERIALLRDYQVNSKMMQLTGNPEVKFLHCLPAFHDDQTTLGKKMAEEFGLHGGMEVTDEVFESAASIVFDQAENRMHTIKAVMVATLSKLNN

SEQ ID NO: 18127 - protein, 908 aa, Oryza sativa Japonica Group
MAVGLPIVFGCHDYSGFTNIDCGFVDGESYTDSTTNLTYVPDHEFVEGGTHHEVVPKLISGSTDEQEKTLRSFPDGQRNCYTIPSTSGKKYLIRTTFTYGNYDGLRSSENGSLFLFGLHIGVNFWTTVNLTKQDSSDTIWKEVLTVAPDEFIYVCLVNFGSGTPFISALELRQLDDPMYPFLNLFVSVSYFTRMRFGAVDDFITRYPTDLFDRFWEAAQCYSYPWLNLTTNQTVNKLPGNDNFQVPTLIVQKASTINSGFSWLNISITAGDNLNGQSLELLPIFHFAEIEKNRPNRTFQIYSDGNELHQAFSPSYLQVDSVYLRDRYLHESGTTFTLCKTNSSELPPLINAFEAYSLVRMENLTTDTIDVSSMKQVKTQYNVQRRSWNGDPCSPKEYTWEGVKCNYYDGKQNPRIILVNLSASRLSGWINPSFRNMSLEILDLSHNNLSGTIPYNQVNSLKSLNLSYNQLIGSVPDYLFKRYKAGLLELRLEGNPMCSNISESYCAMQADKAKKNTATLLIAVIVPVVAITLMLFLWMLCCKGKPKEHDDYDMYEEENPLHSDTRRFTYTELRTITNNFQSIIGNGGFGTVYHGILGNGEEVAVKVLRETSRALSKDFLPEVQTLSKVHHKNLVTFLGYCLNKKCLALVYDFMSRGNLQEVLRGGQDYSLSWEERLHIALDAAQGLEYLHESCTPAIVHRDVKTANILLDENLVAMISDFGLSRSYTPAHTHISTIAAGTVGYLDPEYHATFQLTVKADVYSFGIVLLEIITGQPSVLVDPEPVHLPNWVRQKIARGSIHDAVDSRLMHQYDATSVQSVIDLAMNCVGNVSIDRPSMTEIVIKLKECLLAGTGKKQLVSGSYKQKDAMDAGIARQFQLLISGVPIDGDGCACATHREEMINHCNGKMK

SEQ ID NO: 18128 - protein, 515 aa, Bacillus clausii KSM-K16
MQVTNHETIVVLDFGGQYNQLITRRIRDLGVYSELHSHKLTADELKEMNPIGIIFSGGPNSAYVEGSPKCDPAIYDLGIPILGICYGVQLMTHHFGGKVDKASHREYGKALLNVENQSPLFKGLPIEQTVWMSHGDKIVAPPEGFTVDASNPSCPVAAMSDESRNLYGVQFHPEVRHSEFGNDLLKNFAFDICGAKGDWSMENFIEEEIKKIREQVGDRHVLCALSGGVDSSVVAVLIHKAIGDQLTCMFIDHGLLRKGEAESVMETFTQGFNMNVVKIDASERFLTKLKGVTDPEQKRKIIGNEFIYVFDEESAKLKDKKMDFLAQGTLYTDIIESGTDTAQTIKSHHNVGGLPEDMAFELIEPLNALFKDEVRALGTELGIPDEIVWRQPFPGPGLGIRVLGEITDEKLKIVRESDAILREEIKKAGLDREIWQYFTALPNMRSVGVMGDTRTYDYTVGIRAVTSIDGMTSDWARIPWDVLEIISTRIVNEVEHVNRIVYDITSKPPSTIEWE

SEQ ID NO: 18129 - protein, 668 aa, Shewanella sp. ANA-3
MAELKEVFVPDIGGDEVQVIEICASVGDTLAAEESILTVESDKATMDIPAPFAGVLAELKVAVGDKVSEGTLIAMMQAAGTANVQAAPVAQAAAPAPAPAAPAPVQAAPAPVAAAPATGATQVVEVTVPDIGGDTDVSVIEVLVAAGDKIEVDAGLITLETDKATMDVPSPFAGVVKEVKVAVGDKVSQGSLVIMLEVGGAAPAAAAPQASASAPVAQAAPAAAVAPVAAAPVVAVKEIQVPDIGDASNVDVIEVLVSVGDMITADQGLITLETDKATMEVPAPFAGKLLSLTVKVGDKVSQGSVIATIETVTAGAAPAPQAAAPAPVAQEAAPAPVAAAPSRPPVPHHPSAGAPVATGVVHASPAVRRLAREFGVDLTQVTGSGRKGRIMKEDVQAYVKYELSRPKATAATSVAAGNGGGLQVIAAPKVDFSKFGEVEEIPLSRIQKISGPNLHRNWVTIPHVTQFDEADITEMEEFRKQQNDAAAKKKADYKITPLVFMMKAVAKTLQQFPVFNSSLSSDGESLIQKKYYHIGVAVDTPNGLVVPVVRDVDKKGIIELSRELADISIRARDGKLKSADMQGSCFTISSLGGIGGTAFTPIVNYPDVAILGVSKSEIKPKWNGKEFEPKLMLPLSLSYDHRVIDGAMAARFSVTLSGILSDIRTLIL

SEQ ID NO: 18130 - protein, 420 aa, Anabaena variabilis ATCC 29413
MTYTPTKTLADKVRADFPILREEVNGKTLVYLDNAATSQKPLFVLNALRDYYEQYNSNVHRGAHTLSAKATDAYEGARDKIAKFINAASRQEIVYTRNASEAINLVAYSWGMNNLQAGDEIILSVMEHHSNIVPWQFVAQKTGAVLKFVELTPEQTLDMEQFKQLISEKTKLVSIVHVSNTLGCINPVAEIAEITHRYGAKFLVDACQSVPHMPIDVQQIDCDWLVASGHKMCAPTGIGFLYGKLALLEAMPPFFGGGEMIAEVYLDHSTYAELPHKFEAGTPAIGEAIALGAAIDYLTDIGMDKIHAYEAELTAYLWQKLEQIPQITLYGPTPDAHGGGRAALATFTIEGIHANDLSTLLDQEGVAIRSGHHCTQPLHRHLGLAGTARASLSFYNTREEIDVFIKALKETIDFFAGIFG

SEQ ID NO: 18131 - protein, 475 aa, Shewanella sp. ANA-3
MSNEIKTQVVVLGAGPAGYSAAFRAADLGLETVIVERFSTLGGVCLNVGCIPSKALLHVAKVIEEAKAVAAHGVVFGEPTIDLDKLRSFKQKVISQLTGGLGGMSKMRKVNVVNGFGKFTGPNSLEVTAEDGTVTVVKFDQAIIAAGSRPIKLPFIPHEDPRIWDSTDALELKEVPGKLLVMGGGIIGLEMGTVYSSLGSEIDVVEMFDQVIPAADKDVVRVFTKQIKKKFNLILETKVTAVEAREDGIYVSMEGKSAPTEPVRYDAVLVAIGRTPNGKLIDAEKAGVKIDERGFINVDKQLRTNVPHIYAIGDIVGQPMLAHKGVHEGHVAAEVIAGMKHYFDPKVIPSIAYTDPEVAWVGLTEKEAKEQGIAYETATFPWAASGRAIASDCSEGMTKLIFDKDTHRVIGGAIVGVNGGELLGEIGLAIEMGCDAEDLALTIHAHPTLHESVGLAAEIYEGSITDLPNPKAKKK

SEQ ID NO: 18132 - protein, 1299 aa, Aspergillus oryzae
MTAEDICPLDDPKHGVNVESLQDQAAAFDLSFREVQPVDIRVKDLSLEVDISPPIWETAPSQIWRRLRGKTTTDARKTVLDGIDAYMPSGSLTAIIGSSGSGKTSLLNLMAGRMGMTKASVAGTTTFNGDANIESVRSAYVMQEDVLIPTLTVRETLRYSADLRLPPPTTQEERHQTVEQVIMELGLKECADTRIGTNIHKGCSGGEKRRTSIGVQMLANPSVLFCDEPTTGLDATSAFQIVRTLKRLAQKGRTVIISIHAPRSEIWSLFDNVVLLARGSVLYSGLSSRSLSYFENHGHVIPPFVNPAEFLIDLAAIDNRTEELEAASLARVDFLKTSWRTEEKTEKEVLGSRKDDEKSITRAQAIPIARAVSFSRQFRVLTSRTFKTTIRDPMGLAGSLLEAVGMGVISGWIFLQLDESQAGIRSRQGSLYTSSSLNGYLILLYETYRLTIDIRQFDRERTEGVVGVPAFLLSRRAARLPLEDLPVPIIFAVIFYFMVGYRLSVGQFFIFLALTILTHYIAITFAAVSIGIARSFPGASLVGNLSFTVQSFACGYFVQSNQIPVYVRWLKWVAYTFYIFGALCANEFIGPNGPPEGQFYDCPFSDDPNDPACTQYTGRYIMESLGFPPNWIWRPIVVLVAFVVGHYLLAGILLQYNHFAMDIAQARKSDKDTSTGVEKMAVRPAEEARKVVISLDKYALDIRKRGLFGRGSRTLSILKPITAEFRPGNLNVIMGPSGSGKTSLLNSVARRLHGSLSTQYRVHGDMLYNGAVPSESVIRSVTSFVTQDDDALMPSLTVRESLRFAAGLRLPLWMSREEKNRRAEEVLLKMGLKECADNLIGSELIKGISGGEKRRVTIAIQILTDPKVLLLDEPTSGLDAFTAMSIIEVLKGLAEEGRTLVMTIHQARSDLFQHFSSVLLLARGGYPVYAGDGATMLSHFGALGYHCPQTTNPADFVLDLITVDLQQVDREAVTRERVQKLILSWDDKTFDLGRQTSHIATPAELGSLKRQMLPFRITYPLVLRRSAINFWRQPPLVMARSMQVVGIGIIMALFFAPLKNDYAAVQSRMGFIQEFGALYFVGALTKNRAGMLQNIAIYPNERDVFYREEADHCYSAETFILQYTTLEVPFEILSSLIFGVLAAYADNLGRSATMFLITAYNCFCIVSCGESLGIMFCTLFSHVGFAVNVTSILLSIANILGGVMSLNVNEVLQGLNHLSPVKYAVANLAPYAMRDQEFVCTAAQRLADGSCPIQNGQQVLRLYNLDKNGAINVMALGVCTIIYRVVAYGLVKAMRWERK

SEQ ID NO: 18133 - protein, 469 aa, Coprinopsis cinerea okayama7#130
MYHAQSFAENGFMTELVGYGGSDVIPALERLPRVQIRHLPDPPWILKKLPFVVAAPFKILHQLTAILLILLVYIEKPPEFLLVQNPPSIPTLAIVQLVARIRGSKVIIDWHNLGYSILALRLGQNHIFVRISEWFERTFGQSAYAHLFVTRAMRDHLVKEWDLRGHKVVLHDRPPRHFHRSSPQETHELFQRLRPLLAFHKPLRGFLPKDDPPYSTPFTEIGVRQTSRSPNRASTQGRVQIVSRPTSPGVNALGDYTEIRAPSLRPDRPALLVSSTSWTPDEDFGILLQALSIYELRAREVNKEASKGTTLPKVLAIVTGKGPLKDRYMKEVSALQESWQWVRCISLWLEAEDYPILLGSADLGVSLHSSSSALDLPMKVVDMFGCGLPVCALGFSCAPELAEQLEVDVLFVRIPLVSADICPAPGPIHFIPPSQKSSCAESFSGKYGNTPFNAECPRLEKVQNIYTRR

SEQ ID NO: 18134 - protein, 1224 aa, Ustilago maydis 521
MLATTARPQGARPMPSSSGSGGSGSGGGGGGGAGGAGGVGVGGAMAYYAAAAQPYSAPATKEAAWYEYEERMRPSYIQQPASSPLASSAHYNQPYTTRAQPPVSPSAYASNAYVQYASSSYSQQPSAYQHPPVQHALPSYPSSTKPPHSLYQTPQYTPQYQQPPQSPLRYNQATPSSSRPPPASSAKYANPHLNSAPSRFATNPSYPEPQEIPRSTVQGSAFMHKGFWDILSLVNNQGQGPSSNRLAPPSTSQRPSSPGKFRSTLSKASCALRKNTQDNFQAGPEYDPAAVFPANASPRAPGSPVKDASTSALPGAYPRPLFAAPLTHTANASAISAAMNFFTPAAIGPRAQKKRISIDMVGAPQTQTFVHAAHASDAEQAEVILNRWSRDGVGKVADPLWVEPIKHALRLQAARNQAEAIAQVQAAMHQDSLIQDNPRQLHIVNGAPSQISMLTTTTATAGHSTLSNATIRPGVNAPALSPTRERGAFAGIVEEPAVGMDGELEAAIHAHLQLSSPSPQPFARPAALRTNTAGTLLVNPSPPVARDADARAPDYMMYRPPSPNASNRNSRNIDGLPSGAPNGISAMFEAPAHNDDLQAPTSIPERPNSMVVLDSLRSVDTAGMTALVDLTQPIGAAVRPSLETVEKSVAAKIFFENLYYGILKKPKARDTRRAGLEAELASLRIPESSKNQIREAWMANETQYLRDLRARVNVNSFLKLKTIGHGAFGVVALCKERQSGQLYAMKQLRKADMLRKGQEGHVRAERDLMTSASASATAKWIVKLIYSFQDVDHLYLIMEFMGGGDLLNLLIEKDIFEEDFARFYVAEMVLAIHEAHSFGYIHRDIKPDNFLYTSDGHIKLADFGLCQSFHWAHDGAYYDQQRKNLLKKHGIDLDDSHAAAGMRRAAQATGRRGGAPGQAGAGLSDKELIEIMSDRNADGTPKTHVLTWREKNKKKIAYSVVGTNNYMAPEVLRGLGYDQACDWWSLGVIVFEMLYGYPPFVSKSRHLTRQKILNWKQTLRFPTKPRISREGQDFIARLVCEREDRLGSTASASVSRPNSYLQSARRSGFGNQGQSNTGSALQDGVEELMSHPWFRGIDWENLHRTRPPFRPALSHPGDTKHFEDDIEDEPLAAPGAANNPNADQPRDPMLRDQEQGPKLLEMRKQLAFMGYTFKSPKAFDPREQLADERNVIAVERAAGMTPAQERGRGREPTELGSRIRSMSM

SEQ ID NO: 18135 - protein, 377 aa, Streptomyces avermitilis MA-4680
MTPLPDYFCPADGTRVPGGSLDWCCPACRGPLDLDFAPTPGPLKSLGGRVNSLWRYAECLPLAAPTTSLGEGRTPLVSLTDGVAAKLDFLMPTLSFKDRGAVLLAELALQLRPRQVVADSSGNAGTAIAAYCARAALPCTVYVPEGTSAKKLEQIEAHGARLRVVEGDREATAHAAREAADEAGVFYASHVFNPYFLHGTKTYVHELWEDLGGRLPDALVVPVGNGTLLLGAALAVAELHAAGLIDRRPALYAVQAAAVAPLAHAWEQGADDLVGVTPAAPTFAEGIAIPRPPRARQILRAVRESGGAFLTVTEDQIRHAQSDLASRGLYVESTGVACWAAVRAGALPQPRPRPGEGMPAAVVPLCGAGLKTGPARA

SEQ ID NO: 18136 - protein, 550 aa, Pantoea agglomerans
MSTFTVGDYLLTRLQEIGIKHLFGVPGDYNLQFLDRVIAHPEISWVGCANELNAAYAADGYARCNGAGALLTTFGVGELSAINGTAGSYAEYLPVIHIVGAPATQAQLQGDCVHHSLGDGDFQHFIRMAAEVSVATALLTADNATAEIDRVIISALQARRPGYLSLAVDVAAMAVQPPAQPLNTHQPASADARRAFRAAAERLLAPAQRVSLLADFLALRWQQQSALAALREQSAIPCASLLMGKGVLDEQQPGYVGTYAGAASAGQVCEQIEQVDAAICVGVRFTDTITAGFTQQFATERLIDLQPFSASVGNERFAPLSMADALSELQPLFEHYGQQWQPAAAIPAAQPAEPTAVISQHAFWQAMQGFLQPGDLILAEQGTAAFGAAALRLPSRAQLVVQPLWGSIGYTLPAAFGAQTANPDRRVILIIGDGSAQLTIQELGSMLRDGQRLIIFLLNNDGYTVERAIHGATQRYNDIAPWNWTALPHALSLQGQAQSWRISETVQLDEVMTRLAAPQWLSLVEVVMLKDDLPPLLRKVTACLNQRNGG

SEQ ID NO: 18137 - protein, 219 aa, Coprinopsis cinerea okayama7#130
MFIQTESTPNEDSLKFIPGVPVMEEGSAEFLDTRSALASPLALRLMGIEGITGVFYGPDFVTVSKSSDHPWAVVKPEVYALLMEFFSSGQPLFRSEEDREAAGPQDTRILDTDSETVAMIKELLETRVRPAIMEDGGDIEYRGFDENDGIVRVKLKGSCRGCESSSVTLKSGIERMLMHYVPEVKGVEQILDEEEQIALDEFEKLEKRLAEKEGKKDSP

SEQ ID NO: 18138 - protein, 564 aa, Candida glabrata CBS 138
MSEITLGRYLFERLNQVDVKTIFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMVTDIATAPAEIDRCIRTTYITQRPVYLGLPANLVDLKVPAKLLETPIDLSLKPNDPEAETEVVDTVLELIKAAKNPVILADACASRHDVKAETKKLIDATQFPSFVTPMGKGSIDEQHPRFGGVYVGTLSRPEVKEAVESADLILSVGALLSDFNTGSFSYSYKTKNIVEFHSDYIKIRNATFPGVQMKFALQKLLNAVPEAIKGYKPVPVPARVPENKSCDPATPLKQEWMWNQVSKFLQEGDVVITETGTSAFGINQTPFPNNAYGISQVLWGSIGFTTGACLGAAFAAEEIDPKKRVILFIGDGSLQLTVQEISTMIRWGLKPYLFVLNNDGYTIERLIHGEKAGYNDIQNWDHLALLPTFGAKDYENHRVATTGEWDKLTQDKEFNKNSKIRMIEVMLPVMDAPTSLIEQAKLTASINAKQE

SEQ ID NO: 18139 - protein, 183 aa, Triticum aestivum
  misc_feature (159)..(159): Xaa can be any naturally occurring amino acid
MGKGRSCRYGSERLLYPVQASGHHVAGAADHLADLDEEDVWSVLAAPAPDSNRSTGSARQPEQDRRGRWTAGGLSLAFEATASTPAGRHHHHVASSAPVRVPEWPAARFPAVSGGEQHGYGVSCREEEGEWMAPHEYLQAQARSSGRGTAAPSVFEGVXGRTLKGRDLSRVRDAVWSNTGFFG

SEQ ID NO: 18140 - protein, 299 aa, Propionibacterium freudenreichii subsp. shermanii
MNSPVDPTSTPAWAELENLHRSLDVDFRKWFAEEPNRAQQFTLRAGDLTVDLSRNYLNQQVRDTLVSLAAQVDLAGRRDAMFRGDRINTTEDRSVLHVALRLPKGAELDVDGVNVVDQVHEVLDREISFTEAVRSGERGGVTGKPITTVVNIGIGGSDLGPVMVYEALKPYKHDRIECRFISNIDPADMYEKTHDLDAETTLFIVASKTFTTLETMTNARMAKNWLINSLQSSGAIDGTADSRARAIKRHFVAVSTNAEKVSEFGIDHANMFGFWDWVGGRYSVDSAVGLSALIAIGPD

SEQ ID NO: 18141 - protein, 275 aa, Triticum aestivum
MLYKGTLSSGVEIAVVSSLISSKNDWSKECESQYRKKISSLSKVGHKNFINLLGYCEEENPFTRAMVFEYAPNGTLFEHLHVREAENLDWMARLRISMGIAYCLEQMHKLNPPVVPRSFSSTTIHLTDDFAAKVSDLDFWNGTKGSDSVTDGCTMLDTESIVHQYGIILLEILTGRVPFPEQDLPLEQLASIYFEGKMPLAELMDSSLGSFPEETARALCDVARSCIDPDPSKRPRMAQVAAQMKEITAVGPEGATPKVSPLWWAELEIMSAEAT

SEQ ID NO: 18142 - protein, 404 aa, Buchnera aphidicola str. Bp (Baizongia pistaciae)
MKFPIYLDYAATTPVEFEVMKEMMNYLTLEGEFGNPASRSHKFGWKAEEAVDIARNQIAELIHADSREIIFTSGATESNNLAIKGIAEFYKKKGNHIITCSTEHKATLDTCRYLENKGFDITYLNPLQNGTINIYELQEKIQKNTILVSIMHVNNEIGVIQDIHKISKICQSNNILFHVDAAQSIGKININLKQLKIDLMSFSAHKIYGPKGIGGLYIRRKPRVRLSAQIHGGGHEKGMRSGTLPVHQIVGMGIAYKIAKIKINSDFNYIKHLRNRLWNGIKNIEEIHLNSNFENTVPHILNVSFNYVEGESLIMALKNLAVSSGSACTSSSLEASYVLRSLGLKDELAHSSIRFSLGRFTTKEEIDYTIQLIHQSINRLRNLSPLWEMFKSGVDMNNVNWTHN

SEQ ID NO: 18143 - protein, 341 aa, Mycobacterium avium 104
MAAQMREPKVVVLGGGSWGTTVASICARRGPTLQWVRSRETADDINENHRNSRYLGNDVVLSDTLRATTDFCEAANTADVVVMGVPSHGFRGVLTELARELRPWVPVVSLVKGLEQGTNMRMSQIVEEVLPGHPAGILAGPNIAREVAEGYAAAAVLAMPDQHLATRLSGLFRTRRFRVYTTDDVVGAEMAGALKNVFAIAVGMGYSLGIGENTRALVIARALREMTKLGVAMGGSPDTFPGLAGLGDLIVTCTSQRSRNRHVGEQLGAGKPIDEIIASMNQVAEGVKAASVIMEFANEFGLTMPIAREVDAVINHGSTVEQAYRGLIAEVPGHEVHGSGF

SEQ ID NO: 18144 - protein, 327 aa, Propionibacterium freudenreichii subsp. shermanii
NGFGRIGRNFFRAMVDQKADLDIVAVNDLTDTKTLAHLLKYDSILGRFPGEITYDDNSITVDGHKIQVCEERDPANLPWKDLGVEVVVESTGLFTDGEKAKAHIAAGAKKVIISAPAKNVDATFVIGVNEQEYDTSKHNIISNASCTTNCLAPLAKVFEDEFGIERGVMTTIHAYTGDQRLLDAPHKDLRRARAAAINLIPTKTGAAQAVALVIPALKGKFDGLAVRVPVPTGSLTDLSFIPGREVTVEEINAAVKKAAEGPLKGILAYTEDPIVSTDIVTDPHSSIFDASETKVIGNLVKVLSWYDNEWGYSNRLVDITELVADKL

SEQ ID NO: 18145 - protein, 126 aa, Buchnera aphidicola str. Bp (Baizongia pistaciae)
MAYSKKVIDHYENPRNVGSFKTIDANVGSGLVGAPACGDVMKLQIKVNKNGIIQDACFKTYGCGSAIASSSLVTEWIKGKSLIEAENIKNTNIAEELDLPPVKIHCSILAEDAIKAAITDYKNKNK

SEQ ID NO: 18146 - protein, 496 aa, Coccidioides immitis RS
MATTNDAILSPQPSKPEENTPSKTEERIQELENTGKSRWERSWPIIACGAGLFSDGYLNNIIGSVNTVLRTLYPEAYANSTAVKNVPSIAFAGTVVGQLIFGYLSDHYSRKWSLMISTVLLIVFAALSAGSYGAGGSQSGLFAALTAYRFFLGVGIGGEYPAGSVAAAESSGELKRGHRNRWFIMFTNFQIDFGFVVSAFVPMILVLIFTENHLRAAWRVMLGLGVIPPLSLFYLRLKLKEPEEFNRERMHKYPIWLIAKFYWWRLSLVSLIWFIYDFSAYSFGIYSSVWLKIVLADTAPMWKAFGWNTLINVFYIPGSALGAWVSDWIGPRYCLALGVASQGVIGFIMAGCYKWLATSENVAAFVVVYGLFLSCGELGPGDNIGLVASKSSATAIRGQYYGIAAALGKVGAFVGTYVFPIIQNNAPNEIRAGQDPFFVSSALCLFSAALSAFLLPHIGQDTITYEDIRFRRYLEENGYDTSTMGNRKQERTEEKA

SEQ ID NO: 18147 - protein, 495 aa, Escherichia coli
SYYHHHHHHLESTSLYKKAGLMQHKLLINGELVSGEGEKQPVYNPATGDVLLEIAEASAEQVDAAVRAADAAFAEWGQTTPKVRAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVVNILFGRGKTVGDPLTGHPKVRMVSLTGSIATGEHIISHTASSIKRTHMELGGKAPVIVFDDADIEAVVEGVRTFGYYNAGQDCTAACRIYAQKGIYDTLVEKLGAAVATLKSGAPDDESTELGPLSSLAHLERVGKAVEEAKATGHIKVITGGEKRKGNGYYYAPTLLAGALQDDAIVQKEVFGPVVSVTPFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 18148 - protein, 110 aa, Triticum aestivum
GASHSITRPTRRRRRLGSHPTAHPWRRRAAAAEEEGRCRSRFSVPEAAPFTAVLKFAAEEFKVPPQTSAIITNDGVGINPQQSAGNVFLKHGSELRLIPRDRVGATAASF

SEQ ID NO: 18149 - protein, 458 aa, Staphylococcus epidermidis ATCC 12228
MGEIGMNDTDRTHKENKLEQDITLPYLKKAVIFSITFGFFGVNMAFALQSAMMGRIFQTLGANPNNLGWFFILPPLVGMIVQPLIGYYSDRTWTRFGRRMPYLLIAGPIGAIVLVLLPNAGSFGFGYASLMALSFGAVMTLLMDLTSNACMQPYKMIIGDMVNEKQRDMAWSWQQIFSNLGGIIATVLPFLLTMLGISNVAPKGEVPMTVKLAYYIAAAVLLIASIWTVISVREYEPKTYNYYHGINENNRNNKLNLLQLLKKAPKQFWQISVVQFFNWFALMYLWTYSTGAIAKNVWNVTDPSSAGYQAAGNWYGVLYCIQFLSSVIFGFVIARSKPSQRKFWYSFGLVFGGIGLISIFFIHNQWLLIFSFVLIGINNLTMNTQPFTLLTEAIDGENSGAYLGLFNTSICLPQIVASIVSFGLYPLLGSSMPAMLLLAGIMMLLGAVSVKFINAKFE

SEQ ID NO: 18150 - protein, 344 aa, Vitis vinifera
MAVTRTVTVKNGNDSLDICRVLNGMWQTSGGWGRIDRNDAVEAMLRYADAGLSTFDMADHYGPAEDLYGIFINRVRRERPPEFVDKVRGLTKWVPPPVKMTSNFVRESINVSRKRMDVAALDMLQFHWWDYSNTGYLDALKHLTDLKEEGKIKTVALTNFDTERLQIILENEIPVVSNQVQHSIVDMRPQQKMAELCQLTGVKLITYGTVMGGLLSEKFLDTNIAIPFSAPPLNTPSLQKYKRMVDAWGGWSLFQTLLRTLKTVATKHGVSIPTVAVKYVLDQPAVAGSMVGVRLGLSEHINDSNAVFSLVLDEDDVNSIQEVLKKGKDLLRVIGDCGDEYRRA

SEQ ID NO: 18151 - protein, 493 aa, Salinibacter ruber DSM 13855
MSLPQFLFVCTTTPTTTRHPMEETEEYLPSASNSITVRVVISNRPGMLAKVTSVIGEHGGNIGAIDIVRAEKDELTRDITINTRSDDHAESIVQALRDLDGVEVVNISDRTFLLHLGGKVEVESKSPLRTRDQLSMAYTPGVARVCEAIHETPEDTHRLTIKSNTVAVVSDGTAVLGLGDIGSGAALPVMEGKAQLLKEFANVNGFPICLDTTDVDEIVNTVRRIAPVFGGINLEDIAAPRCFAVEERLKDELDIPVFHDDQHGTAVVTAAALLNALKIVEKDLDEIKVVTVGIGAAGTAVTEMFMEMGVENIVGVDSHGPVTPERDDLNDAKRQYAEMTDPSVTGDTLSAVMEGADVFIGLSVPDILDVEDLNRMARDPIVFAMANPRPEIMPEVAYPHVAVMATGRSDYPNQINNVLCFPGLFKGALDCRAKGITSEMKIAAAEAIANAIDDQSLTPDYIIPSVFDENVVAQVSSAVSQTAQKQGLARKRT

SEQ ID NO: 18152 - protein, 192 aa, Brassica napus
MSPDKNLLSKLAVGDKHGEDSPYFDGWKAYDTNPFHPEHNPQGVIQMGLAENQLCSDLIKEWIKANPQASICTAEGIDGFSDIAVFQDYHGLKQFRQAIAAFMEKARGGRVRFEEERVVMSGGATGANETLMFCLADRGDAFLVPTPYYAAFDRDLSWRTGVRIIPVECNSSNNFQVTKQALESAYLNAQET

SEQ ID NO: 18153 - protein, 477 aa, Oryza sativa
MGISKGGSGKEAKKPPLLLGRFEVGKLLGQGNFAKVYHARNVATGEEVAIKVMEKEKIFKSGLTAHIKREIAVLRRVRHPHIVQLYEVMATKLRIYFVMEYVRGGELFARVARGRLPEADARRYFQQLVSAVAFCHARGVFHRDIKPENLLVDDAGDLKVSDFGLSAVADGMRRDGLFHTFCGTPAYVAPEVLSRRGYDAAGADLWSCGVVLFVLMAGYLPFQDRNLAGMYRKIHKGDFRCPKWFSPELIRLLRGVLVTNPQRRATAEGIMENEWFKIGFRRFSFRVEDDRTFTCFELDDDAAVDAPTSPPDTPRTVDSGDVGAAPTRPRKAGSLTSCDSAPLNAFDIISFSPGFDLSGLIPEQQKHTARFVSAAPVEVIVATLEAAAAAAGMAVREREDGSISMEGTREGEHGALAVAAEIYELTPELVVVEVRRKAGGAAEYEEFFRARLKPSLRELVCDDRPCPEDSGELSRSL

SEQ ID NO: 18154 - protein, 531 aa, Vitis vinifera
MADIQGSPGSSMHGVTGREQTFAFSVASPAIPTDTTAKFALPVDSEHKAKVFKVFSFAKPHMRTFHLSWVSFFTCFVSTFAAAPLVPVIRDNLNLRKSDIGNAGIASVSGSIFSRLVMGAVCDLLGPRYGCAFLMMLSAPAVFCMSFVSSAEGYIAVRFMIGFSLATFVSCQYWMSTMFNSQIIGLVNGTAAGWGNMGGGATQLLMPVIFEIICRVGVTPFMAWRVAFFIPGCLHVIMGILVLSLGQDLPDGNLGTLQKKGDVSKDKFSKVLWYAITNYRTWIFVLLYGFSLGVELTADNVIAEYFYDRFDLKLHTAGTIAATFGMANIVARPMGGLMSDLAARRFGMRGRLWNLWILQTLGGVFCICLGRANSLPISISSMILFSIGAQAACGATFGIIPFISRRSLGIISGLTGAGGNFGSGLTQWLFFTSSKYSTATGISLMGIMIVACTLPVALVHFPQWGSMLLPPSKDAVRSCEEYYYGSEWNEAEKQKGLHQGSLKFAENSKSERGRRVVSAPTPPTATPPASV

SEQ ID NO: 18155 - protein, 125 aa, Zea mays
IGGGKLDPTVPLSEQEDLIVWMRTSALPKFRKLYGVIEDDLHADETIAIFVGNNYNTYTFGGKKSIVLSTASWLGGKNDFLGHAYIVTGSLSIIISILFALIHVKYPRPQGDPNCLSWNRKNSNS

SEQ ID NO: 18156 - protein, 372 aa, Yersinia pestis KIM
MELPMNQSYLWATLLTLAVLCINKSIFNRRFRDCVMKTLGEFIVEKQLDFSHATGELTALLSAIKLGAKIIHRDINKAGLVDILGASGVSNIQGEDQMKLDLFANEKLKAALKARGEVAGIASEEEDDIVIFDGGRAENAKYVVLMDPLDGSSNIDVNVSVGTIFSIYRRITPFGTPITEEDFLQPGTKQVTAGYVVYGSSTMLVYTTGYGVHAFTYDPSLGVFCLSHEKVRYPATGCMYSINEGNYIKFPLGVKKYIKYCQEQDEATKRPYTSRYIGSLVADFHRNLLKGGIYIYPSTASHPQGKLRLLYECNPMAFLAEQAGGKATDGVNRILDIVPEKLHQRAPFFVGTKSMVEDAEGFIAKFPDEEAK

SEQ ID NO: 18157 - protein, 167 aa, Oryza sativa Japonica Group
MASSRASASCALFLALNLLLFAITTACPSCGSGGGGGHGHYGGGGSSGGGGGYGGGSGGYGGGGSSGGGYGGGGGSSTSGWYGKCPTDALKLGVCANVLDLIKAKAGVPATEPCCPLLNGLVDLEAAVCLCTAIKANVLGINLNLPIHLSLILNFCGKGVPTGFMCS

SEQ ID NO: 18158 - protein, 152 aa, Coprinopsis cinerea okayama7#130
MASISARRLGKELREIQEQGCPVGIELVKADDFATWWFTIEVMGESLYQGEKYTLQFRFDSQYPISSPAVQFVVTDGREAPIHPHVYSNGHICASILGNEWSPVLSVIAVCVTLQSMLASCKKKERPADNDRYVRHAPDNPKKTRFHYDDDT

SEQ ID NO: 18159 - protein, 267 aa, Shewanella sp. ANA-3
MDGLTGKVVIITGASEGIGRALAIAMARVGCQLVLSARNETRLASLALEIANYGPTPFVFAADVSSASQCEALIQATIAHYGRLDILVNNAGMTMWSRFDELNQLSVLEDIMRVNYLGPAYLTHAALPYLKSSQGQVVVVASVAGLTGVPTRSGYAASKHAVIGFFDSLRIELADDNVAVTVICPDFVVSQIHKRALNGEGKPLGKSPMQEAKIITAEQCANMMLPVIATRGRQLITSLRGRLGRWLKLIAPGLIDKIARKAIASGH

SEQ ID NO: 18160 - protein, 475 aa, Trichodesmium erythraeum IMS101
MENIKYLRTWLRISRQPQYRWLWFVAAALIYLGILLFPMAGVEKEAKGALAVFGVTAFLWATNTLPVAVTGLMVLFLIPLSGSMSATDTYAYFGNKAVFFVLGAFILASPIQRSGLSTRLALTVVSRFGNSQNTLIASILILSALMSFVISSYAVTAMLFPVVIEVVQAAGAKSGGRFGLAAFLALGWGCGIGGIATLLGGARAPLALGVLRSTTKGEYDITFVEWFLWSVPLVVLMLIVAYLVLLQIGKGIVVSLSSARKFLEVRSQSLGTISSREIGTLALVTGIVLLWVFKGKAWGLDTIAFFGVMCSFVCGLATWQEVEEDVNWGIFLMYGSAIALSAVLRDTGAAQALAENLLGSWINSGFVCFVAMVLIITFLTEGMSNAAAVAVLMPVGLALAAKYGIDPRAMTLGITLPSGLAFLLPVSTPVMAIIMGSGYVSPAEAFKRGLLLKLVGTLIFLAMAKFYWPLFGWGV

SEQ ID NO: 18161 - protein, 421 aa, Aspergillus oryzae
MASQAQAQAQAQAQAQAQRPKVQPCRYKTGKTLGAGSYSVVKECVHIDTGRYYAAKVINKRLMAGREHMVWVSTRKSPGRYTVAGDVRNEIAILKKVSMGHQNILTLVDYFETMNNLYLVTDLALGGELFDRICRKGSYFESDAADLIRAILSAVAYLHDHGIVHRDLKPENLLFRTPEDNADLLIADFGLSRIMDEEQFHVLTTTCGTPGYMAPEIFKKSGHGKPVDIWAIGVITYFLLCGYTPFDRDSNLEEMQAILAADYSFTPLEYWRGVSQHARDFIKRCLTVDPEARMTAHEALQHLWVNPPYDPYADQSGQDLLPTVKKNFNARRTLHKAIDTVRAINKLREGGGLMMDGVMSVDPKPERVNGNHVVEETSHHDGQMDLDSRSDARGQTEEQIRAQEQRVKQMVAGLWSRNAKK

SEQ ID NO: 18162 - protein, 575 aa, Coprinopsis cinerea okayama7#130
MAVLSHSFLVLLRALGLAIGLVLLRGVVWLANMLLWAPLFDPLQKLPGPTGAFFESHLAQASNPQDSPDSYEEWRRAHGDTVRFHGFGKHDYRLLSFDFRAITHVLTSPVYEKPWQTRYYLSKLIGRGIFSTEGHEHKMQRKLISPAFSSQVVKNLSPIFLDKAEQLCDIWDGEISAQGVDSGKTVLNVAHWLSRTTFDIIGLGGFDYSFNSLEDESEPIHMAFRRMFRTTDNGIGLRDIVEMYFPIINSLWPDEAYKTVRESRQLIGEAGERIISQKRERILAEGKDFSSKDILSLLIKANMSTDPSSQLSDKDLLDQCTTFLLAGSDSSSVAMSWCLHLLATHPDVQNQLYDEVCTAAKASKVYDEYDSDHSDDSGFAEEPQLRSQAATSRARTAFLDAIESLPYLNGVVKETLRLYPPVHSTIRVATVDDEIPLSKPMTMPDGSKASSVKIAKGSYVHIPIEGVNNAEDIWGSDVNEFKPTRWIKLPAAVTSNFPGLGNLMTFGYGPSSCVGSKFTVSELKIIIATLVSRFEFTPAEGAKINKYNCIITRPYIEGRWAEGTQLPVQVQRRCP

SEQ ID NO: 18163 - protein, 365 aa, Chlamydophila abortus S26/3
MITEVRIPNVAESISEVTIASLLVTSESLVQENQGIMEIESEKVNQLIYAPISGRIVWSVAEGDVVAVGGIVARIYDANESVSESTVKDTPVGETVDAEIICFPRSTAHNPPSEGKTFVPLREKMQEEPQRSGAKNEVRERMSSIRKTISRRLVTALHESAMLTTFNEIHMTPLMKLRKEKQEAFSARYNVKLGLMSFFIKAVIEALKAYPRVNAYIDGDEIVYRQYYDISIAVGTERGLVVPVIREADKLSSGDIEMKLADLASRARDGLISLPELEGGSFTITNGGVYGSLLSTPIINPPQVGILGMHKIEKRPVVIDNTIAIADMMYVAFSYDHRIIDGKEAVGFLIKIKDAIEQPEQLLDF

SEQ ID NO: 18164 - protein, 276 aa, Streptomyces avermitilis MA-4680
MTPRLSGKTAVITGAARGLGRATAVAFAREGADLMLLDLAADLPGVPYPLGSESQLAHTAELCREQGVAASTARLDVRDLDAVEAAMATTRERFGRIDVLVNNAGIAAPSGKAAHEIDEREWQLMIDVDLSGAWRTIRAVGGHMAEQRSGSIINIASTAGLVGYRHFAGYVAAKHGLVGLTKAVALDYAPLKVRVNALCPGSVRDDSQVEGRMLSEIARCLDVPVAEHEETFVQAQPMNSLIEPEDIASAAVWLASDESRQVTGSVLAVDGGFTAR

SEQ ID NO: 18165 - protein, 331 aa, Triticum aestivum
MTTHERKTVDLEEGWAFMQKGITKLKNILEGKPEPQFSSEDYMMLYTTIYNMCTQKPPHDYSQQLYDKYRESFEEYISSMVLPSLREKHDEFMLRELVKRWSNHKVMVRWLSRFFHYLDRYFISRRSLPALREVGLSCFRDLVYQEIKGKVKSAVISLIDQEREGEQIDRALLKNVLDIFVEIGLGSMECYENDFEDFLLKDTADYYSIKAQTWIVEDSCPDYMLKAEECLKREKERVAHYLHSSSEPKLLEKVQHELFTQYASQLLEKEHSGCHALLRDDKVEDLSRMYRLFSRITRGLEPVSQIFKQHVTNEGTALVKQAEDAASNKKP

SEQ ID NO: 18166 - protein, 353 aa, Ralstonia metallidurans CH34
MKAAVYYGPQDIRCTDIPDPVIRSDHEMLVKVTATSICGSDLHLYRGALDGIMEKGKSQTGHELIGEVVEVGKSVGRFKQGDRVSMGYSVSCGHCYMCEVGQTAHCETTKNAVYGFGIPFGSINGTHAEALIVPHADGHAMNVPKGIPDEAAVTLSCNLPSAIIANRLADIQVGENVALVGCGPTGMMTLDIALHRGPGRVVVLDKVAHRLDVVRKKGGVAIDANQEDWKEKALAETGGRGFDKVIEVVGYPETLQMCLDLVRPGGTVAAIGVFCDSTFNLNLADVFLRNISLHMNGFANAQPYMWEALRLMERGVINPQEYFSHAFELADVDKAFSVFHQKSDSAMKVLIRP

SEQ ID NO: 18167 - protein, 506 aa, Corynebacterium glutamicum
MADPQGFIKYSRREPAHRPVPLRLMDYSEVYEKAPAGQIEEQAARCMDCGVPFCHEGCPLGNIIPEWNDLVRQGRWKEAYDRLHATNNFPEFTGRLCPAPCEGACVLGINDDSVTIKNVELEIVEKAFREGWVQPVVASMSTGLSVAVVGSGPAGLAAAQQLTRAGHSVTVFERDDRLGGLMRYGVPEYKMENRWIDRRIEQMEAEGTTFQVGTSPRAAELALFDAILLATGTPVARELSVPGHDLNGIHAAMDYLTAQNRINEGDGEVSPINAKGKKVVIIGGGDTGTDCFGTALRQGAESVTQFDIRPRAPFQRADSTPWPMYPNLFRTATAHEEGEYIITGDESADEIAALGLAERAAGSTLGERKFAVNTVEFHGNNGHVTGLTGNQIRVVNGKREPIEGTEFPFEADLVLVALGFTGAEQGGLAHELGVGFDDRGRILRDSEYRSPTNSRVYIAGDNGRGQSLIVWAIAEGRACAAAIDADLMGETALPVAVAPQDVPLAV

SEQ ID NO: 18168 - protein, 233 aa, Trichodesmium erythraeum IMS101
MTDDSIEVKAIFNKIAPVYDQLNDLLSLGIHKVWKQMAVRWSEPDYGSTCLDLCCGSGDLAYMLAKHVGNTGHVFGVDFSREQLAIARNREPPLLNKISPIHWVEANALSLPFPHNYFDCATMGYGLRNVSNIPLCLQELYRVLKPNAKAAILDMHCPSSSTIRWFQKWYLDTVVVPVASNLGLTKEYAYISPSLTKFLTGKDQVALAYKLGFVNAKHYPIIGGMMGILVITK

SEQ ID NO: 18169 - protein, 362 aa, Streptomyces avermitilis MA-4680
MSLTIGIVGLPNVGKSTMFNALTKNDVLAANYPFATIEPNVGVVGVPDARLAKLAEIFGSQKILPATVDFVDIAGIVRGASEGEGLGNKFLANIRESDAICQVIRAFHDENVVHVDGKVSPKDDIETINTELILADLQTIEKVLPRLQRESRIKKDIGPKVAAVEAAQAILEKGETLFSAGIVQGSGNEELLHDLHLLTTKPFLYVFNVDEDELVDDDFKAEQRALVAPAEAIFLNAKLEADLAELDEEEAMELLESVGVEEPGMATLARVGFNTLGLQTYLTAGPKESRAWTIKKGATAPEAAGVIHTDFQKGFIKAEVISFEDLVETGSVAEARAKGKARMEGKDYVMQDGDVVEFRFNV

SEQ ID NO: 18170 - protein, 316 aa, Magnaporthe grisea 70-15
MLMEFLPGGDLMTMLIKYQVFSEDITRFFMAEVIEAIEAVHRLGFIHRDIKPDNILLDRHGHIKLTDFGLSTGFRKLHDTNYYQRLLKAPELPKPIAKPIDHRHRDSVNIDQINMTVSNRDQINEWRRSRRTMAFSAVGTPDYIAPELVMGLGYSFSIDWWSLGAIMYECLIGWAPFCSEDATDAYRKIVHWRDSLQFPEDFQLTYNAENLIRSLMCEAENRLGRIGAEEIKAHPFFAGVDFSSLRRIRAPFEPHLSSETDTAYFPSEEELANNAIQLEAARAAAEPAGATDGFEPPEMTLPFIGYTFKRFENNFQ

SEQ ID NO: 18171 - protein, 171 aa, Wolbachia endosymbiont of Drosophila ananassae
MYHILKYKDYEPKIDESAFIAGGSHIIGKVEIGRDASIWFNCVIRGDVGSIKIGNGTNIQDGTVIHVDRNPGGDTIIGSMVTVGHFCVLHACTVHDKAFIGMGSTVMDHAVVEPEAMVAAGSLVTHGKVIKSGEIWAGRPAKFFKKMSNEEIKHIAQSAQNYIMLMKEYKN

SEQ ID NO: 18172 - protein, 250 aa, Photorhabdus luminescens subsp. laumondii TTO1
MAVTKLVLVRHGESEWNRENRFTGWTDVALSEKGRAEAQQAGQLLKEEGFVFDFAYTSVLKRAIHTLWNILDQVDQQWLPVEKSWKLNERHYGALQGLDKAETAAKYGDDQVKLWRRGFAITPPDLTKDDERFPGHDPRYANLKPEELPVTESLATTIERVIPYWEEVIKPRVAQGEKVIIAAHGNSLRALVKYLDNMSEETILELNIPTAVPLVYEFDENMKPIKHYYLGNADEIAAKAAAVANQGKAK

SEQ ID NO: 18173 - protein, 119 aa, Glycine max
MASSVLKSLMRFSSSRNTTTRSFCLVTSQISNHTAKWMQDTSKKSPMELINEVPPIKVESRIVACEGDTNSALGHPIEFICLDLPEPAVCIRYGKPNGPVSVLCILELCEVDHGNHSNE

SEQ ID NO: 18174 - protein, 806 aa, Vitis vinifera
MSNQAESSDSKGTKRDFSTAILERKKAANRLVVDEAVNDDNSVVALHPDTMEKLQLFRGDTILIKGKKRKDTICIALADDTCDEPKIRMNKVVRSNLRVRLGDVVSVHQCPDVKYGKRVHILPVDDTIEGVTGNLFDAYLKPYFLEAYRPVRKGDLFLVRGGMRSVEFKVIETDPAEYCVVAPDTEIFCEGEPVRREDEDRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLSEDVDLERIAKDTHGYVGADLAALCTEAALQCIREKMDVIDLEDESIDAEILNSMAVTDEHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRRRENPEAMEEDVDEEVAEIKAAHFEESMKYARRSVSDADIRKYQAFAQTLQQSRGFGTEFRFSETSTGAAGSDPFAASAGGAADEDDLYS

SEQ ID NO: 18175 - protein, 392 aa, Arabidopsis thaliana
  misc_feature (164)..(164): Xaa can be any naturally occurring amino acid
MASASFVKPNTLSSPWIGQRSFAHTSASSSPPPRVSFAIRAGAYSDELVKTAKSIASPGRGILAIDESNATCGKRLASIGLDNTEDNRQAYRQLLLTTPGLGDYISGSILFEETLYQSTKDGKTFVDCLRDANIVPGIKVDKGLSPLAGSNEESWCQGLDGLAXSRSAEYYKQGARFAKWRTVVSVPCGPSALAVKEAAWGLARYAAISQDNGLVPIVEPEILLDGDHPIERTLEVAEKVWSEVFFYLAQNNVMFEGILLKPSMVTPGAEHKNKASPETVADFTLTMLKRRVPPAVPGIMFLSGGQSEAEATLNLNAMNQSPNPWHVSFSYARALQNSVLRTWQGKPEKIEASQKALLVRAKANSLAQLGKYSAEGENEDAKKGMFVKGYTY

SEQ ID NO: 18176 - protein, 803 aa, Coccidioides immitis RS
MATNRAGRFLAGILGINVDYRQEPEDTFRSAAKSISSVDTFVENEPTVAEWVSDRRPSVNDTKRYIKSLFPFSSWIFHYNLQWMLGDIIAGVTVGFVVVPQGMAYALLARLPAEYGLYTSFVGFLFYWIFATSKDITIGAVAVMSTIVGNVVIKVQDVNPDIPAEQIARGLSVICGAFLLFVGLIRCGWIVEFIPLVTITSFMTGAAISITVGQVPAMMGIRGVNTREAAYKVIINTLKNLPNSQLDAALGLSALFLLYGVRWFCRFMSNRQPNRRKMWFFISTLRMAFIILLYTMISWLVNRNIPDEKEAKFRILGTVPKGFRHAGVPHMDQRLVKSFASDIPASIIVLIIEHIAISKSFGRINNYVINPSQELVAIGFTNLFGPFLGGYPATGSFSRTAIKAKAGVRTPLAGVFTALIVLLALYALTSVFFYIPMSTLAGLIIHAVGDLITPPNVVYQFWEISPLEAIIFFSGVLVTVFTQIENGIYATIAASAAVLLFRTAKAKGNFLGRVSVYRVTPDNFPRRGDGHACKEDPGWSVRDAFIPMEHQDGSNPLIDAQSPYPGIFVYRFNEGFNYPNQARYLDTLTAHIFKETRRTQLERYDKIGDRPWNDPGPRNGEQININDNRPILRAVILDFSAVNNVDVTSIQGLIDIRNQLDRYAAPEIVEWHFSSINNRWTKRALSAAGFGYPSSGSIESLGHWKPIFSVAALSGAEADSITTHKASESSEIDGIDEIEPYGNRGAGRKELIRIPRRIANVHGINRPFFHMDVQAAVENAILNAEHKNATLVSTLEDKDPAKE

SEQ ID NO: 18177 - protein, 380 aa, Listeria ivanovii
QNRWRPELHDIQVSGIRAFNTRVTGIPDMIRLTLGEPDFPTPEHVKQAAIQAIQDNFTNYTPNAGMPELLEAASTYFQEKYNLEYNTNEIIVTVGATEAISVALQTILEPGDEVILPDPIYPGYEPLITLNKAHPIRIDTTETNFKLTPTQLRKHITPKTKALIIPYPSNPTGVSLTKEELVDLANVLREAGIFVIADEIYSELIYHEEHASIAPMLREQTIVINGLSKSHAMIGWRIGFLLAPEIITKQMLKIHQYSVTCASSISQKAALEAITNGKDDAFQMRTEYKTRANFTQDRLEKMGFTVVPPDGAFYFFVKLPDEITENSFDWAVKLAEEAKVAVVPGNAFSEKGDRFFRLSYATSFNKLAEALDRMAAFLSK

SEQ ID NO: 18178 - protein, 581 aa, Vitis vinifera
MVRFDSAILLQKELDLKSQVTSAVSTIKYLFEAGAKIILLSDWNMKINSKLLVVESVADFLSSVLQLKVAPSRCISNCSLSKMEELEKADILLLENLSEFKGELANCSKFAEQLSSVVDIFVNDSFSNSHKILASTVGVPRFCSACVAGFHFEESLCQLKMAAQINKKPCIAIIGGGNLFDKASAVRYLASRCDGLVFVGMMAFQIMHALGLHVPLNLLEGGPLKEASNIVQLAQNRKIPILYPKDFWCMTNDFPKQMEIFPAYGILDGWIPVDPGPKALDEINSLLTGCKKIIWIGPVKFRLPSQDIYGASKLVSMLDRLTQSNCEITVIGNMACKAVMKESSFVSVYNMVENASVVWEFLKGRKLPGLMALDRAYPVEIDWNAAYSHPSQPLVVDIGSGNGLFLLAMAKRREDLNFLGLEINEKLVRRCLDCVHQYGIMNGYFIATNATSTFRSIVSSYPGDLVLVSIQCPNPDFNKPEHRWRMLQRSLVEAVADLLASDGKVFLQSDIEAVAVRMKEHFLKYGKGKLSVVHNEDCTETDRKGWLKENPFGVRSDWEQHVVDRGAPMYRLMLSKSTRPN

SEQ ID NO: 18179 - protein, 232 aa, Nicotiana tabacum
MGYWQAKVVPKIKQIFDKNGPKKAAAAEACKTFDEAKALYSKEFEDKKTELQPKVVEIYEAAAVEIKTLVKEPKVSGLKKHSTEVQKLLDELVKIEFPGSKAVSEASSNFGPSYVFGPVLFVFRESSTFIVTENKKVEEAAVPVAASSSEEEAAASVAAASEAEAIAAAPVEVKKKEIVVEAEAKKEEEPAPAPAAEVAPAPAAEVAPAADVAPAKVEERAPAAAAPEPPKA

SEQ ID NO: 18180 - protein, 170 aa, Zea mays
MMSRERKKAAALQEKLKILRSITHSHALSNTSIIMDASAYIKELKQKVVRLNQEIACAQDALRHKSSSYPTVTVEALGVQGSSFLVNVFSDKSCPGLLVAVLEAFDELGLSVLQATASCADSFRLEAVGGENVADNVDVHVVKQAILHPVRSCSRSPRERRRGALQRVVD

SEQ ID NO: 18181 - protein, 589 aa, Phytophthora infestans
MSSSSRKFFVGGNWKCNGSLGQAQELVGMLNTAKIPVNVEVVVAPSQVHAATVKASLRSYVRVSGQDVWKQGNGAFTGETSAEMLKDLGAEYTLVGHSERREKGETNEVVAKKAAYALEKGLGVIACIGETKDHREANQTVAYITEQLDAYAAEINDWTNVVIAYEPIWAIGTGLTASPEQAQEAHASIRAWLKEKVSPEAAEQTRVIYGGSVGAKNAPELSQKEDIDGFLVGGASLKPDFLQIINAQNPTANVGGAVNVAINGFGRIGRLVLRASAKNPLINIVAINDPFVSTTYMEYMLEYDTVHGKFDGSLSHDETHIFVNGKPIRVFNEMNPENIKWGEEQVQYVVESTGAFTTLEKASTHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDAEAGIALTDDFVKLVSWYDNEWGYSSRVLDLIEHMVKNE

SEQ ID NO: 18182 - protein, 357 aa, Pseudomonas fluorescens PfO-1
MATMKAAIFVEKNRIVLDDKPIPEVGPLDALIRITTTTICGTDVHILRGEYPVAKGLTVGHEPVGIIERLGSQVRGFVEGQRVIAGAITPSGQSYACLCGCGSQDGPDTRHGFRAIGGWKFGNTIDGCQAEYVLVPDALANLCPIPDGLSDEQVLMCPDIMSTGFSGAERGEVSIGDSVAVFALGPIGLCAVAGARLKGASTIIGVDAVAERMTVARRLGATHVVNFREGDVVEQIMALTDGRGVDVAIEALGTQGTFESALRVLRPGGRLSSLGVYSSDLRIPLDAFAAGLGDYSIVTTLCPGGKERMRRLMAVVQSGMVDLSPLVTHRFKLDDIEAAYDLFAHQRDGVMKVAITP

SEQ ID NO: 18183 - protein, 452 aa, Frankia sp. CcI3
MVNASGPVAALSPHALLVFLLQIAVLLGLAYLLGRAATRLGMPAVVGELLTGVILGPSLLGALAPGFAGWLLPARADQFHLLDAVGQLGVILLVGFIGIEMDIQMVRRRGLAAARVGLAGLLVPVGLGVSAGLLLPDSLVADGAHRLVFAVFLGVALGVSAIPVAAKILIDMNLLDRNVGQLTLAAAAVDDVAGWFALSIVSAMATTGVRGSDIAVPVVSVLGTVLAALVVGPPTVRRALRYASTARDGGGHIVVVTVLILAAAAATEALKLEAIFGAFIAGVVIGSSRGFAPDRVAPLRTVVLTVLAPIFFATAGLRVDLGKLTDLSVLAAGLVVLLLAVAGKFAGAYLGARASRLGHWEALALGAGLNARGVIGLVVAGVGLRLGVLNTAAYTVVVLVALITTMITPPILHLTMRRVEHTADETLRRLDPPATPKAHIPVPDASAGMDVK

SEQ ID NO: 18184 - protein, 418 aa, Pseudomonas putida GB-1
MGYQKIKVPTDGAKITVNADHSLNVPDNPIIPYIEGDGIGIDVSPVMIKVVDAAVQKAYGGKRKIAWMEVYAGEKATQVYDQDTWLPQETLDAVRDYVVSIKGPLTTPVGGGIRSLNVALRQQLDLYVCLRPVLWFQGVPSPVKKPGDVDMVIFRENSEDIYAGIEWKAGSPEANKVIKFLKEEMGVTKIRFDQDCGIGVKPVSREGTKRLVRKALQYVVDNDRESLTLVHKGNIMKFTEGAFKDWGYEVAREEFGAELLDGGPWMKFKSPKSGREVIVKDAIADAMLQQILLRPAEYDVIATLNLNGDYLSDALAAEVGGIGIAPGANLSDTVAMFEATHGTAPKYAGQDKVNPGSVILSAEMMLRHMGWTEAADLIIKGTNGAIAAKTVTYDFERLMEGARLVSSSGFGDEMIKHM

SEQ ID NO: 18185 - protein, 286 aa, Methylocapsa acidiphila
MTAKKIAYQGEPGANSDIACRNAYPDWLPLPCATFEDALTAVIEGAAQLGMIPIENSIAGRVADIHHLLPSAGLFIVGEYFLPIHFQLLGLKGARLDAIASVHSHVHALGQCRKIVRKLGLSAHVAGDTAGSAREIVEAGDPTRASIATKLAAEIYDLDVLAADIEDEPHNTTRFVVLSPTAVWAPRGLPTVTSFVFRVRNVPAALYKALGGFATNGVNMTKLESYMVEGEFTATQFLADVDGHPEDPALALALEELAFFCKELKILGVYPAHPFRIDSQMGARRA

SEQ ID NO: 18186 - protein, 387 aa, Arabidopsis thaliana
MDAEKKSAHFRQISSYKPQLLVLSSIHENPSSKISEKANIKADNDAEIGVFGAEKYFSMKLDHVDSTADITKQHEKENTHDHPNANPNPNPNPHPHPHPQLTKTTSSRSKTSRHGTPSVRSESSCNSQTFLMRINNHNENKQRKMNDTSISFGGFRCYGPCSGVKTVHTDPKNSCKSRNSDRDFVAYDARKHNDKPRLHFEAKKADFHAQEKISLPIQRSDIAMNLERKLSLLTWDAIPNQLSTKNNNHNNNGNNSSMSSNTQEEETASVASSDLFEIENITSSVYEPSEASIGWSVVTGSMADQSVISDFDMMKRVTRNGPVVKTKPVIGEKVRSAGFLSGCKSHKAVSVVDSSRKVKETAKVDHHEMSHQKKFKTEIRIQDLSFL

SEQ ID NO: 18187 - protein, 612 aa, Arabidopsis thaliana
MAFNNFTRLDAHSAAEKAVSVIGLGYDLCSDVRFSACKTTPDGSRLVEIDPTRNRDLIFPGGIVVNNVSSSIKCDKGERTRLRSDILSFNQMSEKFNQDMCLSGKIPSGMFNNMFAFSKCWPKDASSVKTLAYDGWFISLYSVEIVRKQLTLRDEVKREVPSSWDSAALAGFIEKYGTHVVVGVTMGGKDVIHVKQMRKSNHEPEEIQKMLKHWGDERFCVDPVESKSPASVYSGKPKEENLLQWGLQPFGTSVSSAVVMHTKNEEIMRVCIRRGGVDLGQSHERWLSTVSQAPNVISMCFVPITSLLSGLPGTGFLSHAVNLYLRYKPPIEELHQFLEFQLPRQWAPVYGDLPLGLRRSKQSSPSLQFSLMGPKLYVNTSKVDSGERPVTGLRFFLEGKKGNHLAIHLQHLSACPPSLHLSHDDTYEPIEEPVEKGYYVPVKWGIFSHVCTYPVQYNGARSDDTASIVTKAWLEVKGMGMRKVLFLRLGFSLDASAVTRKSCWDNLSTNSRKSGVFSMISTRLSTGLSPNPATTKPQSKIDINSAVYPRGPSPPVKPKLLSLVDTKEVMRGPEEQPGYWVVTGAKLCVEAGKISIKAKYSLLTVISEDSLV

SEQ ID NO: 18188 - protein, 392 aa, Silicibacter sp. TM1040
MKFPERFAHLPPYAFPRLRALLDHHAPGGDVVQLTIGEPKHEFPAWVTDVIVENASAFNNYPQNEGSDALRGAMADWAAQRYGVTLDPATRVMALNGTREGLYNAAMALCPEEKNGQRPVVLIPNPFYQVYMIAAISVAAEPVFVPATDETGHLPDYASLPEEVLNRTAIAYICSPANPQGAVASREYWQQLFALAEKYDFKVFADECYSEIYRDTAPVGALTVADEMGLDPERVVLFNSLSKRSNLPGLRCGLLAGGPETLVQVKKLRAYSGAPIPGPLQAAAAKVWADEVHVAENRALYQEKYRIADEVFAGLNGYMSPEAGFFLWLPVEDGEAATLKLWQETGVRVLPGAFLAQGKGAENPGHGYIRVALVASEEQTRASLQLLRDCLY

SEQ ID NO: 18189 - protein, 498 aa, Arabidopsis thaliana
MDIVAIVLSLLFIFFLFFFFYTTGKSCPGGAKNPPGPSKLSLLRNILQTVEKPHRSLADLSRIYGSVMSFKLGCLTTVVISSPETAKEVLKTHDHVLSYRVSSDPVRAAGHHELSLLWIPPLARWRFLRKITRNQLFSTQRLEATSAIRTRKVQELMNFVNKCCERREAVNISRASFITSLNIISNALFSTNLANFDDSKTFHDFQNVVIRMMEISGKPNLADFFPFLGFLDLQGARKEARLLMHKLFRVFQGFIDTKRSSTSRNNNDMLDSLLDIAHKKESELDDNNIKHLLLDLFLAGVDTSSSAVEWAMAELLRNPKMIVKVQEEIRQVIGLKGTVQDLDIVKLPYLQAVVKESLRLHPPAPFLVPRKSESDDVQIFEFLIPKNTQVLVNVWAIGRDPNVWKNPTQFEPERFLGRGIDVKGNHFELIPFGAGRRICPGMPLAFRIMHLVLASLLYGFDWEYQNGVVPENVDMNEAFGATLHKAEPLCIVPIKKRV

SEQ ID NO: 18190 - protein, 231 aa, Arabidopsis thaliana
HLACEFINSCEMEPRINDLQVESRVHELLDFPVHTNQISSAIYEILLQCPNDHIENPKKKPYNCPHSGAKCDVTGDIQRLLLHLRNDHNVEMSDGRSFSHRYVHHDPKHLHHATWMLTLLDCCGRKFCLYFEAFHLRKTPMYMAFMQFMGDEEEAMSFSYSLQVGGNGRKLTWQGVPRSIRDSHKTVRDSQDGLIITRKLALFFSTDNNTTDKELKLKVSGRVWREQPVSI

SEQ ID NO: 18191 - protein, 456 aa, Salmonella enterica subsp. enterica serovar Typhi str. CT18
MDSQQHGEQLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWYPEIPTWASAAAFFVIINAINLTNVKVFGEMEFWFAIIKVIAVIAMILFGAWLLFSDTAGPQATVRNLWEQGGFLPHGWTGLVMMMAIIMFSFGGLELVGITAAEADNPEQSIPKATNQVIYRILIFYIGSLAVLLSLLPWTRVTADTSPFVLIFHELGDTFVANALNIVVLTAALSVYNSCVYCNSRMLFGLAQQGNAPKALLNVDKRGVPVSSILVSAVVTALCVLLNYLAPESAFGLLMALVVSALVINWAMISLAHMMFRRAKQQQGVKTRFPALFYPFGNVLCLLFMAAVLIIMLMTPGMAISVWLIPVWLLILGVGYLCKEKTAKTVKAH

SEQ ID NO: 18192 - protein, 289 aa, Arabidopsis thaliana
  misc_feature (17)..(17): Xaa can be any naturally occurring amino acid
  misc_feature (47)..(47): Xaa can be any naturally occurring amino acid
  misc_feature (71)..(71): Xaa can be any naturally occurring amino acid
  misc_feature (201)..(201): Xaa can be any naturally occurring amino acid
MTRSVSFPLFLFAVVLXLSSSLLADDPKPIRREVYEGGGGVEVRDGXTPEIPGWESSEGWGKTFLRLAASXMKNGSFANVSEMKLSVHSGTHVDAPGHFWDNYYDAGFDTDSLDLQVLNGPALLVDVPRDKNITAEVMESLHIQRGVRRVLFRTSNTDKRLMFKKEFDSSFAGFMTDGAKWLVENTDIKLIGKRWTISVSXLFMIDSLYYTFFSETGYSALWNPGLDYLSFAAFEESPATHRVILKGRDIIPVEALKLDGVEVGTYSLHCLPLRLVGAEGAPTRCILIK

SEQ ID NO: 18193 - protein, 740 aa, Ustilago maydis 521
MPAASTVSHLEASSSRDAEIYVSTSSADHASVSDADDDFTIRAVIAGLLIGCLLAFTNLYLGLQSGWISMMSLQSSLLGFALFRMLPQHVNLAGRRFALMSSAFTPQENVLVQTTAAAVGVMPLSAGLVGVIPALNKLSLDKDGSEPIELDFVHLLGWCFALAYFGVFFASPLREPMIIKEKLTFPSGTATAQLIGVLHNKPLAQQQTSATRHSSGYSNHTEDQQDHERTALLNGYDPSNIHLDDDQEDSASVKLDTSKSWKALAWSFSGSAGFTLLSYYLPVLYAIPLFDFIPPHNLASMWGFWFTPSLNYIGQGIIMGLPTTVSMTAGAIVGWAVLSPMAYYNGWAKGHPLDSEDGSKGWILWISLAIMCSESIVGLVALVASNGIQDLKSLVVTSKQRRQQQSEASGAHESAEDEADSDHEPPHRNTPKTWVMSGLMGSTLVAVMLIYMAFGAEGISPWATLLSIILASLFAILGVRALGETDLNPVSGIGKISQLIFALVQPGNVVANLVAGGIAEAGAMQAGDLMQDYKTGHLVGASPRSQFKGQLIGSTLGILMSSFAYKLYTSAYEIPGPQFPAPTAAVWLNLARLVNHGHLPDKVEVFMMGFGAIFALTGGIKTLARSKALRQEARVGSSVAATVAKLVPSGIAFGVGMLNTPNFSLARLVGGLIAHCHYSRSSSSSNTSSRAMAGIGIIIIASGFVLGEGAASIVTLLLKQNGAQAWTCAGCRGGCAGGCS

SEQ ID NO: 18194 - protein, 525 aa, Silicibacter sp. TM1040
MRDFQTPGRSAVFAQNGLCATSHPLAAQVAVDVLKRGGNAMDAAIAGAVLLGICEPQMTGIGGDCFVLYNRAGETTVRALNGSGRAPKAAQAADLRARGLEAVPLNSADAVTVPGAIDAFCHLSETEGKLGLDALLAPSIHYAEEGVPVAPRVAFDWGNDAETLQGSARDTYLINGRVPRVGEIFRAPGQAEVLRRIARDGRDAFYSGEIAEDMISALTTRGGVHTAEDFAATQATATDPIQGHYKGVDLLEHPPNGQGATAILMLNILKHFDIAGMDPFGAARAHIEAEAAKLAYDTRNRFLADPDHMSRLDYMLAPETAEKLAALIDPKRAMASPADISEAVHKDTIYITVVDKDRMAVSLIYSIFHGFGSGIASDKFGILLQNRGAGFCLEDGHANELAGGKRPMHTIIPAMLAENGRITMPFGVMGGAYQPNGHARFVSNLRDFGMEPQAAMDAPRAFTDRGVFNVERGYSDAVRAELTEMGHKVDIPTTAIGGSQAIHIHDTGVLEGASDPRKDGCALGY

SEQ ID NO: 18195 - protein, 484 aa, Chlamydophila abortus S26/3
MVADKAGADIGLIGLAVMGKNLVLNMIDHGFSVSVYNRSPEKTREFLQEHSQSPELQGHETLESFVRSLKRPRKIMLMIKAGTPVDQSIDSLLPYLEAGDIIIDGGNSYYKDSERRCRDLKEKGILFIGMGISGGEEGARHGPSIMPGGNSDAWPAIAPIFQSISAKVNGNPCCCWVGPGGAGHYVKTVHNGIEYGDIQLICEAYGLLRARLDLSPEAVSVIFAEWNTRELESYLMRISVEVLSLKDSNGFPVIDTILDVAGQKGTGRWTAIDAIDSGVPLSLIIESVLARFLSSWKTIRERASQELPGVPIVFEKPRDPHLFIEDVFQALYASKIISYAQGFMLLKQASEEHQWNLNFGELALLWRGGCIIQSVFLDAIHKGFENEPEAPSLILQSYFKTVLQHSEPGWRRTVAYGVGSGYPMPCLAAALTFYDGYRTKDSPIALAQGLRDYFGAHTYERKDRPRGEFYHTDWIGSKTTTLVK

SEQ ID NO: 18196 - protein, 319 aa, Anabaena variabilis ATCC 29413
MRIANDVTELIGGTPLVKLNKIPQAEGVVARIVVKLEGMNPASSVKDRIGVSMINSAEAEGLITPGKTILVEPTSGNTGIALAMVAAARGYRLILTMPETMSQERRAMLRAYGATLELTPGTEGMRGAIRKAEELVASTPDAHMLQQFRNPANPKIHRETTAEEIWNDTDGEVDIVIAGVGTGGTITGIAEVLKQRKPSFQAIAVEPSNSPILSGGQAGPHKIQGIGAGFVPDVLRLELVDEVIRVSDDQAMSYGRRLAREEGLLSGISSGAALCAALQVGKRPENAGKLIVMVQPSFGERYLSTPLFQDLTNETAGVR

SEQ ID NO: 18197 - protein, 503 aa, Ralstonia metallidurans CH34
MLITDPQATASTGNQSGARAKEIHNFINGEYVPGQRWFEKRSPLNNAVIAKVAEAGRAEVDAAVAAAQAALKGAWGRMSLAQRVEVLYAVADGINRRFDDFLAAEVEDTGKPMSLARHVDIPRGAANFKIFADVVKNVPTEFFEMPTPDGVGAINYAMRRPVGVVGVICPWNLPLLLMTWKVGPALACGNTVVVKPSEETPQTAALLGEVMNAAGVPRGVYNVVHGFGPNSTGEFLTTHRGINAITFTGETRTGAAIMKAAADGARPVSLEMGGKNAAIVFADCDFDAAIEGTLRSCFANCGQVCLGTERVYVERPIFDRFVSALKKGAEGMQLGRPEDPATGMGPLISQEHRDKVLSYYKKAVEAGATVVAGGGVPDMPDALKGGAWVQPTIWTGLGDDSVIAREEIFGPCVLVMPFDSEEEVIRRANDNDYGLATAIWTTNLSRAHRVAGAIEVGIAWVNSWFLRDLRTPFGGAKQSGIGREGGVHSLEFYTELKNVCIKL

SEQ ID NO: 18198 - protein, 516 aa, Bacillus clausii KSM-K16
MFTPYKHEPFTDFTIEANKQELLTAIKQVEANLGGHYPLVINGERVETDDTISSYNPANKQELIGTTGKATKAHAEQAIEAASTAFESWRTVAPAERANILVRAAAIVRRRKHEFTALLIKEAGKPWKEADADTAEGIDFMEYYARQMVELAEGKSVHSREGELNRYIYTPTGVTVVISPWNFAFAIMAGTTVAPLVTGNTVLLKPASTTPVVAAKFVEVLEEAGVPKGVINFVPGSGSEVGDYLVEHPKTALITFTGSRDVGVRLYEKAAIVQAGQNHLKRVIVEMGGKDTVVVDNEADIDTAVEAIVISAFGFSGQKCSAGSRAVIHEDLYDEVVAKVVEKTEALTVGNPADATNYYMGPVIDQAAFDKITGYIEIGKSEGKLVAGGKSDDAEGYFIHPTVFADVDPKARIMQDEIFGPVLAISKASTFAEALDIANNTEYGLTGAVITNNRAKIEQAKQDFHVGNLYFNRNCTGAIVGYHPFGGFKMSGTDSKAGGPDYLTLHMQAKTISEMF

SEQ ID NO: 18199 - protein, 352 aa, Zea mays
PRVRTAEAIEKILTHNSKGINYQILSNPEFLAEGTAIEDLFKPDRVLIGGRETPEGRKAVQALKDVYAHWVPEDRILTTNLWSAELSKLAANAFLAQRISSVNAISALCEATGANVTEVAYAVGKDTRIGPKFLNASVGFGGSCFQKDILNLVYICECNGLPEVANYWKQVIKINDYQKSRFVNRVVSSMFNTVAGKKIAVLGFAFKKDTGDTRETPAIDVCKGLLGDKAQISIYDPQVTEDQIQRDLAMNKFDWDHPMHLQPTSPTAVKQVSCVWDAYEATKGAHGLCILTEWDEFKTLDYQKIFDNMQKPAFVFDGRNIVDSEKLREIGFIVYSIGKPLDAWLKDMPAVA

SEQ ID NO: 18200 - protein, 173 aa, Silicibacter sp. TM1040
MTLYALGEDRPQIHADTWVAPDANLIGKVVLEEGASVWFGVTIRADHEEIRVGRGTNVQENVVMHIDAGYPLTIGANCTIGHKVMLHGCTIGDNSLIGMGATILNGAKIGKNCLIGAGALITENKEIPDNSLVMGAPGKVVREVDDALVAKLTASAIHYQDNMRRFKKDLKEI

SEQ ID NO: 18201 - protein, 423 aa, Photorhabdus luminescens subsp. laumondii TTO1
MTPSDIEFDLRHIWHPYTSMTNPLPVYPVVGASGVELELADGRKLVDGMSSWWAAIHGYNHPVLNQAAKIQLDQMSHVMFGGITHPPAIALCRQLIAISPLSLECVFLADSGSVAVEVALKMALQYWQAKGEKRQRILTLRHGYHGDTFGAMSVCDPDNSMHNLYKGYLPTHLFAESPQCGFDSQWDPRDIMPFRTLLEQHSGDIAAVILEPIVQGAGGMRIYHPEYLRQVRMLCDQHQILLIADEIATGFGRTGKLFACEHAEIEPDILCVGKALTGGYMTLSATLTTRKVAETISNGEAGCFMHGPTFMGNPLACAVAKASLNLLLQSPWQQRIKSIENQLKSELMPLKHHAKVADVRVLGAIGVVEMNQPVNMAVLQHYFVSQSVWIRPFGKLIYLMPPYIIQPEQLSRLTKAVSGAINL

SEQ ID NO: 18202 - protein, 455 aa, Oryza sativa Indica Group
MASQPPALDILVREPDGFSVWSGPPYPTGSAPPVRLPKTACSATYFSSDGSRLLATVASASATVYDCRTLSVVRSFELPGLLAAALSPAGTFLQTFQKSSSPQEKNVTVWHVDTATALYQHYQKNMSKATWPMVQFSADESVACRMMTNEIQFFDPKDFTKGFVYKLRMPGIAAMQLASAPGSHVAGFVPEAKGVPASVQIFSCDKDAQGQAVARRSFFRCSTVQFHWNKGSTGLLVVAQADVDKTNQSYYGETKLNYLTTDRAFEGIVPLKKKLVGKTKAECSVTSEWSPDGRHFMTATTAPRLQIDNGIKIFDHNGSLQFKKMFEKLYQADWKPEAPEKFSDIADLTISLGSIKIEETKKQGSLHFLIFHVISAQGSKSAQPSSKAPANIAAKPTAYRPPHSKNSADVQDKLFGGLASTGGEMSKNALRNKKRREKQKEKKAAEGSGASADDN

SEQ ID NO: 18203 - protein, 408 aa, Bacillus subtilis subsp. subtilis str. 168
MSPMDHLVFEVGTALVLVAIASVIANKIKFSIIPFLIVLGMLVGPHAPKMGIIDLTFIQSSEIIEFFGRMGVLFLLFYLGLEFSVGKLIKSGKSIAVGGTIYILINFSLGLLYGFITGFSFLEVLILAGVITISSSAIVAKVLVDLKRTANPETELILGIIMFEDIFLAVYLSVVSGLILGDATSVGSALLSILIAFGYMLLFFIAARKLPPLLNKLLDIRSNEVFIIVIFAALFFIAGFSETIHVAEAIGALLLGLVFSETEHSDRIEHLVVPFRDFFGAMFFFSFGLSIDPFSLGEAVWLALGAVILTILGNFIAGMVAGRRAGLSHKASSNIGLTIVSRGEFSIIVANLGIAGGLSATLKPFAALYVLILAILGPLVTKESKRIYRLLNKVFKWKPEVQPAKKQG

SEQ ID NO: 18204 - protein, 629 aa, Salmonella enterica subsp. enterica serovar Typhi str. CT18
MAIEIKVPDIGTDEVEITEILVKVGDKVEAEQSLITVEGDKASMEVPSPQAGVVKEIKVSVGDKTETGALIMIFDSADGAADAAPAQAEEKKEAAPAAAPAAAAAKDVHVPDIGSDEVEVTEVMVKVGDTVEAEQSLITVEGDKASMEVPAPFAGTVKEIKVNTGDKVSTGSLIMVFEVAGEAGAAAPAKAEAAPAAAAPAAATGVKDVNVPDIGGDEVEVTEVMVKVGDKVTAEQSLITVEGDKASMEVPAPFAGTVKEIKISTGDKVKTGSLIMVFEVEGAAPAAAPAKQEAAAPAPAAKAEKPAAPAAKAEGKSEFAENDAYVHATPLIRRLAREFGVNLAKVKGTGRKGRILREDVQAYVKDAIKRAEAAPAAAGGGIPGMLPWPKVDFSKFGEVEEVELGRIQKISGANLSRNWVMIPHVTHFDKTDITDLEAFRKQQNAEAEKRKLDVKYTPVVFIMKAVAAALEQMPRFNSSLSEDGQRLTLKKYINIGVAVDTPNGLVVPVFKDVNKKSVTELSRELTTISKKARDGKLTAGEMQGGCFTISSIGGLGTTHFAPIVNAPEVAILGVSKSAMEPVWNGKEFVPRLMMPISLSFDHRVIDGADGARFITIINNMLSDIRRLVM

SEQ ID NO: 18205 - protein, 475 aa, Salmonella enterica subsp. enterica serovar Typhi str. CT18
MMSTEIKTQVVVLGAGPAGYSAAFRCADLGLETVIVERYNTLGGVCLNVGCIPSKALLHVAKVIEEAKALAEHGIVFGEPKTDIDKIRTWKEKVITQLTGGLAGMAKGRKVKVVNGLGKFTGANTLEVEGENGKTVINFDNAIIAAGSRPIQLPFIPHEDPRVWDSTDALELKEVPKRMLVMGGGIIGLEMGTVYHALGSEIDVVEMFDQVIPAADKDIVKVFTKRISKKFNLMLETKVTAVEAKEDGIYVSMEGKKAPAEAQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTEPEVAWVGLTEKEAKEKGISYETATFPWAASGRAIASDCADGMTKLIFDKESHRVIGGAIVGTNGGELLGEIGLAIEMGCDAEDIALTIHAHPTLHESVGLAAEIFEGSITDLPNPKAKKK

SEQ ID NO: 18206 - protein, 59 aa, Triticum aestivum
QKLQEETGIDDLIVCTRSPISGKLTPLLLQLPPNNAAMHIVLVRESSKVAKTFPWPYGS

SEQ ID NO: 18207 - protein, 532 aa, Chlamydophila abortus S26/3
MTQTAEKPFGKLRSFLWPIHMHELKKVLPMFLMFFCIAFNYTVLRDTKDTLIVTAPGSGAEAIPFIKLWLVVPCAVVFMLIYAKLSNILSKPALFYTVIAPFLLFFALFPTVIYPFRHILHPTDFADKLQAILPQGLMGCVAMLRNWTFAAFYVLSELWGSVMLSLMFWGFANEITKISEAKRFYALFGVGANVALLASGRSIIWASKLRASATGNTDPWGLSLYLLMSMVVISGGIIILCYWWMNKCVLTDPRFYDPKELNKTKKSKPKMTMKESFAYLARSPYMLLLALLVICYGICINLVEVTWKSQLKMQYPNANEYSEFMGNFSFWTGVVSVIVMLFIGGNVIRKFGWLTGALVTPVMVLLTGVFFFILVIFRDQASGIVAMFGTTPLMLAVMVGAIQNILSKSTKYALFDATKEMAYIPLDQEQKVKGKAAIDVVAARFGKSGGSLIQQGLLVVCGSIGAMTPYLAIALFLIIAVWLVSATKLNKLFLIQSALKEQELAGEEAAAPTNTEASSSIQGTPAVENASS

SEQ ID NO: 18208 - protein, 462 aa, Trichodesmium erythraeum IMS101
MVKLTPNPSFSLTISLETPNRTGMLAKVTQAIASEGGNIGNVDLIKQSRQIIIREITVDAYSTEHIEKIVQAVKTLPEIKLVNVYDRTFDIHKGGKITVQGKIPLKSQADLSMAYTPGVGRISKAIAEDPQQIYNFTIKKNTVAIVTDGSAVLGLGNLGPGGALPVMEGKAMLFKEFAGIDAFPICLATQDTDAIVETVKNIAPVFGGVNLEDIAAPRCFEIEVKLREILDIPVFHDDQHGTAIVSLAALINALKLVKKSIEDIRIVINGAGAAGIAITRLLQKAGANQICLCDSKGIVSKSRTGLNSEKQAFAVESSGTLADALMGADVFLGVSVPGVLTPEMVRSMAKDPIVFAMANPIPEIQPELVAEEVAVMATGRSDYPNQINNVLAFPGIFRGALDCRATTLTSTMYLEAARAIASLVKTSDLDQEHIIPSVFDTRVATAVAGAVASAARTEGVTV

SEQ ID NO: 18209 - protein, 304 aa, Trichodesmium erythraeum IMS101
MFKNLSNINQQQLNTWVKQVLTQTKSGNLPNYIPLLAEANPNSFAILLQSIDHHIISFGDIKTKVPLMSAIKPFLLFYLLSQFGNELIFKKVGQKPSEKPFNSLEQLEFDGGWPRNPMINSGAIALSSLIPGNTAREKCNNFCSWLNSYGNCQLFLDENMLASVRSLPNQNNQNIAQKLVESGSIKDAKITLDTYNQICCLSGKIIDIANLGILLVNSPHSEWQKHCFTVKTLMTNCGLYETSNRYAMDIGIPIKSSISGIVLGLVPAKGVIVCYSPPLDQQGNSVAGLLLLELISRNLEKQYN

SEQ ID NO: 18210 - protein, 480 aa, Silicibacter sp. TM1040
MLEKREFYINGQWVEPSAANDCAVIDPSTEEPCTVISLGSQADTDAAVAAAKAALPGWMATPPAERIALVEKLVEIYNSRAEDLAQAMSSEMGAPIDMSRSSQVGAGSWHLNGFIEAAKNFQFERPLGDHAPNDRIIYEAVGVAALITPWNWPMNQITLKFGAAAIAGCTMVLKPSEQSPLNAMIFAELVHEAGFPPGVFNLVNGDGAGVGTQLSSHPDVDMVSFTGSTRAGTAISKAAADTLKKVHLELGGKGANLVFEDADEKAVKRGVLHMMQNTGQSCNAPSRMLVQKSIYDRVVEEAAAVANKVEVGPASQEGRHIGPVVNELQWTKIQDLIQKGIDEGARLVAGGTGRPDGLNKGYYVKPTVFADVNNQMTIAREEIFGPVMAIIPFETEEEAVEIANDTPYGLTNYVQTQDGARANRLARVLRSGMVEMNGKSRSAGSPFGGMKQSGNGREGGVWGLEDFMEVKAVGGWTPDA

SEQ ID NO: 18211 - protein, 218 aa, Listeria monocytogenes str. 1/2a F6854
MGKIAPSILSADFANLARDIKEVENCGADYIHIDVMDGHFVPNITFGPAVVQAIRPETKLPLDVHLMIENPDTYIPEFAKAGADYITVHVEACTHLHRTLQLIRSYGVKAGAVLNPATPIDVLQHVLNELDMVLFMTVNPGFGGQKFIPEVLEKISAFKEIVDKKGLDIEIEVDGGVDHETAKLCRDAGANVFVAGSYIYGNKNRQTPIDKLRAIVGE

SEQ ID NO: 18212 - protein, 355 aa, Zea mays
MSAYCGKYADELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAQYTVRTLQRTVPAAVPAVVFLSGGQSEEEATLNLNAMNKLSTKKPWALSFSFGRALQASTLKAWAGKVENVEKARAAFLARCKANSEATLGTYKGDAAADTESLHVKDYKY

SEQ ID NO: 18213 - protein, 610 aa, Magnaporthe grisea 70-15
MAFTNPSIYPPASHDIQKFASRRSVVHSTKGIVACTQPLAAKCGIDILNAGGNAADAAVAVAAGMNMTEPCSTGIGGDMFCLYYDAATKKVSALNGSGRSGAKYTLDAVRSALKLPDSDTKTEIPTKSPLAVTVPGAAAGWCDTVERFGSGKLTMADILKPAIELGEKGYPVSEITSIAAKSEKRIREASPNYSEMLKADPDAPGGCRAPKAGEIIKLPNLARTFRTLAEEGKRGFYSGRIAEELAKVCQDLGGLMELDDLKHHLETGSEPVEPLGLKFTSHGAAAADGSGGVQLWEHPPNGQGIVALMALGILQELERSGKVHKFGPEDHNTPTYLHAIIESLRLAFADASWFVTDPNVAKVPSQELISQEYLAERAKLFDPEKASTSVRHGDPSGAQFKSPALNSSDTVYFAVSDSQGNAISFINSNYNGFGTAIIPKGCGFTLQNRGSNFSLNKAHPNILTPRKRPYHTIIPGLVTNLTDGGLHSVFGVMGGFMQPQGHVQTLLSQVSCGLSPQQALDAPRICIGAGMPDEVTGEMNDDVVAIEEGMPASVIAGLQKLGHKCVLITGTERSQFGRGQIIRWTVDPVDGTGVWSAGSDPRGDGAAYPA

SEQ ID NO: 18214 - protein, 433 aa, Caulobacter crescentus CB15
MTAVRSKPLGVWMCAALVVGNMIGSGVFMLPASLAPYGWNAVIAWILTIGGSLCLAYVFAKLAGAFPRAGGPFAYTEEAFGRAPGFLVAWSYWISVWVANAAIAIAAISYLSVFLPVIAKVPALPALLTVAVVWTATAINCAGARSAGWTQVVTTVLKLVPLIAVAGLAVSVLLRKGPAAITPFEPSALSGASITAAAALTLWALLGVETATIPADKVKDPARTIPRATLAGTAFAGLVYLVVSSGVLLLTPTAVLQGSNAPFVDFVSYHGGGDFRLALAAFATISALGALNGWSLIQGELPAAMAREGVFPAWFAKTSANGTPVRAHLVSSVLVTILVLMNYAKSMADAFTFMALLSTTSTLFAYLFCSLAVLRLQGQGRMDRSKALTLVAALGALYSVWTFSGAGWSVTLWGLVLLAVGAPIYWLMRRAAR

SEQ ID NO: 18215 - protein, 156 aa, Musa acuminata
PLLLSPLASTSSITQNTRSLFSPMAVAAIAEAPFHVLAVDDSVLDRKLIERLLKTSSFQVTTVDSGTKALQFLGLHAEDASISSVHADQLDVEVNVNLIITDYCMPGMTGYDLLKKIKESSSFRDIPVVIMSSENIPSRINRCLEEGANEFFLKPV

SEQ ID NO: 18216 - protein, 261 aa, Zea mays
  misc_feature (11)..(11): Xaa can be any naturally occurring amino acid
MSSRSPPPKTXQMRTERTSYRGAPYRRDSRHGPSRFRNDLCNNCKRPGHFARECPSVAVCHTCGLPGHIAAECSSKGTCWNCKEPGHMANSCPNEGICRNCGKSGFGSRDCTAPPVPPGEVILCSNCYKPGHFREECTNEKACNNCRQSGHLARNCTNDPVCNLCNVAGHLARQCPKSDTLGERGGPPPFRGVGAPFHDVGAPFRGGFSDVVCRACNQIGHTSRDCMAGAFMICHNCGGRGHMAYECPSVSIMDRFPPRRF

SEQ ID NO: 18217 - protein, 319 aa, Pseudomonas putida GB-1
MGLLIDGRWHDQWYENGKDGTFKRENAQRRNQLPAPEAGRYHLYVSLACPWAHRTLILRALKGLEPLIDVSVVSWLMQDHGWTFDQQQGSSGDHLGALQYLHQRYTQDDPHYTGRVTVPVLWDKKEQRIVNNESSEIIRIFNSAFNELTGNTLDLYPEPLRPVIEALNERIYPAVNNGVYRAGFATTQDAYEAAFDDVFNELDYLEDLLSRNRYLAGEYLTEADVRLFTTLVRFDAVYHGHFKCNLRRLSDYHNLSNWLRELYQWPGVAATVDMEHIQKHYYMSHKTINPNGIVPKGPLQDFGAPHDRERLAGKGIWQA

SEQ ID NO: 18218 - protein, 326 aa, Staphylococcus epidermidis ATCC 12228
MKENFWSTLPRPFFILAPMEDVTNIVFRHVVSEAARPDVFFTEFTNTESYCHPEGIHSVRGRLTFSDDEQPMVAHIWGDKPEQFREMSIGLADMGFKGIDLNMGCPVANVAKKGKGSGLILRPETAAEIIQASKAGGLPVSVKTRLGYYDIDEWRDWLKHVFEQDIANLSIHLRTRKEMSKVDAHWELIEAIKTLRDEIAPNTLLTINGDIPDRQTGLELANKYGIDGIMIGRGIFHNPFAFEKEPREHSSKELLGLLRLHLSLFEKYDKDEARHFKSLRRFFKIYVRGIRGASELRHQLMNTQSIAEARELLDTFEARMDARSEV

SEQ ID NO: 18219 - protein, 453 aa, Arabidopsis thaliana
MEAKKVTEEEEETWRREIVTSVMRLVSTRLPQTDLISLLLVSPWLYRTLISYPSIWLTINLREMTNAGDRLLAALSLPRYRQVKHINLEFAQGVVDSHLKLVKTECPDALLSLEWLNLNVCQKISDNGIEAITSICPKLKVFSIYWNVRVTDAGIRNLVKNCRHITDLNLSGCKSLTDKSMQLVAESYPDLESLNITRCVKITDDGLLQVLQKCFSLQTLNLYALSGFTDKAYMKISLLADLRFLDICGAQNISDEGIGHIAKCNKLESLNLTWCVRITDAGVNTIANSCTSLEFLRCLETLSQTCSTTLTTLDVNGCTGIKRRSREELLQMFPRLTCFKYLYIPPLNRTFLLLLGAQFLHLWIISLSTKSKFRSFYSHHDSRDPVMAGAVARFAKWFGAIDVWTRVSVIGLPVAFGVLHQLEKENVRQKKLFQAQIDDLVAKGVIRFIEESE

SEQ ID NO: 18220 - protein, 496 aa, Haemophilus somnus 129PT
MNVNAENNCIVIFGASGDLTHRKLIPALYNLYKIGRLTENFSVLGVSRTDLSDEEFREKMRNALRKTEDITEEHLEKFCSHLYYQAIDTSNASDYGKLVPRLDELHDTYQTGGNTLYYMSTPPSLYGVIPECLATHGLNTEECGWKRLIVEKPFGYDIKTAKELDVQIHRFFEEHQIYRIDHYLGKETVQNLLVLRFSNGLFEPLWNRNFIDYVEITGAEEIGVEERGGYYNDSGAMRDMFQNHLLQVLAMVAMEPPAIINADSMRDEVAKVLHCLHPLSEDDIKNNLVLGQYTSSTIDGEVVNGYLQEKGVPADSNTETYIALRCEIDNWRWAGVPFYVRSGKRLPTRVTEIVIHFKTTPHPVFSQNAPENKLIIRIQPDEGISMRFGLKKPGAGFEAKEVSMDFRYADLATPSLLSAYDRLLLDAIKGDATLFARTDAVHACWKFVQPILNYKKDQGRVYEYEAGTWGPTEADKLIAKTGRVWRKPSGMMKKKV

SEQ ID NO: 18221 - protein, 655 aa, Listeria monocytogenes str. 1/2a F6854
MMIGKRLSDRYKILHAIGGGGMANVYLAHDIILDRDVAVKILRIDLADESNLIRRFQREAQSATSLVHPNIVSVYDVGEENDLHYIVMEHVDGMDLKQYIHENHPISYDKAVDIMLQIVSAVAIAHQHHIIHRDLKPQNILIDHDGVVKITDFGIAMALSETSITQTNSLLGSVHYLSPEQARGGMATQKSDIYSLGIVLYELLTGKVPFDGESAVSIAIKHLQADIPSARAQNPEIPQSLENIIIKATAKDPFLRYQNAEEMEKDLQTCLNKDRLNEPKYVFPTDDGDTKAIPIIATKDTMQNLDKTIVPEGKVAAAEVVPEEKKDKKKKKMSKKKKIALIVSSVIIIFIIGILLLWLLGKSPDEVAVPDVSGKTEDQAVALLQKEGFVIGKTAEKNSDEVDEGKVINTDPEAGEMKEKGTKINLFVSIGSKKITMDDYTGRSYTDTKALLEEQGFKNISSEEAYSSEIEKGLIISQTPTQGTEVVAKSTDVKFVVSKGAEPITLKDLRGYTKTAVEDYASPLGLKVSSKEENSSTVEKGQVISQSPSAGTAMNSGDTIEIVISAGPKEKQVKEVTKTFNIPYTPSDEENPQPQKIQIYIQDKDHSMTSAYREMSITQNTSVEITFQIEEGSSAGYKIISDDKVIDEGTVPYPN

SEQ ID NO: 18222 - protein, 470 aa, Shigella flexneri 2a str. 301
MVDQVKVVADDQAPAEQSLRRNLTNRHVQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPDLSDWVASLAVIVLLLTLNLATVKMFGEMEFWFAMIKIVAIVSLIVVGLVMVAMHFQSPTGVEASFAHLWNDGGWFPKGLSGFFAGFQIAVFAFVGIELVGTTAAETKDPEKSLPRAINSIPIRIIMFYVFALIVIMSVTPWSSVVPEKSPFVELFVLVGLPAAASVINFVVLTSAASSANSGVFSTSRMLFGLAQEGVAPKAFAKLSKRAVPAKGLTFSCICLLGGVVMLYVNPSVIGAFTMITTVSAILFMFVWTIILCSYLVYRKQRPHLHEKSIYKMPLGKLMCWVCMAFFVFVVVLLTLEDDTRQALLVTPLWFIALGLGWLFIGKKRAAELRK

SEQ ID NO: 18223 - protein, 351 aa, Trichodesmium erythraeum IMS101
MKNDRGNVLVVDDNQFNRDLLARRVKRQGHMISSASDGFQALEMVRNHSFDLVLLDIMMPQMNGYQVLETLKADPALRHIPVIMISAVDDIDSIVRCIELGAEDYLSKPFNPILLKARINACLEKKRLRDQEQAYIKQLAEEQEKSEKLLLNILPAPIAQRLKQGEKTIADSFSEVTVLFADLVGFTKVSANLSPAELVELLNMIFSCFDQLADKYGLEKIKTIGDAYMVVGGLPTLRKDHAEAIAEMALDMLYQVKQISESQEKSLQIRIGLNTGAVEAGVIGTKKFAYDLWGDTVNTAHRMESHGIPGVIQVTEDTYGCLANKYIFQERGIINVKGKGMMKTYLLISRK

SEQ ID NO: 18224 - protein, 491 aa, Bacillus clausii KSM-K16
MIRGKMFINGEWTDAKNGRVREIINPFNQEVIATVPEGSAEDSHAAIAAARAAFDEGVWSAASASERGERVRLIGQKIANQNEEFARLESLDTGKTLEESRTDMEDIANVFFYFAGLADKNGGEVIRSPLPNSTSIVVREPVGVCGLITPWNYPLLQAAWKLAPALVAGNTLILKPSELTPLTTMKLFELFEEVGLPTGVANLVLGTGKEVGAPLAESTDVDLISFTGGIETGKTIMQAASSNVKKMALELGGKNPNIVFADADFETAIDQALNAVFFHAGQVCSAGSRLLVEEAIHDDFVEELVKRTKRIKLGNGFDEKTESGPLISAAHRAKVESYIQIGLDEGATLACGGKRPDAAELQNGFFLEPTIFTNCRSSMRIVQEEVFGPVLTVETFRTTEEAIAKANDTIYGLAGAIFSNDIGKAERIASKLRLGTVWINDFHPYFVQAPWGGYKQSGFGRELGKIGLEEYTETKHIFRNKQPQPIGWFRG

SEQ ID NO: 18225 - protein, 219 aa, Brassica napus
MEMAMTFVYPPPPSILLNTMSVVGLAALAQIGWSEVRGNHLKYSKFASSSSSASPKPQKHRFGSFSSRIGMLLLYTPAFLAAAASFFLLPSDDLRFLLLKSALALHFLKRIFEVMFIHKYSGEMAVDSAFLITSSYFSSTVLMLYSQSFTLGLTEPDLDLKLLGIVMFVVGIVGNLYHHVLLAKLRNEEGGKKVYKIPKGGLFNTVICPHYLFEIIVFW

SEQ ID NO: 18226 - protein, 184 aa, Streptomyces avermitilis MA-4680
MLTVGDKFPEFDLTACVSLEKGNEFQQINHKTYEGQWKVIFAWPKDFTFVCPTEIAAFGKLNDEFADRDAQVLGFSGDSEFVHHAWRKDHDDLRDLPFPMMADSKHELMRDLGIEGEDGFAKRAVFIVDQNNEIQFSMVTAGSVGRNPKEVLRVLDALQTDELCPCNWTKGETTLDPVALLAGE

SEQ ID NO: 18227 - protein, 467 aa, Caulobacter crescentus CB15
MNAPIRNHDVAELKRLDLAHHLPAQADHKVIAELGGSRIVTRADGCYITDGDGHRILDGMAGLWCVNVGYGRKELADAAYEQMLELPYYNTFFKTATPPTVKLAAKIAEKMGGHLTHVFFNSSGSEANDTVFRLVRHYWKLKGQPNRTVFISRWNAYHGSTVAGVSLGGMKHMHVQGDLPIPGVEHVMQPYPFGEGFGEDPAAFRDRAVKEIEDKILEVGPENVAAFIGEPVQGAGGVIIPPDGYWPAVEAVCRKYGILLVCDEVICGFGRLGQWFGHQHYGIKPDLIAMAKGLSSGYLPISAVGVADHIVAELREKGGDFIHGFTYSGHPTCAAVALKNIEIIEREDLITRTREDTGPYLAKALARLNDHPLVGETRSLGLIGAVEIVREKGTNHRFLDKEGEAGPIVRDICIRNGLMVRAIRDSIVCCPPLIVSHAEIDELVGIIEKSLTEAEPILRALKPEAVS

SEQ ID NO: 18228 - protein, 160 aa, Zea mays
SSALGSLPWEKPLSSEFEQLARESEYAAWTLANGYALNHVTISVHRLKSHLNKIKKLNQFFEEKGFKLNSEGGVLKVSPDGGLLQSSTVADSISFKFSDGVTKSIPCSYIEFAERLVLPQFQNVPESDIKEFHRRDGFEVGNADKIFESTNQEQLSRRTG

SEQ ID NO: 18229 - protein, 321 aa, Bacillus cereus G9241
MKALYFEQFGNPDVLQYKELNDPIINPKEILVRTKAIGLNFADIYRRRGDYHLAGNPPYVLGYEGAGIVEKVGADVTNINPGDRIAFADVPFANAELVAVPSEKAIKLPDSISFETVASVLLQGLTAHYLTKDSYEIKQGDIALVHAAAGGVGQLLIQMIKLLGGKVIGLTSSNEKGKVATLAGADHVFLYTESWATKVLEITNGTGVNVVYESVGSTLEESFSATKTGGTVVFYGMADGNPAPVDPRMLMDTSKTLTGGDLWNVLTTYEERKKRSTQLFDWIATGKLNIASPTTFSLQNGALAHELLESRKSTGKILLIP

SEQ ID NO: 18230 - protein, 131 aa, Musa acuminata
LSPLIKSPSSLSSLKCISKTSNLKISNCFRALAMAVYTVKLIGPEGQEHEFEAPDDTYILDAAEAAGVDLPYSCRAGACSTCAGQMVSGNVDQSDGSFLDESQMAKGYLLTCVSYPRSDCIIHTHKEGDLY

SEQ ID NO: 18231 - protein, 328 aa, Dehalococcoides sp. CBDB1
MTTCSLEAIGLGAVHVDHIYTVEQILHDGECVVTESASFPGGSGANTIHGLSRLGLKCGFIGAVGNDSDGNLLIKDFENAGIDNQYLMVTDEAQTGSVVSLSESSGRRSTYVNPGANNYLNLSDINLEYLSQAKLVHMSTFFSQNEFALCHEIAERLAPDVLFSFSPGALFAAQGLKRLAPILSRTNALFTNQLDIEKMTQKNYQRATDMCIRSGCEHVVVTLGESRRFQRKGKITLQTYIRDKDHECHMESTVSLRKDIRTVVDTIGAADAFTTGFLFGLMGDKPIEECGLLGDISARFCISKLGARSGLPNLEGLKERFGMHYFTN

SEQ ID NO: 18232 - protein, 389 aa, Triticum aestivum
MTPPAAASPGRKSPAAVLFLCVVTISLLMFILLASYTPRLQPHGRSPHRRLKLHPKNSAAVASSYGAGAVHDSGGNRHAAPFDPAIAELERRLEDKEWEREHYRILHGDAEKDDHMKEWEEFLREEEDFINDDDRFNVSDRIRALFPKIDLTPKDGFVSLDELIRWNLDQARADQLHRSAREMELYDKNGNGIVSFTTFRALRQQSHGDGNSLGFPWWKEEHFNASDVNGDGFLNKTEFHDFLNPSDSENPKIINLLCRQELRQRDKDGDGKLNFEEYFHGLHDHIHGYDDENAAISHIGNMTIAKERFAKLDKDNDGFISEHELEPVLDKLHLSERYYARQQATHAISEADKDHDGRLTLEEMIENPYAFYGSVYFSDDEDYFHEEFR

SEQ ID NO: 18233 - protein, 210 aa, Mycoplasma mycoides subsp. mycoides SC str. PG1
MNYLLIGGAGYIGSHVAEIINKTDNNKVIIYDNLSSGLNDFIEQKSTFIQGDILDFNKLNEVFSSNKIDVVIYLAGLIKVGESVQKPLDYYQTNILGLINTLKIMQAHNVNYFVFFSSAAVYGNNSRHNGYFYEDDPKEPCSPYGRTKYFGEEIIKDFAIANPNFHYTFLRYFNVAGASKSKRIGYLTKDNNKPTHLIPAISYFAFGLTD

SEQ ID NO: 18234 - protein, 290 aa, Mycoplasma mycoides subsp. mycoides SC str. PG1
MAIRKAVIPCAGFGTRFLPFTKSQAKEMLPIIDTPTIEYIVKEAVDSGIKEILIILNDKKSEIMNYFSRNIQLEGFLYNKGKIAELEQIKTKYDANIHYIIQDEPLGLGHAISLCKGFINNESFAVLLGDDLFKCQTPAIKQLMDLYEEKQSTILGTILIDKKDCKKYEICKIESSDDNVYKVCSVIEKPDEQNAPSNVAIAGRYILTPEIFNYLDLQLKGETGEIELTDSILKTISDVDCYAKVIDGKRYDIGNKLGYLEAFVDFALNRDDTKNEFIKLVKKINEEETL

SEQ ID NO: 18235 - protein, 484 aa, Haemophilus somnus 129PT
MSQKGDIGVIGLAVMGQNLILNMNDNGFKVVAYNRTTSKVDEFLAGAAKGTNIIGAYSLEELAGKLEKPRKVMLMVRAGEVVDQFIEALLPHLEQGDIIIDGGNSNYPDTNRRVKALAEKGIRFIGSGVSGGEEGARHGPSIMPGGNEEAWQYVKPILQAISAKTDKGEPCCDWVGKEGSGHFVKMVHNGIEYGDMQLICEAYQFLKDGLGLSYDEMQQIFAEWKKTELDSYLIDITTDILGYKDADGEPLVEKILDTAGQKGTGKWTGINALDFGIPLTLITESVFARCVSSFKDQRVAASKLFNKTIGKVEGDKNVWIEAVRKALLASKIISYAQGFMLIREASENFGWNINYGATALLWREGCIIRSRFLGNIRDAYEANPDLIFLGSDPYFKGILENALSDWRKVVAKSIEVGIPMPCMASAVTFLDGYTSERVPANLLQAQRDYFGAHTYERTDKPRGEFFHTNWTGRGGNTASTTYDV

SEQ ID NO: 18236 - protein, 302 aa, Pseudomonas fluorescens PfO-1
MQALLNEILDAVRPLIGQGKVADYIPALGTVPANQLGIAVYGNDGEMYCAGDAETPFSVQSISKVFSLVQAIEHSGEAIWERLGHEPSGQPFNSLVQLEFERGRPRNPFINAGALVICDINQSRFAAPALSMRDFVRRLSGNPQVMVDGKVADSEYQHRARNAAMAYLMQSFGNFHNDVEAVLRSYFSHCALRMNCIDLARAFCFLANDGFCKHSGEQILTRRQTQQVNSIMATSGLYDEAGNFAYRVGLPGKSGVGGGIVAVVPGQFTVCVWSPELNTAGNSLAGMAALEMLSSRIGWSVF

SEQ ID NO: 18237 - protein, 126 aa, Coprinopsis cinerea okayama7#130
MATSGLGVPVKLLHESLGHIITVELKTGQLYRGKLAEAEDNLNISLKDITVTGRDGRVSQLDQVYIRGSMIRFFIVPDMLQNAPMFKRVGPNAMRGRGIGTARGRATIMRARRGRGVAPAPRGIRR

SEQ ID NO: 18238 - protein, 427 aa, Dehalococcoides sp. CBDB1
MAGMETEIYFKFILSFGLILLVARLGGAIAERFLKQPAVIGELLAGIIISPFLLGQFLFANDPVIMNFALIDGVFSQNGEHLSGFAPMEIISQIAVVVLLFVAGLETNVTSFIKNSFTGAMVAIGGVVVPFALGVFSAMYFFPDLHMAGWLFIGAILTATSIGITVRILMDMGKLSSREGTIILVAAVVDDIIGLVILSVVISMAQSGSVNALSAVTTGVIGFAVWLGILLLGVYGHKYISKYILTPFKSSGTMPVMALIVGLIVSYLVTLVDLHPVVGAYVAGLMFASTMEKEEILHQTRPIMLFIAPFFFAYLGMQVDLREVWAVIVPALVIVVLAIIGKIVGCYFPARFVGKTSHNGAMIVGVGMVPRGEVGLIVAGAGLIAGAITRDLFGIAVAVSILTTLVMPVMIKPFFKPKAEANAKRLP

SEQ ID NO: 18239 - protein, 325 aa, Glycine max
MAVERSGIAKDVTELIGKTPLVYLNKLADGCVARVAAKLELMEPCSSVKDRIGYSMIADAEEKGLITPGKSVLIEPTSGNTGIGLAFMAAARGYKLIITMPASMSLERRIILLAFGAELVLTDPAKGMKGAVQKAEEILAKTPNAYILQQFENPANPKVHYETTGPEIWKGSDGKIDAFVSGIGTGGTITGAGKYLKEQNPNIKLIGVEPVESPVLSGGKPGPHKIQGIGAGFIPGVLEVNLLDEVIQISSDEAIETAKLLALKEGLFVGISSGAAAAAAFQIAKRPENAGKLIVAVFPSFGERYLSSVLFESVRREAESMTFEP

SEQ ID NO: 18240 - protein, 405 aa, Arabidopsis thaliana
MASSKGSQSVRNLMYPGKHALLPPKIPFPSVSASYSEYIPTGLIGSRHGQKLSNEKTHHQRTSSESHLVEELPFWLDDLLNEQPESPARKCGHRRSSSDSYAYLDVANATNISLTLQNDFSYRNTVLSTQRGVQELDRNKNAQDAAFYSGASFLKQKSRQRDSLVATGACPSWLPFARENGGGKNLGALYMSQDATVISSERKNYAEPFSHDPKMLSSEENNSNPSPVTYEADNTKRAKQQFAQRSRVRKLQYISELERNVQTLQAEGSKVSAELDFLNQRNLILSMENKALKKRLESIAQEKLIKQYSTVLKIVYLMSSVYYPVEQEVLEKEIGRLRALYQQQQQTQKPSASRGRATSKDLDSQFSSLSLNTKDSNCRRDSVSVMGPGDSTRSDPYLPPHHRRF

SEQ ID NO: 18241 - protein, 128 aa, Zea mays
  misc_feature (56)..(56): Xaa can be any naturally occurring amino acid
MAASEAAAAAATPVTPTEGTVIAIHSLEEWSIQIEEANSAKKLVVIDFTATWCPPXRAMAPIFADMAKKSPNVVFLKVDVDEMKTIAEQFSVEAMPTFLFMREGDVKDRVVGAAKEELARKLELHMAS

SEQ ID NO: 18242 - protein, 261 aa, Methylocapsa acidiphila
MTLKNRSAIVTGSTSGIGLAIARAFAKEGVNVTINGLGDPAAIEAERAGIEKEFGVKAFYSPADMTRPDEIRGMVKEAEEKHGGVDILVNNAGIQHVAPIEDFPIETWNLILAINLSAAFHAIAAAIPGMKSRKWGRIISTASAHSLVASPFKSAYVTAKHGLAGLTKTAALELATYGVTVNCISPGYVWTPLVEKQIPDTMAARHLTREQVINDVILAAQPTKQFVTADQVASLAVYLSTDAAAQITGANISIDGGWTAE

SEQ ID NO: 18243 - protein, 230 aa, Coprinopsis cinerea okayama7#130
MASHLANIFGTEQDRVNCSFYYKIGACRHGDRCSRKHIKPPFSQTILLPNVYHNPAHDPVCKLTEKELQEGFDAVYEDLYCELAKFGHLLELHVCDNVGDHLIGNVYARYEWETEAQAAVDSCNERWYAGRPLYAELSPVTDFREACCRQNENGECNRGGFCNFMHLRLPSPELLRQLRHGQRLERKLNPPKNENGAGGWEPSKREGGRGRSASPGRRTTHSGEDRWTRK

SEQ ID NO: 18244 - protein, 291 aa, Coprinopsis cinerea okayama7#130
MPSEYPFWLGGVAASMAASCTHPLDVTKVRMQTLAREAGEKRPSTIRVIQLSIQQSGFRGLYVGLTASLMRQMSYSLVRLGSYETIKGYMSKDGPPSTLKSLFAATLAGGLGGIAGNPADILLVRMTSDITRPADKRYNYSNAFTGLISLVREEGFAGLTRGLGVNMSRAVLMNASQVGSYDLIKTNLLGKVVPGTDYHLRDNLLLHVISSTLAGTVATTVSSPADVIRSRVMASASEHTTPARVLVDSLRQEGIRFLFKGWTPAFVRLAPNTVLLFVFYEVLTVTHLLLP

SEQ ID NO: 18245 - protein, 350 aa, Shigella flexneri 2a str. 301
MSSAKKIGLFACTGVVAGNMMGSGIALLPANLASIGGIAIWGWIISIIGAMSLAYVYARLATKNPQQGGPIAYAGEISPAFGFQTGVLYYHANWIGNLAIGITAVSYLSTFFPVLNDPVPAGIACIAIVWVFTFVNMLGGTWVSRLTTIGLVLVLIPVVMTAIVGWHWFDAATYAANWNTADTTDGHAIIKSILLCLWAFVGVESAAVSTGMVKNPKRTVPLATMLGTGLAGIVYIAATQVLSGMYPSSVMAASGAPFAISASTILGNWAAPLVSAFTAFACLTSLGPWMMLVGQAGVRAANDGNFPKVYGEVDSNGIPKKGLLLAAVKMTALMILITLMNSAGGKASDL

SEQ ID NO: 18246 - protein, 489 aa, Haemophilus somnus 129PT
MNDTVIQNQEHQSARKEWLKKIGIPLALTILLVLMFMPTPEGLTIQGQKAIAIFCGALTLWVCGSIPIYLTSLLVIILLPLTQTVAKDKVVFATLGYDVIWLMVSAFVLTSAMIKSNIARRFALWMITHFGQTPRKAMFVLVLINFILVFFVPSTTARASLMVPICLILLEIYRAVPGESNFGKLMMLQGVQADAIATSGVMTGTAGNIIAVGFINNQAGGDIGYLDWLLASFPIAFVTMIISFLIGFKLFSMKKETHFFEALSRLQAEYKKLGSLTLDEKKAMAIFLLTVLLWATESYQKAWFGFKISVYMTAVIAAVLCLMPRIGLLTWSEAKIKWDLMLFAAGAYAAGNTLESTKGAQWIMDKVVHGLGLETMSHTAVYVVVIFVCMYSHLIFTSKTVKTTILIPSIIALAQSLGMNPVTLALAASFTLTYTITLPPHSKVNTIYFATGYFSVLDQMKYGLVTCFIGASIICLSIFTWFQLLGYTL

SEQ ID NO: 18247 - protein, 253 aa, Glycine max
MGRKFFVGGNWKCNGTTEEVKKIVTTLNEAKVPGEDVVEVVVSPPFVFLPFVKSLLRPDFHVSAQNCWVRKGGAYTGEVSAEMLVNLGIPWVIIGHSERRQLLNESNEFVGDKVAYALQQGLKVIACIGETLEQREAGTTTAVVAEQTKAIAAKISNWDNVVLAYEPVWAIGTGKVATPAQAQEVHADLRKWVHDNVSAEVAASVRIIYGGSVNGGNCKELAAQPDVDGFLVGGASLKAEFVDIINAATVKKN

SEQ ID NO: 18248 - protein, 208 aa, Vibrio vulnificus CMCP6
MSYQEKNAMSPIIDALVPMVVEQTSRGERSYDIYSRLLKERVIFLTGQVEDHMANLVVAQLLFLESENPDKDIFLYINSPGGSVTAGMSIYDTMQFIKPNVSTVCMGQACSMGAFLLAGGAPGKRYVLPNSRVMIHQPLGGFQGQASDIQIHAQEILTIKTKLNKLLAEHTGQPLEVIERDTDRDNFMSADQAVEYGLVDAVLTHRSA

SEQ ID NO: 18249 - protein, 246 aa, Coprinopsis cinerea okayama7#130
MGNITSCCDSCFQGRRSQSYEPLLLENEREAVADLLQYLENRTTTNFFTGSPLSALTTLSFSDNVDLQRSAALAFAEITEKEVRPVGRDTLDPILFLLSSHDTEVQRAASAALGNLAVNTDNKLLIVKLGGLEPLIRQMLSPNVEVQCNAVGCVTNLATHDDNKTKIAKSGALVPLTRLARSKDMRVQRNATGALLNMTHSDENRQQLVNAGAIPVLVSLLNSPDTDVQYYCTTALSNIAVDGQSS

SEQ ID NO: 18250 - protein, 61 aa, Glycine max
NKVIILRKKKNFSGRKRESIFKSPDDPQGKRVLTGSGKGLTEFQKREKHFHLKDGTVENDD

SEQ ID NO: 18251 - protein, 249 aa, Zea mays
  misc_feature (131)..(131): Xaa can be any naturally occurring amino acid
LLSPSPSRPPPPRHRHARERRCLLLARLHALERGGFGRGFGRGGRGDRGGRRGGRRGGRQQEEEKWVPVTKLGRLVKENRINKIEEIYLHSLPVKEHQIVETLVPGLKDEVMKITPVQKQTRAGQRTRFKXFVVVGDGDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSNRTSIILGAYLGFSS

SEQ ID NO: 18252 - protein, 364 aa, Chlamydophila abortus S26/3
MGHTECGIVGLPNVGKSGLFNALTGAQVASCNYPFCTIDPNIGIVPVIDNRLDILAKMSQSQKVIYADMKFVDIAGLVKGAADGAGLGNRFLSHIRETHAVAHVVRCFDNDDVTHVSGKIDPSDDISVINLELIFSDFSSATNIHSKLEKQAKGKKDLGMVLPLLDRVIKHLESGQPVRTLHLSSEEQIQLKPYPFLTAKPMLYVANIGEDSIATMHNDYVAVVQEIAKKENAPVVPICVQLEEEIISLPVEERQDFLNSLGLKESGLHRLVRAAYHTLGLISYFTTGPQETRAWTIPIGSTAAEAAGQIHTDIQKGFIRAEVVTLEDMITYGSRTGVREAGKLRAEGRDYIVQDGDIMLFLHN

SEQ ID NO: 18253 - protein, 482 aa, Caulobacter crescentus CB15
MTALNLVETAALIDGQWVRGEASFDVLNPADGTLIAAVADLGAAETTLAIDAAHRALPAWAARTAKERGAILRRWSDLILAHADDLARLMTDEQGKPLAEAKGEVVYGASFIDWFAEEAKRAYGHTIPTPMPGKRLASIKQPVGVCAAIAPWNFPIAMITRKVGPALAAGCTVVVKPAAETPLSALAIARLATEAGVPAGVLNIVTTTRSSEVGKVLCDDSRVRKLSFTGSTPIGKVLYQQCAGTMKKLSLELGGNAPFIVFDDADLEAAVDGAIASKYRNAGQTCVCANRLIVQSGIHDAFAARLAEKVAALKVGPGTGEGVQIGPLINEKALTKVVGLVSGAVQAGAEVLTGGDVHGLGGHFYQPTVLVGATPEMRIFQEEIFGPVAPIVKFETEAEAVELANATPFGLAAYFYSRDVGRCWRVAEQIEAGMVGINEGLISTEVAPFGGVKESGLGREGASEGLDEYLETKYLCFGGVAG

SEQ ID NO: 18254 - protein, 513 aa, Bacillus cereus G9241
MFKRITIVGLSVVMFLPSIYGGSKAYADTVNNGTLMQYFEWYAPNDGNHWNRLHSDAENLAQKGITSVWIPPAYKGTTQNDVGYGAYDLYDLGEFNQKGTVRTKYGTKAQLKSAIEALHKQNIDVYGDVVMNHKGGADYTETVTAVEVDRNNRNIEVSGDYEINAWTGFNFPGRGDTYSNFKWKWYHFDGTDWDEGRKLNRIYKFRGIGKAWDWEVSSENGNYDYLMYADLDFDHPDVANEMKNWGTWYANELNLDGFRLDAVKHIDHEYLRDWVNHVRQQTGKEMFTVAEYWQNDIGTLNNYLAKVNYNQSVFDAPLHYNFHYASKGNGNYDMRNILNGTVMQNHPALAVTLVENHDSQPGQSLESVVSPWFKPLAYAFILTRAEGYPSVFYGDYYGTSGNSSYEIPALKDKIDPILTARKNFAYGTQRDYLDHPDVIGWTREGDSVHANSGLATLISDGPGGSKWMDVGKNNAGEIWRDITGNQTNTVIINKDGWGQFHVSGGSVSIYVQQ

SEQ ID NO: 18255 - protein, 105 aa, Brassica napus
IIGTFVLVYTVFSATDAKRNARDSYVSILAPIPIGFAVFLVHLATIPITGTGINPARSLGAAIIFNKDNAWDDHWVFWVGPFIGAALAALYHVIVIRAIPFKSRS

SEQ ID NO: 18256 - protein, 380 aa, Phaseolus acutifolius
MSSTAGQVIKCKAAVAWEAGKPLVMEEVEVAPPKAGEVRLKILYTSLCHTDVYFWEAKGQTPLFPRIFGHEAGGIVESVGEGVTHLKPGDHALPVFTGECGECAHCKSEESNMCDLLRINTDRGVMIHDSQTRFSIKGQPIYHSVGTSTFSEYTVVHAGCVAKVNPAAPLDKICVLSCGICTGLGATVNVAKPKPGSSVAIFGLGAVGLAAAEGARISGASRIIGVDLVSSRFEEAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPLVVEQYMNGELELDKFITHTVPFSEINKAFDYMLKGESIRCIIRMGE

SEQ ID NO: 18257 - protein, 496 aa, Caulobacter crescentus CB15
MTLPADMTERLAKLAPPSQAVIDGDLVEAASGATFHNVSPRDGQVLNLVTACQADDVERAVAGARAAFEDGRWRDQGPRQKKAVLFRLAELMERDADELALLESLDVGKPISDARNVDIPLAINTCRWYAEALDKVYGEVGTSPADRLSYAVHEPLGVIGAIVPWNFPLHMAMWKVAPALAMGNSVVLKPAEQSPLTALKLGALALEAGLPPGVLNVIPGLGGVAGEALALSMDVDMIAFTGSGPVGRRLMEYSARSNLKRVSLELGGKSPQIVFADCPDLEAAAQAAAWGVFYNQGEVCTAASRLLVEAPIKDAFLARVIEVAKGMKVGDPLDPSTQFGAMVSERQMNTALDYIATADSQGARRVLGGQRVRQEAGGFYVEPTIFDQVRPDQTLAREEVFGPVLGVMTFSSEDEAMRLANDTVYGLAAGLWTADVSKALRGARRLKAGLVWVNGWDACDITMPFGGFKQSGFGRDRSLHALHKYADLKSVSVTLR

SEQ ID NO: 18258 - protein, 780 aa, Silicibacter sp. TM1040
MTIKEIFETMDYGPAPENAAEALAWLVDQGSQFGHFINGDFTAPGTVFESKNPATGEVLAELTQATQKDIDAAVKAARAAQEGWAAMGGSGRATYLYAIARLLQKHSRLFAVLETLDNGKPIRESRDIDVPLVQRHFYHHAGHAQLMDDEMSDRAALGVCGQIIPWNFPLLMLAWKVAPALAMGNTVVLKPAEYTSLTALLFADICRQAGLPKGVVNIVTGDGAVGEMIVNAEVDKIAFTGSTSVGRKIREATAGSGKALTLELGGKSPYIVFDDADLDSAIEGLVDAIWFNQGQVCCAGSRLLVQEGVSERFHQKLRARMKTLRLGDPLDKCIDIGAVVDPVQHAEISRLVASATNCTVHQSAVNMPAKGCFFPPTLIEGLSPSDPLMQEEIFGPVLVSTTFRTPAEAVELANNTRYGLAATLWTENVNLALDVAPKLVAGVVWVNGTNMFDAAAPFGGVRESGFGREGGVEGLMAYTKPKAQSEALQPVVAFEGNAKSATPEGIDRTAKMFVGGKQARPDSGYSKPVYGPKGDLLGHVGLGSRKDVRNAVEAANAAKGWAKTTGHLRAQILYYLAENLAARAGEFAARIDAMTGKGEGAAEVEASLQRLFSAAAWADKYDGLAHGVPIRGVALGMKEPVGTIGVLCADEAPLLGLVSAMAPAIAMGNRVVLAASEAFPLAATDLYQVLETSDVPAGVVNILTGPHKDLGDTMAKHLDIDAVWSFSSSDLSKMIEAASAGNLKRTWVNNGHAFDWSRDQSKRFLQAATEVKTVWIPYGE

SEQ ID NO: 18259 - protein, 348 aa, Bacillus cereus G9241
MRNIENSLFYMPAEWEKHEGTWLQWPHDRTHRGEGYRAKLDDIWVTMVKELHYGETVHIVVYDEKEKVHVQSKLTEAKVDMDKIDFLIEETDDVWIRDNGPIFVKDKKGNLCLTHWIFNGWGEKYPYKKDAVMPAKISEMYSIPKVKSSVCLEGGGIEINGNGTLMAAKTSIINENRNPTLSQEEIEIELTKYLGVTNFIWITGIRGEDNYDEDTDYHIDGAARFVNENTILYEYDPFGEGEPYLLDAYEKHYQELRQARNLDGKPFQLIPVPVTRKVVKEAECKGSYLNFYIGNEVVLVPIYGDEHDKLGLQIIEGQFPGRRIIGIYINELFAYGGMIHCVTQQHLV

SEQ ID NO: 18260 - protein, 380 aa, Phaseolus acutifolius
MSSTAGQVIKCKAAVAWEAGKPLVMEEVEVAPPKAGEVRLKILYTSLCHTDVYFWEAKGQTPLFPRIFGHEAGGIVESVGEGVTHLKPGDHALPVFTGECGECAHCKSEESNMCDLLRINTDRGVMIHDSQTRFSIKGQPIYHFVGTSTFSEYTVVHAGCVAKVNPAAPLDKICVLSCGICTGLGATVNVAKPKPGSSVAIFGLGAVGLAAAEGARISGASRIIGVDLVSSRFEEAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPLVVEQYMNGELELDKFITHTVPFSEINKAFDYMLKGESIRCIIRMGE

SEQ ID NO: 18261 - protein, 439 aa, Caulobacter crescentus CB15
MPDFGANDLDAFWMPFTPNRRFKRHPRMLSSASGMWYRTPESREVLDATSGLWCVNAGHDRPKIREAIQKQAAEMDYAPCFNMGHPLAFQFASRLAQITPKGLDRIFFTNSGSESVDTALKIALAYHRARGKGTKTRLIGRERGYHGVGFGGISVGGIPKNRMYFGSLLTGVDHLPHTHGLPGNTCAKGQPENGAHLADDLERIVALHDASNIAAVIVEPVAGSTGVLIPPKGYLERLRAICDKHDILLIFDEVITGFGRVGAPFAAERFGVTPDLICMAKGLTNAAVPCGAVAASGKIYDAMMDGADAPIELFHGYTYSAHPLACAAGLATLETYREDDLFARAAGLEGYWQDAMHSLADARHVVDVRNLGLVAGIELEPRPGAPTARAMEVFETCFDEGLLIRVTGDIIALSPPLILEKDHIDRMVETIRRVLGQVD

SEQ ID NO: 18262 - protein, 476 aa, Xanthomonas axonopodis pv. citri str. 306
MHNTLILFGATGDLAQRYLFPSLLRLFIDGLLPEDFRIRALALSPHDTDAFRDVLRPRLTEALPIATAEQIDTLLQRVDYRSVDLRNADSVADAVRELASRRCVSYLAIPPGLYISTCQGLALGGALAAPHRLMLEKPIGHDSDSARDILQSIGALIDEDRVFRLDHYLGKAAVQNLIALRFGNTLLEAVWNRTYIESVQILVAESEGVDGRDAYYARSGALRDMVQSHILQLLCLVAMEPPASLEADRIRDEKVKVLRALRPMTAEHAAHDCVRGRYTAGSINGQPAQAYHPPEGSDVETFVAVTAHIDNWRWAGVPFHLCTGKRLAERSTRIVVTLKPVTHWLFERPDRQNAVPNRLTFQLQPQENIELGLMSSLAGPEWGAIELQPLELELSVPTGLHRRIAYERLFVDAFNGNPALFVRDDEVKAAWSWIDSVSDAWKDAALPLQPYPAGSWGPESAAHFLPPATDAQGNNA

SEQ ID NO: 18263 - protein, 503 aa, Zea mays
MATANGSSKGSFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGKARDIPGAAHLLRYYAGAADKVHGATLKMAQRMHGYTLKEPVGVVGHIVPWNYPTTMFFFKVGPALAAGCAVVVKPAEQTPLSALFYAHLAREAGVPAGVLNVVPGFGPTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKREGATLVTGGKPCGDNKGYYIEPTIFTDVKDDMTIAQDEIFGPVMALMKFKTVEEVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 18264 - protein, 548 aa, Oryza sativa Japonica Group
MATSAAAAASTLPYLVAAASSSAAARRRGAHRIRASSAAAEVEGAMDVVSEAELREKGFMGLRKTKLVCTVGPACVGALPALARGGMGVARVNLCHGGRGWHRAVMREVRRLNEEEGFCVSLMVDTEGSQLLVADHGGAASVKAEDGSEWLFTSKRTDESHPFTMHVNFDKFSEDILVGDELVIDGGMATFEVIEKVGNDLRCKCTDPGLLLPRAKLSFWRNGKLVERNFGLPTLSAKDWADIEFGIAEGVDCIALSFVKDANDIKYLKTYLSRKSLEHIKIFAKVESLESLKNLKDIIEASDGVMVARGDLGVQIPLEQIPAIQEAIVDLCRRLNKPVIVASQLLESMVEYPTPTRAEVADVSEAVRQYADAVMLSAESAIGAYPQKALAVLRAASERMESWSREENMQKLLPQHQLAIALPDRISEQICTSAAEMANNLAVDAIFVYTKYGHMASLLSRNRPNPPIFAFTDNANSRKSMNLYWGVIPLQLPLSNNMEDNFNQTIKLMKSKGSVKSGDTVLVVADSDLNRPRAATSVFQSIQVRIVD

SEQ ID NO: 18265 - protein, 434 aa, Photorhabdus luminescens subsp. laumondii TTO1
MEHFLFMNFKSLGLSADILRAVEEQGYSAPTPIQQQAIPVVLAGKDLLASAQTGTGKTAGFTLPMLQRLNDSPIQMKGRRPVRALILTPTRELAAQVGENVRDYSKYLRLRSLVVFGGVSINPQMMKLRGGVDILVATPGRLLDLEHQNAVDLSRVEILVLDEADRMLDMGFIHDIRRVLNKLPPKRQNLLFSATFSDDIKSLASKLLRDPVSVEVARRNSASEQIEQLVHFVDKKRKGELLSFLIGSRNWQQVLVFTRTKHGANRLAEQLNKDGVTASAIHGNKSQGARTRALADFKDGRIRVLVATDIAARGLDIDQLPYVVNFELPNVAEDYVHRIGRTGRADATGQALSLVCVDEHKLLKDIERLLKREIPRMAIPGYEPDPTIKAEPIQNGRQARGDNRQKNSHRRSGAPSRQRSSSHDVSHKSPNVRG

SEQ ID NO: 18266 - protein, 489 aa, Dehalococcoides sp. CBDB1
MKFQYDLVVIGSGLAGFTSTVFANGLGKKVAMVEKGKLGGACTWNACVPSKTLLQIGRRVGQIKKYNQNGLKLVSVNLQTENIMPYLHSVLEDISGVDDFDNLEKTGINILKGEAVFTDRHHISLNGQVVSAKHFIIATGSSPAIPPVEGLADIPYYTNETVFDIKSIPSSMIVLGGGPAGIELGLAFAWLGCKVDIIEMAERILPKDDTELSGLLLDYLNAEENLQIHVSTKAIRFQKQDNGQLKLEMQTREGKISEITAETVLVAVGRRANVAGLALEKAGVKYTARGISVNSKLQTSSLNIFAAGDVAGPIQLGMMAEKQAILAASNACLPFKQSIRYDDVAWVTYSEPQMAHIGLTEDEARRKYGNNIRIIRYPLTKVRRAVMDHDIRGMCKFVLDKHDRLIGAHLLCSQAENLIHELQIVKCLHKPLSRLHTIPHIYPTYEEGIIKRAADISYTMKMRRNPFVRLVLRYWHGYKDKLDTVINRL

SEQ ID NO: 18267 - protein, 190 aa, Escherichia coli
GSSGSSGMTATAQQLEYLKNSIKSIQDYPKPGILFRDVTSLLEDPKAYALSIDLLVERYKNAGITKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 18268 - protein, 447 aa, Vitis vinifera
MMFLHEFIGEALAGDGKQRKNGAAEGRNRRALGDIGNLVTVRGVDGKPQPQISRPVTRSFCAQLLANAQAAAAAENNKKAVCVNVDGAPIITDGGAAGKAPVAAKAAAQKKVTIKPKPEQVIEISPDSEEVKQEKPVSKKKGREGSSKKNVKTMTSILTARSKVACGLTNKPKEQIVDIDAADAGNDLAAVEYVEDIYKFYKLIESESQVHDYMDSQAEINEKMRAILVDWLIEVHHKFELMPETLYLTINIVDRFLSIKTVPRRELQLVGISAMLMASKYEEIWAPEVNDFVCISDRAYTHQQILMMEKAILGKLEWTLTVPTPYVFLVRFVKASIPDTQMEHMVYFFAELGLTNYVTMMYCPSMLAASAVYAARCTLSKSPVWDETLKVHTGYSETQLLGCAKLLVSFHSIAAENKLKVVYRKYSQPQRSGVSLLPPAKSLLAAS

SEQ ID NO: 18269 - protein, 952 aa, Vitis vinifera
MPSKTKKHSKSLSKLSYSDKSESPSVSSVLTPPPDLEISEEDLLRYLDEASSKCPSLIGKSAFIGRVTGVDPDSKGCKIWLSEPSMVAFNLAPGSTVSVSLASSKKKFSNGFPLSSLTDESTRHFQVDSGNKMPGEAGNYFALATVFPSCKVLKNGVRLSLNLYHTMGSPASARIVFVYLIQSQSVTGFVNGSRKSHSTTINGLSLYKCKELYLEMIPSKNGSTVNISTETTNYQVSNGAASSPKTPVSYQSKLISPNSNQLTSPICDDSVSSLSNPNNKIFASFDITEVLGDETAKKLLQSCAASWLYSRSLLTGNLVTIPILSELCTFCVRGAIKLSPDMSHVDDACVVDRETKVYLYLPSNSSSETPQKGRPPHVELEFKNFKANVGSAVKLGGLSEEYAVLKDIIISTSVKNTLSSMGLRTTKGVLLHGPPGTGKTSLAQLCICDAGVNLFSVNGAEIVSQYYGESEQALHEIFDSASQAAPAVVFIDELDAIAPARKDGGEELSHRIVATLLNLMDGISRTDGILVIAATNRPDSIEPALRRPGRLDREMEIGVPSPGQRYDILLNLLSEMENSLSDMQIQQLATVTHGFVGADLAALCNEAALVCLRRYVKSFIMEEECMLVVTFEDFEKARMKIRPSAMREVILEVPRVKWEDVGGQNEVKAQLMEAVEWPQKHQDAFKRIGTRPPTGVLLFGPPGCSKTLMARAVASEAGLNFLAVKGPELFSKWVGESEKAVRSLFAKARANAPSIIFFDEIDGLAVIRGKESDGVSVADRVMSQLLVELDGLHQRVDVTVIAATNRPDKIDPALLRPGRFDRLLYVGPPNESDRADIFHIHLCKIPFSSDVSIGELAFLTEGYTGADISLICREAAIAAIEDNLDASEITMEHLKTAIRQVQPSELQSYQELSTKFQRLVHSSDKRDESGLPLRSSKSTWMPLWYILYLVLV

SEQ ID NO: 18270 - protein, 628 aa, Oryza sativa Japonica Group
MAAAAISHLRRGAPRHARALLYLSTRRFSSSSAAGVAPLAAVAASARRLLSTSVDSGASSTGESYKPPLFDPFRAASLASSAPPLESPPIEELPDDATPPPEEEPGLPAPEKDPVATACQHELEGLKAWVETVRSRKESTEEKEAWSLLGRSVVSYCGTAVGTVAANDPSTANQMLNYDQVFIRDFVPSAIAFLLKGEGDIVKNFLLHTLQLQSWEKTVDCYSPGQGLMPASFKVRSIPLDGNSEAFEEVLDPDFGESAIGRVAPVDSGLWWIILLRAYGKITGDYALQERVDVQTGIRLILNLCLSDGFDMFPTLLVTDGSCMIDRRMGIHGHPLEIQSLFYSALRCAREMVSVNDGSNSLIRAINYRLSALSFHIREYYWVDMKKINEIYRYKTEEYSHDAINKFNIYPEQIPSWLADWIPEKGGYLIGNLQPAHMDFRFFSLGNLWAIISSLATQRQAEGILNLIEAKWEDIIANMPLKICYPALEYEEWRIITGSDPKNTPWSYHNGGSWPTLLWQFTLACIKMGRRDLAQRAIEVAEKRLSEDKWPEYYDTRTGRFIGKQSRLYQTWTIAGYLSSKMLLDCPELASILICEEDLELLEGCACSVNKSARTKCSRRAARSQVLV

SEQ ID NO: 18271 - protein, 451 aa, Staphylococcus epidermidis ATCC 12228
MANTRELNHKDAQYVWHPFTQMGVYAKNDNIIIEKGRGSYLYDTEGNKYLDGYASLWVNVHGHQHKKLNKAIHKQLDKIAHSTLLGSSNIPSIELAEQLVKLTPDRLQKVFYSDTGSASVEIAIKMAYQYWKNIDAKQYAKKNKFLTLHHGYHGDTIGSVSVGGIDSFHKIFKDLIFENIQIETPCLYKSKYRNEAEMLNSILNQIENILSERNDEIVGFILEPLIQGATGLFVHPHGFLKAVEQLCRKYDVLLICDEVAVGFGRTGEMFACNHEDVQPDIMCLGKAITGGYLPLAATLTSQKIYDAFLSQSHGKNTFFHGHTYTGNQLVCSVALENINLFKKKHLIGHIQKTSQTLKQRLEALQPHKNIGDIRGRGLMYGVELVENKSTQTPLDIPTVELIIRRCKENGLMIRNLENVITFVPILSMSNKEIKKMVKIFNKALHQTLGKK

SEQ ID NO: 18272 - protein, 428 aa, Escherichia coli CFT073
MKLYNLKDHNEQVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQILTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEAILGETLDLPKELAERADLPLLSHNLPADFAALRKLMMNHQ

SEQ ID NO: 18273 - protein, 385 aa, Bacillus cereus G9241
MKKIVKFCLMATLSTTIISGCSFEGNNENAKGKGNEKVEVQKTFGKYTMPDEKDKHEGTWLQWPHEYTYGEEYKQEVEPIWVKIASALTEGEKVHIVAYDEEEKERINKLLIDKGLNMDKIDFFIAPTDDVWARDSGPIFVYDNNKNLKILDPAFNGWGKKTPYKNDARIRENVSKQAGIERIDWGKFVLEGGAIELDSNGTALLTRSAVTNKNRNPDLSEKEIEKYISDLGVSNFIWLDGVPNLDITDFHIDGFAKFHNKSTIVTMKEDDLAEWGLSNKDMDTLLDAKNAAGKKYKYEYLPLSKEKVVLENGKTLDYKGSYINYYIGNTVVLVPNYNDPNDKIANDTIQKLYPDRKIVGIDVRELYKNGGMIHCVTQQQPIAMK

SEQ ID NO: 18274 - protein, 528 aa, Trichodesmium erythraeum IMS101
MESKALWQRYIDWLYYHEGLGFYVDISRIKFDDSFVEIMKPKFEKAFQEMKKLEEGKIANPDENRMVGHYWLRDLDIAPTKEIKNEISTTLEAIETFAKKVHSGEIKPSSAPKFTDILSIGIGGSALGPQFVAEALGLDDPPMEIHFIDNTDPAGIDRVLHKLSDRLKSTLVIVISKSGGTPEPRNGMIEVKAAFASQNLNFATQAVATTTPSSKLGQIAKSEGWIDIIPMADWVGGRTSELSSVGLLPAALQGIDIRAMLAGAKEMDKVTRTHEIKGNPSALLALSWYAAGKGHGEKDMVVIPYKDSLLLLSRYLQQLVMESLGKEKDLDGKVVNQGIAVYGNKGSTDQHAYVQQLRDGVLNFFVTLIEVLEDREGTSPEVEPGVTSGDYLSGFIQGTRQALYENDRDSITVTIPKVNPYNLGALIALYERAVGFYGSLVNINAYHQPGVEAGKKAAAAVLELQHKVINILKQEKSPLSLEELSEKAGAGDQIETIYKILRHLAANKRGIVFHGNVGQPDKLGVSYN

SEQ ID NO: 18275 - protein, 490 aa, Vibrio vulnificus CMCP6
MSLWSSVKFAQRYAQLPKVFYRLVTPQPLDNNRWVIWNGELAQGFALPKHADDPQLLSVFSGAEPFSAFKPLAMKYAGHQFGVYNPDLGDGRGLLLGEMQNQQGQWFDIHLKGAGLTPFSRMGDGRAVLRSTLREYLCSEAMAALGIETTRALGMMVSDTPVYREQVEQGACLIRLAQTHIRFGHFEHFFYTEQYDELRLLADNVIEWYMPECTAHDKPYLAMFEQVVARTATMIAQWQAVGFAHGVMNTDNMSILGQTFDYGPFGFLDDYEPGYICNHSDYQGRYAFDQQPRVALWNLSALAHALSPLIERDDLELALAQYEPTLGKVFSQLMRQKLGLLSQQEGDSELFNAMFALLAENHTDYTRFFRTLSQLDREDEQTVIDLFIDRDAAHGWLSRYLERVAMEQTASGEAKSAQQRCEQMRAVNPKYILRNYLAQQAIDKAQQGDFSEVHTLAKLLKNPYDEQAEMEAYAHLPPEWGKKMVISCSS

SEQ ID NO: 18276 - protein, 191 aa, Oryza sativa Japonica Group
ELSLSRSSPLFSLRISRLAHAAGRRRQPQSPLALRRLKDQGFKALRWYGEPGEAHAASASASAPTGAGGRASCARVRTGPPGDGGGGYPNPPDAAIPDAATLREQWLFAVRQYSRWYSHAWGTAILAGAAFFGLGWLVKGSNPLPSRAEPHASNAKEEGLPKVLAGEPSPRVSRSRRACGAPSRSLLPPST

SEQ ID NO: 18277 - protein, 93 aa, Hordeum vulgare
MASGQQERSQLDRKAREGETVVPGGTGGKSLEAQQNLAEGRSRGGQTRREQMGQEGYSEMGRKGGLSSNDESGGERAAREGIDIDESKFKTKS

SEQ ID NO: 18278 - protein, 563 aa, Saccharomyces cerevisiae
MSEITLGKYLFERLKQVNVNTVFGLPGDFNLSLLDKIYEVEGMRWAGNANELNARYAADGYARIKGMSCIITTFGVGELSALNGIAGSYAEHVGVLHVVGVPSISSQAKQLLLHHTLGNGDFTVFHRMSANISETTAMITDICTAPAEIDRCIRTTYVTQRPVYLGLPANLVDLNVPAKLLQTPIDMSLKPNDAESEKEVIDTILVLAKDAKNPVILADACCSRHDVKAETKKLIDLTQFPAFVTPMGKGSISEQHPRYGGVYVGTLSKPEVKEAVESADLILSVGALLSDFNTGSFSYSYKTKNIVEFHSDHMKIRNATFPGVQMKFVLQKLLTNIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEVMLPVFDAPQNLVEQAKLTAATNAKQ

SEQ ID NO: 18279 - protein, 268 aa, Photorhabdus luminescens subsp. laumondii TTO1
MSVPAFGLGTFRLKDDVVITSVKNALELGYRAIDTAQIYENEAAVGQAIEESGVAREDIYITTKIWTENLSKEKLIPSLKESIAKLRTDYVDLTLIHWPSPHNVVSVDETMNALLDAKNMGLTREIGVSNFTIDLMQQAIDAVGAEHITTNQIELSPYLQNCHVTAWAKDHGIHITSYMTLAYSKALQDEVIRRIATKHQATPAQVILSWAMALGYSVIPSSTKRENLQSNLRASVLKLDADDMAAIATLDHNERLVNPEGLAPQWDN

SEQ ID NO: 18280 - protein, 550 aa, Cryptococcus neoformans var. neoformans JEC21
MSAIIPQVQQLLGQVAQFFPPWFAALPTSLKVAIAVVGIPALIIGLNVFQQLCLPRRKDLPPVVFHYIPWFGSAAYYGEDPYKFLFECRDKYGDLFTFILMGRRITVALGPKGNNLSLGGKISQVSAEEAYTHLTTPVFGKGVVYDCPNEMLMQQKKFIKSGLTTESLQSYPPMITSECEDFFTKEVGISPQKPSATLDLLKAMSELIILTASRTLQGKEVRESLNGQFAKYYEDLDGGFTPLNFMFPNLPLPSYKRRDEAQKAMSDFYLKIMENRRKGESDHEHDMIENLQSCKYRNGVPLSDRDIAHIMIALLMAGQHTSSATSSWTLLHLADRPDVVEALYQEQKQKLGNPDGTFRDYRYEDLKELPIMDSIIRETLRMHAPIHSIYRKVLSDIPVPPSLSAPSENGQYIIPKGHYIMAAPGVSQMDPRIWQDAKVWNPARWHDEKGFAAAAMVQYTKAEQVDYGFGSVSKGTESPYQPFGAGRHRCVGEQFAYTQLSTIFTYVVRNFTLKLAVPKFPETNYRTMIVQPNNPLVTFTLRNAEVKQEV

SEQ ID NO: 18281 - protein, 449 aa, Pseudomonas syringae pv. tomato str. DC3000
MNAALNQWKDTHAARLSQYSAVRVSGRVSAVRGILLECKIPAAKVGDLCEVSKADGSFLLAEIVGFTQECTLLSALGAPDGIQVGAPIRPLGIAHRIGVDDTLLGCVLDGFGRPLLGDCLGAFAGPDDRRDTLPVIADALPPTQRPRITRSLPTGIRAIDSAILLGEGQRVGLFAGAGCGKTTLMAELARNMDCDVIVFGLIGERGRELREFLDHELDETLRARSVLVCATSDRSSMERARAAFTATAIAEAFRARGQKVLLLLDSLTRFARAQREIGIASGEPLGRGGLPPSVYTLLPRLVERAGMSENGSITALYTVLIEQDSMNDPVADEVRSLLDGHIVLSRKLAERGHYPAIDVSASISRILSNVTGRDHQRANNRLRQLLAAYKQVEMLLRLGEYQAGADPVTDCAVQLNDAINAFLRQDLREPVPLQETLDGLLRITSQLPE

SEQ ID NO: 18282 - protein, 299 aa, Zea mays
MAEIPVIDLRVAGSAAEESARLRAACERLGCFRVTGHGVPSVLLAEMKAAVRALFDLPDDAKRRNADVITGSGYVAPSPTNPLYEAFGLLDAAVPTDVDAFCALLDAPPNIRETVKAYAEKMHDVIVGVAGELASSLGLVEEHSFQDWPCQFRINRYNYTRETVGSSGVQTHTDSGFLTVLHEDECVGGLEVLDPGTGEFVPVDPVAGSFLVNIGDVGTAWSKGRLHNVKHRVRCVAPVPRISIAMFLLAPKDNSVSAPAAFVDADHPRRYKVFNYNDYRRLRLSTGEHAGEALARMAA

SEQ ID NO: 18283 - protein, 339 aa, Trichodesmium erythraeum IMS101
MIRVAINGFGRIGRNFLRCLLTRTDSQLDLVAVNDTSDPKTNAHLLKYDSMLGTLKDVDISTDENSITVNGKTIKCVSDRNPLNLPWADWGIDLIIESTGVFVTEEGASKHLQAGAKKVLITAPGKGGQIGTFVVGVNHQDYKHEDYNIISNASCTTNCLAPIVKVIHDNFGIIKGTMTTTHSYTGDQRILDASHRDVRRARAAAVNIVPTSTGAAKAVALVIPEMKGKLNGIAMRVPTPNVSVVDLVAQVEKKTFVEQVNEVMEVAAKGPMKGIIEYSDLPLVSIDYRGHDCSSIVDASLTMVMDGDMVKVIAWYDNEWGYSQRVVDLAEVVAQNWAA

SEQ ID NO: 18284 - protein, 429 aa, Chlamydophila abortus S26/3
MISLLKMPKLSPTMEVGTIVKWHKNNGDKIEFGDVLLEVSTDKAVLEHTATEEGWFRDCLVKEGTKVQIGTPIAVISSEKDESFDLDHILPKTPEPELSIENVRLEEKEEVTKAQPYVAPTQLAFQFKPEPPLSKPLSLKVDSSKSPISPLAKRVAKERNLDISGIKGSGPGGRIVEKDLDKAPTKGIAGFGYPEAPEVHPGSYHEETLSPIRDIIAQRLQAAKASIPHFYVTQKVYASPLLALLKELQVQGIKLSINDCIVRACALALKEFPEVNSGFNSVDNTIVRFETIDISIAVAIPDGVITPIVRCADRKNIGMISAEIKNLAAKAKSQSLKEEEYKGGSFCVSNLGMTGITAFTAIINPPQAAILTVGSVQEEPVVINGEIIVGSTCILTLSIDHRVIDGYPAAMFMKRLQKILEAPSVLLLN

SEQ ID NO: 18285 - protein, 180 aa, Rhodopseudomonas palustris CGA009
MTQPASAYFMEERHDPNETHTLSVIVQNEPGVLARVIGLFSGRGYNIESLTVSETEAQKHLSRITIVTTGTPMVIQQIKNQLDRMVPVYRVVDMTLSGRSIERELAMVKLRGVGDHRVESLRLAEAFRARVIDASTESFVFEITGNSSKINQFIELMRPLGLVEVVRTGVAAIGRGAEGM

SEQ ID NO: 18286 - protein, 360 aa, Physcomitrella patens
GTSGKQVVTENLRQLCVFKVTNETSPRQPWKWWDFVTDFQIRCPMEEKKYGPACAEEVIKSLSIDVEAVRKCMGNPDADEENPILRNEQDAQVGQGTRGDVTLLPTLIVNQRQYRGKLDKTAVLKAICSGYQESTEPPVCLSDSVETNECMDNNGGCLKSGTLTACQDTFRGRICQCPLVSGVQLEGDGYTHCEVYGSGRCKVLNGGCWEDTKGDIRYSACQDNQHSGCQCPEGFRGNGTAGADGCVDINECKEKTKCQCSECKCTNTWGSYNCECSGGLLYMQEHDTCINRISSQSKLGLTVSLIVLAGISVLGLGGYVVYKYRLRSYMDSEIRAIMAQYMPLDSQNDSVQTHSQDNDV

SEQ ID NO: 18287 - protein, 494 aa, Euglena gracilis
MSATQLLGGYQTISERTAPQNKLAVVGAVAVIAVASGVAAGYALNLSMPPLLPPCAPLAHGHLSRTTWHRPTPAAVAFASASEGAQTFVAPAAQSSNTFATSSVAASIGMVMGAGAVLLARMNQKPVAMNAWTGSVYGVLSQLWRSHGPSMLMSVRQDHLHPWQGILAADESRPNKTCGARLKSIGVENTEENVHSSRSCVHRTWLQRGNILGVIMYEETLYQKDKNGKPFVQIINEAGAVAGVKVDTGIAPLPGADDEGYTMGLDGLRERCQEYYRQGARFAKWRAVLRIDSKGLPSDRSILANATGLAQYAAICQECGLVPIVEPEILMDGDHDIETAAAAAERVLVAVYDALATQGVLLEGTLLKPNMVTPGVDSGIKATPETLPIFTCALLATVPAAVAGISFLSGGSSEEDASLNLNAINAIPYERKPWALTFSFGRALQASTLKTWGGKDENIARLRRCSLSVPSQWPGKYQGSGQAGESLFVKGYKY

SEQ ID NO: 18288 - protein, 488 aa, Listeria monocytogenes str. 1/2a F6854
MADVRKLKNYINGEWVESKTDKYEDVINPATGEVLCQVPISTRAELDQAAVIAEQAFEKWSQVAVPRRARVLFGFQQLLIQHKEELARLITLENGKNLSEARGEVQRGIENVEFAAGAPTLMMGDSLASIATDVEAANYRYPVGVVGGIAPFNFPMMVPCWMFPMAIALGNSFILKPSERTPLLMEKLVELFSEAGLPKGVFNVVYGAHDVVNGILENEIIKAVSFVGSKPVGEYVYKTGSANLKRVQALTGAKNHTIVLNDADLEDTVTNVISAAFGSAGERCMACAVVTVEEGIADEFLEALRTAAQNVKIGNGLDDGVFLGPVIREENQKRTIAYIEKGIEEGAKLTVDGRETGLSEGHFVGPTILEDVTTDMTIWKDEIFAPVLSVIRVKNLQEAVRVANQSEFANGACIFTNNAKAIRYFREKIDAGMLGVNLGVPAPMAFFPFSGWKSSFYGTLHANGKDSVDFYTHKKVVTARYSLKGYEE

SEQ ID NO: 18289 - protein, 181 aa, Vibrio angustum S14
MNQETLNLIKNSIQSIQDYPKPGILFRDVTSLMEQPEAYRATIAILAEKYKDQGITKIIGTEARGFLFGAPLALELGVGFVPVRKPGKLPREVIAESYELEYGKDTLEIHKDAIKPGDRVLLVDDLLATGGTIEATTNLVRRLGGIVDDAAFVINLPDIGGEARLQGLGLNVYAICDFPGH

SEQ ID NO: 18290 - protein, 488 aa, Bacillus cereus G9241
MIKNNEVGWNLDNSYATLPHSFYTEIPPTPVSSPELVKLNHSLAISLGFNPEELKKEAEIAIFAGNALPEGAHPLAQAYAGHQFGHFNMLGDGRALLIGEQMTPSGKRFDIQLKGSGPTPYSRRGDGRAALGPMLREYIISEAMYALDIPTTRSLAVVTTGEPTYRETKLPGAILTRVASSHIRVGTFQYAAARGSIEDLQSLADYTIKRHYPKIADHENRYTALLQEVIKKQASLIAKWQLVGFIHGVMNTDNITISGETIDYGPCAFMDNYDQGTVFSSIDTQGRYAYGNQPYMAAWDLARLAESLIPILHEDEEAALKIAQDEISKFSVQYEKQWFLGMKKKLGLFSNEEQDQSLIEQLLKMMEKYKADYTNTFRSLTLDTLENTPLFDSPEFKEWYKLWQSRLERQEELKENAYEMMKNNNPSIIPRNHRVEEALEAAVTSGDYSIMEKLLEALANPYAYSADQEDYCAPPAPTNRPYRTFCGT

SEQ ID NO: 18291 - protein, 325 aa, Listeria monocytogenes str. 1/2a F6854
MNLKKHSERKFDLITVGRACIDLNAVEYNRPMEETMTFSKYVGGSPANIAIGTAKLGLKVGFIGKISDDQHGRFIEKYMRDLAINTDGMVKDTEGRKVGLAFTEIKSPDECSILMYRENVADLYLTPEEISEDYIKEARVLLISGTALAKSPSREAVLKAVSLARKNDVVVAFELDYRPYTWKNSEETAVYYSLVAEQADVIIGTRDEFDMMENQVGGKNEATKAYLFQHQAKIVVIKHGVEGSFAYTKAGETFQAQAYKTKVLKTFGAGDSYASAFLYGLFSDESIETALKYGSAAASIVVSKHSSSDAMPTADEIKALIAQAE

SEQ ID NO: 18292 - protein, 813 aa, Microcystis aeruginosa PCC 7806
MMLLQDVARTSREQALILWFEEVDSKDVGLVGGKNSSLGEMIQQLTPKGINVPTGFATTAYAYRHFVEKAGLDAQLRQIFQDLDENDVQNLQEKGKQARTLILNTPFPDDLSHAIAIAYRRLCERYGDDLYHSIDVAVRSSATAEDLPEASFAGQQETYLNVQGVRGVLEACHKCFASLFTDRAISYRHHNGFDHFAVALSVGVQKMVRSDLATSGVMFSIDTETGFKNAALITAAYGLGENVVQGAVNPDEYLVFKPTLKNGYKPILDKRLGSKAIKMIYDDGGSRLTKNIRVNKLEQDQFCISDQEILTLARWTTQIEEHYSQVRGTYTPMDIEWAKDGITGELFIVQARPETVQSQKAANILKSYEIKERSQVLAVGRSVGAAIGQGKARVILSVDKINNFKPGEVLVTNRTDPDWEPIMKQASAIVTNQGGRTCHAAIIAREMGIPAIVGCNNATETIKTGQEVTVCCAEGDEGKVYLGLLPFEILETPLDNLPQTRTKILMNIGNPEKAFAFADIPAQGVGLARLEFIIANHIQAHPSALLKFHELEEGDVKDQIAELTKHYEDKPQFFVDKLARGIAMIAAAFYPKDVIVRMSDFKSNEYANLLGGKPFEPKEENPMIGWRGASRYTDPNYREAFALECRALKMVREEMGLTNVIPMIPFCRTPEEGMRVLEEMAKNGLERGVNGLQVYVMCELPSNVILADQFAQVFDGFSIGSNDLTQLTLGLDRDSALVAHLFDERNEGVKRMVKMAIETAKAHNRKIGICGQAPSDYPEFAQFLVELGIDSISLNPDSVLKTLLMVAAVEKGQ

SEQ ID NO: 18293 - protein, 322 aa, Bacillus cereus G9241
MKVLEAISNIAGKYFAFCVICIAAIAYFIPAPFLGLTSYITILLGGVMFGMGLTLKAVDFKIIATKPLPVIIGVCAQFIIMPLVAYVLAYVMNLPAELAAGLVLLGSVPGGTASNVMVYLAKGNLALSIAMTSLSTLLAPIATPLILLLLAGQWMPVNAMSMFLSIVQVIIIPIILGLVVKKFFPKTVTKGMTVIPLISVVAIIIIVSAVVSANVSSITSSGLLIFIAVMLHNAFGFLLGYITAFILRLDEGTRRAISIEVGMQNSGLGVALATAHFGPAAALPSVLAAVWHNIAGPILATIWSKNAKNTFSDENVSVNIEK

SEQ ID NO: 18294 - protein, 349 aa, Rhodopirellula baltica SH 1
MLLSQPSMNQLSSRVCNGVLDAIGGTPLVRLNRFLDRPDIELIVKWEAANPGGSAKDRPAAKMLSEALKRGEIGPETTIVESTSGNMGIGLAQVCRYHGLKFICVVDPRAQKQNLSIIEALGGTIELVTQPLKGDFLAARIAKVCELIETTPNSYWPNQYANTDNPRSHFKGTIREIDETLNGEFDVLFVATSSTGTAQGCRDFLKSRGRDVQVVAVDSVGSVLFGGSSGPRKIPGLGAGKEPRLAAGQSFDHLVRVSDLECVVGCRRAAQREAMLIGGSAGGVLMSVGRMQEQFAGKRCVAVLHDSGTRYLETVFSDEWVSESLGCTSEELNYLVGSSSFEFFEGVSA

SEQ ID NO: 18295 - protein, 210 aa, Xanthomonas axonopodis pv. citri str. 306
MKLTIPTWLTLLRIVMIPVLVVVFYLPYTWTNFASAGVFALAAITDWLDGWVARRYHQYSAFGAFLDPVADKLMVAVALFLIVQGHPTPWMAFWAAVIVGREIAVSALREWMAEIGQRAKVRVAAIGKIKTTAQMVALLCLLYSVTPGQMPTHEIWLGNLIFRAGYWTLAIAALLTLWSGFQYLQAAWPSLRADEKAAISNKPKKIESNS

SEQ ID NO: 18296 - protein, 355 aa, Rubrobacter xylanophilus DSM 9941
MSVQTLHRGQGVIRRWRGWLPEIPEQAVAELGEGDTPLVEATRLSGRVGARVYLKLEGLNPTASFKDRGMTVAMSRAAAAGRTACVCASTGNTAASAAAYAARAGMVCFVVVPAGKIALGKAVQVLAHGAEIVQIEGNFDAALRLSRRAAEELEHVALVNSVNPDRIEGQKTAAFEVCEALGRPPEALALPVGNAGNITAYWKGFTEWQRAGRAAGRPRMLGFQAAGAAPLVAGHDIESPETVASAIRIGSPASREGALRAVRESGGLIESVTDAEILEAQDLLAREEGVFCEPASAAGVAGLLKLAREGRAPAGTAVCVLTGHGLKDPDAVLSRVRLPEPVPATFEDVARRLGA

SEQ ID NO: 18297 - protein, 702 aa, Gibberella zeae PH-1
MSTPTTATATLPHYHHPHHYPQSYAHSHSHHQPYQPNPSASYRSTASNQNILPPPVSSAVSPSHSAILPPPYQLSPLAYSSTASNGIGLTHSSTSRSAHHAQEPSPRHDAGYSTATMPETAPASHAEPSRKRRRSREPDWNTFYKNGLPKEIIVIDDTPEPEANTSRKITNSTVVAPNDTTNRLAAKKRRQNEETGTVQASGYHIKYLESKNNTPVQITTPAGSSNSSSDRTNSGVNTTAPTSLSSNGQYEDAAAPLKRKRTRQQVANEAKRRDVDGLGDIFTYKPPPYPPKKAGEVNVQVIHDRHYNKNVKVDDDDGHYIVIPEAELTDKYQIVRLLGQGTFGKVVEARDRKHNKAVAVKIIRSVQKYRDASRIELRVLETLKRNDEENRNRCIHLRDCFDYRGHICIVMDLLDQSVFDFLKGNGFVPFPNSQIQSFARQLFTSVAFLHDLNLIHTDLKPENILLCDHAYQTFTYNRKIPSSSTTINRQATQRRVLLDTEIRLIDFGSATFQDEYHSSVVSTRHYRAPEIILGLGWSFPCDIWSIGCILVEFFTGDALFQTHDNLEHLAMMEAVVGSRIDSHLVQAVNKMSNRNGGNAASKYFKRLKLDYPTPETTRGSRRFVKAMKHLDHIIPGNNPFLKNFVDLLQKIFVYDPAHRITAKQALQHPWLKETAQPDDGTEAAKIRQERIRSEQRNQYVRS

SEQ ID NO: 18298 - protein, 173 aa, Methanosarcina barkeri str. Fusaro
MYLLTFKGLIYSAGGTWLNKGNLMYFGSLIFLFLVVFLIFSEQRTEKTSGLEKVSVQEAKEMIEKGDVFVLDVRTPDEFNSSHIKGATLIPLSNAFGSNLSSESLLKAHIDEVPKEKILVYCRTGRRSDTAGRMLVNAGYTQVYNMVGGIIAWTDAGYPVVSSEDTESEGSHN

SEQ ID NO: 18299 - protein, 203 aa, Aspergillus nidulans FGSC A4
MSSPKRRIETDVMKYEHSRLVRLSIPVTTNRSTGLYGLPPLRKGLVKQEFYVRFKGPEETPFAGGHWKIHVELPDQYPYKSPSIGYTVFAPIVDRLHRSGSVCLDVINQTWSPMYDMINIFEVFLPQLLRYPNPSDPLNGEAAAMLMREPKSYEAKVKEYVAKYASKDAVDDAGEDTESEDELSSAGSYESDGEEPAGRLDDV

SEQ ID NO: 18300 - protein, 441 aa, Lactobacillus acidophilus NCFM
MDTKEIKNIIIGFGKGGKTLAKFLASKNEEVLVIEKSNQMYGGTCINIACLPSKRLIIEAANGIEFTDAINSKNEMTSFLRNANYHMLADEKTVTVLDGTAKFLSDHEIEVTKNDGTKEKYSGKRIFINTGAIPNYAPIPGLIESNKVINSTEAMDQTEMPKKLTIIGSGYIGLEFASMFANYGTKVTVLDNHRDFLPREDNDISEMIKQDLENTGIKFELGVKINRVEDDTVFYEKDGQNLSIKSDRILAATGRKPNTQNLGLENTNIELTDNGAIKVNDHLMTTAQNVWAIGDVKGGPQFTYISLDDYRIIKDQLFGDGKRVISDRINIPYSVFITPALSQVGLNEKQAKKQEINYELKKLPVAAIPKARVAKDTRGLFKALVDPTTNQILGATLYGIESYELINQISMAMKAKIPANILRDQIYTHPTMSEAFNDLFK

SEQ ID NO: 18301 - protein, 193 aa, Bacillus subtilis subsp. subtilis str. 168
MTAVCLVRHGETDWNLQQKCQGKTDIPLNATGERQARETGEYVKDFSWDIIVTSPLKRAKRTAEIINEYLHLPIVEMDDFKERDYGDAEGMPLEERTKRYPDNIYPNMETLEELTDRLMGGLAKVNQAYPNKKVLIVAHGAAIHALLTEISGGDPELQSTRLVNACLSNIEFAEEKWRIKDYNINSHLSGFIK

SEQ ID NO: 18302 - protein, 345 aa, Lactococcus lactis subsp. lactis
MSKKIVTLAGDGIGPEIMSAGLSVLKAVSKKIDFEYELEAKDFGGIAIDKHGHPLPEETLQAVKNADAILLAAIGHPKYNNAKVRPEQGLLALRKELGLYANVRPLKIYPALKKLSPIRNVENVDFLVIRELTGGIYFGQHELADDKARDVNDYSADEIRRILHFAFKSAQSRPRKLLTSVDKQNVLATSKLWRKMADEIADEYPDVRLEHQLVDSCAMLLITNPQQFDVIVTENLFGDILSDEASSLAGSLGVMPSSSHGFNGLALYEPIHGSAPDIAGKGIANPVSMILSIAMMLRESFGQEDGAAMIEKAVTQTFTDGILTKDLGGTATTKEMTEAILKNCQ

SEQ ID NO: 18303 - protein, 269 aa, Oryza sativa
  misc_feature (161)..(161): Xaa can be any naturally occurring amino acid
  misc_feature (175)..(175): Xaa can be any naturally occurring amino acid
  misc_feature (191)..(191): Xaa can be any naturally occurring amino acid
  misc_feature (203)..(203): Xaa can be any naturally occurring amino acid
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPVLKASGSRSIVFISSVCXLVAVFSGSLYAMTXNGAINQLTKNLACEWXRDNIRSNSIAPXLLANKDFEGAVVSRTPLRRVGEPEEVSSLVAFLCMPGSSYITAQTISVDGGNRYKSSVSMMVLAEQ

SEQ ID NO: 18304 - protein, 590 aa, Oryza sativa Japonica Group
MNSAAAAAACASAPAWVVGGGAGGGARSARGPCGIRVCGLGGEAVALRSLRISQGAAVRRAAVAARAAAENGVAGSGGFDYDLVIIGAGVGGHGAALHAVEEGLKTAIIEGDVVGGTCVNRGCVPSKALLAVSGRMRELHDEHHMKSLGLQVSSPGYDRQAVADHANNLASKIRSNLTNSMKALGVDILSGFGAIVGKQKVRYGKVGFPDKEITARNIIIATGSVPFVPKGIEVDGKTVFTSDHALKLESVPDWIAIVGSGYIGLEFSDVYTALGSEVTFVEALDQLMPGFDPEIAKLAQRVLINPRNIDYHTGVFASKITPAKDGKPVQIELIDAKTKEHKETLEVDAALIATGRAPFTKGLGLENINVVTQRGFIPVDERMRVMDADGNVVPNLYCIGDANGKLMLAHAASAQGISVVEQISGRDHILNHLSIPAACFTHPEISMVGLTEPQAREKADKEGFEISVVKTSFKANTKALAENEGDGLAKLIYRPDTGEILGVHILGLHAADLIHEASNAIALGTRLQDIKFAVHAHPTLSEVLDELFKAAKLQPREGPERKPKHPPQPLLKVLSFVTRLLTSQKRNRQP

SEQ ID NO: 18305 - protein, 266 aa, Listeria monocytogenes str. 1/2a F6854
MNRIGFIGAGNMGTAMIRGLAQANLVKREEIIVGGRNLEKLKPLEAEFTGLQITTDTEKLVEQADIIILAVKPYTIPEILTSVKEKLTPDKIIISVAAGVTIQDLEELTSAKTKIVRVMPNTPALVGEAMSSVSPNTNVTSEELKEVTAIFTSFGEAEVVSENLMDAVIGVSGSSPAYVYMFIEALADGAVLSGMPRDKAYKFAAQAVLGAAKTVLETGEHPGKLKDMVTSPGGTTIEAVKSLENDGFRSTVINAVQAAAKKNSSM

SEQ ID NO: 18306 - protein, 451 aa, Rhodopirellula baltica SH 1
MSSEHFDLVVLGTGPSGGTVATKIAKAGKRVALVDSRTFGGVCALRGCNPKKVYVNAGQLVDQIHRGDGKLISDASVKIDWKQLHAFKMEFTQPVAEKKEQSFQEDGIETFHGVARFVSPDTIDVVGTKLTADRFLIGTGGRPRELSFDGAEHVTRSDEFLELESMPEHVVFIGGGYISMEFAGVVARAGSRVTVIEMNNQILSGFDPDLVNQLTDSLREHGIRFQMNAEIIGIDKSADGHLQVHLANEQSPIVCGLVVHGAGRVPNIDELCLSQGEIEHGEKGIAVNQFMQNPTNPRVFATGDCADNGMPRLTPVANEDARIAAKNLFSETLERTPDYGQVPKVAFTIPSIASVGLSEEAARDSNDNLTVLSDDISSWGSVRKTGPTVAGYKILIDSKTDAILGAHLLGPSAEETISLFALAMKFNLTATDMKSTLFAFPTFASDVRSML

SEQ ID NO: 18307 - protein, 253 aa, Zea mays
MIEQSKHLQTVMAAPVGANAIGAGDELLLLGTWSSPWVIRARMAMGLKGLSYEYLEEDLGNKSGLLLRSNPVHKKVPVLIHGGRPVCESLVILQYLDEAWPTAGPPLLPADPYDRATARFWAAYINDTFFPAFRALFRSLTDEQRGEALRNALPAVETLERTLAECSAGKAFFGGDAVGIVDVALGSHLVWIRVVDEVGGTSLLDAAKVPGLAAWAERFLAVDAVKKVMPDATKVLEQYKGFRAKWIAGAGCT

SEQ ID NO: 18308 - protein, 109 aa, Oryza sativa
APHTVPCKVTGKCGSVTVRLIPAPRGTGLVCAPVPKKLLTMAGIQDCWTCSRGSTATLGNFAKATFNAISNTFCYLTPDLWKETVFQKTPYQEHSDFLQNFEKKSLGHK

SEQ ID NO: 18309 - protein, 1049 aa, Debaryomyces hansenii CBS767
MSSISNSPSLKPKSSSKSRRSKQHLKKFTPGGSTGQKLVFSVDDDPGEQGNVEANKNKVKFDTEYLEGYNDALKALYLKKSRNIINQEPNTSYTPVYDEDNNEEQIEVDDMLKSTNDAENIRSYKSSDIESNLINNIISAKENLKLLKFIENNKDKELPIDQVLGEEDEENGSSDDDSQSVKSGSSVESLNLRERQDAINSTHPFGIKIWKPSLYKKKRSVAARAEEDIHDYDSHASAYRIFWGVYVCNFLWSITFGLALFVLCLIGAFVVFILSGFAINRQLRPYVKLLMKLGKYWLSPFGKFVLLTKDKNYLDEDQLEGRTISEYQKWREQEEGRLFFAPPRRYTNTNNETAPLLKDHKGRPLSDAYSSLDTADSSANALEDPFESDDEEIQDLELADIKKRFFGRGSWSSGRFMFYLYFYVILQPIIWIVGIICWFFVFTIPIAKVAKILCDHLRRHPLALHFELEREYYANIANKDARNKRKHQLIILCTYKCCGLHYYKYTIDGTNVFFYNLLAAVIFVIFDYFVLKERLGWDTWFTDSSFLFCACLFSIIPLAYFIGQAVASISAQSSMGLGAVINAFFSTIVEIFLYCVALNQSKAKLVEGSMIGSILGGVLLLPGLSMCGGALKRKTQRYNPRSAGVSSTMLLFAMVTMFAPSLFYQIYGSYDVMCKKCDADFDLLDAGDCTKCRFVQPSFTLDTLYYTIIKPFSMIVAAALFSAYVCGLFFTLRTHASLIWATNSHEQAALNKREDYIRSPSTASLDHSLQLKSGKPPLKQANLSPSISATYSSGVDTHKQSGTHKVQPLTQSPSLDAYKSRQAVSRNNSSQGNVNKQKTFNENEAVNKPVGQNKDAESEIEENGGHDAANWSRNKSAIILLGATLLYAIIAEILVDNVDSVLSNFPINPKFLGLTVFALVPNTTEFLNAISFAIGGNVALSMEIGSAYALQVVLIQIPSLVLYSIFKEFDNVDKIFSLVFPRWDIIATLISIYLFTYIYAEGKSNYFKGVILILIYAVVLMGFWYNDKIEDLNDGYTSNPRQPGEGIFW

SEQ ID NO: 18310 - protein, 355 aa, Rubrobacter xylanophilus DSM 9941
MSQRFRVLLLPGDGIGPEVVAAARRVADAAAARFGLTLEYEERRIGAAAIREEGAPVSKETLRRAGEADAVLLGAVGDPEFDGGEVRPEAGLLALRRELGTFANLRPVAAIPALSGSSPLRPGVAEGVDLLIVRELTGGAYFGEKEEGEERASDLSVYTRGEVERVARVAFEAARGRRGRVASVDKANVLATSRLWRRVVGEVARDYPDVALEHVLVDAAAMHLVTDPGRFDVILTENLFGDILSDEAAVLPGSMGMLPSASLGEPGSPGIFEPVHGSAPDIAGKGVANPYAAILSAAMMFRHGLGRPEAAEAIERGVEAAVAAGCLTPDLGGSSGTEEAAEAVARRVAAEEGAA

SEQ ID NO: 18311 - protein, 518 aa, Glycine max
MASNNHSPSLEILVRGPEDFSLWTGPPFANGQPSVKLEKVKCINAKFSDDGSKLMVTKSNSLISVYDCRIAEEIRAFEVPNVVAAALSPKGTYLQTFQKPSGPQEKNVTLWSIETGAAVHQQSQKNMTKANWPAIQFSSDEATACRLATNEVQFFDTGDFSKGVVCRLRVPGVAAAELSSLPGSHVAAFVPESKGVPASVQIFACGNASQSQPVARRSFFRCSTTQLKWNHGSTGLLVVVQSDVDKTNQSYYGESKLCYLTTDGMHEGLVPLRKDGPIHDAQWSYSGLEFAVVYGFMPAKATLFDKKCNPLLELGTGPYNTIRWNPKGKFLCLAGFGNLPGDMVFWDYIDKKQLGATKAEWSVTSEWSPDGCYFMTATTAPRLQVDNGIKIFHYNGSLYFKKMFDKLYQVDWKPESPGKFGDIAELIKSLNLVQLEDKKPSGQGPPKSTQTSTKASSANPTTQKPAAYRPPHAKNASAIQAELFGETTAETLSKNALRNKKKREKQKEKKAASDASSS

SEQ ID NO: 18312 - protein, 550 aa, Glycine max
  misc_feature (61)..(62): Xaa can be any naturally occurring amino acid
  misc_feature (65)..(65): Xaa can be any naturally occurring amino acid
  misc_feature (512)..(512): Xaa can be any naturally occurring amino acid
MRKISSHCSIPDLDDSDLLRLLEKPKLNIERQRSFDERSLSELSIGLARAGLDNYDTYSPXXRSXFNTPASSTRNSFEPHPMVADAWESLRKSLVYFRGQPVGTIAAVDHQSEEVLNYDQVFVRDFVPSALAFLMNGEPEIVRNFLLKTLHLQGWEKRVDRFKLGEGVMPASFKVLHDPIRKTDTLIADFGESAIGRVAPVDSGFWWIILLRAYTKSTGDLSLAESPDCQKGMKLILTLCLSEGFDTFPTLLCADGCCMVDRRMGIYGYPIEIQALFFMALRCALSMLKQDDAEGKECVERIVKRLHALSYHMRSYFWLDFQQLNDIYRYKTEEYSHTAVNKFNVIPDSIPDWVFDFMPMRGGYFIGNVSPARMDFRWFALGNCVAILSSLATPEQSMAIMDLIESRWDELVGEMPLKISYPAIESHEWRIVTGCDPKNTRWSYHNGGSWPVLLWLVTAACIKTGRPQIARRAIELAESRLLKDGWPEYYDGKLGRYIGKQARKYQTWSIAXGYLVAKMMLEDPSHLGMISLEEDKQMKPVIKRSSSWTC

SEQ ID NO: 18313 - protein, 242 aa, Triticum aestivum
HYRTSLYKKAGWYRSGIPGISSTHASDGLVYAGIGWCIWRSKEDLPDELIFHINYLGADQPTFTLNFSKGSSQVIAQYYQLIRLGFEGYRNIMDNCQENAMVLKEGLERTGRFNIVSKDQGVPLVAFSLKDSSRHDEFEISEFLRRFGWIVPAYTMPPDAQHVTVLRVVIREDFSRTFAERLVIDIEKVLHELDALPSRSSGPALQHPNGDTVSEKDLARQREVVSVWKRAVAARKKTQGVC

SEQ ID NO: 18314 - protein, 165 aa, Desulfitobacterium hafniense Y51
MKRWISLLVENEIGVLARVSSLFSGKSYNLDSLTVGATEDNSISRMTISLTSDDQTFEQIKKQLNRSVEVIKVVDFTDVAIHMKELMFIKISDCTQQEMIQLTHIISVFALKMIDYDADTAIIECVQTEDRNNNLIRLFEKTFPNRFSIVRGGGVAIEAINLSNG

SEQ ID NO: 18315 - protein, 388 aa, Dehalococcoides sp. CBDB1
MKLSKRIENLPPYLFVQISKKIAEKRAKGEEVISFAIGDPDLPTPKHILAELCKAAEDPSNHRYPETEGLPVLRKAMAEWYQKRFGVKLNPDTEVLPLIGSKEGIGHAAWCFLDPGDIALVPNPAYPVYAISSQLAGAEVFNLPLNKGNNFLPNLEAIPQNILSKAKVLWINYPNNPTGAVAGLSFFQEVANFAAKHNLAVCHDGPYSEIAFDGYKPVSFLEADGAKDVGIEFHSLSKSYNMTGWRIGMAVGNAKMIDALRRFKSNLDSGIPQAIQLMAIAALNGSQEIINQNCAIYQRRRDRLVESLRNIGMEVTAPKASLYIWAPVPESYTSASFATELLDKTGVVVTPGTGYGTAGEGYIRLSLTVPDEQIEKGIAKLAGYKKSS

SEQ ID NO: 18316 - protein, 565 aa, Photorhabdus luminescens subsp. laumondii TTO1
MELEHESKRPLYIPYSGPILLEFPLLNKGSAFTEEERRNFNLHGLLPEAVETIEEQAERAYRQYLDFKNDADKHIYLRNIQDTNETLFYRLLDAHLNEMMPIIYTPTVGEACEHFSDIYRRARGLFISHPNKAHIDDMLQNATKQNVKVIVVTDGERILGLGDQGIGGMGIPIGKLSLYTSCGGISPAYTLPVVLDVGTNNPQRLNDPLYMGWRHPRITGKEYDEFVDEFIQAVKRRWPNVLLQFEDFAQKNAMPLLNRYRHEICCFNDDIQGTAAVTLGSLIAASRAAGRQLKDQTVTFLGAGSAGCGIAEQIVAQMKSEGLSDEQARARIFMVDRFGLLTDKLPNLLDFQNKLVQKSSSLAKWDVNNDSISLLDVVRNAKPTVLIGVSGQAGLFTEEIIREMHKHCERPIVMPLSNPTSRVEARPEDIINWTDGAALVATGSPFNPVKYKDQEYPIAQCNNAYIFPGIGLGVIASGAKLVTDGMLMAASRTLANCSPLAQEGQGPLLPLIDDIQEVSRKIAKQVAKEAQIQGVATVTSDGALDEAIERNFWKPEYRVYKRTSF

SEQ ID NO: 18317 - protein, 392 aa, Vitis vinifera
MPNLMDPHQHQPIGQADETSPPPSNTAATSCRCCGGPTTCPPPPAWSDISPPPSYRPIRAPAINLPPSNSQQAIILAPVPQAQKTPVVSPPYLFQIPVKRIQTPDDIRHFHDSDSGKNFLGFVVSLSESIRSHKISDPCHQSPILNSILSILQSLIDWVDEIPPVQQSSRYGNLSFRVWQSRLFDNSEQLMLQFLPDDLRSATVELVPYFADSFGNSSRIDYGTGHETNFAAWLYCLARLGLLKEEDYQALVSRVFVKYLELMRKLQFVYCLEPAGSHGVWGLDDYHFLPFIFGSSQLIDHKYMKPKSIHNQDILDNFSKEYMYISCIAFVKQVKKGLFAEHSPLLDDISGVPNWNKVNSGMLKMYKAEVLEKVPIMQHFLFGWLIKWYDHC

SEQ ID NO: 18318 - protein, 253 aa, Dehalococcoides sp. CBDB1
MRQIIIAGNWKMNTTLSEACTLVQSMKCELERIEGIEKIICPPFISLYPIKTILENSSIKLGAQNLFYQEKGAYTGEISPLMLKELCQYVIIGHSERRAYFGETGQVVNQKIKAALQAGLLPIVCVGEKPEENENGQTRQVLETQLKEALDGLNLSCIIIAYEPIWAIGTGKAATASEANSAIGYIRRVLGDTLGNAAAQTSPILYGGSVNEKNITEILSQTNIDGALVGGASLKAESFVSICRQAAVIQNKH

SEQ ID NO: 18319 - protein, 397 aa, Dehalococcoides sp. CBDB1
MENLTIRDLNFSGKKALVRVDFNVPINEETGTINDDSRIRAAIPTIDYLLDHQAKVILCSHLGRPDGMIVESMRLAPVAKRLSEILRQEVFTASDCIGDEVAAKVDALEDSQVLLLENLRFHPEEEANDPIFAKKLADLADIYVDDAFGTAHRKHASIVGVAKYLPAVAGLLLEKELNALGKVLEHPPRPFMILLGGAKVSDKVGMLENVMDKVDTILIGGGMAATFLKAQGLEIGDSLIDDSLDTAKMLMDKAKSKNVKIILPDDVLVTFDKIGPEARAENVSVENIPHTAKIVDIGLLTITHFTKHLEKCKTVFWNGPMGIYEIPQFSEGTRAMVNTMTRLHATTIIGGGSTAEIVTELNIASKMSFVSTGGGASLKFLSGEKLPGVEVLAKKNE

SEQ ID NO: 18320 - protein, 313 aa, Mentha x piperita
MAINLSHINSKTCFPLKTRSDLSRSSSGRCMPTAAAAAFPIIATAAQSQPYWAAIEADIDRYLKKSITIRPPETVFGPMHHLTFAAPATAASALCLAACELVGGDRSQAMAAAAAIHLVHAAAYVHEHLPLTDGSRPVSKPAIQHKYGPNVELLTGDGIVPFGFELLAGSVDPARTDDPDRILRVIIEISRAGGPEGMISGLHREEEIVDGNTSLDFIEYVCKKKYGEMHACGAACGAILGGAAEEEIQKLRNFGLYQGTLRGMMEMTNSHQLIDENIIGKLKELALEELGGFHGKNAELMSSLVAEPSLYAA

SEQ ID NO: 18321 - protein, 647 aa, Dehalococcoides sp. CBDB1
MNTGLEISILHNLEMSKLLDTINSPSDLKKLSLDELRELAVQIREELVNRVTLNGGHLASSLGVVELTIALHRVFESPKDKIIWDVGHQSYAHKLLTGRREQFATLRQHGGLSGFTCRDESPHDPFGAGHASTSISAGLGMAVARDLAKEDYSVISVIGDGAISGGMSFEAINNAGHLHTKFIVILNDNGMAISPSTGALSKFLNNVRFDPRFEFAKRNAKQTITNMPFGKAVWAFTKSIKRKFEKSMLPGSLWEELGFIYLGPVDGHNIRELEAALKRAKDFESKPVLIHMITKKGKGYDDAEADAVKYHGISPKSGGLKSSHGLSYSQVFGQTLHKIMSQNPQVVAITAAMTDGCGLGEIAAAFPDRVFDVGICEQHAVTFAAGMATQGYIPVVVIYSTFLQRGFDQIIHDVCLQKLPVVFAIDRGGIVGDDGKTHQGIFDLSFMSLIPDMVVSAPSDENDLQHLIYTAVNSGKPFALRYPRGFGEGAEIESSLHNIPIGQNEILVNGSDVAILATGKSVAFAKDALEILTESGIKPTLVNNRYISPLDSELVLKIAQSHKYLVTVEENVISGGLGSRINTLLAEAGLVNKIKIANIGIPDKFVEHGNQSLLRAKYGLDGKGIAQRVLSLVGNPNEMKHPQIICP

SEQ ID NO: 18322 - protein, 540 aa, Zea mays
  misc_feature (16)..(16): Xaa can be any naturally occurring amino acid
RPGAVVPLLPTRPPTXSENIIEQSVWPILLAESLKALGGLGLLSLGGKYFIRRVFEFVAESRSSEAFVALCLLTVAGTSLITQKLGFSDTLGAFLAGAILAETNFRTQIEADIRPFRGLLLGLFFVTTGTSIDMQLLIREWPNVLSLLGGLIVIKTLIITAIGPRVGLTLKESVRIGLLLSQGGEFGFVVFSLANRLGVLPLELNKLLIIVVVLSMALTPLLNEVGRRVAGMIDERSEEKEKPAEMVNYGATEPVVILGFGEMGQVLAKFLSAPLSFGIEKDTEGWPYVAFDLNPVVVKSARKSGFPVLFGDGSRPAVLQSAGITFPKAIMVMYTGKEKTIESVSRLRQAFTAVPIYARAQDLSHLLDLKKAGATDVVLENAETSLQLGSILLKGLGVMSDDVSFLSKLVRDSMELQAQEALKDIGDQEVDIMKPLQVRVSDLVESNGNSSRMVAPEQSLSLSSRPDIKAIKPPVANGIPDMKVENDKTGYDFDRVDSENGVTYCLLESDDQSDEASSTSKEMIDQSADTRVNVNDKKIL

SEQ ID NO: 18323 - protein, 715 aa, Vibrio angustum S14
MNKKKTLLLLVIVSLIALWLHFDLGQYLTLEFIKQEQLALQAKIESQLFTAYLSFFVLYIAVTALSLPGAAILTLLGAALFGFWPSLIIISFASTIGATLAFLSSRYILQDWVQQRFGQRLATINQGIENEGAFYLLTLRLIPVVPFFLINLLMGLTPIKTRTFFFVSQLGMLAGTAIYVNAGTQLSNINSLSEIISFPVLISLVLLGIFPLFAKTLINYIKGQKVYSGWQKPTAFDQNLVVIGAGAGGLVSSYIAAAVKAEVTLIERHKMGGDCLNTGCVPSKALIRVAHSAYELQQAQQFGIEAKIEKIDFKAVMTRVHNVIKDIEPHDSIERYSKLGVNCVQGDATILSPWEVEVNGKVITTRNIIIATGASPLLPNISGLNTVNPLTSDNLWQLDTLPKKLLILGGGPIGCELAQAFNRLGASVILVEMADQLLNREDKDAADLIYQKLTHEGVRVLLKHKAVSFVEKGSAQYHHVKLDDLTTEQTVDVEFDQVIVALGRVANTKGFGLEQLKLATNPQGTIKVNHYLQTQYPNIYAVGDVAGPFQLTHAAAHQAWYASINSLFGTFKKFKADYSVLPAVTYTAPELARVGLNEKEAISQNIDYRTYTYPISDLDRAIADNAAEGFVKVLTPPNSDKILGVTIVGHHGGELLAEFTLAMRYKLGLNKILSTIHPYPTMSEATKYTAGVWKQANAPQKLLAMVKRYHQWMRK

SEQ ID NO: 18324 - protein, 350 aa, Cryptococcus neoformans var. neoformans JEC21
MAAPQATLGADLEPPATDLITLTRHILSQQYALGESATGDLTMLLIAIQVTSKYIASNVRKARLINLVGLAGASNVQGEDQKKLDVLSNDIMVNALSASGKCSVMVSEEVDEAIIVSGIKGTYCVVFDPLDGSSNIDAGVNVGTIFGVYKVQEGSRGTVEDVLRPGREMVAAGYTMYGSSCNLVLSTGNGVDGFTLDESLGEFILTHPAIKIPSRGKIYSFNEGNSLHFYPPTNDYLNSIKYPENGKPYSARYIGSMVADVHRTLLYGGIFGYPDDKKSKDGKLRMLYEAFPMSFLTEQAGGVATTGSQRILDIVPTSIHGRCPVFLGSKEDVEDLKKFYVNYKDDSRKW

SEQ ID NO: 18325 - protein, 258 aa, Pseudomonas syringae pv. tomato str. DC3000
MFERLREDIQSVFHRDPAARNAFEVLTCYPGMHAIWLHRFAHVLWRNGWKWLARVVSSFGRWMTGVEIHPGARIGRRFFIDHGMGIVIGETAEIGNDVTLYQGVTLGGTSWNAGKRHPTLEDGVVVGAGAKVLGPFTVGAGAKIGSNAVVTKAVPAGATAVGIPGRIIVKSDDETEARRKVMAEKLGFDAYGVSGDMPDPIARAIGQMLDHLQAVDGRLEGMCDALGRLGSDYCAKDLPQLRNEVFDCVKDAREDTVD

SEQ ID NO: 18326 - protein, 309 aa, Lactobacillus acidophilus NCFM
MSTIFNSVTELVGNTPLLKLNRVVPEDAADVYVKLEFENPAGSVKDRIALAMIEKAERDGKLKKGGTIVEPTSGNTGIGLAMVAAAKGYHIIIIMPETMSVERRKLMKGYGAELILTPGSDGMKGSIAKAEELVKEKGYFMPMQFDNPENPNIHELTTGPEIIAAMNGIGKAIDAFVAGVGTGGTLSGIGRALKKENPNTKVYALEPSESPLLKDRKAGKHGIQGISAGFIPSNLDKNIYDGVIEVSTDEAMNTARKTAKKEGFLPGISAGANVHGAIELAKKLGKGHTVVTVIPDGGDRYLSTALFND

SEQ ID NO: 18327 - protein, 391 aa, Escherichia coli CFT073
MSEYSLEGVLIKSALLVLEDGTQFHGRAIGATGSAVGEVVFNTSMTGYQEILTDPSYSRQIVTLTYPHIGNVGTNDADEESSQVHAQGLVIRDLPLIASNFRNTEDLSSYLKRHNIVAIADIDTRKLTRLLREKGAQNGCIIAGDNPDAALALEKARAFPGLNGMDLAKEVTTAEPYSWTQGSWTLTGGLPEAKKEDELPYHVVAYDFGAKRNILRMLVDRGCRLTIVPAQTSAEDVLKMNPDGIFLSNGPGDPAPCDYAITAIQKFLETDIPVFGICLGHQLLALASGAKTVKMKFGHHGGNHPVKDVEKNVVMITAQNHGFAVDEATLPANLRVTHKSLFDGTLQGIHRTDKPAFSFQGHPEASPGPHDAAPLFDHFIALIEQYRKTAK

SEQ ID NO: 18328 - protein, 203 aa, Escherichia coli CFT073
MERTLTTVSYYAFEGLIPVVHPTAFVHPSAVLIGDVIVGAGVYIGPLASLRGDYGRLIVQAGANIQDGCIMHGYCDTDTIVGENGHIGHGAILHGCVIGRDALVGMNSVIMDGAVIGEESIVAAMSFVKAGFRGEKRQLLMGTPARAVRSVSDDELHWKRLNTKEYQDLVGRCHAALHETQPLRQMEENRPRLQGTTDVTPKR

SEQ ID NO: 18329 - protein, 139 aa, Bacillus cereus G9241
MTRVRDFMSTHIVQCTPLDNVYEAAVKMKEESIGLIPVVENEQVVGLVTDRDLVVRGIAEKHPGSNKITNVMTTNIVSIAPDDSIEKATELMAQYQIRRLPVVENGQLVGMLALGDLATREAADDQAGFALGEISEHKE

SEQ ID NO: 18330 - protein, 482 aa, Zea mays
MEETVANVEGAQGQLLKYLNNISSNRWLMMKIFFVLMASSRISNTPVTYQAREDEAAAPQRVACTVWASCKWQCVTLHAGGVKAAARVPSSASSLRPSQNPSNRASTPTRIPIQVRSPGGEDTRRRFVPADRRAGQIQIRVRGPLGSPRRGPPRRSGSMVGGGRRGGAAEEVKLNTGNVFAALESLKKKKKGDKGKAAGSSSRKKHGEGAAQRQEPPQKELFWAPAPLTTKSWADVEDDDDDDYFATTAPPRPVWGTAGEPAKEEEDVDDAVRAALQEDIESDDGDLDDEVDDGPEDEPEHDAEDAPAEPAIRTAAAPAAPPKDTERQLSKKELKKKELAELDAVLAELGLSANSSSTAQDAEKKGTNQIGDAEKKEDAPAPPESKASKKKKKKDKSSKEGKETQEALDGSEETASAGPDEDTSAVDVKERLKKMASMKKKKSSRETDTAAKIAAAEAAARSARLAAAKKKEKSHYNQQPVR

SEQ ID NO: 18331 - protein, 236 aa, Triticum aestivum
  misc_feature (185)..(185): Xaa can be any naturally occurring amino acid
  misc_feature (196)..(196): Xaa can be any naturally occurring amino acid
  misc_feature (206)..(206): Xaa can be any naturally occurring amino acid
  misc_feature (208)..(208): Xaa can be any naturally occurring amino acid
  misc_feature (215)..(215): Xaa can be any naturally occurring amino acid
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILSTGATSFXGGMKMGREVYXNLKSVIKEEXTXQDATNVXNEVVLLLNLRETKEGLELLNT

SEQ ID NO: 18332 - protein, 185 aa, Vibrio parahaemolyticus RIMD 2210633
MRLNIPNILSLLRLFLIPVFVVVFYLPYSWAPFAAAMVFWVAGFTDWLDGMLARKLGQTSRFGAFIDPVADKVLVATALILITEHYHTIWVTIPAVTMIAREIIISALREWMAEIGKRASVAVSWVGKVKTVSQMFALWVLIWRYDEWMVWLGFAALYVATFLTYWSMVQYLAAAKDDLLNEEHH

SEQ ID NO: 18333 - protein, 349 aa, Arabidopsis thaliana
MSTTAKEAPSSLFSLLPNDIVLNILARVPRWYHPILSCVSKNLRFLVSSSELKITRSLLEKDRFYVCFQEHSNSPSLTTYHWFSFTENRRCLVSIPFTSPVEPYFATLTLGPEIYFVGKSRSMWILDSRSGKLRQGPRPLVACDQAAVGLVNDKIYVFGGIDDMNKRYYEGIHAQVFDLKTQTWHVGPNLSVKLACLNRSVVTPSLGRKIYVRGTDRDVTIYDIKDGKCDKIIPADDFSSGDMCVVDNVIYMYYHNVGLMWYESKEKQWSVVHGLEFNGVFNSIAIAEYNGKLAFLWHDRNKREIWCAMINLYGSSKVAIRGRVEWSHRLLSDLPSNYNFKHFTICTDY

SEQ ID NO: 18334 - protein, 356 aa, Oryza sativa Indica Group
MENMRSENFNQGVSMEGVKHAPEMANTNRRALRDIKNIIGAPHQHMAVSKRVSLMGLNFLTCFSKPAAKNQSGHRPMTRKFAATLANQPSSAPLIYMQKLEMAPIGSERQKRTADSAFHGPADMECTKITSDDLPLPMMSEMDEVMGSELKEIEMEDIEEAAPDIDSCDANNSLAVVEYVDEIYSFYRRSEVHYKLELLDETLFLTVNIIDRFLARENVVRKKLQLVGVTAMLLACKYEEVSVPVVEDLILICDRAYTRTDILEMERMIVNTLQFDMSVPTPYCFMRRFLKAAQSDKKVGQKHTGASIFVLIYSSFAMECSKMMVELHQKAGHGKLTGVHRKYSTFRLLPIKSVGT

SEQ ID NO: 18335 - protein, 706 aa, Gibberella zeae PH-1
MTTMTNNLDTPWVAHGSEEIEEADEPPEINFKKQQFTSTDFQRTTIRPSTEKKSSLLTKAINGNSDDDLYIPQNTTSTRQRRRSLVSNISFASTAELTSDTGFTSPSRPSTPSPTLPDMAMLRLHDERAPVPTHVSLLGAAVKLQQEKTEEPKKRSIQFACGGKPTAPVQPPRSQPMEKAPSAQEAPRKSCIKFACPARPASTQNTPPRSIGINTNRKDATPKAESPSTPKRNIALSAPRQITPRRHSMSRPKFLRADSSDLATDSSQFHEFASGTTREDDWIRRDSTVVVAVKLTINDTLVKENNIRRLATEAEQEAEEEDELDNDDDADVDDDDDEEDEDEDELDVDLDEDDDEDEDEDDDSDGYHTDEETGFADSDDDDEDDDMRLWTPGAKSVVHIGSGATLMRRPSIHEMQSDSSIATVNSQRASRRTKRVRYAEEAPDLPDSTDFVCGTLDEDRPLEEAYLSCLAARRNEKLRVIPQDIDPSFPASEPEEENDGEIFNPVHHESDADEFFGSMEDLHQDRDRSRRRRKSEHASPKRFRSPPPKRLHSPPPKARARSPKPLFSRQSPRRAKSPAPMRKPITTPLGSPRCGQVNFNLAGRPGLTHTKSLPRGGAMCHQRKHPRNKMTHDNDTHIRGAIDIVKGLESKRQRRKEKFHQKYCNRARRGKIPEPKPVPGRGTERMRELGLLMAGKKDQTNYVLSI

SEQ ID NO: 18336 - protein, 265 aa, Mentha x piperita
MASVKKLAGKVAIVTGGASGIGEVIARLFAERGARAVVIADMQPEKGGTVAESIGGRRCSYVHCDITDEEQVRSVVDWTAATYGGVDVMFCNAGTASATAQTVLDLDLAQFDRVMRVNARGTAACVKQAARKMVELGRGGAIICTASATANHAGPNLTDYIMSKRGVLGLVRSASLQLGVHGIRVNSVSPTALATPLTATIGLRTAADVESFYGQVTSLKGVAITAEHVAEAVAFLASDEAAFVTGHDLAVDGGLQCLPFVAVAK

SEQ ID NO: 18337 - protein, 285 aa, Coprinopsis cinerea okayama7#130
MPGRLQHKSAVITGAGSGIGLESSLLFAQEGANLILVDVNLPNAEKAASLISERFPNVKAIPFKADVSKESEVEAAIALAVKEFGRLDIMFNNAGIMHPEDDNALNTEERIWDLTMDINLKGVWWGCKHAILAMRKNPTDESKGLRVGGSIINTASFVAIMGAATPQLAYTASKGAVLAMTRELAMVHAREGIRLNSLCPGPLKTPLLMDFLNTDEKKQRRLVHLPMGRFGEAVELANAALFLASDESSYITGTDFKVDGGLSSAYVTALGEPALPPPASLVNAA

SEQ ID NO: 18338 - protein, 128 aa, Pseudomonas syringae pv. tomato str. DC3000
MAYSEKVIDHYENPRNVGKMNAEDPDVGTGMVGAPACGDVMRLQIKVNEHGVIEDAKFKTYGCGSAIASSSLATEWMKGKTLDEAETIKNTQLAEELALPPVKIHCSVLAEDAIKAAVRDYKQKKGLL

SEQ ID NO: 18339 - protein, 220 aa, Dehalococcoides sp. CBDB1
MYENIAQNVRDILAELPPDVVLVAAVKKRQPAEILAAIAAGVKIIGHNYLSEAEETYPFIGDKAEWHFIGKLQSNKCKKIVRLFSVVETVDSFEIASELNRRAAEIDKVMSVFIEINSGREKQKSGVLPEETVELAKRISGLSNLKLAGLMTMGPALEDPEELRTIFRLTKIKFDEIAVMGLPNTELKFLSMGMSVSYKVAVQEGTNLVRLGTRIFGNRP

SEQ ID NO: 18340 - protein, 615 aa, Medicago truncatula
MVLSSRIFSTPIIVSFSLLVISCGITYGTETDILCLKRVKESLKDPNNYLQNWDFNNKTEGSICKFTGVECWHPDENRVLNLKLSNMGLKGEFPRGIQNCSSLTGLDFSLNSLSKSIPADVSTLIGFVTTLDLSSNDFTGEIPVSLANCTYLNSIKLDQNQLTGQIPLEFGGLTRLKTFSVSNNLLSGQVPTFIKQGIVTADSFANNSGLCGAPLEACSKSSKTNTAVIAGAAVGGATLAALGVGVGLLFFVRSVSHRKKEEDPEGNKWARILKGTKKIKVSMFEKSISKMNLSDLMKATNNFSKSNVIGTGRSGTVYKAVLDDGTSLMVKRLLESQHSEQEFTAEMATLGTVRHRNLVPLLGFCLAKKERLLVYKNMPNGTLHDKLHPDAGECTMEWSVRLKIAIGAAKGFAWLHHNCNPRIIHRNISSKCILLDVDFEPKISDFGLARLMNPIDTHLSTFVNGEFGDLGYVAPEYTTTLVATPKGDVYSFGTVLLELVTGERPTHIAKAPETFKGNLVEWIMQLSVNSKLKDAIDESLVGKGVDHELFQFLKVACNCVSSTPKERPTMFEVYQFLRDIGSRYNFITEDEIMILTDNGDAGKLEELIVAREGHN

SEQ ID NO: 18341 - protein, 493 aa, Mentha x piperita
MAALLVFFSVSLILLAVLFHKRKSSLSSRKRPPPSPLRLPVIGHFHLIGALSHRSFTSLSKRYGEVMLLHFGSAPVLVASSAAAAREIMKNQDVIFASRPRLSIFDRLMYSGKGVAFAPYGEHWRNARSMCMLQLLSAKRVQSFGGIREEETSAMIEKIRRSKPTTVVNLSEMFMALTNGVIHRAVLGRKGDGGDDFNRILIKVIKLLGSFNVGDYVPWLSWINRINGVDAEVEKVGTKLDGSMEGILRKYRRKKVGDDETNFVDTLPQFQRESKDTDPVEDDVIKALIFDMVSAGTDTTFAALEWTMAELIKNPRTLKTLQNEVREVSRNKGGITEDDVDRMPYLKAVSKEILRLHPPFAILLPRELTQDANMLGYDIPRGTVVLVNNWAISRDPSLWENPEEFRPERFLETSIDYKGLHFEMLPFGSGRRGCPGSTFAMALYGLALSKLVNEFDFRLGNGDRAEDLDMTEAPGFVVHKKSPLLVLATPRQS

SEQ ID NO: 18342 - protein, 175 aa, Lactobacillus acidophilus NCFM
MAIDFSKYIASVQDFPNKGIVFRDITPILQNGELYRAATHELAEYAKSRNADVIVGPEARGFIVGCPVATELGLGFVPARKPHKLPREVERASYDLEYGSNSLEMHKDAIKPGQRVVLCDDLMATAGTLRASKELIENLGGKLVGAAFYIELPDLKGREKLPDVDIYSLVKYHGA

SEQ ID NO: 18343 - protein, 384 aa, Lactobacillus acidophilus NCFM
MAQEDYYKVLGVDRDASDQEISKAYRKLAKKYHPDLNHEPGAEEKYKQVNEAYEVLHDKQKRAQYDQFGSAGVNGQGGFGGAGQGFGGAGFDTSGFGDFGDIFGDIFGQGARQQRVDPTQPQRGQDLDYTLTIDFMDAINGKKTQVSYTRDETCETCGGNGCEKGTHPITCDKCHGTGVMTVTQQSMLGMIRRQTTCDKCNGRGVIIEHPCKTCGGKGTVERKNTIEVDIPAGIDNGQQLRYQGQGEAGRNGGPYGDLYISYRIKPSKDFERRGQNIYTEVPISFAQATLGDEITVKTVHGDAKLTIPAGTQPNKKFTLRGQGVPYLRGNGNGDQITTVNIVIPKHINDKQKEDLTNFVHDGGGNITPQEKGFFERLKDKLSGE

SEQ ID NO: 18344 - protein, 141 aa, Pseudomonas syringae pv. tomato str. DC3000
MAVQRTFSIIKPDAVAKNVIGEITTRFEKAGLRVVASKLKQLSKAEAEGFYAEHSARGFFGDLVAFMISGPVVVQVLEGENAIALNRELMGATNPKEAAAGTIRADFADSIDANAVHGSDSEAAAAREISYFFAATEVTAR

SEQ ID NO: 18345 - protein, 403 aa, Bordetella petrii
MLPLHSHPSGRHFLQIPGPTNVPDRVLRAIDHPTIDHRGPEFGELGKAVLAGMKKIFQTEADVIIYPASGTGAWEAALVNTMSPGNKVLMAETGHFATLWKRMAERLGLQVEFQAGDWRHGADPEQIRKRLAADDGREIKAVCVVHNETATGVISDVAAVRKAIDAAGHPALLMVDTISSLGSIDYRHDEWGADVTVAGSQKGMMLPPGLSFNAVSAKALEASKTAALPRSYWDWKEMLAINPRGYFPYTPATNLLYGLYEALEMLLGEGLENVFARHRRHGEATRRAVRAWGLEILCQKPEEYSPALTAVLMPEGHSADAFRKTVLTHYDMSLGQGLSKLADKVFRIGHLGDFNDLTLCGTLSGVEMGLKQAGVPHNAGGVQAALDYLAQTSRPRPDQAQAR

SEQ ID NO: 18346 - protein, 298 aa, Agrobacterium tumefaciens str. C58; identical to SEQ ID NO: 943

SEQ ID NO: 18347 - protein, 435 aa, Bordetella petrii
MSAKATRIDLFTFNTVPMRAFHLSWMAFFVCFFAWFASAPLMPVIAREFALTPGQVADINIAAVAATILVRLIVGPLCDRYGPRRVYAGLMASGAIPVVALAFATDYASVLACRLGIGAIGASFVITQYHTSVMFAPNVVGAANAASAGWGNAGAGGAQALVPMVLAALIALGLDESSAWRAALVVPGAALLAMAVVYWRYTQDYPQGDALELRRRGVAVDGGKKGGWASFAAACANYRVWLLALTYGACFGVELFVHNIAAMYYVDRFQLSLGQAGLAAGIFGLLALFARALGGILSDRAAQRGGLAWRPRVLAAMMLGEGLGLLWFAHAQGVAEAIVAMVAFGLFTHMACGATYALVPFVDRKALGGVAGIVGAGGNVGAVAAGFLMKSVGNVQQTVTVLAGFVILSVLCAIAVRFGAGHQEEAGAAGVVLAR

SEQ ID NO: 18348 - protein, 132 aa, Trichodesmium erythraeum IMS101
MVNKIKKSEKEWKEQLTPEQFNVTRKKGTERPFTGEYYNNKEKGIYKCVCCGIDLFSSEAKYDSGTGWPSYWKPINQENIKEETDWSLFMRRTEVLCNNCDAHLGHVFPDGPPPTGLRYCLNSAALKFSKGE

SEQ ID NO: 18349 - protein, 523 aa, Nostoc punctiforme PCC 73102
MALDSTTSEVVIAEQLKQFLLVLSVSLGVATLPQIFSWLRRIPYTLLLVIVGLGLAFVNVRLVNLSPELILMIFLPPLLFEAAWNLKWSDLKRDLFPICLYAVVGVIISIAGVAIGLHQFAGLELSIALLVGASLSATDPVSVTALFRELGASKRLRTLMEGESLFNDGMAVVAFGLLVALPLGNAKLDLQSALLEFFQVVGIGISVGGLIGFGISYLTQRFDLPLVEQSLTLVSAYSTYLITEYLGGSGVIGVVTTALILGNFGSRIGMNPRTRFIVTEFWEFLAFFVNSIVFLLIGDQIRFAVLGDNLKTIAVTIAAMVVGRAVSIYALSSLSNWLAKSNIPLSEQTVLTWGGLRGSVSIALALSVPAILPQREEIIATVFGVVLFTLLVQGLTTQPLLEKLQLLGSQPLHQKYTEAIARQVALQRALEYLETTQKRPGIQPEFYHYQKTLLSGEITFLQEEIDKLLDEYPNLQEFTTEELRGELLAIEADTYAEFVRAGKLNKELSPFLQTTHDVTDGKE

SEQ ID NO: 18350 - protein, 418 aa, Bacillus pumilus SAFR-032
MATEQMKMPQLGESVTEGTISKWLVSPGDHVNKYDPIAEVMTDKVNAEVPSSFTGTITKLSAEEGDTLQVGEVFCEIEVEGSSQQSAEEEAAPEQSEAPEADQTKEDQSQKKRYSPAVLRLADEHSIDLAAVQGTGAGGRITRKDLLQLIESGGMQEKVAPVNEQAIKPEPVQSSKPKAAPSISTMPGDNELPVTPIRQAIAANMLRSKHEIPHAWTMMEVDVTNLVTRRNQLKDQFKAKEGFNLTFFAFFVKAVAQSLKEFPEMNSMWAGDKIVQKKAINVSIAVATDDALFVPVIKDADEKTIKGIAKEIHELASKVRQGTLKQSDMEGGTFTVNNTGSFGSVQSMGIINYPQAAILQVESIVKRPVIVNGMIAARDMVNLCLSLDHRVLDGLVCGRFLQRIKQILEGIDEQTSVY

SEQ ID NO: 18351 - protein, 490 aa, Arabidopsis thaliana
MITGNEFYTVMCAMAPLYFAMFVAYGSVKWCKIFTPAQCSGINRFVSVFAVPVLSFHFISQNNPYKMDTMFILADTLSKIFVFVLLSLWAVFFKAGGLDWLITLFSIATLPNTLVMGIPLLQAMYGDYTQTLMVQLVVLQCIIWYVIKLLSVLYSFTLYTLLLFLFELRAARLLIRAEFPGQAAGSIAKIQVDDDVISLDGMDPLRTETETDVNGRIRLRIRRSVSSVPDSVMSSSLCLTPRASNLSNAEIFSVNTPNNRFFHGGGGSGTLQFYNGSNEIMFCNGDLGGFGFTRPGLGASPRRLSGYASSDAYSLQPTPRASNFNELDVNGNGTPVWMKSPAAGRIYRQSSPKMMWESGQRHAAKDINGTFSLKDVSFSFFVSTDTTAFSQFSSLFVFFFIIGSVPEKEISFRDALKAAPQATAAGGGASMEEGAAGKDTTPVAAIGKQEMPSAIVMMRLILTVVGRKLSRNPNTYSSLLGLVWSLISFK

SEQ ID NO: 18352 - protein, 462 aa, Zea mays
MDRLPESTRSMRKYASEAGGLRAARQGPHGRSLTARTAHSMSTTALRTKSKSAASLLRRVPFAPLRPVLANLQEVFLGTKLAVLFPAVPLAIAAQCAHFGQVWVFTLSLLGLIPLAERVSFLTEQIAIYTGPTVGGLLNATCGNATELIIALFALMGGQIEVVKCSLLGSVLSNLLLVLGTSLFCGGVVNLGSDQPYDRTQADVSTGLLILGVLCQSLPLMLRYAVGAGEHSVAAATTVLDLSRACSVVMLLAYVAYLFFQLKTHAQLFEPQEVDDGCEAEEDEQAVIGFASGFFWLAFNTVLIAILSEYVVGTIEPTSKSWGLSVSFISIILLPIVGNAAEHAGAIIFALKNKLDITLGVALGSATQISMFVVPLSVIVAWIAGIQMDLDFKLIETGSLFVSVIVTAFTLQDGSSHYLKGILLLLCYIVIGACFFVTRQPASNNNGAGLSLPTGTLSAQAA

SEQ ID NO: 18353 - protein, 487 aa, Hyphomonas neptunium ATCC 15444
MSDTSPNFPQGRGLYYGGAWHEPKQSGSVEVRSPATDELLCTINVGSAADVRPAVEAAHKGYLEWRDVRPMERARLMKEMGVRIRSNARELALIESMDGGNPISEMMGDVLGTAAMLDYFAGLVTEMKGSSVPYGPEAVSFSVREPYGVVARIAPYNHPLGFSVAKAAAPLAAGNAVVVKPPEQAPLSALRAAELFDGLLPAGVFNVLSGDRDLGAALVSDPGISIVALVGSVPTGKAVMRAAADSLKRVMFELGGKNALIAFPDSDPEKIARAMVAGMNYTWCGQSCGSVSRAFVHEDIYDEVLARMPQYLEKHKPGLPSDPKTTMGALVDRQALDRVTRYIASAHEDGARLIHGGVPPEDPALAKGCFMPPTVFADVTMGMKIAREEIFGPVQAVIKWSDEAEMLRQVNQVEYGLTCAVWTRDVARAHRIISRVEAGFCWINDVARHALGSPFGGYKQSGIGREECLEELLSFTQEKNVWINLNN

SEQ ID NO: 18354 - protein, 665 aa, Arabidopsis thaliana
MVEGFSLSLMFLLVSHFFVSGVMSRNFTIENKCDYTVWPGFLTMTTAVSLPTNGFSLKKGESRVINVPPSWSGRLWGRSFCSTSSTGNFSCATGDCGSGKIECSDSGARPPTTLIDFTLDATDGQDFYDVSVVDGYNLPLVVVPQRLGSGRTCSNVGCVVNLNKTCPSELKVMGSSNKEHPIACMNACQKFGLPEFCCYGEYGKPAKCQPTLYSTNFKNECPLAYSYAYDNENNTFRCSNSPNYVITFCPNDISSMSQPSKETNGGTKQKSSWKLKLIVGVSAALTLMILIVVVIIVRTKNMRNSEWNDQNVEAVAMLKRYSYTRVKKMTNSFAHVLGKGGFGTVYKGKLADSGRDVAVKILKVSEGNGEEFINEVASMSRTSHVNIVSLLGFCYEKNKRAIIYEFMPNGSLDKYISANMSTKMEWERLYDVAVGISRGLEYLHNRCVTRIVHFDIKPQNILMDENLCPKISDFGLAKLCKNKESIISMLHMRGTFGYIAPEMFSKNFGAVSHKSDVYSYGMVVLEMIGAKNIEKVEYSGSNNGSMYFPEWVYKDFEKGEITRIFGDSITDEEEKIAKKLVLVALWCIQMNPSDRPPMIKVIEMLEGNLEALQVPPNPLLFSPEETVPDTLEDSDDTSTFFNPSHFERGTLLDSEDVLQHGSRSS

SEQ ID NO: 18355 - protein, 404 aa, Frankia sp. EAN1pec
MRAVVWHGVGDIRLDTVTEPKIEQPTDAVVRITTAAICGTDLHFVRGTVPGMKPGLIIGHEGVGVVEEVGQSVRNFRRGDRVLLSAVLGCGSCTYCRSGYFAQCDDINPYGRRTGSAFYGAPRDNGSFDGLQAEYARVPYAHTNLFRLSDSISDDQAIPLSDIYPTGYFGAVIAEVSDGDVVAVWGCGPVGQFAVLSSFQRGAARVIAIDGHADRLDRAQALGAEVVNFNEEDPVEAILDLTRGIGPDRAIDAVGVDAESPKSGPAAARAREQDDQHREELRQIAPETHAHNGHWKPGDAPTQAHSWAVESLAKAGTLGIIGVYPPTDRFFPIGTAMNKNLTINMGNGNHPRYIPKLLDMVESGVVHPQKMVTQHEPMRDVLAAYEEFDLRRPGWLKVALDLTS

SEQ ID NO: 18356 - protein, 375 aa, Rubrobacter xylanophilus DSM 9941
MKSRAALLYGEGQEFRVEEIEVDDPKQNEVLVHLAATGLCHSDYHMVTGEYGPLHFPMIGGHEGAGVVEKVGPGVTRVSPGDHVLLTFIPACGHCRFCSMGLSFLCDRGAAILQGPQLDGTFRMHTADGQDAGQFCCISTFSEYTVVPEASIVPIDRDLDLTKVCIVGCCVPTGFGSAVNKADVQPGETVVVFGIGGVGINAVQGAAVKGASKVVAVDPVDFKLETAEELGATHTINPNERDPVQTVVDLTNGVGADKAIITIDNVLPEHVGQAFKAIRKGGRVVVTGVARYDHQHIDVPPYELTLFAKEVVGTMYGDSPVNADLARYLELYRTGKLKVDELITRTYSHDEINQGYRDMLDGKNIRGVIVYDWAR

SEQ ID NO: 18357 - protein, 567 aa, Zea mays
  misc_feature (410)..(410): Xaa can be any naturally occurring amino acid
MVVSVAATGPGTDAEPVSSTFFASRYVRDPLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCERPNIVTGANVQVCWEKFARYFEVELKEVKLSEGYYVMDPVKAVEMVDENTICVAAILGSTLTGEFEDVKQLNDLLTDKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEVLLFFDRFFLLLIEHSEYICAGEQKGVLSDTFLEGESFLFLFSLCAAVTASQSGRVFFFLVPLLSGVXGYRNIMENCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVATATAEQSGDGVVAKKSVLEIEREVAARWMNAVNKKKTGVC

SEQ ID NO: 18358 - protein, 329 aa, Agrobacterium tumefaciens str. C58
MRQASVLAPHTNGPTVTAGEILVEIMATTVGDGFLEPQTLIGPFPSGAPAIFIDQVARCGGTAGIIAAVGDDDFGRLNIERLRRDGVDVSAITTIADRPTGSAFVRYRENGARDFVFNIAHSAASETRMTDEAQALIEKAGHVHIMGSAFAIAGIGAIILEAVKSVKARGGSVSFDPNIRKELAQGDEGRRLIDDLLAVTDLLLPSGEELQAASGLDDEEAAIEKLLAAGIGEIVLKRGANGASHFSRAHGRIDAPGLEVEEIDPTGAGDCFGATYLTCRRLGMRPGKALVYANASGAHNVTKRGPMEGAASLAELDAFMAAQLSEEVL

SEQ ID NO: 18359 - protein, 495 aa, Mentha arvensis
MAALLVFFSLSLILLVVLFHKRKSSLSSRKRPPPSPLSLPVIGHFHLIGALSHRSFHSLSKRYGEVMLLHFGSAPVLVASSAAAAREIMKNQDPIFASRPRLSISDRLLYSGRDVAFAAYGEHWRHARSMCVLQMLSAKRVQSFRRIREEETSAMIEKIRRSQPSAVNLSEMFMALTNGVVHRAALGRKDGGGDDFNRTLNKFIELLGSFNVGDYVPWLAWINRINGVDAEVEKVFKKMDGFMEGILQEYRKKKVGDDATTNFVDTLLQFQRESKDTNPVEDDVIKALILDMFVGGTDTTFAALEWTMAELIRNPRTLKALQNEVREVSRNRGGITEDDVDKMPYLRAVSKEILRLRPPFPSLVPRELTQDANLLGYDVPRGTLVLVNNWTVSRDPSLWENPDEFRPERFLETSIDYKGLHFEMLPFGSGRRGCPGITFAMSLYELALSKLVNEFDFRLAMANGDRVEDLDMTEAPGIVVHKKSPLLVLATPRQS

SEQ ID NO: 18360 - protein, 708 aa, Dehalococcoides sp. CBDB1
MDLSWLVWTAGLIAVLFALYLIRDVMRRDSGTPAMQDIAGRILEGAVAFLRRQYRTIAILAVVAAVAVGAVVGLLGGERGLEAYGITGIGIAWRTALAFLAGALCSGISGVIGMYISVKSNLRCAAAAAKGGLSEAVTVAIRGGAVSGFLIVALSLLGVAGIYYMYGGNPEVTPHLIIGFGFGASFVALFAQLGGGIYTKAADMGADLVGKVEAGIPEDDPRNAAVIADLVGDNVGDCAGRGADLFESTAAENIGAMILGITLYLATGNAAWVLFPLVVRAFGILASIVGIMFVRGKDNESPMNALNRGYFTAVGLSIIGIFIANQTIGGDLWLFGAGVIGILTSVAMVFITQYYTEFRYKPVQEIANASRTGAATNIVSGTAVGLETAMPTAITIGAALLLSYWMGGQTGIAGGAVFGTAAATMGMLMTCPFILAMDTFGPITDNANGVIEMAGVGGKVRKITDRLDAVGNTTKALTKGYALASAGLAAFLLFEAYLERVAFLRGETEMMAVDLSRIEVFVGGLLAVALVYFFSAVAIKAVGRTASKIIEEVRRQFKADPGILAGTSRPDYARAVDITAAAGLREMIFPGLLPVLSPIVLGVFLKLTGYDSAMAIAGFLMVGTIGGIMMAAYLNNSGGAWDNAKKYIETGEMLEKDGSPVLKHTVTHAATVVGDTVGDPFKDTAGPSIHVLIKLLSTITLVLAPLFI

SEQ ID NO: 18361 - protein, 494 aa, Mentha arvensis
MAALLVFFSLSLILLVVLFHKRSSSLLPSRKRRLPPSPSRLPVIGHLHLIGSLAHRSFHSLSKRYGEVMLLHFGSAPVLVASSAAAAREIMKNQDMIFASRPRLSISDRLLYSGKDVAFAAYGEHWRHARSMCVLQLLSAKRVQSFRRIREEETSAMIEKIRRSQPSVVNLSEMFMALTNGVVHRAALGRKDGGGDDSNLTLNKFIELLGRFNVGDYVPWLAWINRINGVDAEVEKVFRKLDGFIEGILREYRMKNDTHASTNFVDTLLQFQRESKDTNPVEDDVIKALILDMFAAGIDTTSAVLEWTMAELIRNPRTLKTLQNEVREVSRNKGGITEDDVDKMPYLKAVSMEILRLHPPFPSLLPRELTQDANMLGYDVPRGTLVLVNNWAISRDPSLWENPEEFRPERFLETSIDYKGMHFEMLPFGSGRRGCPGITFAMSVYELALSKLVNEFDLRLGNGDRAEDLDMTEAPGIVVHKKSPLLVLATPRQS

SEQ ID NO: 18362 - protein, 481 aa, Medicago truncatula
MKNKFKDFSRLLSSIREEASSVPTSILILTTLAAVSGSYVFGSAVGYSSPAQSGITDDLNLGVAEYSLFGSILTIGAMVGAIVSGSLADYAGRRAAMGFSELFCILGWLAIAVSKVAWWLYVGRLLLGCGMGILSYVVPIYIAEITPKDLRGGFTAVHQLMICFGVSLTYLIGAFLNWRLLAIIGTIPCLAQLLSLSFIPESPRWLAKVGRLERSESTLQHLRGKNVDISEEATEIREFTEASQQQTEANIFGLFQLQYLKSLTVGVGLIILQQFGGVNAIAFYASSIFVSAGFSRSIGTIAMVVVQIPMTALGVILMDKSGRRPLLLISASGTCLGCFLVSLSFYLQDLHKEFSPILALVGVLVYTGSFSLGMGGIPWVIMSEIFPINVKGSAGSFVTFVHWLCSWIVSYAFNFLMSWNSAGTFFIFSTICGLTILFVAKLVPETKGRTLEEVQASLNPYQQVSNKEMNLAYDPVTELHA

SEQ ID NO: 18363 - protein, 620 aa, Escherichia coli CFT073
MDSHTLIQALIYLGSAALIVPIAVRLGLGSVLGYLIAGCIIGPWGLRLVTDAESILHFAEIGVVLMLFIIGLELDPQRLWKLRAAVFGGGALQMVICGGLLGLFCMLLGLRWQVAELIGMTLALSSTAIAMQAMNERNLMVTQMGRSAFAVLLFQDIAAIPLVAMIPLLAASSASTTMGAFVLSALKVAGALALVVLLGRYVTRPALRFVARSGLREVFSAVALFLVFGFGLLLEEVGLSMAMGAFLAGVLLASSEYRHALESDIEPFKGLLLGLFFIGVGMSIDFGTLLENPLRIVILLLGFLIIKIAMLWLIARPLQVPNKQRRWFAVLLGQGSEFAFVVFGAAQMANVLEPEWAKSLTLAVALSMAATPILLVILNRLEQSSTEEAREADEIDEEQPRVIIAGFGRFGQITGRLLLSSGVKMVVLDHDPDHIETLRKFGMKVFYGDATRMDLLESAGAAKAEVLINAIDDPQTNLQLTEMVKEHFPHLQIIARARDVDHYIRLRQAGVEKPERETFEGALKTGRLALESLGLGPYEARERADVFRRFNIQMVEEMAMVENDTKARAAVYKRTSAMLSEIITEDREHLSLIQRHGWQGTEEGKHTGNMADEPETKPSS

SEQ ID NO: 18364 - protein, 382 aa, Pseudomonas syringae pv. tomato str. DC3000
MIDSKLPNVGTTIFTVMSQLAAETGAINLSQGFPDFDGPQALRDAVCRHITQGHNQYSPMTGLPALRQQVAAKIARSYGREINPDSEITITPGATQAIFCAIHSVIRPGDEVIIFDPCYDSYEPAVELAGGRCVHVQLGLDDFSIDWQKLSDALSPRTRMIVINSPHNPSGALISRAELDRLASLIADRDIYLLSDEVYEHLVFDGARHVSVLDHDELYQRAFVVSSFGKTYHVTGWKTGYVVAPPALTAELRKVHQYVSFCGVTPLQYALADFMAEHPEHIDELPGFYQAKRDYFCNQLAGSRFSFKPVGGTYFQLVDYSQIRPDLNDVDMALWMTREHGVASIPISVFYQSPPPGQRLIRLCFAKQEDTLRLAAEKLCAI

SEQ ID NO: 18365 - protein, 474 aa, Bacillus pumilus SAFR-032
MATEYDLVILGGGTGGYVAAIRASQLGLKTAIVEKEKLGGTCLHKGCIPSKALLRSAEVYQTVKRAADFGVEANGIALQFANVQKRKAEIVEKLAGGVKHLMKQGKIDVYEGIGRILGPSIFSPMPGTISVEMANGDENEMLIPKQVIIATGSRPRVLPGLEADGTHILTSDDALELPELPQSMLIVGGGVIGIEWASMLNDFGVKVTVIEFADRILPTEDHDISKEMEKLLSKKGITFVTNAKVLPDTVKKQEDLVTIQAEKDGDILTFEAEKLLLSVGRVPNIEGIGLENTDIQTEKQGIVVNEHYQTKESHIYAIGDVIGGLQLAHVASHEGMIAVEHMAGQNPKPLDETLVSKCVYSHPETASVGLTEQAAKEQGFEVKMGKFPFMAIGKALVYGESDGFVKIIADQKTDDILGIHMIGPHVTDMISEAGLAKVLDATPWEVGQTIHPHPTLSEAIGEAALAVDGKAIHF

SEQ ID NO: 18366 - protein, 505 aa, Zea mays
MYRVASGLGALKRHGANAQMMNAAIRCASTSVAQRSSGGFWTWLTGARSNEIPPPDFTLPGVTIPPPLPDHVEAGKTRVTTLPNGVKIASETSAGSSCSVGVYVDCGSVYEAPETTGASQLLKTMAFTTTANRSELRVVREIEAIGGSAKASASREMMSYTYGALKTYMPEMVEVLIDCVRNPAFLDWEVKEQILRLQAELAKSSSFPENFLLEALHSTGYSGALANPLIVPEYSVSRLNADVLEQFITENYTASRIVLAASGVDHDELVSIAEPLLSDIPSVSGTTRPKSTYIGGEYRRSADSSNTDVALAFEVPSGWLKEKDCVTVSVLQALLGGGGKFSWGRQGKGLHSRLKRLVNEFDQIKSISAFKDVHSNTGIFGIHTSTDASFVPKAIDLAARELISLATPGQVDQSQLDRAKASAKSAILANLESQASLTEDMGRQVLAFGERKPAEHLLKAIDGVTMKDITSVAEKIISSPLTMASHGNVLNMPTYESVSGKFRSK

SEQ ID NO: 18367 - protein, 375 aa, Streptococcus pneumoniae R6
MASSKPSSISYFSVAFDALCIINRIGEVMADDKLRATPAARKLADDLGINLYDVSGSGANGRVHKEDVETYKDTNVVRISPLAKRIALEHNIAWQEIQGTGHRGKIMKKDVLALLPENIENDSIKSPAQIEKVEEVPDNVTPYGKIERIPMTPMRKVIAQRMVESYLTAPTFTLNYEVDMTEMLALRKKVLEPIMEATGKKTTVTDLLSLAVVKTLMKHPYINASLTEDGKTIITHNYVNLAMAVGMDNGLMTPVVYNAEKMSLSELVVAFKDVIGRTLDGKLAPSELQNSTFTISNLGMFGVQSFGPIINQPNSAILGVSSTIEKPVVVNGEIVIRPIMSLGLTIDHRVVDGMAGAKFMKDLKELIETPISMLI

SEQ ID NO: 18368 - protein, 401 aa, Vibrio angustum S14
MTIEILVPDLPESVADATVATWHKQPGDAVSRDEVLVDIETDKVVLEVPAPEDGVLEAIFEGEGTTVLTKQLIGKIKVGAVAGEPTKDVPTEAEASPNKRNTASLTEETSEALSPAVRRLLSEHGIDAGAVKGSGVGGRITREDVEAYLKIQSAPTVTKAPVVDAPLAHRSEKRVPMTRLRKRVAERLLEAKNSTAMLTTFNEVNMKPIMDLRKQYKDIFEERHGIRLGFMSFYVKAVVEALKRYPEVNASIDGDDIVYHNFFDVSIAVSTPRGLVTPVLRDCDKLSLAEIEKGIRELAIKGRDGKLTVEDLTGGNFTITNGGVFGSLMSTPIINPPQAAILGMHKIQDRPMAVNGQVEILPMMYLALSYDHRLVDGRESVGYLVTIKELLEDPTRLLLDV

SEQ ID NO: 18369 - protein, 388 aa, Vibrio angustum S14
MNLHEYQAKQLFAEYGLPVPEGYACDTPQQAAEAAGKIGGSKWVVKCQVHAGGRGKAGGVELHETKDGIKQFAQNWLGKNLVTYQTDANGQPVTKILVEEASNIANELYLGAVVDRGSRRIVFMASTEGGVEIEKVAEETPELIHKAAIDPLVGPQPYQGRELAFKLGLKGDQIKQFTKIFMGLANMFAEYDLALLEINPLVITGDNNLLCLDGKINIDSNAMYRQPKLREMHDPSQEDEREAHAAQWELNYVALDGNIGCMVNGAGLAMGTMDIVNLHGGQPANFLDVGGGATKERVTEAFKIILSDSNVKAVLVNIFGGIVRCDLIADGIIGAIAEVGVKVPVVVRLEGNNAEVGAAKLADSGLNIIAATSLTEAAEKVVAAAEGK

SEQ ID NO: 18370 - protein, 196 aa, Vibrio parahaemolyticus RIMD 2210633
MANIVFIDNFDSFTYNLVDQFRSLGHSVKIYRNHIPAETIEQAINELENPVVLLSPGPGAPSEAGSMPELIQRMKGKVPMIGICLGHQAIVEAYGGTVAGAGEIIHGKVSMMEHQDHAIYQNLPSPLAIARYHSLVATKVPDSLTITAEVDNLVMSVVHEQDKVCGFQFHPESIMTTYGATLLGNAIEWALEKNNA

SEQ ID NO: 18371 - protein, 89 aa, Capsicum annuum
LGGGANVVNPGYTKGDGLGAEIIGTFVFVYTVFSATDAKRNARDSHTPILAPLPIGFAVFLVHLATIPITGTGINPARSLGAAIIFNQD

SEQ ID NO: 18372 - protein, 389 aa, Rhodopseudomonas palustris CGA009
MKALTWHGKNDIRCENVPDPKIQHGRDAIIKVTACAICGSDLHLMDGVMPSMQSGDVLGHETMGEVVEVGSENTKLKVGDRVVVPFTISCGECFFCQRGFYSGCERSNPNAKMAEKMWGHSPAGLFGYSHMLGGYAGGQAEYLRIPYADVGPIKVPDGLTDEQVLFLSDIFPTGFMAADFCNLKGGETVAVWGCGPVGQMAIKSAFLLGAERVIAIDTVPERMELARQSGAIVINFMDDDVYDKIQDLTNGRGADACIDAVGTEAAATASLDSMIDRVKVATFMGTDRPHVLRQAIHCCRNFGTVSIVGVYGGLLDKIPMGSAINRGLTMRMAQTPVQQYLPQLLGRIQQGEIDPSFVITHRATLDEGPELYKTFRDKKDGCIKVVMRP

SEQ ID NO: 18373 - protein, 493 aa, Gibberella zeae PH-1
MAPPQEALDFVDFVNASPTPYHAVQSASARFEKAGFKLIRERDSWASTLRPGGKYYLTRNASTIVAFTIGRKWRPGNPVAIVGAHTDSPCLRLKPVSKKTNVGFLQIGVETYGGGIWTSWFDRDLSIAGRVLVKEGDNFVQKLVKVDKPLVRIPTLAIHLHRQTNFDPNKETELFPIAGLVAAELNKDVKEKSEEKKDDGEEDEEFKPLKVITERHHPQVLDVIAAEAGVEVSDIVDFELVLYDTQKSCIGGLADEFIFSPRLDNLGMTYCSVEGLIESVKNESSLEEDGTIRLTVCFDHEEIGSTSAQGANSNLLPSVIRRLSVLPGNRDASSEGSYEAVHHEGEDATAYEQTLSRSFLVSADMAHSVHPNYAGKYESSHQPAMNGGTVVKINANQRYATNSPGIVLIEECARTAGVPLQLFVVRNDSPCGSTIGPGLAAALGMRTLDLGNPQLSMHSIRETGGTADVGYGIRLFREFFEKYGSLEPKILID

SEQ ID NO: 18374 - protein, 371 aa, Streptococcus pyogenes MGAS315
MALTAGIVGLPNVGKSTLFNAITKAGAEAANYPFATIDPNVGMVEVPDERLQKLTELITPKKTVPTTFEFTDIAGIVKGASRGEGLGNKFLANIREVDAIVHVVRAFDDENVMREQGREDAFVDPVADIDTINLELILADLESINKRYARVEKMARTQKDKESVAEFNVLQKIKPVLEDGKSARTIEFTDEEAKVVKGLFLLTTKPVLYVANVDEDKVANPDGIDYVKQIRDFAATENAEVVVISARAEEEILELDDEDKEEFLEAIGLTESGVDKLTRAAYHLLGLGTYFTAGEKEVRAWTFKRGIKAPQAAGIIHSDFERGFIRAVTMSYDDLMTYSSEKAVKEAGRLREEGKEYVVQDGDIMEFRFNV

SEQ ID NO: 18375 - protein, 535 aa, Colwellia psychrerythraea 34H
MAKIISKINTRSQDFLDNAAHMQTQVDDLREKLGEIKLGGGERSRERHIGRGKLLPRDRVNALLDDGSAFLEFSQLAAYQVYDDNVPSAGIITGIGRVAGQECVIVANDATVKGGTYYPLTVKKHLRAQSIAKENNLPCIYLVDSGGANLPNQDDVFPDKEHFGRIFFNQANMSANNIPQIAVVMGSCTAGGAYVPAMADESIIVKEQGTIFLAGPPLVKAATGEVVSAEDLGGADVHCRTSGVTDHYAQNDHHALEIARSAVKNLNRVKPVTIDFKQVVEPEYPTDDIYGIIPKDTRQPYDIREVIARIVDGSEFDEFKALYGNTLVCGFANIYGYPVGIVANNGVLFGESAEKGAHFIQLCAQRKIPLVFLQNITGFMVGKQYESGGIAKHGAKMVTAVATAQVPKFTILIGGSFGAGNYGMCGRAYDPRFLFMWPNSRISVMGGEQAAGVMAQVTRDKKEKLGESWSEAEEQSFKQPIIDNYEHQGHPYYASARLWDDGIIDPADTRQVLGLAISASLNKTIEETKFGIFRM

SEQ ID NO: 18376 - protein, 592 aa, Frankia sp. EAN1pec
MSGFELPRNLSCAGAGRRRSPGRAEGRLAPQGSEHETDGLRTWAGRGAVFLLDALASRRGDQRAAARTLGAGHDSRRGTSGTRAGRGRRRTAAPTVDHPVRRAPFRPLQDMCDAWAAEFAERLDAAPGAIDPGLARAAIELFHTLPGSVEREVLLCTDPHAGNILAARREPWLVIDPKPYVGDPAYDPVQHMLNRDEGLDLDPDRVNRWLFARCAQQSIDVAGRLGPGARLDMGTDRRRDGEHPGGTQEVRSEQADRTEAAMSRRKAHGCDGPTAHLSRPISPVLTAAREEAEQARHGYVGPETHEANRSRALRPDLVGSTSPSGWLISAHTSSRESPRTSAIAAMVGKAGVATRPDSIFRRVSGETPASSAVRWTKTMIVEAGAQSCYVDYEPSFGRGPFGHYICTAVNDAVLHGLPYDYTLADGDLLTLDLAVSRDGVAADSAISFIVGDSKPPESVAMISATERALSAGIAAAGPGARIGDISHAIGSVLSEAGYPINTEFGGHGIGSTMHQDPHVSNTGRPGRGYRLRPGLLLALEPWVMADTAELVTDADGWTLRSATGCRTAHSEHTIAIINNGAEILTLPTQAHS

SEQ ID NO: 18377 - protein, 105 aa, Oryza sativa Indica Group
MAPCFLLLLIFFFLHVDAAAAAASSSHPQLVKRARSLLQAPKIDCQGTCSGRCANNWKKEMCNKMCNVCCNRCNCVPPGSGQDTRHLCPCYDTMVNPHNGKLKCP

SEQ ID NO: 18378 - protein, 360 aa, Nicotiana langsdorffii x Nicotiana sanderae
QQSDPLVVIRNGKEIILQAFNWESHKHDWWRNLDRKVPDIAKSGFTTVWLPPASQSLSPEGYLPQNLYSLNSSYGSEHLLKALLNKMKQYKVRAMADIVINHRVGTTQGHGGMYNRYDGIPLSWDEHAVTSCTGGRGNKSTGDNFNGVPNIDHTQSFVRRDLTDWMRWLRSSVGFQDFRFDFAKGYSPKYVKEYIEGAKPIFSVGEYWDTCNYKGSYLDCNQDSHRQRIINWIDQTGQLSSAFDFTTKAILQEAVKGEFWRLRDSKGKPPGVLGWWPSRAVTFIDNHDTGSTQAHWPFPSNHIMEGYAYILTHPGIPSVFYDHFYDWGNSTHDQIVKLIDIRRHQGIHSRSSVQILEAQP

SEQ ID NO: 18379 - protein, 243 aa, Triticum aestivum
MAGGEELKLLGWWAPGVSPYVLRAQMALAVKGLSYDYLPEDRWSTSDLLIASNPVYKKVPVLIHNGRPVCESLLILEYLDDAVGLAGNGKPILPADPYSRAVARFWAAYVNDKLFPSCTGILKTTKQEERAGKMEETLSGLRHLEAVMAECSEGEAEAPFFGGDAIGFLDIALGCYLPWFEAAGRLAGLGPIIDPARTPKLAAWAERFSVAEPIKALLPGVDKLEEYITTALYPKWNIAVTGN

SEQ ID NO: 18380 - protein, 640 aa, Solanum lycopersicum
MFSLNGTSFTNNSLSGVSRCLNQSSRRVSAPMVVVAAVNSNGKPGDGSVSVLVENALTESPAPVEMEVKSTVTGGVQDVYGEDSATEDQSITPWTLSVASGFSLLRNPHYNKGLAFSERERDTHYLRGLLPPVVISHDLQVKKMMNSIRKYDVPLQRYMAMMDLQEMNERLFYKLLIDNVEELLPIVYTPTVGEACQKYGSIFRRPQGLFISLKEKGKIHEVLKNWPEKKIQVIVVTDGERILGLGDLGCQGMGIPVGKLSLYTALGGIRPSACLPVTIDVGTNNENLLNDEFYIGLRQRRATGQEYSELLDEFMYAVKQNYGEKVLIQFEDFANHNAFDLLAKYGTSHLVFNDDIQGTASVVLAGLMAALNLVGGSLSEHTFLFLGAGEAGTGIAELIALEMSKQTGIPLEETRKKIWMVDSKGLIVKSRMEMLQHFKRPWAHDHEPVQELVNAVKSIKPTVLIGSSGAGRTFTKEVVQAMATFNEKPIIFALSNPTSQSECTAEEAYSWSEGRAIFASGSPFAPVEYNGKVYASGQANNAYIFPGFGLGLIISGAIRVHDDMLLVASEALADEVSQENFEKGLIYPPFSNIRKISAHIRAKVAAKAYELGLATRLPQPKDLVAYAESCMYSPAYRSYR

SEQ ID NO: 18381 - protein, 320 aa, Kineococcus radiotolerans SRS30216
MSVLVTGGAGYIGSHVVRLLQQRGERVVVVDDLSNGRAQRVGDAPVVQVDLGTDAAAGALASAFAEHDVDAVIHFAARKQVGESVAKPARYWAQNVGGTANLLQAMEDAGVGKLVFSSSAATYGAPATALVREDGPAEPINPYGQTKLVGEWMSRAAGVAWGLRAANLRYFNVAGAGWSDLGDAAVMNLIPIVFRALDEGRAPVVFGDDYPTPDGSCIRDYVHVLDLARAHLAALDHLAADERPFDTFNVGSGSGSSVFEVLRVVREVTGVDVQPDVRERRAGDPPQLVADVSRINDTLGWSTTKDLTDIVASAWEAWRA

SEQ ID NO: 18382 - protein, 316 aa, Oryza sativa
MEASIRNALGDIGNRIGLGNVQLAALGKNDAVMANKNHQPSQQFRFTKTTTTTKTMSSMSTKTATSVKQQQQTTTTTTVVAKAAEPELMTMKEEEEKPANNSCVMLEEDEEEDIELGEESDEEDDEDIMYSDAESDEQEIEQDEDEVDESILDIDALDTEDPQLCADYVREIYKYMTHMERKYRIAPTFLEKKMVTSRMRAVLIDWLIQVHMKFQLLQETMYLTVYFIDSYLQRMDVSKMHLQLVGVTGMFLASKYKEMYLPAIEDFVYMTDNTYTKSEIPKNGGKPVLNPSKFEFGKPIALCFFLTSFLQKLAKA

SEQ ID NO: 18383 - protein, 290 aa, Silicibacter sp. TM1040
MAKIAFLGLGVMGYPMAGHLQKAGHEVTVYNRTTAKAEGWAAATGGRSAPTPREAAQNADFVMACVGNDDDLRSVCLGEDGAFAGMKPGAIFVDHTTVSAEVTAELYARAKDAQLGFVDAPISGGQAGAENGVLSVMCGGDAADYDKAAPVMEAYARICRRIGESGAGQMTKMCNQIAIAGLVQGLSEALHFAEKAGLDGRAVVEVISQGAAGSWQMANRYETMLDDEFEHGFAVDWMRKDLGICLDTADDIGASLPVTALVDQFYKDVQKLGGGRWDTSSLIKRLRALG

SEQ ID NO: 18384 - protein, 579 aa, Solanum lycopersicum
MESALKDLSTPTGGVEDVYGEDCATEDQCITPWTIAVSSGYNLLRDPRYNKGLAFTERERDAHYLRGLLPPVISSQELQEKKLMQSIRQYDVPLHKYVAMMELEERNERLFYKLLIDNVEELLPIVYTPTVGEACQKYGSLFKRPQGLYISLNEKGRILEVLKTWPEKSIQVIVVTDGERILGLGDLGCQGMGIPVGKLALYTALGGVRPSACLPITIDVGTNNEKLLNDEFYIGLRQRRATGQEYYDFLHEFMSAVKQNYGEKILVQFEDFANHNAFELLAKYRTSHLVFNDDIQGTASVVLAGLIASLKLLGGALCDHTFLFLGAGEAGTGIAELIALEISNKTNIPVEETRKKIWLVDSKGLIVSGRKETLQAFKKPWAHEHEPVNNLLDAVKAVKPTVLIGTSGTGRTFTKEVVEAMACMNKRPLIMALSNPTSQAECTAEEAYTWSEGRAVFASGSPFPSFEYDGKLNIPGQANNCYIFPGFGFGLVMSGTIRVHDDMLLAASEALAAQVTEEHYAKGMIYPPFADIRKISAHIAASVAAKAYELGVATRLPRPADLVKYAESCMYTPNYRSYR

SEQ ID NO: 18385 - protein, 620 aa, Bradyrhizobium japonicum USDA 110
MLSITDLSIRLAGRLLIDQSSVQITPGSRVGMVGRNGTGKSTLFKVIRGELAAEHGAVTLPPRWRVGSLAQEAPNGPESLISVVLKADLERDALLHEAESATDPHRIAEIQTRLVDIDAHSAPSRAAAILSGLGFSAADQLRPCAEFSGGWRMRVALAATLFAAPDLLLLDEPTNYLDLEGTLWLEDHLAHYPRTVIVISHDRDLLESSVDQILHLERGKLTLYKGTYSSFEEQRAARELLDAKAVKRQEAERARLQAFVDRFKAKASKARQAQSRVKMLERLKPITALVTEDVREISFPAPEKILSPPIIAVDNASVGYDPATPVLGRVTLRIDNDDRIALLGANGNGKSTLVKLLAGRLAPFSGKVTRADKLSIAYFAQHQLDELNEDASAYDHVRKLMGDAPEAKVRARAGAIGFSGKAADTKVAKLSGGEKARLLLGIATFFGPNMIILDEPTNHLDIDSRAALAEAINEFPGAVIMVSHDRYLIEACADRLWIVADRTVTNYDGDLDEYRRLVLSARNSEPAPRERSTAAEKPQRPKSDNRGSLRKRITEAEAEIARVSDIITKIDTALALPDIFTRDPKQAAQLSKARANAADALARAEEQWLEASTQFDEAAG

SEQ ID NO: 18386 - protein, 432 aa, Leifsonia xyli subsp. xyli str. CTCB07
MLICFSSSHRTAAFDLLDQLERHAPAVATALAEHSELVTGSVVLATCNRFEAYLDIDEPLPAARAVSAETVIAAVGNAAGIDADLLRSSSRVYCDDAAAEHLLSVSSGLDSVVVGEGEIAGQVRRALTTARQAGTVSQDLERLFQVASRTSRGVKNRTGIATAGRSIVRLALDLAESRVSDWSRMRVLLIGTGKYAGASLAALRDRGVADVQVHSPSGRAEKFALSHGVTAVPAGGLGAALAHAHLIVTCTTVRDYTLTPGNFGQAQQQDGIERRLVIDLGLPRNVDSAVAELPGVELLDLETISLHAPVAELNAADDAREIVGAAAAEFAAQTAEQAVKPALIALRKHVFDILDAEIARARTRGDSSEQTEAALRHLAGVLLHTPSVRARELARAGDAQRFADAAETLFGLRIEEAPVHPRLIAVDRVTAS

SEQ ID NO: 18387 - protein, 422 aa, Oryza sativa Indica Group
MASLHRPLSAMAVAAFAAVSSLELPDRLSHHKLPDTAVDAEAVVSIPASRPDVSAAPSASAMSRLHFLPRNLQTSHPAKAPPASLPVIHTVYHYAKFAKYYSEEEAVTTAMPSSSSPDVLYRWHLPDPKVCGDSHGKSQTVVVLLGWLGSRQKHLKRYADWYTSRGYHAVTFTLPMSDIVSYNVGGKAEKNVEMLSEHLADWVSEEDGKKIVFHTFSNTGWLCYGVILENLQRQDPSAMDKIKGCVVDSAPVAVPDSQVWASGFSAAIMKKHSIAAKGVKPNDARPDVLVVESNKDHPKPAVSEAILLSALEKLFDVVLNYPAINRKLSGVMELLSSKQPKCPQLYIYSSADRVIPAKSVESFVESQRRAGHEVRACDFVSSPHVDHYRSNPELYTSQLTEFMEDCVLARCQAKEEEEEVTN

SEQ ID NO: 18388 - protein, 229 aa, Listeria innocua Clip11262
MTKQANLEKVTAQIKQSCEKSNRQQADVTLVAVTKTIDVAGITELYDLGIRHFGENRADVFLDKTRELAGKDDICWHYIGSLQTRKVKDVLPEIDYLHSLDRSSLAKEIEKRATKPIKCFLQVNISGEESKHGFSKEEALSFLQEADFNFIEIIGLMTMAPITNSDKELHHVFHELKQLQQEIHALQLKNVPCTELSMGMTNDYGIAITEGATFIRVGRALVSDDNMEV

SEQ ID NO: 18389 - protein, 463 aa, Streptococcus pyogenes MGAS315
MTIFRKKKKYSNKTEMQRHFKVIDLIFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWFHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPMLAIIICLSFMSQYKAFTWIAFAIATIIGTLIYLAYGYTHSIENK

SEQ ID NO: 18390 - protein, 331 aa, Cryptococcus neoformans var. neoformans JEC21
MADIIETPVSRRLSTVKNIIIVLSGKGGVGKSSSSVQLALSLLAQSPTNRVGLIDLDITGPSLPRMVGLDTPTATVHQSSAGWVPVYVDQGRRLGVMSIGFLLKDRGDSVVWRGPKKDGMIRQFLSEVRWGDLDYLVIDTPPGTSDEHISLLTHLHPLFTPTMSNATTPTSILISTPQTTALNDTLKSLSFTRKLSLPVMGLVENMAGYVCPCCGEISDTFGKGGGEAMAHKEGVGFLGRVPIDTVLVSLLDAVSKGEVLGEGAVEHTSDEAAEGQTNGSTEHFPLLDKYLETTSSKVWKDITQKLVDKIEQHKSDIRARLESSSETLAIA

SEQ ID NO: 18391 - protein, 835 aa, Cryptococcus neoformans var. neoformans JEC21
MGLIKSSLGNSNKGKFVDCSTPPLHNSSFIRIQEDSSSTAAARTSTQEDLHASMSPDIKPSFRPEVVKSKIKHYFGYTETTPETVSVFDWARSQTPALGPGIKAYILSLFPFIQWVPRYNLTWLFGDLVAGITVGMVLVPQSLSYAKIAELEPQYGLYSSFIGVLTYAFFATSKDVSIGPVAVMSLETGNIILSVQDKYGDLYSKPVIATALAFICGFIVLGIGLLRIGWLVEFIPQPAVSGFMTGSALNIAAGQFPAVFGLSKKFDTRAATYKVIINTLKYLPQASLDTAFGMTALAALYGIKWGFTWLGKRYPRYGRITFFCQSLRHAFVIIIWTIISWRVNVHAASPRISLVGNVPSGLQHVGRPFIDSQLLSAIGPHIPVATIILLLEHISIAKSFGRLNGYKINPNQELIAIGVNNTIGTLFSAYPSTGSFSRSALKSKAGVRTPAAGLATGVVVIVALYAVAPAFYWIPNAALSALIIHAVADLVASPKHSYSFWRVAPIEYVIFVGAVLWSVFYTIESGIYWSLATSVVLLLLRIARPKGHFLGRVRIKPEAGNTLEHIRDVYVPLDEESSGEDVKVENPPAGVIIYRFEESFLYPNASYINDRLIEQAKKVTRRGGDYSKVAAGDRPWNDPGPSKKNAAAVIEADMVKPVLKAVILDFAAVANLDTTGVQNLIDTKTEMEKWADGPVEFHFCGILSPWIRRALVAGGFGQGRAKEGAALEVAPAVIENLENAASPGMERERYNEHEVSFIHEVGQASNSTSAGTSFSEEEKRIGSGATTPSPQLDGVNERRPSGVSTKTVPLLDRSTPFFHFDLADALNSLNLPENE

SEQ ID NO: 18392 - protein, 525 aa, Pseudomonas syringae pv. tomato str. DC3000
MALDIHAHRILILDFGSQYTQLIARRVREIGVYCELHPFDMDDEAIREFAPKGVILAGGPESVHEANSPRCPQAVFDLGVPVFGICYGMQTMAEQLGGKVAGSELREFGYARVDVVGKSRLLDGIEDHIDADGLFGLDVWMSHGDKVTKLPEDFHILASTPSCPIAGMADDARGYYGVQFHPEVTHTKQGGRILSRFILDICGCEALWTPSKIAEDAIAQVRAQVGTDSVLLGLSGGVDSSVVAALLHKAIGDQLTCVFVDNGLLRLHEGEQVMAMFAENMGVKVIRANAEEQFLNNLEGESDPEKKRKIIGRTFIDVFDAESCKLDNIKYLAQGTIYPDVIESAGAKSGKAHVIKSHHNVGGLPEEMNLKLVEPLRELFKDEVRRLGLELGLPYDMVYRHPFPGPGLGVRILGEVKKEYADILRRADHIFIEELRKADWYHKVSQAFVVFQPVKSVGVVGDGRRYAWVVALRAVETIDFMTARWAHLPYELLETVSGRIINEIEGISRVTYDVSSKPPATIEWE

SEQ ID NO: 18393 - protein, 78 aa, Methylobacillus flagellatus KT
MSDIEQRVKKIVSEQLGANEADVKNESSFVDDLGADSLDTVELVMALEEEFDCEIPDEEAEKITTVQQAIDYVNANLK

SEQ ID NO: 18394 - protein, 633 aa, Bacillus pumilus SAFR-032
MDLLSIKNPTFLKGMSNAELEELSADIRMFLIESLANSGGHIGPNLGVVELTVALHKVFDSPKDKFLWDVGHQSYVHKLLTGRGSEFDTLRQYKGLCGFPKRNESEHDVWETGHSSTSLSGAMGMAAARDIKGTDEYILPIIGDGALTGGMALEALNHIGDEKKDMIVILNDNEMSIAPNVGAIHTMLGRLRTAGKYQWVKDELEYLFKRIPAVGGKLAATAERIKDSLKYLLVSGMFFEEMGFTYLGPVDGHSYEDLFENLEYAKKTKGPVLLHVITKKGKGYQPAESDKIGTWHGTGPYKIDTGDFVKPAAAAPSWSGLVSETVRKLAREDERIVAITPAMPVGSKLEGFAKEFPERMFDVGIAEQHAATMAAGLATQNMKPFLAIYSTFLQRAYDQVLHDICRQNLNVFIGIDRAGLVGADGETHQGVFDIAFMRHMPNMVLMMPKDENEGQHMVNTAIQYDDGPIAMRFPRGNGLGVKMDEQLKTIPIGSWEVLHPGKDAVILTFGTTIKMALQAAEELQKEGKSVRVVNARFIKPLDEAMLNDILSEGIPILTIEEAVLQGGFGSSVLEYIHDKKASHIKVERMGIPDEFIEHGSVDALLEEIGLTKVQVADTLRDMLPVAPRKGIGS

SEQ ID NO: 18395 - protein, 202 aa, Zea mays
MEWRDSFLDLALIPLSLLLPMAYHAWLWREVRLRPLRTAVGINAATRRLWAIGMMKDNAKNAVTVVQSVRNVIMGSTLMATTAILFCTGVAAVLSSTYTIKKPLSDTVFGAHGEYMMALKDYIGDVLERGFTLNLVGNRLFYAGVPLLLWIFGPLLAFLSSMVMVPILYSLDVVNLMGHSGCVVVSGKSAEMNGGSECARAV

SEQ ID NO: 18396 - protein, 296 aa, Bacillus pumilus SAFR-032
MTSNLNEFLTTRKQTIEDYLFTYVQELTIPKDLKSSMLYSLKAGGKRLRPVLVLALLNAYGKNEEDGIPVGCAVEMIHTYSLIHDDLPCMDDDDLRRGKPTNHKVYGEATAVLAGDALLTESFRLITSQLSSSVSADKKLRIVDELVKSAGALGMVGGQFDDMEAEQKQVSLAELEYIHARKTGKLLTFSVAAGAMLAGASDDDIEKLREFSYHIGIAFQIRDDILDLEGSEEKIGKRVGSDTANEKSTYPSLLTLSGAKEKLDEHITRAKEIVSNLQLEQQLLHGLCDLIASRDH

SEQ ID NO: 18397 - protein, 263 aa, Bartonella henselae str. Houston-1
MPQSAVMNVMVQAAMKAGRSLVRDYGEVQNLQVSLKGPADYVSQADRKAEKIIFNELSKARPKFGFLMEESEEIIGEDSQHRFIVDPLDGTTNFLHGIPFFAVSIALESQGKIVAGVIYNPINDELFTAERGSGAFFNDRRCRVSARRRLEDCVIATGMPHLGRPGHGTYLIELRNVMAEVSGIRRFGTAALDLAYVAAGRTDGFWEDNLQIWDMAAGILMVREAGGFVTDKEGGNDIFRKKNIIAGNEHIRIKLERALKKGI

SEQ ID NO: 18398 - protein, 486 aa, Oryza sativa Indica Group
MASYDKAIESYKRAVTTAASLAASAMLVRGVVNELVPYEVRDLLFSGVGYLRSRMSSQHTVIIEETEGWTNNQLYDAVRTYLATRINTDMQRLRVSRVDETKSMMFSMEEGEEMADVHEGSEFRWRLVCRDNSSSSNGNGNGRGGNGNYRLEVRSFEMSFHKKHKDKALNSYLPHILATAKKIKDQDRTLKIYMNEGESWFAIDLHHPSTFTTLAMDHKQKQSVMDDLERFIKRKEYYKKIGKAWKRGYLLYGPPGTGKSSLIAAMANYLKFDVYDLELTEVNWNSTLRRLLIGMTNRSILVIEDIDCTLELQQREEGQESSKSNPSEDKVTLSGLLNFVDGLWSTSGEERIIVFTTNYKERLDPALLRPGRMDMHVHMGYCCPESFRILASNYHSIDNHATYPEIEELIKEVMVTPAEVAEVLMRNDDTDVALEGLIQFLKRKKDVGKEGKAENVEQVVKAEETEKGMMKKNDVPENQDPQDASK

SEQ ID NO: 18399 - protein, 230 aa, Nicotiana langsdorffii x Nicotiana sanderae
QQSDPLVVIRNGKKVILQAFNWESHKHDWWRNLDRKVPDIAKSGFQDFRFDFAKGYSPKYVKEYIEGAKPIFSVGEYWDTCNYKGSYLDCNQDSHRQRIINWIDQTGQLSSAFDFTTKAILQEAVKGEFWRLRDSKGKPPGVLGWWPSRAVTFIDNHDTGSTQAHWPFPSNHIMEGYAYILTHPGIPSVFYDHFYDWGNSTHDQIVKLIDIRRHQGIHSRSSVQILEAQP

SEQ ID NO: 18400 - protein, 495 aa, Arabidopsis thaliana
MDGADGTVRVKPGRGFETETDVAVSSPVTRQKAAAAKQFIENHYKNYLQGLHERMERRREFQRKVQEAQLPVEEQDEMMRNLARRETEYMRLQRRKIGIDDFELLTVIGKGAFGEVRLCRLRSTSEVYAMKKLKKTEMLSRGQVEHVRSERNLLAEVDSRYIVKLFYSFQDSECLYLIMEYLPGGDIMTLLMREDILSEDVARFYIAESILAIHSIHQHNYVHRDIKPDNLILDKSGHLKLSDFGLCKPLDDKYSSLLLEDDEMLSQDSENQSGKSDADKAPWQMPKEQLLQWKRNRRALAYSTVGTLDYMAPEVLLKKGYGMECDWWSLGAILYEMLVGYPPFCSDDPRITCRKIINWRVCLKFPEEPKISDEARDLICRLLCDVDSRLGTRGVEEIKSHPWFKGTPWDKLYDMEAAYRPIVDGELDTQNFEKFPEVEGSPSEAPQVGPWRKMLTSKDTNFIGFTFKKSDITRSMESSGSLHISCLYCLCVCLL

SEQ ID NO: 18401 - protein, 343 aa, Bartonella henselae str. Houston-1
MNERLEDIALTLVGAGKGILAADESTATIGKRFESIGVECTEDNRRAYREMLFTAKEAMESAISGVILFDETLRQKASTGQMLTDLIRDAGAVPGIKVDTGAKPLAAFPQETITEGLDGLRERLKDYYTLGARFAKWRAVIAIDAQTLPTRGAISQNAQALARYAALCQEAGLVPIVEPEVLMDGPSRQHSITRCFEVTKVVLHTVFKELFEARVLFEGMILKPNMVIDGKDARIASVEEVAEKTVHVLKQTVPAAVPGIAFLSGGQTDEEATAHLSAMNALGALPWKLTFSYGRALQAAALKAWAGKNENIVVAQKAFCHRARMNHLAALGQWTKDQEKSCA

SEQ ID NO: 18402 - protein, 450 aa, Bordetella bronchiseptica RB50
MAFDFDLYVIGAGSGGVRAARFAAGYGARVAVAESRYLGGTCVNVGCVPKKLLVYGAHFHEDFEQAAGFGWNPGRPEFDWPTLIANKNREIERLNGIYRNLLVNSGVALHEGHARIVDPHTVEINGQRHSAQHILVATGGWPFVPDIPGKEHAITSNDAFFLPELPRRVLVVGGGYIAVEFASIFNGLGAQTVQVYRRELFLRGFDGSVREHLRDELVKKGLDLRFNTDVERIDKRADGVLAVTLSDGSVLETDCVFYATGRRAMLDDLGLENTGVRLAESGYIEVDDEYRTSEPSILAIGDVIGRVPLTPVALAEGMAVARRLFRPQEYRKVDYDLIPTAVFSLPNIGTVGLTTEQALERGFRVTRYESRFRPMKLTLTQSQEKTLMKLVVDADSQKVLGCHMVGPDAGEIVQGLAVALKAGATKQVFDDTIGIHPTAAEEFVTMRTAT

SEQ ID NO: 18403 - protein, 397 aa, Bartonella henselae str. Houston-1
MGFRTLDDVDVTGKRVLVRVDFNVPMAQGKVCDDTRLKRHKETLLELQKRGAKLILLSHCGRPKGQVEPEFSLHPVVQVLEKIINQPVNFASDCIGVAVQTAVEALQNGGILLLENVRFHSGEEKNAGSFAEALAHNGDLYVNDAFSVSHRAHASVEGITHFLPSYAGRSLQCELQALEKGLGKPERPVIAIVGGAKVSSKLFVLNHLVKKVDYLVIGGGMANSFLAAQGVCVGKSLCEHALIETVKKVIEKARECQCTLLLPVDAIVGFRFEKDAPHRLYDIGDIPEDGMILDVGTRSIAHINAVIDKAATLVWNGPLGVFEMSPFDQGTIAVARHAAELSLTGKLVSIAGGGDTVFALNHAGVADDFTYLSTAGGAFLEWMEGKMLPGILALTQA

SEQ ID NO: 18404 - protein, 232 aa, Nicotiana tabacum
MGYWQAKVVPKIKQIFDKNGPKKAAAAEACKTFDEAKALYSKEFEDKKTELQPKVVEIYEAAAVEIKTLVKEPKVSGLKKHSTEVQKLLDELVKIEFPGSKAVSEASSNFGPSYVCGPVLFVFEKVSTFIVTENKKVEEAAVPVAASSSEEEAAASVAAASEAEAIAAAPVEVKKKEIVVEAEAKKEEEPAPAPAAEVAPAPAAEVAPAADVAPAKVEERAPAAAAPEPPKA

SEQ ID NO: 18405 - protein, 140 aa, Bradyrhizobium japonicum USDA 110
MAIERTFSIIKPDATARNLTGAVNAVIEKAGLRIVAQKRIRMTKEQAETFYAVHKARPFFGELVEFMTSGPVVVQVLEGENAVAKYRDAMGATDPSKAAEGTIRKLYAKSIGENSAHGSDAPETAAIEIAQFFSGNEIVG

SEQ ID NO: 18406 - protein, 335 aa, Bartonella henselae str. Houston-1
MSVRVAINGFGRIGRNILRAIIESGRQDIEVVALNDLGSVETNAHLLRYDSVHGCFPGTVQVVGDAIDIGSSLIKVFAERDPAQLPWKALDIDIALECTGIFTARDKASAHLDAGAKRVLVSAPSEGADLTVVYGVNHQFLSKEHHVISNASCTTNCLAPVAQVLHNTVGIEKGFMTTIHSYTGDQPVLDTMHRDLYRARAAALSMIPTSTGAAKAVGLVLPELKGLLDGVSIRVPTPNVSVVDLTFTAKRSTTIEEINTAIRTAAQGSLKGILDYTDEKLVSCDFNHNPHSAIFHNDQTKVIDGQLCRVLVWYDNEWGFSNRMCDTAVAFAKTI

SEQ ID NO: 18407 - protein, 215 aa, Nicotiana tabacum
MGYWQAKVVPKFKQIFDKNGPKKAAAAEACKTFDEAKEQYSKEFEEKKTELQPKVVEIYEAAAVEIKTLVKGPKVSGLKKHSTQVQKFLDELVKIEFPGSKAVSEASSNFGPSYVSGPVLFVFEKVSTFIVTEDKKEEEAAASEAEATTAAPVEVKEKEIVVEAEAKKEEEPAPAPAATPAAEVAPAEVAPAADVAPAKVEEAPAAVAAPEPPKA

SEQ ID NO: 18408 - protein, 478 aa, Bartonella henselae str. Houston-1
MKRARKVKIIATLGPSSFSISMIEKLFMAGADVFRLNMSHTDRETMVDLVQRIRKVEKTVRRPIGILVDLQGPKLRVGCFDKGQEDLRIGQSFTLDDRDILGDAQRVFFPHGEVLAAIKPGDRLLIDDGKLELLAQVCDGHSVQCLVVAGNRISDRKGVSLPDTVLPFGPMTLKDKADLQAVLEQPVDWVALSFIQRPEDIIAVRALTKSKVSLMAKIEKPQALEHIEEIIDVADGIMIARGDLGVEMPLERVPAIQMELIKACRLAGKPVVVATQMLESMITSSVPTRAEVSDVATAVYTGTDAVMLSAESASGRYPEEAVLMMDRIAQQIEQDQTYAAQVGAQHPAPESTGTDAISLAARQIAETLQLTAIVAYTASGTTGVRTSRERPNRPIIALSPIVKTARRLALVWGLHCVVTEDARDLEDMVDRAAAIAFQEGFCQGGDRFLVTAGVPLGTPGATNLLRIASVSQDGTKGV

SEQ ID NO: 18409 - protein, 465 aa, Methylococcus capsulatus str. Bath
MRIFRTKAVSTDDCSGGSLKRCLGALDLTLLGIGAIIGTGIFVLTGIAAATQAGPAVVLSFVFAGLACAFAALAYAELAACVGGCGSAYGYSYAAFGELIAWIIGWDLILEYAISVAAVANGWSGYFANALTAVGLELPDYLTKAPEKGGIINLPASAIIILLMALLIAGVKESARLNTVMVSVKVLAIAVFVAVASAHVDPAHWDPFLPFGWFGHDAEGRPTGVLAGASIVFFAYVGFDAVSTAAEEARNPMRDVPIGIIGSLVFCTLIYIVVAGLLTGVVPYTELNVSSPVAHALQLLGIRWASGLVATGVIAGLTTVMLVLYYALTRIIFAMSRDGLLSPWFSAVNTRTQTPVRVIVLCGLFISLVAGFVPLGELAELVNIGTLFAFVLVCLGVIVLRVTRPELHRPFKTPVVPWFPILGALSCGALMAFLPALTWLRFVVWLLLGIGIYFAYSYRHSRLAD

SEQ ID NO: 18410 - protein, 278 aa, Brassica napus
MDSVFSNVDRAPEDPILGVTVAYNNDPSPSKLNLGVGAYRTEEGKPLVLDVVRRAEQQLVNDPSRVKEYIPIAGLADFNKLSAKLILGADSPAIQESRVATIQCLSGTGSLRVGAEFLKKHYHQSVIFIPKPTWGNHPKVFNLAGLSVEYYRYYDPSTRGLDFQGLLEDLGAAPSGAIVLLHACAHNPTGVDPTPEQWEQIRQLIRSKSLLPFFDSAYQGFASGSLDTDAHSVRTLVADGGECLIAQSYAKNMGLYGERVGALSIVCKSADVASRLRA

SEQ ID NO: 18411 - protein, 465 aa, Rubrobacter xylanophilus DSM 9941
MAIATVNPATGEELKRFEALDREQIDEKIERAVGAFRGWRETPVQERCRLMARAAEVLEERAEEFGRLITTEMGKPLAAAVAEVRKSARGCRYYAQNAARFLADEEVELEGARAFVRYQPLGPVLAVMPWNFPFWQVFRFAAPALTAGNVGLLKHASNVPQSALAIEEVFRQAGFPEGVFQTLLIGASQVRDVISDPRVRAATLTGSTPAGRDVGGEAGRNIKPSVLELGGSDPFIVMPSADLDRALDTAVTSRTLNNGQSCINAKRIIVHRQIAEEFTRRFVEKMASLKVGDPMDETTDMGPLAMPSILEGVDEQVRRSVEAGAKVLTGGKPLDGPGYFYPPTVLAEIPEGAPAREEEIFGPVASLFTARDIDEAIRLANETPFGLGSSAWTNDPEEQERFVDEIEAGMVYINRLVESTPEVPFGGVKSSGYGRELSHFGIREFVNVKTVWIDASGGERGRGVE

SEQ ID NO: 18412 - protein, 679 aa, Dehalococcoides sp. CBDB1
MSIWIALVVGLVGLAVAGLLAKFVLKQDEGTPKVREIAAAIKEGAMAFITREYTVMAIFVAAVTIILAFLPSLGWPVSVSFLFGALCSGLAGFIGMSIAVRANSRTTTAASHSLNQGLKLSFRAGSVMGMCVVGIGIIGLSIMYFAFGSDVDFIKILPGYGFGASSVAIFARVGGGIFTKAADTGADIVGKVEKGIPEDDPRNAAVVADFVGDNVGDVAGMGADLFESYVDSIIATMALATIGAFSMKLGYALVPSQEAAFFLPMLVAAGGILASVIGIFLVRTGEKLQMKALLAALRKGTLAAAFLSAVFSFLAVWYLQADLGLFFAILAGLVAGVLIGESTNYFTSYVYKPTLGIAASCQTGAATNIISGFSVGLMSVVPPIVLVVIAIVISYAFGDVYGVALAGVGMLATLGIQDATDAYGPVADNAGGIAEMSGLPKEVRERTDALDSLGNTTAAIGKGFAIGSAGLTSLALLLSYTQAVGISASQVSLLDVKVLAGLLLGVMMPAVFCSLTLKAVGVTSFSIVNEVRRQFKEIAGIMEGTAKPEYGKCVDICTRDSIKQMILPGVITVVSPVIVGWLLGPVAVVGFLTGTILCGFILAVTFANAGGAWDNAKKWVETGAYGGKGSDAHKAAVVGDTVGDPMKDTAGPSLNIMIKLVAIIALVMAPILATFNGII

SEQ ID NO: 18413 - protein, 461 aa, Dehalococcoides sp. BAV1
MLENAEYIKAGELLDHTQKLYDEGAIFCTASCVDLGNEFEVIYHYNLENGLRMKHLRLKVDKNETVPSISNIYLCASLIENEMQELYQLKLSKIAIDFSGGFLVTKETPTSYMIKAPDYKLIPVERLTAPCQKTCPAGIDVSRYVRLCGEGNYDAALAVIKQAMPFPGILGRVCLAPCESACRQGKCGESISIKQLKRAAYEYGHYTDSITAKPTGKKVAIVGSGPSGLATAYFLAKKGHKITVFEALPKAGGYMRVGIPEYTLPRQILDAEIENVSKLGVEFKLGTTVNSLGSLKEMGFDATLLALGANQGVRRSNIIAAFSGGTDVFKRFGLAVENINGNNVLKVDDDTLTTSQQGVFACGDAVNGPTSVIHAVASGKKAAASIDKYLGSDGKWVFENIVAHEPVSRDTFLERILPKSKPLSVKYDIKQAKERNEETAGYNREVASTEGKRCWRCDLEE

SEQ ID NO: 18414 - protein, 410 aa, Medicago truncatula
METEKSVAAKIKKVRNDIPNDLVFSILSKLPVKSLNRFGCVRKSWSILFKNRYFMSMFRKNLLCKNHSYYKDTSLLQLETVTIDSELKFVLYSLSGERYQNKTKLDWPNLFEEADPEFDVVGSGSINGILCLVSKSQPNNRVVFWNPTTDEFKIVPISLRESVRHVDVEITRHGFGYVSIADEYKLIRQVMYNPKSDTDDSSLEDVSYDLFWEIYSLRSNSWRELHSDVPYDYREDGICLDGMCHWLGEDGYDIDRVDEVYLLSFDLSKEAFLITPIPSECDSRIFQMAWKDLVVLNGFIALISHYKQNDTFHISILGEIGVKESWTKLYIVCPLPCIERPITSGNKRYIISNVVDGTLVCIDLSTLMVEQLNIDLSTLMVEQLNFEGYRFWGKTIIYKQSSLPIGGINQ

SEQ ID NO: 18415 - protein, 173 aa, Hordeum vulgare
VGGAASAGMVFDFTTKGILNAAVEGELWRLIDPQGKAPGVMGWWPAKAVTFVDNHDTGSTQAMWPFPSDKVMQGYAYILTHPGTPCIFYDHFFNWGFKDEIAALVAIRKRNGITATSALEILMHEGDAYVAEIDGKVVVKIGTRYDVGAVIPAGFATSAHGKDYAVWEKTAAA

SEQ ID NO: 18416 - protein, 174 aa, Hordeum vulgare
VGGAASAGMVFDFTTKGILNAAVEGELWRLIDPQGKAPGVMGWWPAKAVTFVDNHDTGSTQAMWPFPSDKVMQGYAYILTHPGTPCIFYDHFFNWGFKDEIAALVAIRKRNGITATSALKILMHEGDAYVAEIDGKVVVKIGTRYDVGAVIPAGFATSAHGKDYAVWEKTAAAA

SEQ ID NO: 18417 - protein, 671 aa, Magnaporthe grisea
MADQLNMAGLSVGGGGPGNGPRSYIPPHMRGKVGGPGMNGPQNGPQNGGGPPGHDGPPSSVNNGLNNSAWAGNQNHDARGGNWGNQGGGPPPRNNNWNRPSFNPNAYGGGNQGGGHGGGGGGGYARGSGDGQWRDGKHIPGPVNARVERELFGTPDDPSKQHTGINFEKYDDIPVEASGHDVPEPVYTFSNPPLDDHLISNIELARYKVPTPVQKYSVPIVMGGRDLMACAQTGSGKTGGFLFPILSQAFKTGPSPIPATNQGPGGYGRQRKAYPTSLILAPTRELVSQIYDESRKFAYRSWVRPCVVYGGADIGSQLRQIERGCDLLVATPGRLVDLIERGRISLCNIKYLVLDEADRMLDMGFEPQIRRIVEGEDMPNVQDRQTLMFSATFPGYIQQLARDFLKDYIFLSVGRVGSTSENITQRVMEVKHRDDKISHLLDLLSTHGGGLTLIFVETKRNADELSDFLQNQNLPATSIHGDRTQRERERALEMFRTGRCPILVATAVAARGLDIPNVTHVINYDLPTDIDDYVHRIGRTGRAGNTGIATAFFDMKDNSGVAQELLNILKEAKQDIPPFLETAARMKSYGGGRGRGGGGRGRGGGGNRDFRKFGGGGGGGFNGGGGGGFSGGGYGGGGGGYGGGGGGYGGGGYGGGGGGSYGNPGGGQSWW

SEQ ID NO: 18418 - protein, 273 aa, Nostoc sp. ATCC 53789
MLEDLQIAFIGGGTMGEMIMARLLSTKIVPKPDLIIVSDPVSARCLHLESEYGVSTTTCNIEAVVGASIVILAVKPQVLAEVLAILKGKISPDALVISIVSGASIPYLCEGLNHPAVVRTMPNIAVQVGHGTTVWSASSSVTEIQRSHTQVILQALGKEFPTQNEHYLDMATALSSAGTGFIFLYIEAMIDAGVQMGLTRTQAQELTLHTIAGSVELMFQTDEHASSLTKQGTSPGGVTAVGLYELEKGGMRTLISNAVLAALSRTQQLGTGV

SEQ ID NO: 18419 - protein, 368 aa, Nostoc sp. ATCC 53789
MPLAAVMTAPNQPVEVQQLPDPVLEKGGIILETLYSEVCGTDVHLLHGRLEGVPYPIIPGHFSVGRVVETGGAVSDVNGKLIQPGAIATFLDVHETCYNCWYCLVAKASTRCPKRKVYGVTYSAKDGLLGGWSELIYLKPGVKVLTLPEEVSPKQFIAGGCALPTALHAIDRAQIQIGDVVVVQGCGPVGLSVAILALLSGAGKVIVIDKFESRLVVAKSFGVDETLAIKADDPRQHIERVLELTNGHGADVTIEATGIPIAVKEGLNMTRNGGRYVIVGHYTNTGEILINPHLEINLKHIDIRGTWGIDFSHFYRMIELLKRHSDSSKNIAWSSIISRSYTLQQINQALADVEQGSVLKAVIQPNLS

SEQ ID NO: 18420 - protein, 489 aa, Hyphomonas neptunium ATCC 15444
MAKFVPVEAFDIVIFGGTGDLSRRKLLPALYHRWVDGQIPENSTIVGTARSELDAQAYRDLAREACEKASGKSWDADAWEKFAQILHYVAIDATDPEGDWEGLKARLKAEDGRPRIFYLATSPHLYVDISRALGKVGLVDGMCRVVLEKPIGTDLASAQAINDGVGEVFTERQVFRIDHYLGKETVQNLMVLRFANILFEPLWSQNYIDHVQITVAEDLGLEGRADYYDRSGALRDMVQNHLLQLLCLTAMEPPNDMDDDDIRTEKIKVLKALRPVSSQDAKRLTVRGQYAAGMHAGKPAKGYVEELSETGGSKTETFVAIKAEINNWRWTGVPFYLRTGKRMSSRHSDIVIQFKQAPHNLFGEQSGNVNQLVIRLQPDEAVRLYVQIKEPGPGGLRVKSLPLNLSYAESFTLRYPDAYERLLMDVVRGNLSLFMRRDEVEAAWRWVDGLIDAWDTSGYQPEAYPAGTDGPMSAAMLMDRDNRSWWKES

SEQ ID NO: 18421 - protein, 94 aa, Glycine max
MIAIRNYKVLAPLPIGFAVFMVHLATIPVTGTGINPARSFGAAVMYNQKKAWDDQWIFWVGPFIGAAIAAFYHQFILRASAAKAVGSFRSNPTI

SEQ ID NO: 18422 - protein, 500 aa, Streptococcus equinus
MNKRVKIVATLGPAVEIRGGKKFGEDGYWGESLDVEASAQKIAQLIKEGANVFRFNFSHGDHAEQGERMATVRRAEEIAGQKVGFLLDTKGPEIRTELFEGEAKEYSYKTGEQIRVATKQGIKSTREVIALNVAGALDIYDDVEVGKQVLVDDGKLGLRVVAKDDATREFVVEVENDGIIAKQKGVNIPYTKIPFPALAERDNADIRFGLEQGLNFIAISFVRTAKDVEEVRAICEETGNGHVRLFAKIENQQGIENIDEIIEAADGIMIARGDMGIEVPFEMVPVYQKMIITKVNAAGKAVITATNMLESMTEKPRATRSEVSDVFNAVIDGTDATMLSGESANGKYPVEAVRAMATIDKNAQTLLNEYGRLDSSSFARTSKTEVVASAVKDATSSMDIKLVVALTESGNTARLISKYRPDADILAVTFDEKTQKSLMINWGVIPVVTEKPASTDDMFEVAEKAALESGLVQSGDNIVIVAGVPVGSGGTNTMRIRTVK

SEQ ID NO: 18423 - protein, 460 aa, Bradyrhizobium japonicum USDA 110
MSMLPNSQEARDVAYQLHPYTNARAHQQAGPLVIERGEGPYVFDASGKRYFEAMAGLWSVGLGFNEKRLVEAAHKQMLALPFYHTFSAKSHGPSIDLAEKLVALAPVPMSKVFFTNSGSEANDTVLKLIAYRSNALGQPQRKKVISRMRAYHGVTIASASLTGLPNNHRSFDLPLPNILHTGSPHFYKDGAPGESEEAFATRRAEELDALIQKEGPDTIAAFFGEPVMGAGGVIVPPATYWDKIQAVLKKYDILLVADEVICGFGRTGKMFGCETYGIKPDAIVVSKQITSSYFPLSAILMNDRMFEPIADESNKIGVLGHGFTAGGHPVGSAIALENLKIIEERGLVAHAAELGGYMQGKLRELAGHPLVGEVRGVGMIAALELVLDKQRKTAAATPGAVGGIASRMLQERGVISRNMLDAIAICPPLIVNKTQIDELVAAISGVLEDMKAEVAKLTPA

SEQ ID NO: 18424 - protein, 397 aa, Colwellia psychrerythraea 34H
MFANIPLPASDEIIDLMARSSKDERPFKVDLTVGVYKDSNDNTLLMKAVMEADQLLANAGRNKSYVGSKGDLEYVQLLQELVFANQTVNGYISGVQTAGGSGGLRAILDLIKLANPTAKIWVSDPTYANHIPTIIAAGLAYEEYPFIDHKTMTLDESGMFDTLEKLGENDVVLLHGSCHNPSGLRLTAQHWQQIAQLSKSTNFLPLIDTAYQGFADGLNEDAAGLLTMAKSVERLALCVSCSKNFGVYSDRVGAAYILSPTLEEANKAQSQLAIMSKTTYWVPPSNGAEIVKTILKTPALKTMWSDELSQINGKIKGIREKLCAAFRQHSGDNYFDYILSQEGMFAMLPATEEQMESLRTEYAVYGLNNGRINLASIPEQDIDYLVESILAVTQVSE

SEQ ID NO: 18425 - protein, 647 aa, Flaveria pringlei
MMSLNSSSVVKSSISGVSWTQSQSVRLSVRRPMVVAMVNSNGRPERSVGVSVDGAVKDVNAPVAVEVADSESKKPTAVVGGGVEDVYGEDSATEDHFITPWSVSVASGYSLLRDPHHNKGLAFTEKERDAHYLRGLLPPVVVNHDLQVKKMMHNIRQYEVPLQRYQAMMDLQERNERLFYKLLIENIEELLPIVYTPTVGEACQKYGTIFKNPQGLYISLKDKGKVLEILKNWPQKKIQVIVVTDGERILGLGDLGCQGMGIPVGKLSLYTALGGIRPSACLPITIDVGTNNEKMLNDEFYIGLRQRRASGKEYAELMNEFMSAVKQNYGEKVLIQFEDFANHNAFDLLEKYRTTHLVFNDDIQGTASVVLAGLISALKLVGGSLADHKFLFLGAGEAGTGIAELIALEISKQTNAPLEETRKKIWLVDSKGLIVRSRLDSLQHFKKPWAHDHEPVNKFLDAVKAIKPTVLIGSSGAGQTFTKEVVEAMSSFNEKPIILALSNPTSQSECTAEQAYTWSEGRTIFASGSPFAPVEYNGKVYVSGQSNNAYIFPGFGLGLIISGAIRVHDEMLLAASEALAEQVTQEHFDNGLIYPPFTNIRKISAHIAAKVAAKAYELGLASRLPQPENLVAYAESCMYSPKYRNYR

SEQ ID NO: 18426 - protein, 173 aa, Colwellia psychrerythraea 34H
MIFQLGKHSPKISASCFIAPSANVIGKVDIAENASVWFNVVIRADLDKVTIGENSNIQDGCILHVDEGFPINISKNVTVGHKAMLHGCTIDEGSLIGMNAVILNGAKIGKNCLIGANTLVTENMSIPDGSLVIGSPGKVVKQLDEKVKEMIAKGVEHYVHCNHQYKNELKLID

SEQ ID NO: 18427 - protein, 423 aa, Brassica napus
  misc_feature (33)..(33): Xaa can be any naturally occurring amino acid
MQNPRLKQQQQQQQAMMQQALMQQQHHSLYHPXGLMAPPPPPPQMEPLPSGNLPPGFDPTTCRSVYAGNIHTQVTEVLLQEIFASTGPVESCKLIRKDKSSYGFVHYFDRRSAGLAIMSLNGRHLFGQPIKVNWAYATGQREDTSSHFNIFVGDLSPDVTDAALFESFSAFNTCSDARVMWDQKTGRSRGFGFVSFRNQQDAQNAINEMNGKWLSSRQIRCNWATKGATFGEDKHSSDGKSVVELTNGSEDGREISITNEEAPENNPQYTTVYVGNLAPEVTQLDLHRLFHTLGAGVIEEVRVQRDKGFGFVRYNTHDEAALAIQMGNSQPFLFNRQIKCSWGNKPTPIGTASNPLPPPAPVAVPGLSPMDLLAYERQLALAKMHPQAQHSLRHVNAAGASAAMYDGGFQNVAAAHQQLMYYQ

SEQ ID NO: 18428 - protein, 362 aa, Coprinopsis cinerea okayama7#130
MFRAPIRKLTTAATRQSLKIGLIPADGIGKEVIPAARAAIVALGNDIPKPEFIDLNAGWETFTRTGVALPEETVRVLREECDCALFGSVSSPSRKVTGYSSPIVALRKELDLYANIRPVTSVAPEAGQQPAVDLIVVRENTECLYVKQEQQTIGENGKEARATRLITERASRRIGQMAFELAAARPRKHLTVIHKSNVLSITDGLFRETVRAVPRLPEVNGKYDDVTIMEQLVDSAVYRLFREPEVFDVMVAPNLYGDIISDAAAALVGSLGLIPSVNAGDNFVMGEPVHGSAPDIEGKGIANPIASIRSAALMLRHLGYTKGADRLDLAVDQVIREGKYLTPDLKGKSTTREVLDAVLAKI

SEQ ID NO: 18429 - protein, 174 aa, Pseudomonas syringae pv. tomato str. DC3000
MKFRLGDSSVQTDPQSWVAPSAVLIGNVKLEAGASVWFNAVLRGDNELIHIGENSNVQDGTVMHTDMGSPLAIGKGVTIGHNAMLHGCSVDDYSLIGINAVILNGARIGKYCIIGANSLIGEGKVIPDGSLVMGSPGKVVRELTDVQKKMLEASAAHYVHNARRYARDLAVQED

SEQ ID NO: 18430 - protein, 271 aa, Oryza sativa
  misc_feature (264)..(264): Xaa can be any naturally occurring amino acid
MSSAAGEPSSSSAAAAAISCSSSNDDEKPPPSLEGKELRRVEEEEPAAAARPEKLTEGSSRAAEAEEEEEVVEDEEDDDEEDEGKVAEAIDLGPRVSIKEQLEMDKEDESLRRWKEQLLGSVDLNSVGESLEPDVRITSLCILSPGRPDVLLPLPVEPSNSKEPWFTLKEGSTYRLKFTFSVSSNIVSGLRYTNTVWKAGIRVDKTKEMLGTFSPQLEPYTYVTPEETTPSGVFARGSYSAKTKFVDDDRKCYLEINYTFDIRXRDWPCKS

SEQ ID NO: 18431 - protein, 211 aa, Xanthobacter autotrophicus Py2
MRDPVDTYMNYLIPMVVEQTNRGERSYDIFSRLLKERIIFLTGPVEDGMSTLAVAQLLFLEADNPKKEISMYINSPGGVVTSGLAIYDTMQFIKPAVSTLCIGQAASMGSLLLTAGEKDMRFALPNARIMVHQPSGGFQGQVTDIMLHAQEILNLKRRLNEIYVKHTGRSMDKIEDALERDNFMTAKAALDFGLIDAVIDQRPTDDTSKAA

SEQ ID NO: 18432 - protein, 177 aa, Zymomonas mobilis subsp. mobilis ZM4
MDINLIPTGDNAPETLNVIIEVPQGGEPVKYEFDKKSGALFVDRLLHTPMRYPANYGFVPHTLSDDGDPLDALVLAPTPFVPGSVVSVRPIAVLRMKDEKGEDEKLLTVPVDDIIPLYSSVKEASDLPAIITDQIGHFFEHYKDLESKKWVKIEGWGSSADARKIIVEAIERAQKSA

SEQ ID NO: 18433 - protein, 475 aa, Lactobacillus acidophilus NCFM
MNLWQKMNKKEDPRVYENKDGHLVRSLKVKDFLALGVGTIVSASIFTLPGEVAALHTGPAVAISFILAAVAAGLVAFAYAEMAAAMPFAGSAYSWINVVFGEFWGWVAGWALLAEYFIALAFVGSGLSANFRALIAPLGIKLPAALSNAFGTNGGVIDIISLISILLVALLISHGVSRAARVENALVVLKVLAILFFIVVGLTAIKGSNFVPFIPKYRPTAHGPFGGWQGIYAGVSMIFLSYIGFDSIAANSAEAINPQKTMPRGILGSLAIAVTLFVGVSLVLIGIMPYQKYANSAEPVGLALRYAGHPIVAIVVQTIAVLGMFTALIGMSMAGSRLIYSFGRDGMLPKWLGKLNADRRPNNALWTLTVIGILLGAFFPFSMLSQLVSAGTLIAFMFVSLGIYKLRPREGKDIDDPSFKMPFYPVLPALGFLAALVVFLGLDYQAKLYAGIWFILGLLIYLGYGVHHSVLNNKK

SEQ ID NO: 18434 - protein, 223 aa, Neisseria gonorrhoeae
HTHWGYTGHDSPESWGNLSEEFRLCSTGKNQSPVNITETVSGKLPAIKVNYKPSMVDVENNGHTIQVNYPEGGNTLTVNGRTYTLKQFHFHVPSENQIKGRTFPMEAHFVHLDENKQPLVLAVLYEAGKTNGRLSSIWNVMPMTAGKVKLNQPFDASTLLPKRLKYYRFAGSLTTPPCTEGVSWLVLKTYDHIDQAQAEKFTRAVGSENNRPVQPLNARVVIE

SEQ ID NO: 18435 - protein, 441 aa, Nostoc punctiforme PCC 73102
MTSTLRKFTRLHSPTLHQLPNGLTIIAEQMPVEAVNLNLWIKVGSAVESDAINGMAHFLEHMIFKGTERLASGEFERRIEERGAVTNAATSQDYTHYYITTAPKDFAHLAPLQIDVVSNASIPDDAFERERLVVLEEIRRSEDNPQRRTFRRAMETAYNELPYRRAVLGPESVIAELKPQQMRDFHHSWYQPQSITAVAVGNLPVEELIAIVAEGFTKANKTQHSRSATLTASPLSRDVINRVSTHSSLNPESPFTEIVRREFTDESLQQGRLVMVWRVPGMVQLDRTYGLDVLAGVLGHGRTSRLVRDLREERGLVSSISVSNMSNQLQGTFYISAKCAVENLAEVENAIAQHIRKVQTELVTESEIARVRRRVANRFIFGNETPSDRTGLYGYYHSLVGDLEPAFNYPDYIQSQDATDLMQAAKEYLSPDAYGVVVVKP

SEQ ID NO: 18436 - protein, 300 aa, Bartonella henselae str. Houston-1
MHEFITLLAKHAHSVEKRLATLLSDQVQNGEIARPEILLKAMRYGVLNGGKRLRPFLVIQSCALFDIPIEYSLNVASALECIHCYSLIHDDLPAMDNDTLRRGQPTVHIAFDEATAILAGNALLTFAFEIIAHKTSELSFETRIRLITALAQASGLGGMIGGQMLDLEAEKKPQESKDITTLQHMKTATLISFACQAGAIIGNASQELTEKLAAFGTYLGLAFQLTDDLLDVTASTKVLGKTAGKDETAHKATFIRLYGIEETQKKRDELIAQAEALLLPFGAKATPLQQAARFSATRKN

SEQ ID NO: 18437 - protein, 441 aa, Zea mays
MMKHSSSLCLLFLLALCTTLLACGLVQAQVLFQGFNWESCKQQGGWYNRLKTQVDDIARAGVTHVWLPPPSHSVSPQGYMPGRLYDLDASKYGTAAELKSLIAAFHGRGVQCVADIVINHRCAEKKDARGVYCIFEGGTPDDRLDWGPGMICSDDTQYSDGTGHRDTGEGFAAAPDIDHLNPRVQRELSAWLNWLRSDAVGFDGWRLDFAKGYSPAVARMYVESTGPPSFVVAEIWNSLSYSGDGKPAPNQDQCRQELVDWARAVGGPAMAFDFPTKGLLQAGVQGELWRLRDSSGNAAGLIGWAPEKAVTFVDNHDTGSTQKLWPFPSDKVMRGYAYILTHPGTPCIFYDHVFDWNLKQEISALSAVRSRNGIHPGSELNILAADGDLYVAKIDDKVIVKIGSRYDVGNLIPSDFHAVAHGNNYCVWEKHGLRVPAGRHH

SEQ ID NO: 18438 - protein, 80 aa, Zea mays
KQILAPLPIGFAVFLVHLATIPITGTGINPARSLGAAIIYNRDHAWSDHWIFWVGPFIGAALAAIYHQVIIRAIPFKSRS

SEQ ID NO: 18439 - protein, 466 aa, Cytophaga hutchinsonii ATCC 33406
MYDVVVIGSGPGGYVAAIRCAQLGMKTALIEKYSTLGGTCLNVGCIPSKALLDSSEHYYNATHTFKEHGIDVKDVKVNLKQMIDRKAGVVKQTCDGINYLMKKNKVDVHTGIGSFVDKNTIKVTAADGSVKELKTAKTIIATGSKPTSLPNVAIDKKRIITSTEALELTEVPKHLIVIGGGVIGMELGSVYARLGAKVSVVEFMDTLIPTMDKALGKELIKVSKNHLGFDFYFSHKVTGATAKGKEVTVTAEDKDGKVLELKGDYVLVATGRRPYTEGLGLEAAGVKLDERGRVAVDGHLQTNVPGIYAIGDVVVGAMLAHKAEEEGVFVAESIAGQKPHINYNLIPGVVYTWPEVAAVGYTEEQLKKDGKAYKVGNFPFKASGRARASMDLDGFVKVLADKETDEILGVHMIGPRVADMIAEAVVAMEFRASAEDISRMSHAHPTFTESFKEACLAATDNRALHI

SEQ ID NO: 18440 - protein, 320 aa, Arabidopsis thaliana
MATAVGGGSDVEVGFAKLQGEDFEYYMQSYSIILGRNSKKATVDVDLSSLGGGMSISRNHARIFYDFTRRRFSLEVLGKNGCLVEGVLHLPGNPNVKLDSQDLLQIGDKEFYFLLPVRSILGGPLGPRHHVSGQTSVVPYHNYQSGPGSGSGKKGVRSRELYEYDDEDDDDDDDEEDDMRGSGKKTRRDGHEVVYASGEKKREGRSKVDREADDQQFLQLEEKDVVSSVATVLSDLCGPGEWMPMEKLHSVILKEYGNVWHHSRVRRYLSQEDWAIPEAKGKPWYGLLMLLRKYPEHFVINTRSKGRVTLEFVSLVTLLS

SEQ ID NO: 18441 - protein, 421 aa, Magnetospirillum magnetotacticum MS-1
MKRSRRTKIVATLGPASDTPEMIEKLFHAGVDVFRINMSHLAREKLPERIEVIRTIEREAKRPIGILVDLQGPKLRLGTFLGDAAHIENGQTFVLDSDPTPGNANRVYLPHPEILTALEPDHAVLIDDGKLRLVVTEVSEGRAVTRVEVGGRISNRKGVSLPHTVLPLPAMTDKDRGDLEAGLAAGADWIAVSFVQRPEDVAEVKKVAAGRAQVMAKIEKPQALSRLDEIIEISDGIMVARGDLGVEMPLEQVPGVQKRITRGARRLGKPVVVATQMLESMITSPVPTRAEVSDVATAVYEGADAVMLSAESAAGEFPVEAIATMNRIAEQVERDALYWSILMAQRSEPEPTASDAIAAAAHQIVDALGLRAIMAWTHSGSTVLRLARARPNASVIALTPKRETARRITMAWGVHPITQST

SEQ ID NO: 18442 - protein, 767 aa, Rickettsia prowazekii str. Madrid E
MDEMNKINYTEALEYHEKDKPGKIAITTTKSLVTQQDLSLAYSPGVAAPCLEISKNLEAVYKYTSRSNLVAVISNGTAVLGLGNLGAAASKPVMEGKAVLFKKFADIDAIDLEVNTEDPIEFINAVKYLGYSFGGINLEDIKAPECFLIEEKLKSLMDIPVFHDDQHGTAIITAAGLINAAYLTNRTLKDLKIVINGAGAAAIACIDLLIALGVDKSKIILCDTKGVIYKGRTSGMNKWKERYASDTKIRTLTESLNNADVFIGLSVKGAVTKDMISKMAHKPIIFAMANPDPEITPEDIKFVRDDAIIATGRSDYNNQVNNVMGFPYIFRGALDVRASTINTEMKIAAARAIADLARRPVPEEVYKAYSGRKMVFGNEYIIPVPFDPRLITVVATAVAVAAIESGVARVKDFSIDKYKQQLGSRLNPTANYMNFLAEKIHNVPLKRIVFAEGEEEEVISAALMMRDEKYGNPIIIGRVERIEVTLKKIGKDISLAGIQIMNAALSDRLEQYTDYLYKRLQRKGYLYRDCAKLVKTDKNIFAACMVACGDGDALLTGVTKSYIDSLEDIIKVISPKQNRRILGYSIMIAKDHNIIIADNCITEYPNSLELAQIATQTAEIAKNMGITPRVALIAFSTFGNSSQEKTVRIREAVNILDNFSKDKKKLNGIKVDFEYDGEMSVKVALDHDLRKLYQFCRLSGSANVLIMPGLNSAAISTELLQKFSSNSFIGPITNGFAKPVQILPTTATANEILKIATFACVEAIKEV

SEQ ID NO: 18443 - protein, 491 aa, Bradyrhizobium japonicum USDA 110
MTVHFPFQNSYSALPDSFFARVAPTPVAAPRLIKLNRPLAVQLGLDPNMLETPEGAEILAGKTVPDGADPIAMAYAGHQFGQFVPQLGDGRAILLGEVIDRDGVRRDIQLKGSGPTPFSRRGDGRAALGPVLREYIVSEAMYALGIPTTRSLAAVVTGEHVIRETALPGAVLTRVAASHIRVGTFQFFAVRRDTDAIRRLADHVIARHYPELLGTERPYHALLAGVVARQAELVARWLLVGFIHGVMNTDNSSISGETIDYGPCAFMDAYNPAQVFSSIDEMGRYAYANQPRIALWNLTRLAECLLPLFGEEQEKAVEQAQDILGAFPETFSKAYQAGLRKKVGLFTERDGDEALIQDLLDAMAKNQADFTLTFRRLGDAAGDPAADDARAEFMDPAAFDEWARRWRERLAAEPQSAAERQTAMNAVNPLFIPRNHRVEAVIQAAVNDDNYALFEELVKVLAKPYEDQPDYAAYADPPLPDQRVLQTFCGT

SEQ ID NO: 18444 - protein, 444 aa, Medicago truncatula
MMATNLHRHRRRISTLTHRLYSSFSTTTTTKTSTLYTTDTPDPTTVQLLSWGKGASGQLGGGVEETRLYPSPVTNLLLAPKFTLFNTPGLLPGPEGSNNKGVEVGISCGLFHSCLVVDGGLWVWGKGDGGRLGLGHESSMFVPTLNPHLENVKSVALGGLHSVALTSAGEVFTWGYGGFGALGHSVYTRELFPRLVKGAWEGTIKHIATSGAHTAAVTESGDLYIWGREEGEGRLGLGPGRGPDHAGGLSIPCKVKELPFPVAAVSCGGFFTLALTEEGQLWNWGANSNYELGRGDRIGGWRPRPVPSLEKVRVIQIASGGYHSLALTDDGKVLSWGHGGQGQLGHGSVENQKIPTLVEAIAHEHIIYISCGGASSAAVTDEGKLYMWGNASDSQLGVPGLPAIQPYPVEVNFLMEDDGLGSHKVLSIANGASHAMCLALRESC

SEQ ID NO: 18445 - protein, 323 aa, Rubrobacter xylanophilus DSM 9941
MQGQSLLHRGLSESVLEAIGDTPLIEVEEGIYAKLEYLNPSGSIKARIAKYIVEKAEREGLLLPGHTIVEATSGNTGNAFSMVAAIKGYRMVVLMPEGLSTERVAISRAFGAHIEHVGEFYVTEALKRARELGKKEGYFCPAQFDSEWNVEENREWLGKEILGQLEEGGVGAPDALVMGVGTGGTLIGVGQAFREKNAEAKLIAVEPEESCTLLCGESGVHKIEGISDGFVPGIYERHAERLGVDEVYAVGSEEALGAMRWLARRRGLFVGPSSGANLVAARRLKEAHPELKSIVTLFCDEGEKYISEHFAGEGRTLETGERA

SEQ ID NO: 18446 - protein, 491 aa, Colwellia psychrerythraea 34H
MTTEIKVPVLPESVADATVATWHVQVGEKFTRDQVLVDIETDKVVLEVPATCDGVMTDISQADGATVLGDQVIGSFSEGSEAAAPAPVAAASAPAASGAVKVIDIVVPVLPESVADATVATWHVAEGDTVSVDQNLVDIETDKVVLEVVAQDNGVIGKIIHVEGDTVLGAQKIGELNAGATAGSAATAAPIEDAVSSDDLASPSVRRLMTEKGLTAATVVGTGKGGRISKEDVEAAANKPAAAPKAVAPVAAPVQELGERTQKRVPMTRLRKTIATRLLEAKNSTAMLTTFNEVNMKPIMDLRKQYKDLFEKTHDTRLGFMSFYVKAVTEALKRFPAVNASIDGDDIVYHNFFDISIAVSTPRGLVTPVLRDSDQLSMAGIENGIRELAIKGRDGKLSMADMTGGNFTITNGGVFGSLLSTPILNLPQAAILGMHKIQDRPMAVDGKVEILPMMYLALSYDHRLIDGKESVGFLVTIKELLEDPTRLLLDV

SEQ ID NO: 18447 - protein, 255 aa, Rubrobacter xylanophilus DSM 9941
MPGRLEGKVAVITGAASGIGRESARRFAEEGAGVCVVDLDPSGGKEVAASVDGLYVRADVTDPKDVQRMYREAADYFGRLDVLFNNAGISPPEDGSILETSIDAWQRVQDANLKSVYLCCKYGIPYLLENGGGSVINTASFVAVMGAATSQISYTASKGGVLAMSRELGVQFARQGVRVNALCPGPVDTPLLQELFAKDPEKAKRRLVHLPMGRFAKAAEIANAALFLASDESSYVTASTFLVDGGLSGAYVTPE

SEQ ID NO: 18448 - protein, 453 aa, Rubrobacter xylanophilus DSM 9941
MIEVVNPATEEVLKRLEPASSSEVDAAVDRAKRAFPGWRDVPPAERARLLGRLAEALDAEREDLARTESLNVGKPLSAARAEMKMVVDTFAYYAGAPERLLGETIPVAGGVDMTFREPLGVVGLIVPWNFPLQITSWKVAPALAAGNTVVLKPAELTPLTALKLERIAGEAGIPEGVLNVVVGPGEIVGKRLVEHPEVAKIAFTGSTEVGRKIMAGAAGTVKRVTLELGGKSASIVFADADLEKAAAAAPLAVFDNAGQDCCARSRILVERGAFERFMSLLEPAVKELRVGDPQDETTQMGPLISASHREKVASYVTEEAPVAIRGEAPDGKGFWYPPTVLAPVSNKDRVAREEIFGPVAAVIPFEDEEEAVRLANDTIYGLSGSVWTRDVARALRVARRVETGTLSINSNTSVRVSTPFGGFKQSGVGRELGPHALEHYTEVKNVFVATEEG

SEQ ID NO: 18449 - protein, 456 aa, Kineococcus radiotolerans SRS30216
MFSHRVRVATVRSMRMTVIGCGYLGAVHAACMAELGHEVIGIDVDPEKIAALQAARAPFYEPGLPELLERTMATGRLRFTTDIAEAAGSAVHFVCVGTPQKKGEFAADMKYVDAAVDALIPHLGAGELVVGKSTVPVGTAARLASRIADRAPDTEGLAWNPEFLREGHAVEDTLTPDRLVYGVDGGADTAEGKRAKALLDEVYATPLKRGTPLIVTDYQTAELVKVAANSFLATKISFINAMAELCEKVNADITQLADAIGHDDRIGRKFLNAGLGFGGGCLPKDIRAFMARAGELGADQTLTFLREVDSINMRRRIRMVDLAREVCDGSLIGRRVAVLGAAFKPLSDDIRDSPALNVAAQIRLQGGDVVLTDPAALDNARKAVPDISYAETVEDAVRGADVVLLLTEWKEYRDLEPATISGLVKNKRILDGRNALDPARWRAAGWTYRALGRPRA

SEQ ID NO: 18450 - protein, 769 aa, Bradyrhizobium japonicum USDA 110
MSSYSDDLHQAALAYHRLPRPGKLEIQATKPLANQRDLALAYSPGVAAACTEIAKNPAEAATLTTRANLVAVVSNGTAVLGLGNIGPLASKPVMEGKAVLFKKFAGIDVFDIEIAADTIDRVVETVAALEPTFGGINLEDIRGPECFEIEARLKERMKIPVFHDDQHGTAIIVAAAITNGLRLNGKKLSDVKIVASGAGAAAIATLNLLVSMGAQRKNIWVCDIDGLVHEGRNTSMDRWKAVYAQKTDKRTLADVIGGADIFIGLSAPGVLKPEMAKAMSDKPLIMALANPTPEIMPEEARKVRPDAMICTGRSDYPNQVNNVLCFPFIFRGALDVGASAINEEMKHAAVEAIAQLAREAPSDAVAQGVDTGEMGGFGPGSLIPSPFDPRLILRVAPAVAKAAIESGVATRPITNFDEYAAQLMRFAFRSGLVMKPMFAKAKTQPVRVIYAEGEDERVLRATQVVLEEKLATPILVGRPSVVEARIKRFGLSIKAGKDFDLVNPEDDPRYRSYVQSYVEVAGRRGVTPDAARTVVRTNNTVIAALAVTRGEADAMLCGVEGRYMSHLRHVREIVGFSAGISDYAALALLITSKGAFFIADTQVRPNPSAEELAEIASLAAVHVQRFNIKPKIAFVSHSDFGSYDTESSRKMRRATQLLKEKHPEIEADGEMQGDTALSAAARKMVLPHSNLEGEANIMIMPTLDTANVAYQMIKSLADALPVGPILIGPARPAHILTPSVTARGILNMTAVAVVEAQERAARQQPTLFT

SEQ ID NO: 18451 - protein, 507 aa, Rickettsia prowazekii str. Madrid E
MNIVDSNCTIWHKARNSKFRHIVWPIRSYELTKFIPMTLLMFFILLNQNLVRSIKDSFVVTLISSEVLSFIKLWGEMPMGVLFVILYSKLCNIMTTEQVFRIITSTFLFFFAIFGFILFPYKEFFHPNPELINQYIIVLPHLKWFLIIWGQWSLVLFYIMGELWPVIVFTLLYWQLANKITKVEEAPRFYSFFTLFGQTNLLFSGTVIIYFAKSEHFLLPLFAHLNDTNEILLKSFITVILISGLICLALHKLIDKSVVEADKNIKFKNQRTDILKLSLLESAKIILTSRYLGFICLLVMSYSMSINLIEGLWMSKVKQLYPATKDFISYHGEVLFWTGVLTLVSAFLGSSLIRIYGWFWGAIITPIMMFVAGVMFFSFTIFEQHLGNIVNTLGYSSPLVIIVFIGGLWHVFAKSVKYSLFDATKEMVYIPLDNEIKTKGKAAVDVMGAKIGKSIGAIIQFISFSIFPNAVHNDIAGLLMVTFIIVCILWLYGVKVLSQNYNKMIKR

SEQ ID NO: 18452 - protein, 338 aa, Streptococcus pyogenes MGAS315
MKAVVVNQASTGVEVVEHDLPNVGHGEALVKVEYCGVCHTDLHVAHGDFGQVPGRILGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGAAPGQWIVIFGAGGLGNLAVQYAKKVFNAHVVAVDINNDKLELAKEVGADIVVNGKEIEDVPGYIQEKTGGAHGVVVTAVSKVAFNQAIDSVRAGGTVVAVGLPSEYMELSIVKTVLDGIKVVGSLVGTRKDLEEAFAFGAEGLVVPVVEKVPVDTAPEVFDEMERGLIQGRKVLDFIS

SEQ ID NO: 18453 - protein, 480 aa, Rubrobacter xylanophilus DSM 9941
MSRGERRGVQGVEYEHVGAEYLERRQLKKGAAGWVLLAGLGVAYVISGDFAGWNFGLAQGGWGGLLIATLLMATMYTTMVLALAELSSAIPVAGAGYGFARRAMGPWGGFLTGTAILIEYAIAPAAIATFIGAYVESLVGFGGPLVYLFFYALFVGIHLYGVGEALKLMFAITAVAALALVVFVIGMIPQFDAANLFDIAPADAAGASEFLPFGYLGIWAALPYAIWFFLAIEGVPLAAEETRDPATDMPKGLIGGMLVLLVFAALILIFGPGGAGSAAIQDSGNPLVEAVQAAYGGPNLLSGFINVVGLAGLVASFFSIIFAYSRQIFALSRAGYLPRWLSVTNRRRVPWVALVVPGVIGFLLSLSGQGDLLILIAVFGATISYVLMMLSHIILRYKEPEMERPYRTPGGVLTSGVALMLACAAVIAGFLVDPRVLVGTAIIYAILIAYFAFYSRHHLVAEAPEEEFEAVQRAEAELSG

SEQ ID NO: 18454 - protein, 621 aa, Vitis vinifera
MEAVLQTKGLLSLPSNPKFRVFNSQQGLRQRLFVQKPKTLGGLSLPLNGFQKFQGFVAKPHDFCRQNRGFICRAEAAAAADGQSLFAEPEKPKFLGIETATFKKIVPLGLMFFCILFNYTILRDTKDVLVVTAPGSSAEIIPFLKTWVNLPMAVGFMLLYTKLANVLSKQALFYTVIVPFIAFFGAFGFVLYPLSNFFHPTALADKLLAALGPRFLGPLAILRIWSFCLFYVMAELWGSVVISVLFWGFANQITTIDEAKRFYPLFGLGANVALIFSGRTVKYFSNLRQNLGPGVDGWAISLKGMMSIVVLMGLAICFIYWWVNKSVPLPTRSKKKKEKVRLGTMESLKFLVSSRYIRDLATLVVAYGISINLVEVTWKSKLKAQFPSPNEYSSFMGDFSTATGIATFTMMLLSQWIFNKYGWGAAAKITPTVLLLTGVGFFSLILFGDPFAPALAKFGLTPLLAAVYVGAMQNIFSKSAKYSLFDPCKEMAYIPLDEDTKVKGKAAIDVVCNPLGKSGGALIQQFMILTFGSLANSTPYLGGILMVIVVAWLAAAKSLDTQFTALRREEELEKEMERATVKIPVVAQDESGNGSLASDPALNPAGGDSSSSSSETTPRNI

SEQ ID NO: 18455 - protein, 267 aa, Methylobacillus flagellatus KT
MAINIKTEQDIEKMRVACKLASEVLDFITPHIQAGVTTGELDELCHDYMVNVQHTIPAPLNYAPHGHSPFPKSICTSVNHQICHGIPGAKVLKNGDILNIDITVIKDGYYGDTSRMFHVGDISIQAKRLSEVTYECMWLGIDQVKPGATLGDIGHAIQTYAEKQGFSVVREFCGHGIGKNFHEDPQVLHYGQPGKGAVLKPGMIFTIEPMINAGKRDIKQLGDGWTIVTKDHSLSAQWEHTVLVTDTGYEVLTVSAGTPPAPAFINK

SEQ ID NO: 18456 - protein, 177 aa, Vitis vinifera
MVGASSSWSRALVQISPYTFSAIGIAIAIGVSVLGAAWGIYITGSSLIGAAIKAPRITSKNLISVIFCEAVAIYGVIVAIILQTKLESVPASNIYAPESLRAGYAIFASGIIVGFANLVCGLCVGIIGSSCALSDAQNSSLFVKILVIEIFGSALGLFGVIVGIIMSAQATWPASTA

SEQ ID NO: 18457 - protein, 222 aa, Zea mays
IQRTSGEYLARNGVRIYACSETVKFGHVTFFWNGNRSGYFDQNLEKYEEIPSDAGIPFNVQPKMKALEIAQKARDAILSQKFDQVRVNIANGDMVGHTGDIEATIVGCKAADEAVKIILDAVEQVGGVFVVTADHGNAEDMAKRDESGEPLRDKDGKVQTLTSHTLNPVPIALGGPGLAPGVRFRTDLASAGLANVAATVMNLHGFEAPDHYEPTLIQVVDE

SEQ ID NO: 18458 - protein, 514 aa, Cytophaga hutchinsonii ATCC 33406
MAFEVKVPTVGESITEVTIGRWNKKDGEFVDVNELICEIESDKATFELNAEKSGILKLNAKEGDTVAIGTVICSIEEGAGSAAAKPAANAAPAAAPAATPAAPAPAASNAAPVEVKIPTVGESITEVTLGAWSVKSGDAVKAGDLLLEIESDKATFELHAETTGTIEILSKSGDTVAIGTVVCKIVPGAGGASQAAAPASAPAATAAASSGGANYAGGHASPAAGKILNEKGVDASAVAGSGKDGRITKEDALKASAAPAAAAKPAAAASTAAPAAKASAAGRADDRVKMTSLRKTIARRLVAVKNETAMLTTFNEVDMKPVMDMRSKYKDTFKEKYGIGLGFMSFFTKAVCMALQEFPAVNAYIDGDEIVYHNFCDVSVAVSTPKGLVVPVIRNAETMSFNEIEAEIVRLATRARDGKLSIDEMSGGTFTITNGGIFGSMLSTPIINSPQSAILGMHNIVERPVAVGGQVVIRPIMYLALSYDHRIIDGRESVGFLVRVKQLLEDPSRLLLGV

SEQ ID NO: 18459 - protein, 311 aa, Zymomonas mobilis subsp. mobilis ZM4
MKLLAGNSNLPISQAIADYLEIDLTKASVRRFADEEIFVEIRENVRGQDVFVIQSTCWPTNDNLMELLICIDALKRASARRITAVIPYFGYARQDRKPGPRTPISAKLVANLITVAGASRVLSVDLHAGQIQGFFDIPTDNLYAAPVMSADILARFPDKKLTVVSPDVGGVVRARALAKRLDNAPLAIVDKRRERPGESEVMNIIGDVSGRFCILIDDIVDSAGTLCNAAEALLNAGAEGVIAYVTHGVLSGAAVARVEKSSLQELVVTDSIGMRPEVEQCAKIRQLSLAPLLAEAIRRIADETSVSSLFD

SEQ ID NO: 18460 - protein, 399 aa, Methanosarcina mazei Go1
MEKAEFRVSRIQSKQNSEDIIYGTLGGHNLKEIKFSENVSRIDTSGIRKIFEAAGSNAINLGLGQPDFDTPDHIKAAAIKAINEGFTGYTAGPGIPELREALSQKFKEENCFSVSPQEIIVTSGASEALTIALTALLNRGDEVLISNPGFVSYNALTEMLYGKVVNVPLGEDLTMKPEDVLERITPKTKAIILNSPSNPTGAVSSRADIKALAEIADDHRITIISDEVYEYFIYEGEHVSPASYSDNVVTVNATSKSYAMTGWRLGYLAARNEYISQMLKVHQYIQACANSIAQKAAYAAVTGPKDSVSAMREEFRKRRDVLVKGLNDLGMECALPKGAFYAFPRVSNSAEVASKMISNGVVVVPGTAFGSEGDGYIRISYAASMKDIEKSLSIMEKVL

SEQ ID NO: 18461 - protein, 229 aa, Bartonella henselae str. Houston-1
MSTDTTPHDLCVEAWKNLQKDITKTCKDYHRLAEEIQFIAVSKTVSVENIRPLLQAGQSVFAENRVQEATEKWSVLRQQFKNIELHLIGPLQSNKTAQAVKIFDVIQTVDREKIAKNLSIEMQKQKKTLPCYIQVNLGLEPQKSGIAPQEVVPFVARCKNHYGLDIIGLMAIPPVEENPGPYFALLAKLAKQADLQKLSMGMSNDFKTALQFGSNVLRIGSALFGKRPV

SEQ ID NO: 18462 - protein, 110 aa, Zea mays
MGNARRPAADSAAASDREVGFAKLHGECFEYYMQTYSIVLGRHSRRRSKGPVAAPPEADDGVDVDLGALGAGMNVSRRHARIFYDFLRRRFALEVLGKNGCLVEGVHHVP

SEQ ID NO: 18463 - protein, 336 aa, Colwellia psychrerythraea 34H
MKPVICFGEALIDFLNTGSQEDGCLTLNNYRQYPGGAPANAAVAVSRLGGKAFFAGQVGDDAFGDFLINALHTYQVDTQFVSKHPHAKTALAFVLLDEMGERSFSFHRHQTADLLFEKSQVDEIWFCESPIFHFCSNTLTEKDIADCTEYAVERALVHGAIISFDVNLRHNLWATGKVSISVVNKLVKQAHVLKFSSEELTYLAQGNIESYIQSCFDANCQLLIITDGENVLTYYTAAILDAISPPKVITVDTTAGGDAFIGALLFALSHFEQLTELLDDNELLKQIINFSASCGALTVTKAGAFPALPNFEQAVAFVKELGLKQTQLLDIFSRSR

SEQ ID NO: 18464 - protein, 249 aa, Oryza sativa
  misc_feature (137)..(137): Xaa can be any naturally occurring amino acid
  misc_feature (228)..(228): Xaa can be any naturally occurring amino acid
IGPKTEHPDNAGILIDEGLNVARLNFSHGDHEEHRGQMAGVREALKKRPGAHSSILLDTKGPEIRTGNMEGNKPIILERGQLLELTTDYSYLGNNKRIACSYQDLERSAKIGKKILFADGSISSVVRKVENGIVTVXILNDGKLGNKKNMCLPGVTISLPTIGTYDEYDIVEFGLKDKVDYIAISFARYGTDLTRLRQYLKEKDPIHGAHIHLISKIENHEAIHNIDXIIQNSDGIMVARGDLVLEVSI

SEQ ID NO: 18465 - protein, 650 aa, Listeria innocua Clip11262
MILLQVQQISKFFGAEVILDNIKLEVKTGDRIALVGRNGAGKSTLLKIIAGKMSYDGGTISKPKSVEIGYLAQNTGLESTKTIWDEMLSVFDSLRKMEADLRKMELRLGEPELYNNPEKYQALMTDYDTLQHTFKEVGGYTYEAEIRSVLNGLRFYPEDYEVEIASLSGGQKTRLALAKLLLAKQDILVLDEPTNHLDIETLAWLETYLQNYHGSLLIVSHDRYFLDKVVNQVYEISRTRIDHYKGNYSSFVSQKQAKLEQMWKEFDKQQKQISKLEDFVARNIVRASTTKRAQSRRKQLEKMDVLARPQGDEKSAHFGFQFEKQTGKDVLMVDKLSIGYAKDKRIASNLTFEMKRQDSLALVGPNGIGKSTLLKTLIRDIPALSGEFHFGAGVKIGYYDQEQAKLTSNKTVLMELWDDYPELNEVNVRTTLGNFLFSDDDVLKNVQSLSGGEKARLALAKLTLLEANVLILDEPTNHLDIESKEVLEAALIDFEGTILFVSHDRYFINRIASKVVELAPEKATVFLGDYDYYQEKIAEAKELARLDAEDRRKKGEPVEATASVRKLNYQEEKEQQKLLRQRKRKLEEVEKSMEETDKKIAELELQLTKPEIFQDHEKAFEITQELDVVKARGEKLMEEWEKVSEELESM

SEQ ID NO: 18466 - protein, 123 aa, Medicago truncatula
MGVPVDSNRVQLFGQPSEQNTYADIEAAYKCLVEMYGSKEEDIILYGQSVGSGPTTDLAARLPNLRAVILHSPILSGLRVMYPVKRTYWFDIYKNIDKIPMVNCPVLVIHHIDACWKWLAEQL

SEQ ID NO: 18467 - protein, 607 aa, Medicago truncatula
MPTSLDYDLSQKNKKTLDFIEDITTHADEIQKKVLAEILNRNANVEYLQRHGLNGHTDSETFKKLLPIITYEDIQNDINLIANGDTSPILTSNPISNFLTSSGTSGGERKLMPATEEEFGRRYLLYSYLMPIMSQFIPDLEKGKGMYLMFIKNESKTPGGIKASPVLTNYYKSSHFLNRPYDPYTNFTSPNETVLCLDSYQSMYSQLLCGLIQNNEVLRVGAVFASGLIRAIRFLEKNWRLLCNDIRTGTLDLLITDDSVREAVMKILKPNKNLADFVEGECNKGSWQGIITRLWPNTKYVDVIVTGTMSQYIPTLDYYSNGLPLVCTMYASSECYFGVNLNPLSKPCHVSYTLIPTMCYYEFLPVNRSNCEVNGSIPPSTTKSLGEKKYQEVVDLVDVKLGQEYELVVTTYAGLYRYKVGDVLKVTGFKNKAPQFSFVCRKNVVLSIESDKTDEVELQNAMKNAVTHLAPFEADVAEYTSYADTTTIPGHYVLYWELNLKGSTKIPHSVYEDCCLTIEESLNSVYRQGRVSDKSIGPLEIKIVEQGTFDKLMDYAINLGASINQYKTPRCVKFAPMVELLESRVMAKYFSPKCPKWVPGHKKWNNE

SEQ ID NO: 18468 - protein, 80 aa, Lactobacillus acidophilus NCFM
MSEEEIFNKIKDLIADNFEVDKDSITENTNFMNDLDADSIDLVEFILQLEDEFGAEIPDDEAEKIKTVGDAVSYIKSHQG

SEQ ID NO: 18469 - protein, 711 aa, Oryza sativa Indica Group
MAGVVTRAVAAAVLVVVVVVAAAELVAAEPPPSERSALLAFLAATPHERRLGWNSSTSACGWVGVTCDAGNATVVQVRLPGVGLIGAIPPGTLGRLTNLQVLSLRSNRILGGIPDDVLQLPQLRLLFLQNNLLSGAIPPAVSKLAALERLVLSSNNLSGPIPFTLNNLTSLRALRLDGNKLSGNIPSISIQSLAVFNVSDNNLNGSIPASLARFPAEDFAGNLQLCGSPLPPCKSFFPSPSPSPGVSPADVPGAASSSKKRRLSGAAIAGIVVGAVVLALLLLVAAVLCAVSKRRRGASEGPKSTTAAAAGAGAAAARGVPPPGSGEGTGMTSSSKEDMGGASGSAAAAVAAVAAEPSRLVFVGKGAGYSFDLEDLLRASAEVLGKGSVGTSYKAVLEEGTTVVVKRLKDVAVARREFDAHMDALGKVEHRNVLPVRAYYFSKDEKLLVFDYLPNGSLSAMLHGYYSYSRSMAPILIALSLEVFDWRMPEWSRGSGKTPLDWDARMRSALSAARGLAHLHTVHSLVHGNVKSSNVLLRPDADAAALSDFCLHPIFAPSSARPGAGGYRAPEVVDTRRPTYKADVYSLGVLLLELLTGKSPTHASLEGDGTLDLPRWVQSVVREEWTAEVFDVELVRLGASAEEEMVALLQVAMACVATVPDARPDAPDVVRMIEEIGGGHGRTTTEESEEGVRGTSEEERSRGTPPAAPTP

SEQ ID NO: 18470 - protein, 364 aa, Hyphomonas neptunium ATCC 15444
MLALAKEAGDLALSYTLTGGAEAWNKTGGKGPVTEADLAVNRLCLKQLQTARPDYGWLSEETLDDPAARAKSRVWVVDPIDGTRAYISGDPHWCIALAIVEEGEAVASVLYAPALSRMYSARKGAGAFLNGNAIHVSLRDAEDGLRLITNEGLVTHPAWKEPWPRVEIARPKPNATLLRMAHVATGEWDAALVLAEKSDWDLAAGTVLVHEAGGHATTHLGEAFVFNQAVPAQRSVLASGKALHPLLLRRLEVVKIPDPQARAAQPMPDQTKPVQTEPKRMSESAKTGKQLLHIVFGGELKDVTGVEFEDLSQMDFIGAFPNYQEAYDAWKSAAQRTVDQAEMRYFILHAHKLLDPATGDHHHV

SEQ ID NO: 18471 - protein, 737 aa, Halobacterium sp. NRC-1
MRLTVKQLKNRDPGSGMAVIDRDALQEIGVSSGDFVAIEGRNGGRTVARVWPSNTSDAGRGIIRIDGQLRQAANVSIDDRVEVEKTEVEPADRVTVSLPQNLQIRGDLGSHLREHLVDQAVRAGQTVAFPIGFGMFSGRSGRRIPLRVVDTQPSGTVVVQNTTEIEIADQSAQEVSVESGEPENTTAPALTYEDIGGLDDELEQVREMIELPMRHPELFGTLGIEPPKGVLLHGPPGTGKTLIAKAVANEIDAHFQTISGPEIMSKYYGESEEQLRDVFEEAEENAPAIVFIDELDSIAPKREDVSGDVERRVVAQLLSLMDGLEERGQLTVIGTTNRVDAVDPALRRPGRFDREIEIGVPDHDGREKILQIHTRGMPLGDGVDLDRYAENTQGFVGADLENLVKESAMHALRRIRPDLDLDEEEIPADILDSIEVTENDFKEALRGIEPSALREVFVEVPDVTWDHVGGLDDAKERLQETVQWPLEHADAYEQVALEPAKGVLLYGPPGTGKTLLAKAVANEANSNFISIKGPELFNKYVGESERGVREVFSKARENAPTVVFFDEIDAIASERGQGVGDSNVGERVVSQLLTELDGLEELEDIVVIATTNRPDLIDDALLRPGRLDRHVAVDEPDEAARREIFEIHTEDKPLAEDVDVDELVERTDGYVGADIEAVCREAATVAVREYVRATASAESANVDEIELSIEHFEQALEEVDSNAGSETQAFEKPAEAV

SEQ ID NO: 18472 - protein, 139 aa, Methylococcus capsulatus str. Bath
MAYSDKVIDHYENPRNVGSFDKDEDGVGTGVVGAPACGDVMKLQIKINEEGVIEDAKFKTYGCGSAIASSSLVTEWVKGKTVDEALAIKNSDIAEALALPPVKIHCSVLAEDAIKAAVSDYKAKLGVADDGYEIRKSAA

SEQ ID NO: 18473 - protein, 216 aa, Methylococcus capsulatus str. Bath
MTENTLDPAADLLERLGDKRFRTILADPPWQFQNRTGKMAPEHKRLNRYGTMSLEAIAGLPVERLTADTAHLYLWVPNALLLEGLKVMEAWGFTYKTNLVWHKIRKDGGPDGRGVGFYFRNVTELVLFGVRGKNARTLAAGRRQVNFLATRKREHSRKPDEMYGIIESCSPGPYLELFARGARDRWSVWGNEADENYYPRWNTYANHSQAEICPFE

SEQ ID NO: 18474 - protein, 479 aa, Kineococcus radiotolerans SRS30216
MSPTSASPKAQATRVAILGGGPGGYEAALVAAQLGADVTVVERDGLGGSTVLTDVVPSKTLIATAELMSTVGGSAELGVRFPGGPTPDAEPRGAVTVDLARVNERVKALAAAQSGDVRARLEKEGVRLLSGRGALDGPQAVVVTDGEDEGARVEADIVLLSTGSSPRTLPDAQPDGERILTWKQVYDMTELPEHLIVVGSGVTGAEFANAYDALGAHVTLVSSRDRVLPGEDADAAEVLEGVFRRRGMDVLSRSRAEKVERHGDTVTVTLSDGRTVEGSHCIVAVGAIPNTAGIGLEEAGVWTSDSGHVDVDKVSRTSARGVYAAGDCTGVFPLASVAAMQGRIAMWHALGDSVGPLKLRSVSSTVFTSPEIATVGWTQAQIDSGEAQGEIVKLPLSTNARAKMLGIHDGFVKLFCRKGSGTVIGGVVVAPRASELIFPVTLAVEKRLNVDDVAHAFTVYPSLSGSLAEAARQLHVMAE

SEQ ID NO: 18475 - protein, 149 aa, Zea mays
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSVENGKKEIALWFPEGVAQWKSNLHPWIYEA

SEQ ID NO: 18476 - protein, 341 aa, Colwellia psychrerythraea 34H
MKSLAKLKAEPGIWLTRTEKPKLGHNDLLIKIKKTAICGTDIHIYNWDEWAQKTVPTPMVVGHEYAGEVVGIGQEVKGFTLGDRVSGEGHITCGHCRNCRGGRTHLCRNTVGVGVNRAGSFAEYLVIPAYNAFKLPDEISDDLASIFDPFGNAVHTALSFDLVGEDVLITGAGPIGIMAAAVAKHVGARHVVITDINEYRLDLARKMGATRAVDVSKESLKDVMTDLGMTEGFDVGMEMSGVPMAFTSMLESMNNGGKIAMLGIPGSDMAIDWSQVIFKGLTIKGIYGREMFETWYKMASLIQSGLDLTPIITHHYNIDDFQQGFDMMRSGQSGKVILDWT

SEQ ID NO: 18477 - protein, 269 aa, Leifsonia xyli subsp. xyli str. CTCB07
MLGAGSMGRAILSGLTAPGVTVTGGIRATNRSAASAEGLGDLPGVTAYATEADPDANRLAVAGTEIVVVAVKPGMVPGLLREIAPSLTPGAVVVSVAAGVTTATFESLLPESVAVVRSMPNTPAVVGRAVTGISAGTRSEPDDLALVRSLFETVGEVVDVPESQLDALGTISGSGPAYVFFLVEALTAAALEKGFTPEQARTLVNGTFLGAADLLVASGEDPADLRRRVTSPGGTTERAIGVLAAADLPALFARATDAALARSRELAAT

SEQ ID NO: 18478 - protein, 421 aa, Halobacterium sp. NRC-1
MAVTHAEGIEVTDAGGTTYLDCLAGAGTLALGHNHPAVTAELERLLAEDRPLHTLDITTPEKEAFVDALFDSLPASFANTAKVQFCSPAGTDAIEAALKLTKTATGNRSVLAFHGGYHGMTAGALSLMGDIDAKEPVSGLMPNVHHLPYPDQYRHPFGLPAGEHESIHTYIEHAISSPERGFTEPAAVVLELVQGEGGVNPAPDAWVQELRRITREHDIPLVVDEIQTGLGRTGETWSFEHAGIEPDVVTCSKAVGGGLPLAVVLYNEGLDVWEPGAHAGTFRGNQLAMAAGRVTIEHVIEQDLPAHADKTGARLRSALTDLEADFDVVGDVRGRGLMLGVEFVAPDAAGDERPPPDGDLAAAVKQACFERGLIIETGGRDSAVARFLPPLIVSSHQIDEIAARFSDAVTAVLSSSAEVSA

SEQ ID NO: 18479 - protein, 468 aa, Azoarcus sp. BH72
MDRYGALWRAFLQDNRSLVEGANPFQYAGRLTRINGLVMEAAGLKLPLGSGCQIVVPGSGAVEAEVVGFNGEKLYMMPTDDVFGLAPGAQVLPMENSVPRLVPGKRLGPRRRASDRAKHLPVGDAMLGRVVDGAGRPLDGLGPLNTVETRSLQGRPVNPLNRAPIAQPLDVGIRAINSLLTVGRGQRLGLFAGSGVGKSVLIGMMARFTSADIIVVGLIGERGREVKEFIEHNLGAEGRKRSVVVAAPADNSPLMRLQGAAYATTIAEYFRDQGKQVLLIMDSLTRYAMAQREIALAIGEPPVTRGYPPSVFARLPALVERAGNGPDGGGSITAFYTVLAEGDDQQDPIADSARAILDGHFVLSRNLADQGHYPAIDIEQSISRAMHTLVDNAHFDLVRRFKQLFSRYQRSRDLIAVGAYQPGAEPLLDMAVALYPRLEAFLQQRVDEREPYDGAVMKLAQLFTGTPG

SEQ ID NO: 18480 - protein, 527 aa, Medicago truncatula
MSTTFSSLSEDLNSPILPPSSKTSNETEKICIDEMLEKYCGEFGKWQLKHFILTSLAWALEAFHTMVMIFADREPDWKCVEGMECSANGSVCDMASSSWQWVAGEGASTVSEWSLICGDKFKIGLVQALFFAGCMIGAGVFGHLSDSSLGRKGSLIVVCALNTIFGCLTAFSPNYWIYVLLRLLTGFSTGGVGLCAFVLATEPIGPSKRGMAGMSTFYFFSSGIAILSGIAYTFQTWRTLYIVSSIPSILYIILVLPFISESPRWYLVRGRINEATTLMSTIASFNGKHLPDGVVLALDEEVSNSKKSTSDLEYNLISYVENKDAQVGSIIDVIRYPVTRIRLFLAIALNFLASVVYYGLSLNVTNLETNLYMNVLLNAVAEMPAFTITAVLLDRFGRKPLTIGTMWFSGFFCLLGSFMGNVGVWKVIKLVCGVLGIFGMAGTYNLLFIYTSELFPTVVRNAALGSATQAAQMGAILAPFVVVLGSWLPFGVFAVCGILGGMFAFYLPETLNMPLYDTFNGLEAGLA

SEQ ID NO: 18481 - protein, 514 aa, Bradyrhizobium sp. ORS278
MRAQAMTHFIDPRLRDAALPFWPEFETIGSHVGGELVIGIGAAVSVNDPATGKLLFSYTDAGADVGAKAAAAAVAGQAEWARVTAAGRGRVMQAVARAILALAEPLAQLESLSAGKPIRDTRGEVAKVAEMFEYYAGWADKFHGDVIPVPTSHLNYTRREPMGVVLQITPWNAPIFTAGWQIAPAISMGNAVILKPSELTPLTSLALAVLAERAGLPKGVVNVLAGFGHTTGQAALAQPAVKKVVFVGSVPTGRLIGEAAARRLVPSVLELGGKSANIVFADADLERAAIGAQAAIFGGAGQSCVAGSRLLVQSAVYDRFVDLVAKGAAKIKCGDPLSADTEIGPINNAKQYDHVLSLIREGAEGGAEIVTGSTGESAGGGYYVKPTVLKNVTNAMGIARKEVFGPVVAAIRFETEEEAIAIANDSEFGLAGAVWTKDVARAHRVAAQVKAGTFWINSYKTINVASPFGGFNNSGHGRSSGVEALYEYTQVKSVWVETAAEPAIAFGYAPGLRE

SEQ ID NO: 18482 - protein, 253 aa, Mycobacterium smegmatis str. MC2 155
MSAHEHVHEDSVAGQVVTITGASSGIGEATARLLAARGASVVLGARRTDRLDRIVEEIRSTGGAAVAVAVDVTRRADVDNLVATAVREFGRLDVLVNNAGIATLGPLADGDTDTWSAVIDVNVRGVLHGIAAATPVFTCQGRGHVITVVSTAGLKIVPEMGVYAGTKNAVRTIMEALRQESTDGVIRTTSISPGYVRTELGGPPGGPAGNAARATMDRIGLPPDAVARAIAFAIEQPHDVEIGDLTIRPTVQG

SEQ ID NO: 18483 - protein, 394 aa, Medicago truncatula
MFPRAGVFGHLSDSSLGRKGSLKVVCSLNAIFGCLTAFSPNYWTYVFLRLLTGFSNGGVGLCAFVLATEPIGHSKRGMAGMSTFYFFSGGIAILSGIAYIFQTWRALYIAASIPSLLYIILLLPFVSESPRWYLVRGRINEATALMSTIAYFNGKHLPDGVVLSLDEEVSNSNKSTSDLEYNLINYVENKDAQVGSIVDVIRYSVTRIRLFLAITINFLTSVVYFGISLNVTNLETNLYMSVLLNAVAEMPAFAITAVLLDRFGRKPLTIGTMWFSGFFCLMGSLMSNVGVWKVIKMVCGVLGIFGMAGTYNLLYIYTTELFPTVVRNAALGSTMQAARMGAISVPFVVVLGGWLPFGVFAACGLIGGMFAFYLPETLNMPLYDTFKGLMAGLA

SEQ ID NO: 18484 - protein, 253 aa, Hordeum vulgare
MGRKFFVGGNWKCNGTVEQVEAIVQTLNAGQIVSPDVVEVVVSPPYVFLPIVKAKLRPEIQVAAQNCWVKKGGAFTGEVSAEMLANLGVPWVILGHSERRSLLGESSEFVGEKVAYALAQGLKVIACVGETLEQREAGSTMEVVAEQTKAIAGKIKDWSNGVVAYEPVWAIGTGKVATPAQAQEVHANLRDWLKTNVSPEVAESTRIIYGGSVTGASCKELAAQADVDGFLVGGASLKPEFIDIINAAAVKSA

SEQ ID NO: 18485 - protein, 673 aa, Arabidopsis lyrata
MEKDNHEDDGEDLPPEINQIKEQIEEERFLHIKKTFELRCIPSVAAHASHHQSFDLNQPLAEDDNEGDNKTLLSRMQNPLHHFSALSDSDTYEDQRCVFNKEAPLFPSVNLPVVEQLPRSLTWVFIKSSQLMAESDSVIGKRQIYYLNGEALELSSEEDEEDEEEDEEETKKEKCEFSKDVDRFIWTVGQDYGLDDLVVQRALAKFLEVEVSDILERYNELKLKNDETVGEASDLTSKTITTAFQDFADRRHCRRCLIFDCHMHEKFEPEFRPTEDKSGLFENEDRQPCSEHCYLKVRSVTEADHAVDNDNSISNKNVGSDPNTTMWTPVEKDLYLKGVQIFGRNSCVITLNILRGLKTCLEVYNYMLEQDQCTMSLVLHKTTKTKNQVNKKVSRKGTRSVRKKSRLRKYARYPPALKKTTNGEAKFYKHYTPCTCKSKCGYQCPCLTNENCCEKYCGCPKDCNNRFGGCNCAIGQCTNRQCPCFAANRECDPDLCRSCPLSCGDGSLGEPSEQIQCKNMHFLLNKNKKILIGKSNVHGWGAFTPDSLKKNEFLGEYTGELITHEEANERGRVEDRIGSSYLFTLNDQLEIDARRYGNKFKFLNHSARPNCYAKLMIVRGDQRIGLFAERAIEQNEELFFDYCYGPEHADWSRGREPRKTGASKRSKEARPTR

SEQ ID NO: 18486 - protein, 388 aa, Exiguobacterium sibiricum 255-15
MKITVAGTGYVGLSMAVLLAQHNEVTSIDIIKERVELVNDRKSPIVDAEIENFLQNKELNLHATTDNFEAYKDAEFVIIATPTDYDPTRNYFNTRTVESVIATVLAINPDATMVIKSTVPVGYTQELKEKFDTPNIIFSPEFLREGQALHDNLYPSRIVVGEQSERAQQFADLLLEGAIKKDVPILLTDSTEAEAIKLFSNTYLAMRVAFFNELDTYAEVRNLDTKQIIEGVGLDSRIGNHYNNPSFGYGGYCLPKDTKQLLANYDEVPNNIIGAIVEANRTRKDYIADTIIKQNPKVVGVYRLTMKTDSDNFRASSIQGIMKRIKAKGIEVTVFEPVLTEDTFYNSRVIRDLEAFKQESDIILSNRMHSELSDVEDKVYTRDLYSRD

SEQ ID NO: 18487 - protein, 216 aa, Lactobacillus acidophilus NCFM
MIIAPSILNADNLNLETDIKEAIAAGINRFHIDIMDGHFVPNLSFGPQLVEDFKREFPMTDAEIHLMSDSPDDLVPAFVNAGADLIELHYEAMDEDKLDYWLDYLISNGVNTGLALNPDTPSDVVTKYVSKLNQVLVMTVYPGFGGQEFIANSAQKIKEVRELVGPDIDIEVDGGINNQTIKIAKDAGANVFVVGSYLYKAGNIANQVHKLEDILK

SEQ ID NO: 18488 - protein, 342 aa, Exiguobacterium sibiricum 255-15
MINNKILITGALGFIGFHLSNKLLSMGIEVIGLDNENNYYDVNLKKNRFEKIKSDYKDSFYFYKIDITDREKLNTLFEKHNIEIVINLAAQAGVRYSIENPYAYLDSNLTGFLNILEACRNYPVKHLLYASSSSVYGGNKVAPFSTNHNVDHPVSLYAATKKSNELMAHTYSHLYDIPTTGLRFFTVYGPWGRPDMAYFSFTKDIVEGNPIKVFNHGKMERDFTYIDDIVEGIVKLIPRAPQKNPDWDESKDELGASFAPYRVYNIGNNQPVQLMKFINVLEEKIGKEANKKYMEMQPGDVLRTYADVSELERDIDFKPSTSIEEGLGKFVDWYKEYYNVKL

SEQ ID NO: 18489 - protein, 483 aa, Brassica napus
MVLSRTTTESNEPVSSTFGSRYALTALPKYEIGESSIPKDAAYQIIKDELMLDGNPRLNLASFVTTWMEPECDKLIMDSINKNYVDMDEYPVTTELQNRCVNMIARLFNAPLGDTETAMGVGTVGSSEAIMLAGLAFKRNWQNKRKAEGKTYDKPNIVTGANVQVCWEKFARYFEVELKEIKLSEGYYVMDPEKAVEMVDENTICVAAILGSTLTGEFEDVKRLNHLLVKKNDATGWNTPIHVDAASGGFIAPFIYPELEWDFRLPLVKSINVSGHKYGLVYAGIGWVVWRTQHDLPDELIFHINYLGADQPTFTLNFSKGSSQIIAQYYQLIRLGFEGYKNVMQNCRENMLVLKEGIEKTERFNIVSKDVGVPLVAFSLKGQSFHSEFEISEMLRRFGWIVPAYTMPADAQHITVLRVVIREDFSRTLAERLVADILKVLHELDTLPSKISRKMGAEDFGNVKGKKVERDILMEVIVGWRKV

SEQ ID NO: 18490 - protein, 194 aa, Xanthobacter autotrophicus Py2
MNGLWQFGDLKMFGYDLIVADPPWDFELYSEAGEGKSAKAHYGTMKLDEIAALRVGDLARGDCLLLLWCCEWMPPAARQRVLDAWGFTYKTTIIWRKVTRAGKVRMGPGYRARTMHEPVIVATVGNPKHTPFSSVFDGVAREHSRKPEAFYRMVEAAAPKAARADLFSRQRRDGWDAFGNEVEKFDQPPAEAAE

SEQ ID NO: 18491 - protein, 426 aa, Clostridium thermocellum ATCC 27405
MHKKEIIALLLAGGQGSRLGVLTKNIAKPAVLYGGKYRIIDFSLSNCVNSDIDTVGVLTQYQPLELNAHIGIGKPWDMDRINGGVTILSPYLKAEIGEWYKGTANAVFQNIHYVDKYSPKYVIILSGDHVYKMNYSQMLDFHKENNADATISVINVPWEEASRYGIMNTYENGKIYEFEEKPQNPKSNLASMGVYIFNWEVLKEYLIRDDQNEESAHDFGKNIIPMMLKEGRSMWAYKFNGYWRDVGTIQAYWESNMDLISRVPEFNLFDPAWKIYTPNPVKPAHYIGPTGSVKKSIVAEGCMIYGSVRNSVLFPGVYVSEGAEIVDSIVMSDSVIGENTQIYKCIIGEEVKVGKNVRMGIGENIPNELKPHLYDSGITVVGEKAVVPDGCQIGKNVVIDPYITAEEFPSLNIESAKSVLKGGETE

SEQ ID NO: 18492 - protein, 373 aa, Clostridium thermocellum ATCC 27405
MKSTMGIILTGGKNDRLKELAEMRSSTAVPIGGKYRVIDFVLSNMVNSGIKNIGVLTQYSFRSLMDHLGSGKEWDLDRRNEGLFIFPPYLAGEHSGWYQGSADAMYHNITFLKRSYEEYVLVAQGNCVYKMLFDDMLDYHIKKNADITIAYRDMSDFPREELSFMGVMTMDENRRVVDFKEKHKNPESTICSMGIYILKRELLIALLEECNSHGKYDFVKDVIINKLPTLNIYGYKFEGYWRNLNSINAYYRINMEMLNPEIRYQLFEQHGKVYTKVKDEPPAKYNEEAEVRNSIIADGCIIEGTVINSVLFRGVTIKRNAVVKDCIIMQDSVIEEDVDIESLIIDKNVYLSKGIRLKGMVNFPITIGKNAVI

SEQ ID NO: 18493 - protein, 249 aa, Hyphomonas neptunium ATCC 15444
MPRTLIAGNWKMNGLMANLAEVERVAAEVPASSEGAETLLCLPATLIHAGSAKSEGSGLKIGGETCHANEKGAHTGDLAAEMLKDAGASYVIVGHSERRADHGETDAVVAAQASAALRAGITPIICVGETLDQRDAGEVLTVITTQMAESIPEGAEAAAIVIAYEPVWAIGTGRVATSEQIAEVHTSIRNLLVRRFGDAGRTTRILYGGSMNPGNAAEILAVAEVNGGLIGGASLKAADFLAIYRLAAQ

SEQ ID NO: 18494 - protein, 449 aa, Saccharomyces cerevisiae YJM789
MFLEIPRWLLALIILYLSIPLVVYYVIPYLFYGNKSTKKRIIIFVLGDVGHSPRICYHAISFSKLGWQVELCGYVEDTLPKIISSDPNITVHHMSNLKRKGGGTSVIFMVKKVLFQVLSIFKLLWELRGSDYILVQNPPSIPILPIAVLYKLTGCKLIIDWHNLAYSILQLKFKGNFYHPLVLISYMVEMIFSKFADYNLTVTEAMRKYLIQSFHLNPKRCAVLYDRPASQFQPLAGDISRQKALTTKAFIKDYIRDDFDTEKGDKIIVTSTSFTPDEDIGILLGALKIYENSYVKFDSSLPKILCFITGKGPLKEKYMKQVEEYDWKRCQIEFVWLSAEDYPKLLQLCDYGVSLHTSSSGLDLPMKILDMFGSGLPVIAMNYPVLDELVQHNVNGLKFVDRRELHESLIFAMKDADLYQKLKKNVTQEAENRWQSNWERTMRGLKLIH

SEQ ID NO: 18495 - protein, 394 aa, Arabidopsis thaliana
MAIMSDLPRDLLAEILSRVPLASLRSVRFTCKKWNDLSKDRSFLKKQIVEAKKKQLKSKEFEVIMMRNFRVYLTSVDLHNDVNPSFTPKGTLTSFSDDANQHQVDNVSSVFHCDGLLLCITKDLNFRLVVWNPYFGQTRWIQPRNSYHIKDIYAIGYDENKNHKILRLKDQYYDYDSHPRARICEFELYSFESNSWKVVLDVSPDWYIHSYHRGLSVKGNTYWYATEKHGYVNFLICFDFTTEKFGPRLPLPFNATESFTYDDVVTLSSVGEEQLALLFQSDATLMMEIWVTSKVDPTEVLWNKLFLAVDHDMIEFDYELKFVADAGSFFIDQKKNVVVVFDKDMNEHTHRGMAYIVGKNGYFKRVDIGEEAYTSCFPLVCSYVPSSVQIRQLT

SEQ ID NO: 18496 - protein, 288 aa, Cytophaga hutchinsonii ATCC 33406
MKGILLAGGTGSRLHPLTLAMSKQMMPIYDKPMIYYPLSCLMLAGIREILIISTPQDLPNFQKLLGDGSALGCRFEYAVQPSPDGLAQAFVIGEQFIGNDKVALILGDNIFYGSGLGRLLHSHNDPDGAVIFAYHVTDPERYGVVDFDDDMNALSIEEKPIKPKSNYAVPGVYFYDNSVIDIAKNLKPSSRGELEITDVNKIYLEKNKLKVAVLNRGTAWLDTGTFASLMQAGEFVRVIEERQGLKVGCIEEIAYTMKFITKEQLEALAKPLMKSGYGQYLLGLIKNK

SEQ ID NO: 18497 - protein, 1035 aa, Arabidopsis thaliana
MKIHKLCFLALLLAHTTSAVNLNLNLKTSELVFLGDAELGPASDGVSRSGALSMTRDENPFSHGQSLWSTPVPFKPSSNSSSPYPFETSFTFSISTRIKPAPGHGLAFVVVPSIESDGPGPAGYLGIFNKTNNGNPKNHIFAVEFDVFQDKGFGDINDNHVGININSVTSVVAEKAGYWVQTGIGKMKHWSFKEFKLSNGERYKAWIEYRNSKVTVTLAPETVKKPKKPLIVAHLDLSKDFSTAILERKKSPNRLVVDEAINDDNSVVSLHPTTMEKLQLFRGDTILIKGKKRKDTVCIALADETCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVSNEHFHTALGNSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGNSAGDAGGAADRVLNQLLTEMDGMNAKKTVFIIGATNRPDIIDSALLRPGRLDQLIYIPLPDEDSRLNIFKACLRKSPVAKDVDVTALAKYTQGFSGADITEICQRACKYAIRENIEKDIENERRRSQNPEAMEEDMVDDEVSEIRAAHFEESMKYARRSVSDADIRKYQAFAQTLQQSRGFGSEFRFDSTAGVGRTTGVAAADPFATSAAAADDDDLYS

SEQ ID NO: 18498 - protein, 206 aa, Methylococcus capsulatus str. Bath
MDYATRAAGGLVPVVIEQSARGERAFDIYSRLLKERVIFLVGQVEDYMANLVIAQLLFLESENPDKDIHLYINSPGGLVTAGLAIYDTMQFIKPDVSTLCVGQAASMGALLLAGGAAGKRYCLPHSRIMIHQPLGGFQGQASDIDIHAREILAVRDRLNKILAHHTGQPIEKIQIDTDRDNFMGGNDAVEYGLIDKVLVSRASGAA

SEQ ID NO: 18499 - protein, 510 aa, Ageratina adenophora
MTILTLLLYTSISALAFYLLLNLRTRHPKRLPPGPTPWPIVGNLPHLGTVPHHSLAALATKYGPLMHLRLGFVDVVVAASASVASQFLKSHDANFASRPPNSGAKHIAYNYHDLVFAPYGPRWRMLRKICSVHLFSAKSLDDFRHVRQEEVAILTRVLISAGETTVKLGQLLNVCTTNALARVLLGRRVFGDGSRDSDPKADEFKDMVVEMMVLAGEFNIGDFIPALDWLDLQGVTKKMKKLHTRFDSFFNLILEEHKSYGNSGDLLSTLIGLKDDADADGEGVKLTDIEIKALLLNLFTAGTDTSSSTVEWAIAELIRHPRLLKQAQEEIDTVVGRDRLVTELDLNQLTFIQAIVKETFRLHPSTPLSLPRISSEACEVDGYYIPKGSTLLVNVWAIARDPEMWTDPLEFRPSRFLPGGEKPNVDVRGNDFEVIPFGAGRRICVGMTLGLRMVQLLVATLVQTFDWELAKGLEPEKLNMDEAYGLTLQRAEQLIVHPKPRLAPGVYESC

SEQ ID NO: 18500 - protein, 336 aa, Vibrio parahaemolyticus RIMD 2210633
MKYLVTGAAGFIGSATIRKLNSLGYEVIGIDNINDYYDVELKYARLNFIKNPLFRFFNMDISNKNKNEIERLFEKEKFDRVIHLAAQAGVRYSLVNPHCYAESNLSGFLNVLEACRKSHIKHFIYASSSSVYGLNKKVPFSTSDNVDHPVSLYAATKKSNELMAHSYSHLYQLPTTGLRFFTVYGSWGRPDMAPFIFTEKIINGQSIDINNNGDMWRDFTHINDIVEGIVRISDVIPRINQRWQFENSTPADSSAPYSIYNIGYGSPICLMDFIKAIENELGIEAKKNYREMQPGDVYQTYADTTAFYQATGYRPSVSVEEGIAEFVAWYRNFYNK

SEQ ID NO: 18501 - protein, 487 aa, Halobacterium sp. NRC-1
MSSSQTRSPDAELGLLDATMIGMGAMIGAGIFVLTGLAAEIAGPAAILVFALNGVVTAFTGLSYAELAASIPKSGGGYAFVREIFGDFSSFIMGWMLWFAYMIAGALYALGFAPNFLELLHVYGLVAPPDQVGAIAVPLLDASVPAAFVLAFIAVLGLVALNAVSTAASGSAETIFTIIKVSILVVFVAFGATSPLFSGAEFQPLFGVGGGPAAILPAMGLTFIAFEGYDLITTVTEEVKNPRENIPKAIFVSLIATVIVYLAVVTVAVGTLGADGLAAAGEAGIAEAATSFMPTGLPIIQNGGALIVFGAVFSTLTALNAVVIASSRVAFSMGREGQLLPSFGQIHHRYGTPFVAIIASAVVMLASVALPTQSAGNMSSLFFLLSFIIVNVAVIRLRRERPDMNRPYEMPFYPAPPLIGIALNLVLSVVLVDYLVRTDPLALALSAAWIVLGTAAYYAHASRQSAAGDDEDTTTISADAEHTPHDH

SEQ ID NO: 18502 - protein, 365 aa, Leifsonia xyli subsp. xyli str. CTCB07
MVSKADLSKQPVQVVAMFDEVSTHYDRTNAVLSMGNASLWRAATTRAVGPLAGETILDIAAGTGTSSASLARNGARVVAADFSPGMIEVGRRRQSGNPFVTFQQADATDLPFPDDTFDAVTIAFGLRNIVEPRRALAEFYRVTKPGGRVVICEFSHPPVALIRSGYNVYLRWGMPVLARAASSNPAAYEYLMDSIQAWPEQPELAAWLREAGYQDVAWRNLTAGIVALHRGWKPLTAKAAPAAESVLKQSAPEDSAPGEPERGKPGPDSSATATSATAKPATRKSAPAKSESVAPSPRKSAPEKSVAAKPASPKPATAKPAIDKSTDSAGKPSGSAGRSSGRGAASGGGAGSEYSSSAIPPEGEQ

SEQ ID NO: 18503 - protein, 184 aa, Zea mays
MAPGALTRLLRVASTPRMARPFAAKSRASRRPQDPELPTGDENDFAGSEVAAPTESIDKPLAEVLKELGKRVPDSLVKTRVEDNGFTMKYIPWHIVNKILNIHAPAWSGEVRNIVYSSDGKSVSVVYRVTLHGIDAEIYREATGTASVDDTIYGDPVQKAESMAFRRACARLGLGLHLYHEDMS

SEQ ID NO: 18504 - protein, 306 aa, Colwellia psychrerythraea 34H
MWHSIEQAISVETGKSFYISEKKEISTRPASSSSFTCSYDNKEPPPNLSFKITDGHRSYFLKINNKDYLENFQAEAYSLKQLNSLANIASPNVTAIGTSLDKSFLVLDYIDFSKAKPMLWYQLGQQLAQMHYENRHGQFGWQHDNFIGSTIQPNHWSSNWTTFFSDQRIAWQLQLLSERSIMLGNIEHITQVCHDALLHHQVSPCLVHGDLWQGNTGFSGEKAMIFDPACYYGDREVDIAMTELFGHFPDDFYHGYQAEYPLDDGYEQRKLVYNFYHILNHANIFGGIYIDQAKATLSRIMSLPLH

SEQ ID NO: 18505 - protein, 296 aa, Exiguobacterium sibiricum 255-15
MRVKKAVIPAAGLGTRFLPATKAMPKEMLPIVDKPTIQYIIEEAIESGIEDILIITGKGKRAIEDHFDSVPELEANLIAKNKSELLHLVEATTNINIHFIRQSKPKGLGDAILQAKAFIGNEPFVVMLGDDIVQAEVPCTRQLIEQYEITNSSIIGVQPVADEDTQRYGIVDPSTSISENLHKVKSFVEKPAPGTAPSNLAILGRYLLTPEIFKYLETQEIGSGGEIQLTDAITRLNEMQRVFAYEFDGKRYDVGEKLGFIQTTLEFALKREDLGDDVAKMMEELLKARSVTASLV

SEQ ID NO: 18506 - protein, 337 aa, Oryza sativa
MVVPLHGRRLGIISKPLAMDKAGGSGEAPPEPEPAAAATVKSIVVYPIKSCRGISVPQAAITSTGLRWDRPWLVMNSAGRAFTQRVEPKLALIEVEMPQEAFTEWQPTPDSHMVIRAPGLDPLKIPLGAKRATVDDVSIWEWSGSAYDEGDEAAEWFSSYFGKPTRLVRFNEASEIRETNPDYAQGYKVLFADDFPFLLASQGSVDALNSILKEPVPMNRFRPNIIVDGCHPYSEDLWKTIKIGKLTFLGVKLCDRCKVPTINQDNGIPGEEPTEALQALRSDEVLRPSHKNKRRVYFGQNLVCKESLSAKDEGRIIKVGDPVYVLESFPSSDEVPA

SEQ ID NO: 18507 - protein, 461 aa, Aspergillus nidulans FGSC A4
MIESVIEVAFFVSTIVTLFILMLPSQYEPKRRVAGSSDDLSEPKTTVQVLVLGDIGRSPRMQYHALSIARGGGHVDIIGYSESEIHPDVSSHPNISVVPIPPHPSVLQTSNKVLFLFVAPLKVLFQVIALWWILAYHTKPAKWLLIQNPPSIPTLAIASLVCFFRQTRLVIDWHNFGYTILALKLGDTHPLVKVSKWYENVFCRSAVAHFCVTNAMASVLKKEFDLQAPILPLHDRPASHFRPILDEQERKSFLLSLPEAAPMRRSIEEGNTKVIVSSTSWTPDEDFSLLIDALCRYSEVSSTTKPHLPAVLAIITGKGPQRDIYVERISRLQKEGKLSKVTICTAWLSTGDYARLLASASLGVSLHTSSSGVDLPMKVVDMFGSGLPVVGWSKFRAWPELVTDGVNGKGFGSPSELAEQLVELLGNPENLNMLRAGAQDASAFRWDDEWAPVAGKLFGLD

SEQ ID NO: 18508 - protein, 358 aa, Mesorhizobium sp. BNC1
MGNSRRYRIAVIPGDGIGKEVVPEGLAVLEAVAAKYGIEIIFNHFDFASCDYYLRHGRMLPEDWKQQIGSHDAIFFGAVGWPQIVPDHVALWGSLVQFRREFDQYINLRPVRLMEGVPCPLQGRKPGDIDFYVVRENTEGEYSSIGGRIFAGTEREVVMQETVLTRTGTDRVLRFAFQLAAQRKKKHLTSATKSNGISITMPYWDERVEQMARNFPDVIWDKYHIDILCAHLVLHPDWFDVVVASNLFGDILSDLGPACTGTIGIAPSGNINPERTFPSLFEPVHGSAPDIAGLGIANPIGQIWSVSMMLDHLGEPEAAASIVKAMETVLREPKLRTRDLGGTADTRTCGKAVAAAIS

SEQ ID NO: 18509 - protein, 248 aa, Alkaliphilus metalliredigens QYMF
MIYLKSRQEIEIMREAGRIVAETHELLKEAIKPGITTKELDEIAEAHIISRGATPAFKGYGGFPASICASVNHEVVHGIPGLKRLEDGDIISIDIGAFYQGYCGDAAKTHGVGNLSEKPQKLIDVTRHSFYEGIQFAKEGYRLSDISHAIQSYVESYGFSVVRNYVGHGIGSKMHEEPQIPNYGPPGKGPRLQAGMVLAIEPMINIGTYEVKVLSDDWTVVTLDGEYSAHYEHTIAITDGEPEILTII

SEQ ID NO: 18510 - protein, 432 aa, Cytophaga hutchinsonii ATCC 33406
MPTFSNQLIQKNQTLAVIGLGYVGLPIALAFAKKVKVIGFDINSKRIDIMKKNIDPSGELRESDFLNSDIFFTAELSDLKKASFYIVTVPTPIDEFNHPDLAPLVSATRTIAKVLKQGDYVVYESTVYPGCTEEECIPLLEELSGLVCGKDFKVGYSPERINPGDKEHTLAKITKVVAGCDAESLDIIAQTYEIVVDAGIHKASSIKVAEAAKIIENTQRDVNIALMNELSVICDKLNINTLEVLEAASTKWNFLPFTPGLVGGHCIGVDPYYLTYKARKLGLNPNVILSGRLINDQMPMNIAKKIVKSLIKSGTDISKGRVLVLGVTFKENVEDIRNSKVAELIKELQSYSLQVDAVDPYASFQEFKHEYNLDFSTEITGTYDVVILAVSHKEYQKLNIEYFENLLTEKGIFVDIKGLYRKQNHRNSYWTL

SEQ ID NO: 18511 - protein, 145 aa, Glycine max
  misc_feature (134)..(134): Xaa can be any naturally occurring amino acid
MAPAVEAVKETGTFQKVPALNERILSSMSRRSVAAHPWHDLEIGPGAPTIFNCKRLLFLCQVIEIPRGSKVKYELDKKTGLIKVDRVLYSSVVYPHNYGFIPRTLCEDSDPLDVLVIMQEPVIPGCFLRAKGIXLMPMIDQGEAD

SEQ ID NO: 18512 - protein, 142 aa, Brassica napus
LNKDEQGNPLLTADEIKPTIKELVMAAPDNPSNAVEWAMAEMVNKPEILRKAMEEIDRVVGKERLVQESDIPKLNYVKAILREAFRLHPVAAFNLPHVALSDATVAGYHIPKGSQVLLSRYGLGRNPKVWADPLSFKPERHL

SEQ ID NO: 18513 - protein, 485 aa, Brassica napus
  misc_feature (133)..(133): Xaa can be any naturally occurring amino acid
  misc_feature (136)..(136): Xaa can be any naturally occurring amino acid
  misc_feature (223)..(223): Xaa can be any naturally occurring amino acid
MASVAASPAFSLLKSTGGAIASSTSTRARASLLPITPSSKSISPRPLGFSAVLDSHRFSLHVASKVHSVRGRGTRGVVSMAKKSVGDLTSADLKGKKVFVRADLNVPLDDNQTITDDTRIRAAIPTIKYLIEXGAXVILSTHLGRPKGVTPKFSLAPLVPRLSELLGIEVKKADDFIGPEVESLVASLPEGGVLLLENVRFYKEEEKNDPEFAKKLASLADLXYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLELATSLLAKAKAKGVSLLLPTDVVVADKFAPDANSKVVSASGIEDGWMGLDIGPDSIKTFNEALDTTQTVIWNGPMGVFEMEKFAAGTEAIANKLAELSEKGVTTIIGGGDSVAAVEKVGVAGVMSHISTGGGASLELLEGKVLPGVIALDEAIAVTV

SEQ ID NO: 18514 - protein, 441 aa, Magnaporthe grisea 70-15
MATAQAAYAAEKAVGHQEGGITRQDVSDYTETGDPSRTMKALVWMGKNKVEIADMPRPKIIEPKDVILKVTGSTVCGSDLHLLHGSVIQMNKNDILGHEFCGIVDEVGPEVTKCKPGKRYVASFQIACGECERTNDNTIAKAMYGNQTAGMFGYSHFTGGFAGGQAEYVRVPFGDVNLLEIPDDVPDEKALYLSDVLPTSYNAVKDTAVYPGDTVAVFGAGPIGQMAGYWALLEGAEKVIFVDTEPRLSYIQERFNAEQKAKTTCIDYKKLSSGITNKETVVSKLKEMCGGRGPDCAIECAAGEYAKGWAHWLEMTLGAETDTSEILNEMIEGVRNYGRVGVTGVYVGYTNHFNIGSLMQRGVRLIGNGQAPVHKYWEELLARIQSNDFDPLQMLSHRVRLEDLDKVYYKFEKREDSMQKIFVETKFSLPRATGTPELTTY

SEQ ID NO: 18515 - protein, 324 aa, Zea mays
  misc_feature (66)..(66): Xaa can be any naturally occurring amino acid
HRISLPFHSSPPPLPFPSRRRHGQRRPLPSAHTGGPQGRHPLALLSSRAHSLPPSPPSPPPPPPPXTSPTASDLTAFPPNPNGIFASDRPIDVDAATEAELRENGFRSTRRTKLVCTVGPATSRPDQLEALAVGGMNVARLNMCHGDREWHRAAIRAVRSLNEEKGFAVAVMMDTEGSEIHMGDLGGASSVKAEDGEVWTFSVRSFELPLPERTINVNYDGFAEDVRVGDELLVDGGMARFEVIEKIGPDVKCRCTDPGLLLPRANLTFWRDGSIVRERNAMLPTISSKILVTNIKTTPNCTVSIFHIFSRAKKPHPLHKVRSF

SEQ ID NO: 18516 - protein, 298 aa, Zea mays
MGSGEEPSQMRRALVDSLAGAISGGISRTVTSPLDVIKIRFQLVWAEMLMRVLLSLDGWKCCWFSETKVQLEPTTSWGILRRDVYGPSKYTGLLQATKDILREEGLPGFWRGNVPALFMYMPYTAIQFTVLHKLKTFASGSSRTEDHLDLSPYLSYVSGAIAGCTATIGSYPFDLLRTILASQGEPKVYPNMRSAFIDIIKTRGVQGLYSGLSPTLVEIIPYAGLQFGSYDTFKRSMMTWNRYKYSHLSFGSEDDSVSSFQLFLCGFAAGTFSKAACHPLDVVKKRFQNKNFFMHPLH

SEQ ID NO: 18517 - protein, 262 aa, Bordetella bronchiseptica RB50
MAGRTDCAPAAGRLAGRVALITGAAGGIGSAAALRFAAEGAALALLDRRPDAIEQLAGRICGQGGQAIGVAADVTDDDSVRQAVRRAVEHFGRIDTLFNCAGGSVAGDTAVDKVELALWNRTLRLDLDGTMLCCRHAVPAIVRAGGGAVVNMSSGAGLRGSFGGHAYTAAKGAVIALTRALAAEYAPHGVRVNAICAGRIRTERILRNLDAGAPAQAGAAQRYPCREGDPIDIAHIALFLASHESRMITGEAIAANGGYSAF

SEQ ID NO: 18518 - protein, 492 aa, Petunia x hybrida
MELAGDNKIMNVGLLLVATLVVAKLISALIMPRSKKRLPPSVKAWPVLGGLFRFLKGPVVMLREEYPKLGSVFTLNLLNKKITFFIGPEVSAHFFKAPETDLSQQEVYQFNVPTFGPGVVFDVDYTIRQEQFRFFTESLRVTKLKGYVDQMVMEAEEYFSKWGDSGEVDLKYELEHLIILTASRCLLGEEVRNKLFEDVSALFHDLDNGMLPISVIFPYLSIPAHRRRDNARKKLAQIFANIIASRKRTGKAESDMLQCFIDSKYKDGRPTTESEITGLLIAALFAGQHTSSITSTWTGAYLLCNNKYMSAVVDEQKNLMKKHGNKVDHDILSEMEVLYRCIKEALRLHPPLIMLLRSSHSDFTVKTREGKEYDIPKGHIVATSPAFANRLPHIYKNPDTYDPDRFAPGREEDKTAGAFSYISFGGGRHGCLGEPFAYLQIKAIWSHLLRNFEFELISPFPEIDWNAMVVGVKGEVMVKYKRRKLSTDWSSR

SEQ ID NO: 18519 - protein, 227 aa, Leifsonia xyli subsp. xyli str. CTCB07
MLTARRSRSSIRDALAAARPRDGFLGEETGADRGSSGLTWVVDPIDGTVNYFYGIPAYAVSVAVVEGDPDPASWVTLARAVANLESREVFTAAAGAGARLNGTALRVNGGVELPLALVGTGFGYDAAMRTRQAQFVAELVGRVRDVRRIGAASLDLCGLAAGRLDAYFERWLNPWDHAAGALIAREAGARVGGRAGGAEGRELLIAAAPGLYEQLDPLVQRFYAGWE

SEQ ID NO: 18520 - protein, 674 aa, Arabidopsis lyrata
MEKDNHEDDGEDLPPEINQIKEQIEEERFLHIKKTFELRCIPSVAAHASHHQSFDLNQPLAEDDNEGDNKTLLSRMQNPLHHFSALSDSDTYEDQRCVFNKEAPLFPSVNLPVVEQLPRSLTWVFIKSSQLMAESDSVIGKRQIYYLNGEALELSSEEDEEDEEEDEEETKKEKCEFSKDVDRFIWTVGQDYGLDDLVVQRALAKFLEVEVSDILERYNELKLKNDETVGEASDMTSKTITTAFQDFADRRRHCRRCLIFDCHMHEKFEPEFRPTEDKSGLFENEDREPCSEHCYLKVRSVTEADHAVDNDHSISNKNVVSDPNTTMWTPVEKDLYLKGVQIFGRNSCVITLNILRGLKTCLEVYNYMLEQDQCTMSLVLHKTTKTKNQVNKKVSRKGTRSVRKKSRLRKYARYPPALKKTTNGEAKFYKHYTPCTCKSKCGYQCPCLTNENCCEKYCGCPKDCNNRFGGCNCAIGQCTNRQCPCFAANRECDPDLCRSCPLSCGDGSLGEPSEQIQCKNMHFLLNKNKKILIGKSNVHGWGAFTPDSLKKNEFLGEYTGELITHEEANERGRVEDRIGSSYLFTLNDQLEIDARRYGNKFKFLNHSARPNCYAKLMIVRGDQRIGLFAERAIEQNEELFFDYCYGPEHADWSRGREPRKTGASKRSKEARPTR

SEQ ID NO: 18521 - protein, 126 aa, Oryza sativa
MSERGGTRGGFGTRGGRGGEGGRGRGEGFRGEGEGRGRGRGEGRGRGRGRRGQRPKEDSAKSWVPVTKLGRLVNDGKIRTLEEIYLFSLPIKEADIIDRLLPGLKDEVLKIMPVQKQTRAGQRTRF

SEQ ID NO: 18522 - protein, 325 aa, Listeria innocua Clip11262
MSELFTTIKGQVTGKNVRIVLPEGTDERIVGAAARLQKENIVTPILLGNKAEIEAKAKEIGVSVEGITIHDPATDPLFDELVAAFVERRKGKATEEAARKMLVDPNYFGTMLVYTGKAEGLVSGAAHSTGDTVRPALQIIKTKPGVSKVAGAMIMVRGEERYLFSDVAINIAPVAADLAENAIVSAETAEIFGIDPRVAMLSFSTKGSAKSDETEKVVEATALAKEKAPELTLDGEFQFDAAFVPTVAEKKAPGSVIKGDANVFIFPSLEAGNIGYKIAQRLGNFEAVGPILQGLNAPVNDLSRGCNTDDVYNLTLITAAQAVNK

SEQ ID NO: 18523 - protein, 1129 aa, Zea mays
MANIDMAKILADLDRGASGGDARVPKTKLVCTLGPASRTVPMLEKLLRAGMNVARFNFSHGTHEYHQETLDNLRQAMHNTGILCAVMLDTKGPEIRTGFLKDGKPIKLTKGQEITVTTDYDIKGDENTIAMSYKKLPVDVKPGNVILCADGTISLAVLSCDPDAGTVRCRCENTAMLGSDLVTVRQVLGQHAKRIKLMSKVENQEGVVNFDEILRETDAFMVARGDLGMEIPVEKIFLAQKMMIYKCNIAGKPVVTATQMLESMIKSPRPTRAEATDVANAVLDGTDCVMLSGESAAGAYPEVAVKIMARICIEAESSLDHEAVFKAMIRSAPLPMSPLESLASSAVRTANKAKAALIVVLTRGGTTAKLVAKYRPRVPILSVVVPVLTTDSFDWTISSEGPARHSLIYRGLIPLLAEGSAKATDSESTEVILEAALKSAVQKQLCKPGDAIVALHRIGVASVIKICIVNRGTEDQERGGAEAAAMGSDVPPPSAIPPLSAAAASVVRQIAGVPVDQLLRRVDAEEQARGPLEYARSVVEYCSHVALRVEARRPDHLGDREFHTLTYDMMLAWEAPDEETDAVFQKTAFSVLRGDDADDDDSGSIFYSSPTQMAIQVSGLFLLRTVGPEAFAKIAPACPAMAHPITVRNLFDAITNSTGGRLHFLIYHKAFCSAKRVLGGHRAPALQLSDDEVILDIHGAATTKPVLQHIGTSTWPGRLTLTNHALYFEAIGVDFSYGEAVVYDLARDLKQSVKRESTGPWGAHLFDKAVMYKSSLTSEPVFFEFPQFKGHTRRDYWFAAIKEVLHAHKFIRKYKLAGFQKAEALSVATLGILRYRTVKEGFHILPAHFKTILAFNLAEKLPKGDKILEALGGQDLGQSSSEELMLADPFPLSAYTMVTMGLLKLKEEDNAEERDFAVRDVQIGGTSSVQMALERSVGYSGRVEAARATLDQVRVEDIDTNVAVLKELLFPLIEIGKRLLALSGWEEPFKSYVFLLCFLYMAYRYCFLAISQLEAHVQAGNIFLLKLRSLMLAAFPQSTNRVAAALVAVAAIFTFVPLRTIVLLILLEEYTRQMPVRKKSSEKLVRRLREWWLRIPAAPVQLFYTMFRAHSLSGRDLGITPSSESKTLV

SEQ ID NO: 18524 - protein, 757 aa, Neptuniibacter caesariensis
MLDVLRKIVQEVSVAPNLESVLNLIVTSVQRSMKTEVCSVYLFDPSDQRYVLMASEGLNPEAVGSVRLSAAEGLVGLVVDRAEPINLENASEHRAFKYVESTGEERFNSFLGVPIIHHRDVLGVLVVQQRDLRRFDESEEAFLVTLSAQLAGVIAHAEATGSLGTIGEQEKAVVDLRFEGVAGSSGVAIGSATVIAPPADLSSVPDKPAKDVAKEIASFEEALKLVRRDIKVVGRSLAQRLRTEEQALFDVYLRMLDDNALAGEVVARIEKGNWAQGALREVVTEHVRQFSMMDDPYLRERATDIKDLGRRVLAYLQEAAPASLEFTDETILVADELTPAMLGEVPSEKLVGLVSVHGSSNSHAAILARSMGIPTIMGAVDLPLTRIDGRQLILDGYSGRIYVQPGEDLLTAYQDIVKGEKEQAEELAALKDLPAETTDGFRMPLWVNTGLIADVARSLERGAEGIGLYRTEVPFMIRDFFPSEQEQAQTYRKQLEAFHPRPVTMRTLDIGGDKALPYFPIEEENPFLGWRGIRVTLDHPEIFLVQVRAMLKAGEGYENLRIMLPMVTSVREVEEANRQIDRAVRELQEEGHNIKRPLVGVMVEVPAAVYQVRRFARRVDFISVGSNDLTQYLLAVDRNNPRVADLYVSYHPAVLKALEYIAREAHKENASVSICGEVASEPGGALLLMAMGYDVLSMNATNLPKVKAAIRKITKTDADRLLKDVMSMDDADRIQALINERLDELGIALPAQPNIPN

SEQ ID NO: 18525 - protein, 261 aa, Bradyrhizobium sp. ORS278
MGRLEGKSVIITGAGSGIGRAASLMFTKEGARLIAVDRTEGVKETVELVKQQGGIAEAVMADAGSEADISGFIDRAVATYGKLDVIWANAGISGGLKPIAEQTVEHWQEILRVNLIGPFLAVKYAMPHMVRQQRGAIVCTASVAGLKSGASGHPYAASKAGVISLVQTTAYSLSGTGVRINAVCPGLIETGMTKPIFDGAKERGTEGKIGQLNPLKRAGQPHEIAAMALFLASDEASYVNGQAFPVDGGLTASMPYAGKPI

SEQ ID NO: 18526 - protein, 399 aa, Bacillus anthracis str. Ames
MLANQINERSLLLHKELVGKIEITSKVEVNSADDLSLTYTPGVAESCKAIAADEETVYDYTARGNMVAVVSDGTAVLGLGNIGPKAAMPVMEGKSILFKKFANVDAFPLCLGTTDVDEIVTLVKNLEPTFAGINLEDIAAPRCFEIEKRLKEETNIPVFHDDQHGTAIVVLAAVINALKVVSKQMDHVKIVINGAGSAGIAIGKLLLKAGAQHITLVSLEGIVCEGEAWMNEAQIEVSKKTNREHVRGTLKEAIHQADIFIGVSAPNVLTKELVQMMNEKAIVFAMANPIPEIFPEDALEAGAAVVGTGRSDYANQVNNVLAFPGIFRGALDVRATDITEEMKLAAAYGIANIITDEERNANYVIPNPLDKRVVPSVAEAVAKAAIDSGVAQIMKIPSY

SEQ ID NO: 18527 - protein, 413 aa, Exiguobacterium sibiricum 255-15
MQVTVIGTGYVGLVTAIGLADAKHDVVCVDLNKERMEQLAQGIAPITEEGIEEALQKNQSRLTFTTEYPLSDLYLVAVGTPERADGSCDLSAVQAVVKLIHSIQPDAAVVLKSTIPPGTTESLQEMYPSLRFAMVPEFLREGTAIRDMRNPHRVIIGTHDQGLAESLADLFKTNAPIVHVDPTTAELTKYAANSFLAVKISFINEIARLADIVGADVEDVAHGIGLDPRIGPAFLKAGAGYGGSCFPKDIAALTTLAQRQGEHLHVIEAADRTNEAQLEYVLQKIDPRPGLRIALLGLSFKPGTDDLRDAPALRLAERLTKMGVIVTGYDPAAKTLLDQKKTIEEAVAGAEVAVIMTEWDDIKHVTPQQLTANMKTARLIDGRNCWAFVDEPGDVQYEGIGRPGKTFSNNPTS

SEQ ID NO: 18528 - protein, 459 aa, Burkholderia sp. 383
MTQHFDAIVIGTGQAGPPLAARLSAAGMKVAIIERGRFGGTCVNTGCIPTKTLIASAYAAHLARRGSEYGVSVGGPVTVDMKAVKARKDQISGRSNQGVEQWVRGLANTTVFQGHARFERADAVRVGDALLEAERIFINVGGRAQVPAMPGLDTVPYLTNSTMMDVDFLPDHLVIVGGSYIGLEFGQMYRRFGSKVTIVEKGSRLIRREDEDVSQAVRDILEKEGIDVQLDATCLSARRNGDGIAVGLDCVGGGREVAGSHLLLAVGRVPNTDDLGLDRAGVATDARGYIEVDEQLRTNVPGIWALGDCNGRGAFTHTAYNDFEIVAANLLDGDPRKVSDRIAAYALYIDPPLGRVGMTFAEAKQTGRRLLVGTRPMTRVGRAVEKGESQGFMKVIVDADSHAILGASILGVTGDEVVHGMLDVMAAGAPYTTISRAMHIHPTVSELVPTLLQDLHPVE

SEQ ID NO: 18529 - protein, 211 aa, Triticum aestivum
  misc_feature (28)..(28): Xaa can be any naturally occurring amino acid
KIVKLCRQLNKPVVVASQLLESMIEYPXPTRAEVADVSEAVHQCADALMLSGESAMGRYPDKALSVLSSVSLRIERWWREEKHHEPLELEDVSSSFADKISEEICISAAKMANKLEVDAVFVYTKGGHMASLLSRCRPDCPIFAFTNSTSMRRRLNLQWGLIPFRLTFSDDMESNLNRTFSLLKARGMIKPGDLVIALSDMLQSIQVMNVP

SEQ ID NO: 18530 - protein, 185 aa, Zea mays
DPAVAGKKLLHEDPYTAGEIEKITGEGLTSVFQGSQTSLDVIKAAKHYKLFQRATHVYFEARRVYAFRDTVSSKLSEEGKLKKLGDFMNESHYSCSVLYECSCPELEELVKVCRDNGALGARLTGAGWGGCAVALVKEPIVPQFILKLKEMYYKSRIDRGVIKQGDVGLYVFASKPSSGAAILRL

SEQ ID NO: 18531 - protein, 827 aa, Saccharomyces cerevisiae YJM789
MHSNVFVGVKPGFNHKQHSKKSRFLENVSSHSPELPSNYDYVLLPITTPRYKEIVGQVFKDFQRQSIQNWKPLQIPEPQLQDICIPPFNVKKLDNDDTPSYIGLLSSWLELESRDPNVRDLGLKVLLNECKYARFVGINKLILAPPRDLSNLQLYGQMIYRLLQNRIVFAAPALTISISLPLYEDSDPLATWELWNTVRKQCEYHPSLTISLALPRTRTPSYVLNRWLAEPVSCLLVSSSIFASNQYDYPVLHKFNQNLILKFQKVNGDSQILGNELCVILHGMEKYANNVKGGESAYLEYINYLLKKGDKVLNSNSNHQFLLQEESRIMPPLKPHSDNLLNSTYLTFEKDLVKYDLYESAILEALQDLAPRASAKRPLVILVAGAGRGPLVDRTFKIISMLFMDSKVSIIAIEKNPQAYLYLQKRNFDCWDNRVKLIKEDMTKWQINEPSEKRIQIDLCISELLGSFGCNELSPECLWSIEKYHSHNDTIFIPRSYSSYIAPISSPLFYQKLSQTNRSLEAPWIVHRVPYCILSSRVNEVWRFEHPMAQKDTAQDEDDFTVEFSQSSLNEFKIKHRGEIHGFIGFFSANLYNNIFLSTLPNDSTVRLKFSEETLMNTRREENLIKKCDHTPNMTSWSPIIFPLKQPISFIDDSELSVLMSRIHSNTEQKVWYEWSLESFIYLMLSNYTSAVTAASMTIPRSIVTDDTKTLAHNRHYSATTNQKLDNQIDLDQDIENEEEQGFLSNLETGWQSVQGIHGLSETAKPDHLDSINKPMFDLKSTKALEPSNELPRHEDLEEDVPEVHVRVKTSVSTLHNVCGRAFSLPL

SEQ ID NO: 18532 - protein, 191 aa, Desulfovibrio desulfuricans G20
MKPNYILLLDFAAVFSYLSFVTGSAAQSGAHTPQNTPAVSGKTWHGSTLPDKEELKAKLSPLQFAVTQHDETEPPFKNEYWDNKQPGIYVDIVSGEPLFSSTHKYDSGTGWPSFYQPLAAGHIVEKEDRGLFFTRTEVRGRLADSHLGHVFSDGPPPTGLRYCINSAALRFIPADALDKECYGELLYLFDQ

SEQ ID NO: 18533 - protein, 362 aa, Pseudomonas aeruginosa UCBPP-PA14
MKPLLHAFAPGVMALMLLLPQAAQAKEVAPQQKLSNVVILATGGTIAGAGASAANSATYTAAKVPVDQLLASVPQLKDIANVRGQQVFQIASESFTNENLLELGKTVAKLADSDDVDGIVITHGTDTLEETAYFLTLVEHTEKPIVVVGSMRPGTAMSADGMLNLYNAVAVAGDKSARGKGVLITMNDEILSGRDASKMVNIKTEAFKSPWGPLGMVVEGKSYWFRAPVKRHTVNSEFDIKQISALAPVEIAYSYGNVSDTAYKALAQAGAKAIIHAGTGNGSVPARVVPTLQELRKQGVQIIRSSHVNAGGFVLRNAEQPDDKNDWIVAHDLNPQKARILAAVAMTKTQDSKELQRIFWEY

SEQ ID NO: 18534 - protein, 437 aa, Pseudomonas aeruginosa
MENLREKVTRKFKDKEALVGIVGLGYVGLPLMLRYNSIGFRVLGIDIDAEKVRRLNSGESYIEHISAESISHACSSGFEATTDFSRAKECDALILCVPTPLNKYREPDMSFVVNTTEAIKPYLREGQVVSLESTTYPGTTEEELLPRVQSDGLVVGKSIFLVYSPEREDPGNPNFETRTIPKVIGGHTPECLEVGVALYEQAIDKVVPVSSTKAAEMTKLLENIHRAVNIGLVNEMKVVADRMGIDIFEVVDAAATKPFGFTPYYPGPGLGGHCIPIDPFYLTWKAREYGLHTRFIELSGEVNKAMPEYVVSKLMDGLNERGKALKGSRVLVLGIAYKKNVDDMRESPSVEIMELIQAKGGIVSYSDPHVPSFPKMREHHFDLASEPLTAERLSRFDAVVLATDHDRFDYDLIHAHASLVVDSRGKYRAPSQKVIKA

SEQ ID NO: 18535 - protein, 621 aa, Debaryomyces hansenii CBS767
MVQDHDCKEIPPIGRDEENTTKCTMDNEFKEVDEYEQSSSTKTHEPHVPLMRGVQLIENVKTAMDDSKRGNIVKAVYGTSILVCAWAASLDASTTNSLQPLATSSFGAHSSLATINIANGIIGAVSNPILAKFADLISRTFIYIISVFFYTVGYIIAASSQTATAFIVGLGIATVGKTGVDFVNTLIVIDFTPLKWRGFVTSILATPFIINCWFAGLIVGDLRVANWKWGYGMFAIIIPVVLLPAIALMTYFDKTVTLADSFSAGKSKTKKEELYNIVSIIKQGLIEVDAFGLLLLGFGFALLLLPFSLAGSADNGWRNPSLIAMIIVGGLLVIAFFVYEIYYAPFPAMPKRILNVTLVMSIIIDFFYYFAGYIGLLYFSSYVFVVKDWNYTNWTYFNNTLTLALCIFGVIAGILFRVTRRYKIWQLLGLAMRIISYGILILGKGSTIVTGALIAHPILAGGGGGLSVVASGVALQASVEHSQVALAIAMLSLWTRIGGSIGEAITSAIWNAKMPASLRKHLSSSVSDAQVAEFFGDITLLHEYPIKSEIRQGAIAAYQEVNYYFFCIALGLSFIPFICAFFQTNYFLNDKQNAVDQDVHDEKDITKGAPKNWKDKFARCF

SEQ ID NO: 18536 - protein, 360 aa, Methylococcus capsulatus str. Bath
MRVGKFEVDHMALLLVFVPVSIVLEWVHADPVWIFAASALAIVPLAGQMGKATEYLAEHLGSGLGGLLNASFGNAAELIIGFFALRAGLIDVVKASITGSIIGNILLVLGASVVVGGLKHETQYFNRTAAGLGVTLAALSAIALVVPAIFHLVVQGHPEPHERELSLEIALVLFVTYILSLVFTLRTHRHLYVGESSEETDEALGVGAWSMRKSLLILLVATALVAWMSELLVGAVEHAAHDLGMTNVFIGVILVAIVGNAAEHSTAVMMAAKNHMDLAMNIAIGSSIQIALFVAPLLVFAGHVMGQPMDLVFSTFEVVAVAIAVAAVVLIAMDGESNWMEGVNLLAVYVILAIAFYFLP

SEQ ID NO: 18537 - protein, 364 aa, Burkholderia thailandensis E264
MSLKCGIVGLPNVGKSTLFNALTKAGIAAENYPFCTIEPNVGVVEVPDARLKALADIIKPERVVPAVVEFVDIAGLVAGASKGEGLGNQFLANIRETDAITHVVRCFEDENVIHVAGKVSPLDDIEVINTELALADLGTVEKALARYSKAAKSGNDKEAAKLVAVLEKTRAHLDQGKAVRGLDLSDDEKALLKPFCLITAKPAMYVANVKEDGFENNPHLDAVRKYAESEKSPVVAVCAAIEAEIADLDDADKEAFLADMGMDEPGLDRVIRAGFKLLGLQTYFTAGVKEVRAWTIHIGDTAPQAAGVIHTDFERGFIRAQTIAYEDFIAYKGEQGAKEAGKMRAEGKEYVVHDGDVMNFLFNV

SEQ ID NO: 18538 - protein, 393 aa, Kineococcus radiotolerans SRS30216
MTDGGQASARSWSAAWSEDDLEDGQIDLSDFHAVVPAGGAGTRLWPLSRSDRPKFLLDLTGRGRTLLQSTWDRLLPLTEASRTWVVTGRSHADAVAAQLPDLPGENLLREPCQRDSAAAIGLAAAVLVRRDPDAVLGSFAADHNISGRDDFESSVEEAVVTARRGFVVTIGIAPSHPATGFGYIRLGKRLRLQGAPNARRVVQFKEKPDARTAAAYLSTGDYRWNGGMFVARADVLLELLAAHAPALHAGLQRIADAWDTPQRDAVLEEQWAALPAIAIDHAVAEPAAEEGRVAVVPATFGWDDVGDFSSLAELLPADVDMPKVLGDPHLVITEGVAGGLVVPGNDRVVALLGVDDLVVVDTPDALMVTTRARAQEVKKLVARAREAGLDHVL

SEQ ID NO: 18539 - protein, 418 aa, Bradyrhizobium sp. ORS278
MTRSNRTDHIRLTSHPVPGAKHNFPLHWGAASARERGPVIGTVSRPQDRNVIGSHGGSYTVYRALAVSSGALDPIRRPDLTNTHPAATIGPFDQWRDPAKIVALDPWGHLVAENFGGEIAEGIDIRPSIAVTKARIELPELHAALAAKRLVHDGSVVHANGSVSVVKIAIDPVWYLPGVAARFGTSETNLRRGLFEQTGGMYPELVTRPDLQVFLPPIGGTTVYLFGDVTKLNEPRTKITCRVHDECNGSDVFGSDICTCRPYLIHGIEECVAAGQNGGLGIIVYNRKEGRALGEVTKFLVYNARKRQEDGDAAAAYFERTECVAGVQDARFQQLMPDVIHWLGITRIDRFISMSDMKHDALVGQGVDIVERVPIPDELIPADAHVEIAAKKAAGYFSLEPQKPQELGDTVGRPLEKY

SEQ ID NO: 18540 - protein, 398 aa, Neptuniibacter caesariensis
MSLPILKLNSGAERRLRGGHLWIYSNEVDNSATPLKGFEPGQQVVVETDKGKPLGIAYVNPNTLICGRMVSRDLKYKLDRSLLIHRIKVALSLREACFSDDCYRLVFGDSDALPGLVIDRFYDVFVVQVSTAGMEAVLDEVVDALNKVFTPKAILLRNDGKMRDMEGLETYTEIVQGDIPELCPLMENTVPLLAPLQKGQKTGWFYDHRNNRAQMQKHVEGKRVLDLFSYVGGWGAQALAAGASQAICVDASHFALEVAAENARINNAEDRFEGFHGDAFDICKSLIADKEKFDVVVLDPPAFIQKKKDVRNGERAYSRMNNFAMRLLKKDGILVSASCSMHLQRERLVDIIRSNSRELDRNAQIFDQGHQGADHPVHPAIPETDYLKSFFVRVLPSA

SEQ ID NO: 18541 - protein, 181 aa, Physcomitrella patens subsp. patens
MGLTFTKLFTKLFSKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIANKA

SEQ ID NO: 18542 - protein, 386 aa, Rickettsia prowazekii str. Madrid E
MNIHEYQAKEILRKYGVPTSTGLVVTKTEKINETIDKLNTKVYVIKAQIHAGGRGKAGGVKVAKSKEEAKKVAHDMFGINLVTHQTGPQGQKVNRIYIESGCDILKEYYFSIVFDRSASCITFIASTEGGVDIEAVAEKMPEKIIKFAVDPATGLQDFHMRGIAYELGFKDNQAKQMKEIVKAVYNAFIETDATQIEINPLIINSYGNLLALDAKITFDDNGLFKHPNITAMRDHDEEDPLETRAANAGLSYVKMDGNIGCMVNGAGLAMATMDIIKLYGALPANFLDVGGGADRERVKEALKIILSDKEVKGILVNIFGGIMRCDIIAEGIIAAAKDIGIKVPLVVRLAGTNVEKGKEILSNSDLKIIPAHDLADAANKIVEAIR

SEQ ID NO: 18543 - protein, 563 aa, Nocardia farcinica IFM 10152
MTRSQQVTTAGTVLRGTPAVPGVAAAPAVRPNPRLPVDARTDIVPQSERAAELTALRAAAATVADRLRTRAEAASGAAAEVLAANAAMAADRGWSAAAEKLIGTGSTASAAAIGATEQFAQMFSRLGGLMAERVTDLRDVCDRIVAELHGLPEPGVPTPERPSILLARDLAPADTAGLDPARIIGLATALGGATSHTAIIARQLGIPCVVAVDGLDDVPAGAQILIDGAAGTVTVEPAPAVAAAAVAAHRATAARIASWTGPGATRDGHRVGILANVQDGAGARAATATPAEGIGLFRTELCFLDRDAEPSVAEQTRIYREVLDAYPTAKVVIRTLDAGSDKPLRFAEHPDEANPALGVRGIRIAARDSGILERQLDAIAAAADGRATPPWVMAPMVATVAEARSFAAAARARGLVAGVMIEVPAAALLAEAILDEVDFVSIGTNDLAQYTMAADRMSPDLAALTDPWQPAVLSLVARTAAAGVRCGKPVGVCGEAAADPLLACVLAGLGVTSLSAAAPAVAGVGAQLATVTRAQCESAAWAVLRTTDPGEARVQARRLLLDD

SEQ ID NO: 18544 - protein, 267 aa, Triticum aestivum
MASVTSRCSGLLLPDLRPGLAGLRSRSPPLSSPRVHLRGGRRRPRTLSCVAPPDSAEPKTDEQNVKAELGEEKPQPSSSSSSSTPQEAAAEPPVPDRGLNRRIAVLTTLAAVGLFGSQRLQLGGFSLKDLAANAVPYEEALSNGKPTVVEFYADWCEVCRELAPDIYKIEQQYKDRINFVMLNVDNTKWEQELDEFGVEGIPHFAFLDKEGNEEGNVVGKLPRQYFLDNVVALSSGDPTIPHARAVGQYSSAEFRKVHQVADPRSHG

SEQ ID NO: 18545 - protein, 513 aa, Arabidopsis thaliana
MSILSFPHTFFNISPSLFYTILISSLVLLILTRRSAKSKIVKLPPGPPGWPVVGNLFQFARSGKQFYEYVDDVRKKYGPIYTLRMGSRTMIIISDSALVHDVLIQRGPMFATRPTENPTRTIFSSNTFTVNASAYGPVWRSLRKNMVQNMLSSIRFREFGSLRQSAMDKLVERIKSEAKDNDGLVWVLRNARFAAFCILLEMCFGIEMDEESILNMDQVMKKVLITLNPRLDDYLPILAPFYSKERARALEVRCGQVDFIVKLIERRRRAIQKPGTDKTASSFSYLDTLFDLKTEGRITTPSNEELVSLCSEFLNGGTDTTGTAIEWGIAQLIVNPEIQSRLYDEIKSTVGDREVEEKDVDKMVFLQAVVKEILRKHPPTYFTLTHSVTEPTTVAGYDVPVGINVEFYLPGINEDPKLWSDPKKFNPDRFISGKEEADITGVTGVKMMPFGIGRRICPGLAMATVHVHLMLAKMVQEFEWSAYPPESEIDFAGKLEFTVVMKKPLRAMVKPRV

SEQ ID NO: 18546 - protein, 370 aa, Populus trichocarpa x Populus deltoides
MVVTADSTTGVSATYDRDQEIRSFDESKCGVKGLVDAGITKLPRFFIRPPEDIAADYINTGEWINTQFTIPVIDLKNMDSRRAEAVAGVKRAAEEVGFFQVVNHGMENRVLEEMLEAVRGFHEQPREVKEEYYSREMTRKVTYVSNFDLYKAKYANWRDTLFCVMGPDPLDPQELPLVSRDIIMEYSNKVCKLATVLFELLSEALGLKSDHLKEMDCVKGHALLSHYYPACPEPELAMGTTKHSDPDFLTILLQDDIGGLQIFHQNHWIDVPPVHGALVVNIGDLLQLISNDKFKSVEHRVVANHIGPRVSVASFFTPHLYPSTRLYGPIKELLSEENPPIYCEITVKDFIAYYDSKGLDGNSALPHFKL

SEQ ID NO: 18547 - protein, 161 aa, Zea mays
CFGSAVTCAYIVKKLLEVTSAGSSQDPLDLLFIRQGNLSQRKCSYVVIGRVIFSILGIFMAAVVTYTVITDGLPFRKELLTPWMAATLIDFYINVFAISVWVAHKESSWISTTIWIVLLICFGSITTCGYIVIQLFKVSYQDPIYHVLLNSHSKYGIPTSL

SEQ ID NO: 18548 - protein, 420 aa, Oryza sativa Japonica Group
MDRASENRRLAAVGKPVPGIGEMGNRRPLRDINNLVGAPPHPSAIAKKPMLEKSGKEEQKPALVVSHRPMTRNFAASLTRKEQLDHQVSVADAAVVCTDPQKNPIPDGTVDDDVESCESNDYIAVDECNDTDEDESMMDIDSADSGNPLAATEYVEELYKFYRENEEMSCVQPDYMSSQGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLQLLSFFILELSLVEYQMLKYRPSLLAAAAVYTAQCALTRCQQWTKTCELHSRYTGEQLLECSRMMVDFHQKAGAGKLTGVHRKYSTFKFGCAAKTEPALFLLESGAGGYNLQKQPC

SEQ ID NO: 18549 - protein, 132 aa, Triticum aestivum
  misc_feature (113)..(113): Xaa can be any naturally occurring amino acid
MSSSSRVRVGTLVPFVEGKSGSPNASSLPMPSIPIFKGSNVVGRSNLVAVDKRVSRKHLSLRALPDGSLEVVVSDGTNPIVVQSEGQRRKVCAQQRAKIMHDDVLELIPGEYXMKYVNMSDERKSSTSVESH

SEQ ID NO: 18550 - protein, 215 aa, Arabidopsis thaliana
MAESTQMEVETATEGTVPLPPKPTFKPLKAHEMSDGKVQFRKIAVPPNRYSPLKKAWLDIYTPIYDQMKVDIRMNLKARKVELKTRADTPDISNLQKSADFVHAFMLGFDIPDAISLLRMDELYVESFEIKDVKTLKGEHLSRAIGRLSGKGGKTKFAIENSTKTRIVIADTRIHILGAFSNIKVARSSLCSLIMGSPAGKVYSKLRSVSARLNE

SEQ ID NO: 18551 - protein, 480 aa, Neurospora crassa
MPSNTQTEFAPAPERNPDKYGPNANNNQKKCSQLASDFFKDSVKRARERNQRQSEMEQKLGETNDARRRESIWSTAGRKEGQYLRFLRTKDKPENYQTIKIIGKGAFGEVKLVQKKADGKVYAMKSLIKTEMFKKDQLAHVRAERDILAESDSPWVVKLYTTFQDANFLYMLMEFLPGGDLMTMLIKYEIFSEDITRFYIAEIVLAIDAVHKLGFIHRDIKPDNILLDRGGHVKLTDFGLSTGFHKLHDNNYYTQLLQGKSNKPRDNRNSVAIDQINLTVSNRAQINDWRRSRRLMAYSTVGTPDYIAPEIFTGHGYSFDCDWWSLGTIMFECLVGWPPFCAEDSHDTYRKIVNWRHSLYFPDDITLGVDAENLIRSLICNTENRLGRGGAHEIKSHAFFRGVEFDSLRRIRAPFEPRLTSAIDTTYFPTDEIDQTDNATLLKAQQAARGAAAPAQQEESPELSLPFIGYTFKRFDNNFR

SEQ ID NO: 18552 - protein, 110 aa, Vitis vinifera
MDSMKGQGGIQMLLTAEQEARQIISNAKNLKLTRLKQAKEEAEREVKLYHSNMEAAHQKKISETSGSSGSNVKRLDEETAMKIQSLKESASRVSSDVVATLIKHVTTVKA

SEQ ID NO: 18553 - protein, 1142 aa, Saccharomyces cerevisiae
MAINGNSIPAIKDNTIGPWKLGETLGLGSTGKVQLARNGSTGQEAAVKVISKAVFNTGNVSGTSIVGSTTPDALPYGIEREIIIMKLLNHPNVLRLYDVWETNTDLYLVLEYAEKGELFNLLVERGPLPEHEAIRFFRQIIIGVSYCHALGIVHRDLKPENLLLDHKYNIKIADFGMAALETEGKLLETSCGSPHYAAPEIVSGIPYQGFASDVWSCGVILFALLTGRLPFDEEDGNIRTLLLKVQKGEFEMPSDDEISREAQDLIRKILTVDPERRIKTRDILKHPLLQKYPSIRDSKSIRGLPREDTYLTPLSESNSSIDATILQNLVILWHGRDPEGIKEKLREPGANAEKTLYALLYRFKCDTQKELIKQQQVKKRQSISSVSVSPSKKVSTTPQRRRNRESLISVTSSRKKPISFNKFTASSASSSNLTTPGSSKRLSKNFSSKKKLSTIVNQSSPTPASRNKRASVINVEKNQKRASIFSTTKKNKRSSRSIKRMSLIPSMKRESVTTKLMSTYAKLAEDDDWEYIEKETKRTSSNFATLIDEIFEYEKYEQIRKEKEELERKVREAKAREELERRRRKQEEKERARKLLEKEDLKRKQEELKKQIEIDISDLEQELSKHKEEKLDGNIRSISAPMENEEKNINHLEVDIDNILRRRNFSLQTRPVSRLDPGIMFSSPTEEVSPVEPKRTENERLTTEKKILETIRRSKFLGSSFNIDKELKLSKMEYPSIIAPQRLSEERVVSDSNDGYESLILPKDGNGVSQLKDSTATTAPVSDGRLRKISEIRVPQFTRKSRHFSESNKRLSVLSMYSTKESFTNLVDILKNGNLDVNNQQSQRIPTPRSADDSEFLFETVNEEAEYTGNSSNDERLYDVGDSTIKDKSALKLNFADRFNGSNEAKQTDNLHLPILPPLNGDNELRKQNSQEGDQAHPKIKSMIPESGSSSHTEKEEENEEKEEKKPEQHKQEEDQEKREKVVDDMEPPLNKSVQKIREKNAGSQAKDHSKDHLKEHKQDKNTAIGNGSFFRKFSKSSDKTMELYAKISAKQLFNGLEKLLRGWTQYGLKNIKSHPNNLTLTGKLSSDNIFSLRSTLFEVNIYPRGKMSVVQFKKVSGSFKAVKKLVNEVENVLNKEGVLQK

SEQ ID NO: 18554 - protein, 541 aa, Striga asiatica
MTVEKIKGDNENCENFPVGMRVLAVDDDPICLKLLDTLLRKCQYHVSTTSQARMALKMLRENKDRFDLVISDVHMPDMDGFKLLDQVGLEMDLPVIMLSANSDPKLVMKGVTHGACDYLVKPVRIEELRNIWQHVIRRRKSVTRNENKSADQAKPNQIASGEGGQLGGTIPGENADQNGKTNIRKRKDEEDESEDGNENEDPATQKKPRVVWSIELHRKFVAAVNQLGIEKAVPKRILDLMNVEGLTRENVASHLQKYRLYLKRISTVATQQANMAAAFGVKDSPFMRMGPFGGLPNAAFPHYSPGAMLGRINPPPNMNLRNISPSAFIQPNSFSALNKMHPGLANPNPGQNLFPGIQLSLELDPNKQVPNKFPEQGTIGGPSNVINGNFQQTMNNGGFGIGPDSFSVGSIETSGLMQPNNSLISGQPFQLAMNSNRDSGFSGEGYVPSNSLDMSGPGTTLALDGLSQRWGDQQGQNGHCLKVGYVPLNGSQNEKSQGGFGGRGYDALDDMMNAMIKREQDETAPNCDFAFDSYSFGSGGV

SEQ ID NO: 18555 - protein, 651 aa, Prosthecochloris aestuarii DSM 271
MFEARNIFLSAGTKDLLQNASFRIGDRDRVSLVGLNGTGKSTLLRLISQAASGRTALSQGEFTCSSGTTIGYLPQEISFENELETTAFHYVMQANKTLNELAEKIERLQEDLAAPGHDHESSQYHRLIERFSEASHDFERLGGYTMEGQAEKVLTGLGFTKTGFEKKVKEFSGGWQMRLLIARLLLQNPTLLLLDEPTNHLDIDSLRWLENYLLNYEHSCMIVSHDRFFLDKVTTRTLEINFRTIIEYKGNYSYYEKEKAERFELMMARYENDLKKMAHLKDFVDRFRAKATKAKQAQSRLRQMQKLEEELQAPEEDNASISFSFPKARPSGKEVLRLQNISKSWQLPDGTKKQVLQAIDAEIMRGDRIAIVGSNGAGKTTFCRIIAGDLDYEGTMTTGHNVSLNYFAQHQTEHLDPLKTILEEMMNAAPDSESQRKVRDILGCFLFSGECVEKKTGVLSGGEKSRVALAKILLQASNLLIMDEPTNHLDMRSKEMLIDALENYDGTLLLVSHDRYFLDSLVNKVIEIKDGSLQLYLGTYAEYLEKADKADKAAEEERRKKAAQQIQRPVKSKKNTHKKDSTPPGNNSRKTERIEKEITRLEQQKKDLEAIMGAPAFYEESGEKTAATLKKYDGISNELDKLYKEWEKALS

SEQ ID NO: 18556 - protein, 663 aa, Burkholderia thailandensis E264
MTLLLLLASVAGVVVFRSLNLPPMLGYLTVGIVVGPHALGFAADLERAEHLAEFGVVFLMFSIGLEFSLSKLRAMRRLVFGLGLAQVLGTIAIALVLGALFERWMHITWEGSVALGGALAMSSTAIVSKMLAERLEIETEHGRNIFGVLLFQDLAVVPLLIVIAAFGGESSRDLALSLGFAAVKIVVALALLLIVGQRFMTRWLNVVARRRSQELFVLNLLLVTLGAAFITDRFGLSLALGAFIAGMLISETPYRHQVEEDIKPFRDVLLGLFFVTTGMLLDPSVIWRHPFLVLAFFVGQVLLKSVMITGLARAFGATPGVAMRTGLGLAQAGEFGFVLLNLILDRHLVDATLLQSILASMLLSMLAAPFLIQNADRIVMRLSAAEWMQQSLQMTRIATQSIKQKGHVIVCGYGRAGQNLARMLEQEGIAYVALDLDPDRVTAAAAAGESVVFGDAARRESLLAAGIHRAAAVAVTYANTPSALRVLHNVHELEPTLPAIVRTVDDADLEKLLAAGATEVIPEIVEGSLMLASHTLVLMGVPMRRVVRRVEEMRDERYSLLRGYFRGADDADDDDHEQVRLQSVPVDARADAVGRSLAELGLFALGIEVTAIRRHGIRGVEPDPETKLRASDIVVLRGLPEALAEAEERLSRHRREGGSTAAA

SEQ ID NO: 18557 - protein, 529 aa, Azoarcus sp. BH72
MSGPPGQSRAALLARLRADPVWDVLVVGGGASGLGCAVDAAARGYQVALVEARDFAQGTSSRSTKLIHGGVRYLAQGRLGLVREALHERARLLENAPHLVRPLRFVVPARRWSELATVGAGLGLYDLLAGRGGIGRSRLLGAAETRAALPGVKADGLCGGVAYWDAQFDDARLALALARTLADLGGVPLNHCALERLLIEDGVIRGAVVRDTERAEPFALRARVVINATGVWSDQVRRLANPAAPATLRPSQGVHLVVDRAFLPGRQALLVPRTEDGRVLFMIPWQDRLLLGTTDTARADLPLEPEALPGEVDFILSTAARYLERAPGRADVLSVFAGLRPLLESAAARNSGELSREHVVEVSAQGLVSMLGGKWTTYRSMAADAVDAAIEWAGLPARPCATASLRLHGAAAPRGDRLDAYGSDLSGLESLPGAGRVLVEGLDLTEAEVRHAARAEWARGVEDVLARRHRALFLDATLAACAAPAVAQILAAELGRDEGWVAAQTDAFHALASAYGASLSRACAAARSG

SEQ ID NO: 18558 - protein, 569 aa, Striga asiatica
MNLGVTPMSFASVNALWKSGNGLSDQFPAGLRVLVVDDDPTCLRILEKMLKNCLYEVTTCNRAGIALKFLRDKRNVYDIVISDVHMPDMDGFKLLEHVGLEMDLPVTMMSADDSKNVVMKGVTHGACDYLIKPIRMEALKNIWQHLVRKRQHEWKEKDLDQHLGSVDEQKLPEDLDYSLSVSEENWNTSKKRKDEEDEAVDKDDTSSLKKPRVVWSVELHQQFVAAVNQLGIDKAVPKKILELMNVPGLSRENVASHLQKYRLYLRRLSSQHHNGLPNPFMGLPDSPFGPMTQLSAVDLQALAASGQLPPAHSLATIQQAAALGQAQPTTNNTITSPLVDQRNNIFSFDSPKSRFANGQPQQNSNVNQVNLLHGIPTTTNRSLSIPMVQTQPRAQNFNEVNSRVSQPCLPIGISGQPSQAINARTMGPVIKSRDDVNSQVKGSRGFFANYSAFGGLNQNRARDLFLQNVGPNVQQIGSGPVNGVGFSVAGGLGNVANTSQLVSSSGENTFKIKAQRMPNMGSSFENGFSHELSGQEDLMSMLLKEEQEGVGAIDNEFDFNIYNLDNLPV

SEQ ID NO: 18559 - protein, 366 aa, Mesorhizobium loti MAFF303099
MPYDQKKIVEAIRAFERGEIVVVMDDDGRENEGDLIVAAVHCTPEKMAFIVRNTSGIVCTPMPREEAKRLNLQPMVADNDSAHTTAFTVSVDFKHGTTTGISADDRTLTVRNLANGNVGASDFVRPGHIFPLIAREGGVLMRSGHTEAAVDLCKLAGLPPIGVISELVNDDGTVKRGPQVQAFAEEHGLKQVSVADLIAYRQRKETLVERVACSDIDTLGGKAQVFTYTLPWDTMHHVAVVFGDIRDGEEVPVRLHSEDVVTDVFGTSHRLDGIMKAMGERKRGVIVYLREGSVGVAHQERKRPLSGDREDHEEARRRENEWREIGLGAQILKDLGISSINLIASRERHYVGLEGFGIHIAKTEIL

SEQ ID NO: 18560 - protein, 554 aa, Pseudomonas fluorescens
  misc_feature (446)..(446): Xaa can be any naturally occurring amino acid
MAYYRTPHDVTALPAWQALNDHRKAMQDFSMREAFNADPQRFTQFTLSSCGLFLDYSKNLINAQTRDLLVGLANEVDLKGAIKSLFEGEIVNASENRPALHTALRRPVGDKLLVNGVNVMPDVHKVLNQITDLVGRIHDGLWRGYTEKPITDVVNIGIGGSFLGPELVSEALLSYAQKGVRCHYLANIDGSEFHELTMKLRAETTLFIVSSKSFNTLETLKNAQAARAWYLAQGGSEAELYRHFIAVSSNNAAAVAFGIREENIFPMWDWVGGRYSLWSAIGLPIALAIGMSNFKELLSGAYSMDQHFQSAPFEQNMPVLLALLGVWYGNFWGAQSHAILPYDHYLRNITKHLQQLDMESNGKSVRQDGTPVSTDTGPVIWGGVGCNGQHAYHQLLHQGTQLIPADFIVPIVSFNPVSDHHQWLYANCLSQSQALMLGKTRAEAEXELRDKGASEEEVQKLASHKVIPGNRPSNTLVVERISPRRLGALVALYEHKVFVQSVVWGINAFDQWGVELGKELGKGVYNRLVGSEESLAEDASTQGLINYFRGRHRG

SEQ ID NO: 18561 - protein, 472 aa, Pseudomonas syringae pv. phaseolicola 1448A
MAERLSNDFQFIDVGRKDPKKKLLRQRKKEFVEIYEPFKPQQSADQAHRCLGCGNPYCEWKCPVHNFIPNWLKLVAEGNILAAAELSHQTNTLPEVCGRVCPQDRLCEGACTLNDGFGAVTIGSVEKYITDTAFAMGWRPDMSRVVPTGKRVAIIGAGPAGLGCADVLVRGGVTPVVFDKNPEIGGLLTFGIPEFKLEKSVLSHRREVFTGMGIEFRLNTEVGKDVTIDQLLEEYDAVFMGMGTYTYMKGGFPGEDLPGVHDALDFLIANVNRNLGFEKAPEDFVDMKGKRVVVLGGGDTAMDCNRTSIRQGAKSVTCAYRRDEENMPGSRKEVKNAKEEGVKFLYNRQPIAIVGDGKVEGVKVVETRLGEPDARGRRSPEPIPGSEEIIPAEAVVIAFGFRPSPAPWFEQFTISTDSQGRVVAPEQAQYKHQTSNPKIFAGGDMVRGSDLVVTAIFEGRNAAEGILDYLGV

SEQ ID NO: 18562 - protein, 414 aa, Sinapis alba
MAFRPIGYTISSLRKASAANDLRFSFLSIYSSFPAKKNLLLSFLRGFSSLHRRQQQQSRVNKSETLAQKIGKSIRRAGAPSKARVYADVNVIKPKDYWDYESLAVQWGAQDDYEVVRKVGRGKYSEVFEGIHATDNEKCVIKILKPVKKKKIKREIKILQNLCGGPNIVKLLDIVRDQQSKTPSLIFEHVNNKDFKVLYPTLSDYDVRYYIYELLKALDFCHSRGIMHRDVKPHNVMIDHEQRKLRLIDWGLAEFYHPGKEYNVRVASRYFKGPELLVDLMDYDYSLDLWSLGCMFAGMIFRKEPFFYGHDNYDQLVKIAKVLGTDELNTYLNRYRIELDPNLASLVGRHSRKPWSKFINSENQHLAVPEAVDFVDKLLKYDHQERPTAKEAMAHPYFNPIRNAESSRSTPRAQ

SEQ ID NO: 18563 - protein, 655 aa, Halobacterium sp. NRC-1
MPQDPSESPSTADTNRTTNDHTRPGPAPTVPAGKNVAELTVKAVLIGLALNVLLLTANMYLGMRSGLTISASIPAAVISMGLFYALRYAGIGGTILENNIVQTMTSAGEALAAGVIFTIAGVTFLDQSINIVETAAVAALGGLLGVLFMIPMRRYLIVDKHEQLPYPEGTACADVLETGSEGDGGVKLISLGFFVSFIYMWLANGMAVMKTTLETAFSAGQTRGFAIGGDFTPALIGVGYIIGPRIAAYVFGGGLVAWMMLIPLLITGGFVPDQAANLTLMGQAHAVWDQYVRYIGAGAMIVGGFYAIISMAGTIRDALASAAAELSGSKSETATQIPRTQRDLSMKVVVLGALAITIALVAIPQVELGVLGGVIAVVAAFLFVAVSAYLVGVVGSSSNPVSGMAVATVLIAALAMKSTGVSDPVVVLLTASVVAIAAAVAGDTSQDLKTGYLLGATPRKQQIAQMVGIAISSVFAGWVLSFFNQAYGIGSETIPAPQAGMMALISEGVLTGSAQWGMILIGAVFAIVLIMMDVPVLPFSVGIYLPITLATPIFLGGLLRAGVDRYVDWRSDDGDGAAKERATYRGRIIAAGLITGEAIMGIVVGGIYVLGIGADEGAPYAVGLASGTQTLLGGVALVALVAVFVGGVIRDPQDT

SEQ ID NO: 18564 - protein, 184 aa, Arabidopsis thaliana
  misc_feature (66)..(66): Xaa can be any naturally occurring amino acid
  misc_feature (91)..(91): Xaa can be any naturally occurring amino acid
  misc_feature (97)..(97): Xaa can be any naturally occurring amino acid
  misc_feature (110)..(110): Xaa can be any naturally occurring amino acid
  misc_feature (124)..(124): Xaa can be any naturally occurring amino acid
  misc_feature (135)..(135): Xaa can be any naturally occurring amino acid
MASSMLSSAAVVTSPDQATMVAPFTGLKSSAAFPGTRKTNKDITSIARNGVRVSCMKVWPPIVKNXFETLSYLPDLIDYELAKEYDYLLRXNKWIPXVEFQIYHGFVYRXHGNTPGYYVVERTXTTRELPLFSCXTDSAQVVKEDKECPNDYPSTFIMIIAFDNTRIVQCVNFIAYKTPNFTEA

SEQ ID NO: 18565 - protein, 144 aa, Nicotiana tabacum
MASISGTMVSTSFLPRKPVVTSLKAIPNVGQALFGLKSERGGRITCMASYKVKLITPEGTVEFDCPDDVYILDQAEEEGHELPYSCRAGSCSSCAGKVTGGNVDQSDGNFLDDDQMAGGFVLTCVAYPQSDVTIETHKEEELTG

SEQ ID NO: 18566 - protein, 271 aa, Oryza sativa Japonica Group
MLTPEDGSADLIRALNNRLIALSFHIREYYWVDMQKLNEIYRYKTEEYSYDAVNKFNIYPDQVSPWLVEWIPPKGGYFIGNLQPAHMDFRFFSLGNLWSIVSSLATTHQSHAILDLIESKWSDLVAEMPLKICYPALENQEWKIITGSDPKNTPWSYHNGGSWPTLLWQLTVASIKMNRPEIAAKAVEVAERRIAIDKWPEYYDTKRARFIGKQSRLYQTWSIAGYLVAKQLLDKPDAARILSNDEDSEILNALSTNRKRGKKVLKKTFIV

SEQ ID NO: 18567 - protein, 211 aa, Xylella fastidiosa 9a5c
MKLTVPTWLTLLRIVMIPVLIVVFYLPYQWSNIVATGVFAIAAITDWLDGWIARRYAQHSLLGAFLDPVADKLMVAIALFLIVQGHPTPSMAFWAAVIVSREIAVSALREWMAEIGHRAKVRVAVLGKVKTTAQMIAVLCLLYSVTPEKKAIHQIWFGHLIFQVGYWTLLISALLTLWSGFQYLHAAWPSLRTGKPVVIKTHISKNRKINS

SEQ ID NO: 18568 - protein, 250 aa, Arabidopsis thaliana
LRCSRGSYLIEAMRPLSSSLRPSSSVSFSTGKPIKRAYDGLLLDAGGTLLQLSKPVHETYASLGQKYGLKTTPAEIKEGFKRVFSAPWPEKLRYQGDGRPFWKLVVSEATGCSDNDYFEDVYQYYANGEAWHLPEGAYETMSLLKDAGVKMAVVSNFDTRLRKLLKDLNVIDMFDAVIVSAEVGYEKPDERIFKSALEQISVDVNRAVHVGDDEGADKGGANAIGIACWLWGEDVQTFSDIQKRILVSEL

SEQ ID NO: 18569 - protein, 228 aa, Gossypium marchantii
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHBKPVQEVLAEMTNGGVDRSVE

SEQ ID NO: 18570 - protein, 316 aa, Saccharomyces cerevisiae YJM789
MAFLNIFKQKRGDEASQLSAKGREEISQSIKICKSDDAANEHSCSGDCKTEIEEGEQAFAKLKIEHETPLLNSSKTPKIHFVVPTSQIDWQHDACLEDPKSVQYKISQWCDKNSAKFSNVGTGKTLNCAVSSLPKDIMDIDVMRGTKNNVLILPYFIWLNDLRSDDVEATLDGLVPDLLNENISREKLLETRPNVAVARERAFVFICSHTTRDKRCGITAPYLKKVFDSKLQEHGLYRDNSDYRAEGVKIAFVNHVGGHKFAANVQIYLRNPNTLIWLGRVTPTIVPSIVEHLIVPEEPTLPFPEKVRCIKKYQSW

SEQ ID NO: 18571 - protein, 1178 aa, Vitis vinifera
MAPKRKRSLTRSTLSPPFPWRWDVFLNFRGEDTRFNFTDHLYKKLRRTGIRTFRDDEGLERGGEIQPSLLKAIEDSSISVVVFSKNYAHSKWCLDELDKIMQSMEKGQLVLPVFYHVDPSDVRKQRGSFGEAFAGYGEVAEERVQRWKAALTKAGSLAGWHVEHGYESQIIKGIVRHISKKLISHPELLTIDDHLVGINSRLEEMSSLLCMESNDVRIIGIYGIAGIGKTTLAKGIYNQIAHQFEDASFLPHVAEAVERHGLLELQRQLLADILRENFVHISNIHEGISLIKKTLFSRKVLIILDDVSALTQLELLAGSHQWFGSGSRIIITTRDKHLLDGYGVDGLYEVQKLKVEEALQLFSLNVFKADFPDEGFWELSGHALNYCDGLPAALKVLGLFLRGKTELAWENALLKQQTVGDRRIQQMLRVSFDGLDSTEKDLFLDIACFFRGKDSDSVGRILDSCNFSANGMKVLKDRSLISILDNKIEMHDLMQKMGWEIIKEEFPGRPGKWNVHAVLTQNTWTKAIQGISFDMSASIEIQFTTRAFKNMTKLKTPQVHLPQEFKFPSYELRYLHWDGWSLESLPSNFDGKKLVQITLKHSSLKHLWKGNKCLENLKVMDLSHSPCLVECPDVSGAPSLETLNLDGCTTTAIIELPSSVGYLRGLVLLNMKSCKNLKILPGRICALKSLKTLILSGCSKLERFPEITEVMEHLEKLLLDGTSIRELPRSILHLKGLVLLNLRKCKDLRSLPNSICDLKSLETLIVSSCSKLNRLPEDLGMLQCLRRLQADGTAITKPPISLRLEVLNLSRNYMVSIPADISKLSNLKVLLVRQCEQLQKIPKLPPSIKLLDACDCTSLMSLPTPSRIISPQHWLVSTWLRPVEFMLWNCSGLYQDHKLFPEIGYSILIPGSRIPKWAWHENMGASVSATLPPDWLDDNLLGIALCGVFALEAGETIQRPGGICCNFECREGPYFSHSISWTHSGDRVVETDHVWMVYQPRTQFVKSKSICARFKHIKAYFSLSGASHEVKKCAIRLIYAPNTSGNKRKFLAAPNTDIDFRNIHVLKKKKKKRRQGGIQMLLTAEQEARQIISSAKNLKLTRLKQAKEEAEREMKLYHSNMEAAHQKKISETSGSSGSNVKRLDEETALRIQSLKKSASRVSSDVVAMLIKHVTTVKA

SEQ ID NO: 18572 - protein, 254 aa, Zymomonas mobilis subsp. mobilis ZM4
MSVSFDYSGKVALVTGAGTGIGRETALAFAKAKAYVAIIGRSENNIQETLRLVTEMGGQAIAIQADVSQEDSIKAAIEKTVETFGKLDFAFNNAGIEHKAIPAADIPSEEWDRIISTNLNGVFFSMKHEIPAMLKSGSGSIVNTASGAGVKGFPGNGAYCASKFGLIGLSKAAALDYAKQHLRINVVAPGIIETPMMQRFTGGTEEGRETAIAQEPVGRAGHPKEIAGTVLWLCSDLAAFTTGSVFVVDGGQTA

SEQ ID NO: 18573 - protein, 232 aa, Oryza sativa Japonica Group
MASSSDPWVREYSEASRLADDVTSMIADRGSLPQSGPEIMRHTSAIRRKITILGTRLDSLEALLSRIPPKSITDKELHKRQDMLSNLKSRAKQMATSFNMSNFANREDLLGQSKKAADDMSRVAGLDNQGIVSLQRQVMKEQDEGLEKLEETVLSTKHIALAVNEELTLHTRLIDDLDDYVDVTNSRLQRVQKRLAILNKRVKGGCSCMALLISVVAIVFLAVIAWLLIKHL

SEQ ID NO: 18574 - protein, 321 aa, Populus trichocarpa x Populus deltoides
MDGSESHDKASWTKAMLHTFCDICIKAIEKGMRPNTHFDKAGWKFIITAFKEQTGHSFTKSQLKNKWDGIKKDWRIWKRLIYETGVGWSSELGTISASDEWWKTKIQEIRGAKKFRHVGIEPTLCAKYDTMFSNIVATGQHAWAPSQGMISEEDQGGDGLGNSSNVGINLKEGIGDSEVDVVPDFVEDVSRMVAGCNVPNSSSNHSSVKRKATETSIPQPQKKKGGSGMGAKLCSRLDRLLESVLIASNCTVNSRDKKGCSIEEVMEEFHSIHGVDFGSPIHIFATEFFRGRSKREMWKAMGNLERKYSWLKIMYERQSKQ

SEQ ID NO: 18575 - protein, 355 aa, Halobacterium sp. NRC-1
MTRGEARRPPQEFDRVLSSMCTTPHPAAREAAQAFLATNPGDPETYPAVAERERDAVALLGEIVGLSSPHGYIAAGGTEANLQAVRAARNRADADAVNVVAPASAHFSFQKAADVLGVELRLAPTDGDHRADVAAVADLVDGDTAVVVGVAGTTEYGRVDPIPALADIAAGVDANLHVDAAWGGFVLPFTDHDWSFADAPVNTMAIDPHKMGQAPVPAGGFLARDPETLDALAIETPYLESDTQPTLGGTRSGAGVAGALASLRALWPDGYREQYERTQGNAEYLAAELAARGYDVVDPELPLVAADMPDAEFQALREEGWRISRTASDALRVVCMPHVTREMLAAFLDDVDALA

SEQ ID NO: 18576 - protein, 134 aa, Vitis vinifera
MILILSLTKTDGFAYSCILGSIFSMDSMKGQGGIQMLLTAEQEARQIISSAKNLKLTRLKQAKEEAEREMKLYHSNMEAAHQKKISETSGSSGSNVKRLDEETALRIQSLKKSASRVSSDVVAMLIKHVTTVKA

SEQ ID NO: 18577 - protein, 397 aa, Prosthecochloris aestuarii DSM 271
MTSILNKETEHELFFHNYARLPLAITHGKGVYLFDENSNRYLDMISGIGVNALGYGDERLIEAIHDQAKKIIHASNLFMLEPQFKLASKLLDISGLSKVFFANSGTEAIEAAMKLSRKWASLSGSTGKKEILSLSNCFHGRTYGAMSLTAKPKYLEGFDPLLPGTGSIAFNDIEDLKRKITSNTAAVFIEFVQGEGGIHQISREFVEELKKLRETHNFLIVADEIQAGCGRTGKFFSYMHFDIDPDLVCVAKPLGGGLPLGAVIGSRKVQDVFAAGNHGTTFGGNPVACAAGHALIETLYSKKIMEHALATGSWIKAALTKLAETHTQIQEIRQYGLMIGITVNRDAAYYVQESLKRRVLVNATSQNVIRLLPPLTITVEEAQQCIDCLDEIFSEEQ

SEQ ID NO: 18578 - protein, 752 aa, Halobacterium sp. NRC-1
MAVRWLEDVRADDIDSVGGKGASLGELTDAGLPVPPGFVVTAGTYRTFIEEAGIDQELFDAVGVDAEDSDALADAAARASDLILNTDFPASLREDILSSYDALDDGAAFVAVRSSATAEDLPDASFAGQQETFLNITREALLDHVKRCWASLFTERAIYYRQEQGFDHDRVNIAVVVQRMVDAEKSGVLFTSHPSTGAHEAIVEAAWGLGEAVVSGAVSPDNYVVDRDTDTVEEATVADKKVMHVKDDDTGETVSRDVPDRKRTQRVLDDGEISDLVTIGERVEAHYDAPQDVEWAIVDGDVYMLQSRPITTIEDDTDGAVANTDGGGGDAVVTGLGASPGVASGPARVVTSLDELDKIGEGDIIATEMTTPDMVPAMKRAAGIVTDEGGMTSHAAIVSRELGCPAVVGATDATTTLCDDQAVTLDGDRGVVRDGREETTTEHDPIEDARPTTPVKPMTATEVKVNVSIPEAAERAAATGADGVGLLRMEHMILSTNKTPKRYIDDHGEDAYVQELVDGIRGVAEEFYPRPVRVRTLDAPTDEFRQLEGGNDEPHEHNPMLGYRGVRRSLDRPDVFKHELSAFRRLYEMGYDNVEVMFPLVNDAQDVARARDLMADAGIDVEKRSWGVMIETPAAALAIEEIAQEGVDFASFGTNDLTQYTLAVDRNNGSVADRFDELHPSVLTLIERTIDACREHDVATSICGQAGSKPEMVDFLVETGVSSISANIDAVRDVQHEVKRVEQRLLLESARE

SEQ ID NO: 18579 - protein, 110 aa, Vitis vinifera
MDSMKGQGGIQMLLTAEQEARQIISNAKNLKLTRLKQAKEEAEREVKLYHSNMEAAHQKKISETSGSSGSNVKRLDEETAMRIQSLKESASRVSSDVVAMLIKHVTTVKA

SEQ ID NO: 18580 - protein, 431 aa, Yersinia pseudotuberculosis IP 32953
MSKIVKVIGREIIDSRGNPTVEAEVHLEGGFVGLAAAPSGASTGSREALELRDGDKSRFLGKGVLKAVAAVNGPIAQAVIGKDAKDQANIDKIMIDLDGTENKSQFGANAILAVSLAAAKAAAASKGMPLYEHIAELNGTPGKFSMPLPMMNIINGGEHADNNVDIQEFMIQPVGAKTLKEAVRIGSEVFHHLAKVLKAKGLNTAVGDEGGYAPNLGSNAEALAVIAEAVKAAGYELGKDVTLAMDCAASEFYKDGKYVLAGEGNKAFTSEEFTHFLEDLTKQYPIVSIEDGLDESDWAGFKYQTEVLGDKIQLVGDDLFVTNTKILKEGIEKGVANSILIKFNQIGSLTETLAAIKMAKDAGYTAVISHRSGETEDATIADLAVGTAAGQIKTGSMSRSDRVAKYNQLIRIEEALGDRAPFNGLKEVKGQ

SEQ ID NO: 18581 - protein, 388 aa, Medicago truncatula
MELSIMLCFFTSILFIVLFRIFIKSFVSKRHDLPLPPGSMGWPYIGETFQLYSQDPNVFFASKIKRYGSMFKSHILGCPCVMISSPEAAKFVLNKAQLFKPTFPASKERMLGKQAIFFHQGEYHANLRRLVLRTFMPVAIRNIVPDIESIAEDSLKSMEGRLITTFLEMKTFTFNVALLSIFGKDEIHYREQLKQCYYTLEKGYNSMPINLPGTLFHKAMKARKELAQILAQIISSRREKKEEYKDLLGSFMDEKSGLSDEQIANNVIGVIFATRDTTASVLTWIVKYLGENISALESVIEEQESILKSKEENGEEKGLNWEDTKKMVITSRVIQETLRVASILSFTFREAVEDVEYQGYLIPKGWKVLPLFRNIHHSPNNFKDPEKV

SEQ ID NO: 18582 - protein, 145 aa, Brassica napus
IFLTRDCLAYAKIKPAVNQIETHPYFQRDSLVKFCQKHGICVTAHTPLGGSTANTEWFGSVSCLDDPVIKSLAEKYGKTPAQLVLRWGLQRNTVVIPKTSKVERLEENFAVSDFDISGEDMEKIKALDRRYRTNQPAKFWGIDLY

SEQ ID NO: 18583 - protein, 301 aa, Halobacterium sp. NRC-1
MTETRALLVDAFTDDSCAGNAAGVVPDAGGLTDDQMQAIAAELGASETAFLRPSDAADRRLRYFTPTTEVDLCGHATIASHAHLYDDGALAAGEHTLETNVGVLDIEVAEDGTVWMAQNPPTVREVELSYERVAEATGTEAAALRGASDDIPLAVADTGLPFLIVPITYLSDLGDADPDFDAVEALADDVGAAGVYMFSFDALDRASTAHGRAWVPGVGVDEDPVTGTASGAAGAYLARFGAFDGDAPDEMVFEQGHFVDRPGRVRVRVAGDAPMVGGRGVSTLDGTLAVPAETEEEILEA

SEQ ID NO: 18584 - protein, 542 aa, Bordetella bronchiseptica RB50
MKAFNWVNPYPSTRIPVFARNVVSTSHPLAAQAGLRMLLKGGNAVDAAIAAAATIVLVEPVSCGLGGDCFAIVWDGRQLHGLNSSGVAPAAWNVEYFKRKYGTGPDGLAVQPKRGWDAVTVPGVVAGWAALHEKLGKLPFEQLFEPAIEIAERGYTVPPVVAHKWAAAAAELSEQPGYAQAFMPEGRAPRVGEHFRFPDAAYALRRIAASGGRDFYEGELAERIAAFSKECGGAMTLDDLRNYRPEWVKPISRSYRGYELHEIPPNGQGIAALIALGICERFDLADMPVDSVQSQHLQIEAMKLAFSDLYRYVADPRSMEVTPQQMLDDAYLDSRARLIDPDRATHFEAGRPHAGGTIYLTAADENGMMISFIQSNYMGFGSGVVVPGTGISLQNRGVGFSMNPASANVVEGGKRPFHTIIPGFLTRGGKPVMSFGVMGGDMQPQGHLQTVIRMLDYHQQPQAACCAPRWKVNRDFTLDIESTMNRATVEGLKNLGHRLKAVDDPYMDFGAGQFIWRMAESDNDLGYVAASDSRRDGQAVGF

SEQ ID NO: 18585 - protein, 572 aa, Bacillus licheniformis ATCC 14580
MGNEILKAPEGPPSDVERIKKESDYLRGTLKESMLEPLSAGISDDDNRLMKHHGSYLQDDRDLRNERQKQKLEPAYQFMLRVRMPGGVATPEQWLVMDELARKYGNGTLKLTTRETFQMHGILKWNMKKTIQSIHSAMLDTIAACGDVNRNVMCTSNPYQSEIHREVYEWSKKLSDDLLPRTRAYHEIWLDEEKVAGTPDADEVEPMYGPLYLPRKFKIGIAVPPSNDIDVFSQDLGFIAIVEDDKLIGFNVAIGGGMGMTHGDKATYPQLAKVIGFCKPEQLYDVAEKTITIQRDYGNRSVRKNARFKYTVDRLGLETVKNELENRLGWSLAEAKPYHFEHNGDRYGWVKGVKGRWHFTMFVEGGRVTDYDDYKLMTGLREIAKVHTGDIRLTANQNLIIANVTSQKKKKISELIEQFGLTDGKHYTALRRSSIACVALPTCGLAMAEAERYLPKLIDKIDEIVEENGLKNEEITIRMTGCPNGCARHALGEIGFIGKAPGKYNMYLGAAFDGSRLSKMYRENIGEEEILKELRNILPRYAKERNEGERFGDFVIRAGIVKETTDGTNFHD

SEQ ID NO: 18586 - protein, 192 aa, Bacillus cereus ATCC 10987
MSMTEICLVRHGQTDWNFQEIIQGREDIPLNEVGKKQASQSAAALQAEAWDIIISSPLIRAQETAKEIAEATGLQSILLDERFVERNFGEASGKPVATVRELIAEGKVEGMEQDEEIVARCFAAVKDVAETHSGKRIIIVAHSHAIKAILHAIAPEDISFKTPLKNACISYVNENSGKWDVVKYNIAEHINV

SEQ ID NO: 18587 - protein, 637 aa, Mesorhizobium loti MAFF303099
MNATPHTPLLDKVRIPADLRALDESELPQLASELRLELVDAVSRTGGHLGAGLGVVELTVALHYVFNTPDDRLIWDVGHQAYPHKILTGRRDRIRTLRQEGGLSGFTRRAESEYDPFGAAHSSTSISAGLGMAAARDLSGGRNNVIAVIGDGAMSAGMAYEAMNNAGALDARLIVILNDNDMSIAPPTGAMSAYLARLASGKAYAGLRDFGKKLTSYLGKRADRAITRAVEHARGYVTGGTLFEELGFYHIGPIDGHNLEHLIPVLKNVRDNGEGPVLIHVVTQKGKGYAPAEAAADKYHGVNKFDVITGAQAKAPANAPAYTKVFAESLIREAREDDRIVAVTAAMPSGTGLDLFGEVFPSRTFDVGIAEQHAVTFAAGLATEGYKPFAAIYSTFLQRAYDQVVHDVAIQKLPVRFPIDRAGFVGADGATHCGAFDTTFLASLPGFVVMAAADEAELRHMVRTAAAYDDGPIAFRYPRGNGVGVDMPERGEVLELGKGRVVREGSKVALLSFGTRLQDCLIAAEELGAAGLSTTVADARFAKPLDEDLIRRLARSHEVLVTVEEGAIGGFASHVLQFLAHEGLLESGLKVRPLVLPDVFTDHAKPEKMYADAGLDAAGIVRTVFTALDHTARAQRA

SEQ ID NO: 18588 - protein, 298 aa, Bradyrhizobium sp. ORS278
MEFAQEDGSLFRRGFGGDTLNTALYLSRLGVPTSYVTALGDDPLSAMMLAAWRAEGIDTAEVLRVEGRVPGLYMIERDARGERSFLYWRDRAPARELFDRADRDMLDRLSRFDWIYLSGISLSLYGETGKAKLRELLTVARKRGARVVFDGNYRPRGWASREMAQRAFRAIMPLVDIALPTLEDEQMLFGDVDASVCLRRFRDAGVGEVVIKRGPRGCLIHAEGVLVDIAPPAVLQPIDTTAAGDSFNAGYLAARIKGAPPRKAALAGHRLAGAVIMAPGAVIPAAAMPRDILALSEA

SEQ ID NO: 18589 - protein, 421 aa, Prosthecochloris aestuarii DSM 271
MSEKKIDSIESAIEDLKNGKLIIVIDDEDREDEGDFIAAADKVTPEMVNFITKEARGLLCVAVTMDRAKELQLDPMVQRNTSQHETNFTVSVDALAEGVTTGISAFDRYMTIKMLADPVSHADNFSRPGHIFPLRAMDGGVLRRVGHTEAAVDLAELAGSTPVGLLCEILHDDGSMARLPELLKIKEKFDLKLITIKDLVAYQMKRKKLVARAVETSLPTRHGDFRLIAYEACCDSQQQNHLAFVKGDFSTDEPVLVRVHSQCATGDIFASLRCDCGNQLASAMQQIEKAGKGVLIYLMQEGRGIGLINKLKAYNLQDQGFDTVEANEQLGFKADLRDYGIGAQILQDLGVKKMRLLTNNPKKIVGLEGYGLEIVERVPIEIAPNSVNLSYLETKRDKMGHMINCSCNCSGVSQQDNHTQQ

SEQ ID NO: 18590 - protein, 182 aa, Physcomitrella patens subsp. patens
MASVVAASSVVAPATFVAASSSVSNSKSNSVKAFSGLKSATLFTSKAETLSSVQNGSRVQCMQVWNPIGQTKFETFSYLPPLSDDAIAKQVEYMIQQKLIPCLEFDVNSNGVSRANNSSPGYYDGRYWTMWKLPMFGCQDSAQVLREIEECKKTFPGCFVRVLGFDNVKQVQICGFLVARPN

SEQ ID NO: 18591 - protein, 132 aa, Triticum aestivum
  misc_feature (107)..(107): Xaa can be any naturally occurring amino acid
MSEEVKENQSGKLQKPTPRLNERILSSLSKRSVAAHPWHDLEIGPGAPVIFNVVVEISKGSKVKYELDKKTGLIKVDRILYSSVVYPHNYGFIPRTLCEDNDPLDVXVIMQEPVLPGCFLRARAIGLMPMID

SEQ ID NO: 18592 - protein, 108 aa, Neptuniibacter caesariensis
MSENIVNVTDASFEEDVLKAEGAVLVDYWAEWCGPCKMIAPVLEEIAKEYGDQLKICKLNIDENSETPPKFGIRGIPTLMLFKGGNVEATKVGALSKSQLAAFIEANL

SEQ ID NO: 18593 - protein, 235 aa, Pisum sativum
MADDNKKLNHDEEANPLLHHHHHQQQPPPKAAEQPTQEELFHLWTADGVPIAHGSVMGQPIPRSPWNSSVCACLGQSDHFCSSDLEVCLLGSVAPCVLYGSNVERLGSNNSGTFANHCLHYSGLYVIGNSCCGWNCLAPWFSYPSRTAIRRRFNLEGSCEALNRSCGCCGSFLEDEAQREQCELACDFATHFFCHACALCQEGRELRRRVPHPGFNAQQILVMIPPAEQAMGRGA

SEQ ID NO: 18594 - protein, 472 aa, Exiguobacterium sibiricum 255-15
MNELGLKGRVVAVMGPVIDVKFDGHLPNIYNALRIQYTPQTVEEVAIDLTLEVALHLGDDVVRTIAMDSTDGVRRGVEVLDTGAPISVPVGEATLGRVFNVLGNPIDEKELDASVERLPIHKKAPTFDNLSTKVEILETGIKVVDLLAPYIKGGKIGLFGGAGVGKTVLIQELINNIAQEHSGISVFAGVGERTREGNDLYHEMTDSGVIKQTAMVFGQMNEPPGARLRVALTGLTMAEYFRDEQGQDVLLFVDNIFRYTQAGSEVSALLGRMPSAVGYQPTLATEMGMLQERITSTNKGSVTSIQAVYVPADDYTDPAPATTFAHLDATTNLERRLSEMGIYPAVDPLASTSRALSPEIVGEEHYGVARQVQETLQRYKELQDIIAILGMDELSEEDKLTVHRARRIQFFLSQNFHVAEQFTGQKGSYVPVKDTIRGFKEILGGKHDDLTEEAFRLVGPIEDAIEKAKTLV

SEQ ID NO: 18595 - protein, 372 aa, Corynebacterium efficiens YS-314
MSSSEKNGSLDASAGASVDVDAVILVGGKGTRLRPLTNNTPKPMLPTAGHPFLKHLLARIKAAGITHVVLGTSFKAEVFEDYFGDGSDLGLEIEYVVEDQPLGTGGGIRNVYDKLRHDTAVVFNGDVLSGADLGDILATHREKEADLTMHLVRVANPRAFGCVPTDADGRVLEFLEKTEDPPTDQINAGCYVFQRELIASIPADRVVSVERETFPQLLQEGRRVYGHVDTSYWRDMGTPQDFVRGSSDLVRGIAFSPLLEGQTGEELVDPSAGVRDGVILLGGTVVGRGTEIGAGCRLDGTVVFDGVTIEPGAFIENSIISSGVRIGANAHISGCVIGEGAQIGARCELSSGMRVFPGVVIPDGGIRFSSDQ

SEQ ID NO: 18596 - protein, 247 aa, Zea mays
  misc_feature (35)..(35): Xaa can be any naturally occurring amino acid
MARCSNGLLGLLNAGVLVLAIVALGGGAWLSHRAXTTDCERFLERPVIALGVLLLALFLLILLLFAFTVFAFVVTNRGAGWVVSGRGYKEYRLGDYSTWLQRRVENSQNWAKIRSCLQDGKVCQKLASRKETAAQFVNSNLSPIQSGCCKPPTGCNFTYQSETVWTKPAGFNTTTDDPDCTTWSNDQTVLCYDCMACKAGVLANLKNDWKKIATVNIVFLIFLVVVYSVGCCAFRNNRQDNSYPAWK

SEQ ID NO: 18597 - protein, 374 aa, Xylella fastidiosa 9a5c
MTKPVNTTADKVALSDTALADIRTKIDKIDRDIQTLIAERACYAQQVGQAKSKLAAAMDYYRPEREAQVLRMVVERNEGPLSDEVLVRLFREIMSACLAQQEPLKIGYLGPEGTFSQQAVLKHFGHYVLGEPMASIEEVFQEVEAGHTDFGVVPVENSGHGTIQVTLDLFLNSKLKICGEIELRVHQYLMSRSGRLEDIHRIYAHPQSFAQTACWLRANLPHVEKIPVSSNAEGARRASNANDAASIGSESAARVYALSKVFIHSIEDEQDNTTRFLVIGRRIFAPSGCDRTSILVFIRDNPGALFEVLGSFARHGINMNRIESRPSHQVRWEYVFFIDLLGHVEDEPMKQALAELEQHAVKVKILGAYPIALL

SEQ ID NO: 18598 - protein, 408 aa, Zea mays
  misc_feature (104)..(104): Xaa can be any naturally occurring amino acid
HASAGPSACIGFFVDSGSIYESGETTGVSHLLERMAFKDTKHRSHLNIVSELELAGGNVGASASREQMVYSYDTLKGYMPEALEILIDCMRNPLFLQEEVERQXVNELQKNPEKFLHEQLNLVGYSGALANPLIAPEDALARINDKIIQKFYHENFTADRVVLAASGVDHEHLLGYADLLLKDWHKGTPMEKPKSTYVGGDSRHRADSDMTHVALAFEVPGGWLQERDATIMTVIQTLMGGGGSFSSGGPGKGMHSRLYRRVLNKYHLVDSFSAFNNVYDSSGLFGIYLTTPSDFVAKAVDIAVSELIAVATPGEVTEVELQRAKNSTISSVLMNLESRVVVAEDIGRQLLSYGCRKPIDYFLQCMEEITLDDVATFARKMLATQPTMASWGNVDKVPPYEFICKRLQ

SEQ ID NO: 18599 - protein, 460 aa, Oryza sativa
AAIVPVRLSISLARSALEGSTIGAVTEVADGGDGGGLSGGAAAGNGAAALGGSAEQEDEDRRDRDTRLSRASRPLKQNLPAITDAIFQLSVAAVQGSHVKVIAATSSVTAFVVLLSMVAIALYLSLKTRYNEEIHMKVEMFLKTYGTSKPTRYTFSEVKKIARRFKVKVGQGGFGSVYRGELPNGVPVAVKMLENPKGEGDEFINEVATIGRIHHANIVRLLGFCSEGTRRALIYEYIPNDSLEKYIFSHDSNTSQELLVPSKMLDIALGIARGMEYLHQGCNQRILHFDIKPNNILLDYNFSPKISDFGLAKLCARDQSIVTLTAARGTMGYIAPELYSRNFGEISYKSDVYSFGMLVLEMVSGRRNSDPSVESQNEVYFPECIYEQVTTGRDLELGREMTQEEKETMRQLAIVALWCIQWNPKNRPSMTKVVNMLTGRLQNLHVPPKPFFSADSHPIM

SEQ ID NO: 18600 - protein, 261 aa, Aspergillus nidulans FGSC A4
MSRILITGSTDGFGLAAARQLVQKGHTVYLHARSASRAAEAEKACPGAAGTLIADFSSLSETKRFAEEANALGIFDVVIHNAGLYLGPIRRTEDTQVPVQVFVNVLAPYILTCLMNKPKRLIYISSTLHKIADPNNLNDMFWTQRGEAQWDAFKAYCDTKLQVNLVANVVAKKWKGVTSVATIHPGWVATKLGGGQAPDSLEDGVETYVKLAEGDYDQSLIGPYFDPKGKLGEQIAAAVDEGLQETAVKLLEEKTGLKIPA

SEQ ID NO: 18601 - protein, 434 aa, Picea abies
IHSQCSGVLHRAGYGGSQGARSAACCQAQIQIGCEIYQTRPRLDLGGLWSSLCQGYEGVYSGALLSQEIGGPQACQGRRGCSHGGIHIQCLYQTRRNRKALGGEEISVSCGIQQYHQDCFWEKICERRREDGSTRCGVQGNCCNQGCSWGLPSSMAEPPFPIFFRWMFSHYKRVRSPSMGARRDNVTKAIMEEHTLARQTSGAKQHFVDALLTLQEKYDLSEDTIIGLLWDMITAGMDTTAITVEWAMAELVRNPRIQQKAQEEIDRVVGRDRVLNETDFPHLPYLQCITKEALRLHPPTPLMLPHKATQNVKIGGYDIPKGSNVHVNVWAVARDPAVWKDPVTFRPERFIEEDVDIKGHDYRLLPFGAGRRICPGAQLGINLVQSMLGHLLHHFEWAPPEGMKAEDIDLTENPGLVTFMAKPVQAIAIPRCRS

SEQ ID NO: 18602 - protein, 219 aa, Lilium longiflorum
VEQFSPVPYLATLLNCMLWVVYGLPLVHPHSTLVLTINGLGLIIELTYVLLFLLYSNGRARIRVLAMLLTEIVFVGLITVIVLSTAHTLVTRSLIIGVLCVFFGTMMYAAPLSVMKLVIQTKSVEYMPLFLSVASFLNGICWTTYALIRFDLFITIPNALGTMFAVAQLILHAMYYKSTKIQMEAQKRKLEMGFEEVMAPVENTEKIRGASQTGKYPPV

SEQ ID NO: 18603 - protein, 576 aa, Yersinia pseudotuberculosis IP 32953
MNEKHPGPLVVSGKLSDGERMKSESNFLRGTIAEDLNNGLTGGFSGDNFLLIRFHGMYQQDDRDIRAERAEQKLEPRHAMMLRCRLPGGIITPQQWLGIDKFAADNTLYGSIRITNRQTFQFHGILKGNVKPAHQLLNELGLDALATANDVNRNVLCTSNPVESALHQEAYEWAKKISEHLLPRTRAYAEIWLDAEKVATTDEEPILGATYLPRKFKTTVVIPPQNDVDLHANDLNFVAVADKGKLIGFNVLVGGGLSIAHGDKNTYPRKASEFGYIPLKHTLAIAEAVVTTQRDWGNRTDRKNAKTKYTLERVGVETFKAEVEKRAGVSFSAIKPYQFTGRGDRIGWVKGVDKKWHLTLFIENGRLLDYPGRSLKTGVAEIAKIHQGDFRLTANQNLIVAGVPEKDKARIEALAREHGLMDDHVTSQRENSMACVSFPTCPLAMAEAERFLPEFVTRVEGILQQHGLADEHIVLRVTGCPNGCGRALLAEVGLVGKAVGRYNLHLGGNREGTRIPRMYRENITADEILLITDQLVGRWAKERHVDEGFGDFVIRAGVIAPVIDSARDFYDVQEAM

SEQ ID NO: 18604 - protein, 214 aa, Brassica napus
  misc_feature (194)..(194): Xaa can be any naturally occurring amino acid
MSASTVSLTANPTAAIRRTPVISGDKKSTLDLPPSESHANTNQDPIRGEAAAERSNSYDVGPVIRKSGSSTAAGTKSTTAQRRTRKVQGTKNEKTPWTRVVRVFAKQLGALLLLAGLIQLVRKVVIKETTLSSHSSFPIETEMGLSELESRIAAVDGLVKTTTKMMQVQVEFLDKKMGGETRALRETMESTSSXVEDELKKVGSKVERLQASVE

SEQ ID NO: 18605 - protein, 184 aa, Magnetospirillum magnetotacticum MS-1
PPPGNPPPTLKFLPGRVVLTEGTFEARDASSAERSPLASALFAVPGVSGVYFGHDFISVTKADGVNEWPQVKPAVLGAIMDHFQSGRPVLAEGTALAEDDAEEFYDEADHDTVATIKDLLETRVRPAVAGDGGDITFRGYRDGIVYLEMKGACSGCPSSTATLRQGVQNLFRHFLPSVREVQAV

SEQ ID NO: 18606 - protein, 264 aa, Vitis vinifera
MDNSSGSSNFQHIGRWTALPHRTQLPQMPPSLNHYNLNHEVGSIGNPKPTGGQPTQSISSESVLIEEPPSWFEELLNEPDTPMQRGHRRSASDSLAYLGAVAKVSNTNEDHKFKNSFAWPSFGSLCNASTYTRPSSFDENQNRAWESSLNCLNYTSDLPLTRDQPNIINVQVSGSCAPPDQPDGVPPIATKKQDCAESISHNQEDSSERSDSSSAQPSLSKNDAKRAKQQFAQRSRLRKLQYIAELEMSVQVLQARQQKLKHFA

SEQ ID NO: 18607 - protein, 306 aa, Streptomyces coelicolor A3(2)
MYDYDLLVVGSANADLVIGVERRPAAGETVLGSDLAVHPGGKGGNQAVAAARLGARTALLARVGDDDYGRLLLDSQRAAGVDTVGVLVGGAPTGVALITVDPSGDNSIVVSPGANGRLAPGDVRAAASLFHASRVVSTQLEIPLETVVEVVRSLAPDSRFVLNPSPPRPLPQEVLTACDPLIVNEHEAKVILGDSLVGERPEDWARVLLAKGPRSVVVTLGAEGALVASAAGGVVRVPSVKVDAVDTTGAGDAFTAALAWRLGTGESLADAAAYAARVGAAAVTKAGAQESYPTAAEAEDLGAGAL

SEQ ID NO: 18608 - protein, 60 aa, Brassica napus
MTGETVNPKAYPLADAQLAITILDLVQQAANYKQLKKGANEATKTLNRGISEFVVMAADT

SEQ ID NO: 18609 - protein, 110 aa, Physcomitrella patens subsp. patens
SPCAACKLLRRRCTRDCVFAPYFPPDEPQKFANVHKVFGAANVNKMLQELPVEARGDAVSSMVYEADARVRDPVYGCVGAISSLQQQVAHLQTQLAVANAEIVCMRMHNT

SEQ ID NO: 18610 - protein, 226 aa, Glycine max
  misc_feature (103)..(103): Xaa can be any naturally occurring amino acid
  misc_feature (123)..(123): Xaa can be any naturally occurring amino acid
MAETSNGNGVYVDEEEQEVVKLKQKTQRVKETLPEVLNRIASAILFPEPAYSGSLLRRIKLSVADHAPLLPEASKNSARDVLLWTRRGTPFRPLFVISVGTVXLLLLTALLGFMLFFLNCTPXCIVISLLISLAAAGGFLALFFAFVTAIYIGALAIAIFAISVTTFWSIVAILIITGFIGFIYTVWLVTRKSFGFAKHSLDVTGSAISSYTTARHAHHLIHTNSK

SEQ ID NO: 18611 - protein, 585 aa, Arabidopsis thaliana
MESSPASSSSPTPVTDSSADSLAKDLQNQSLGAVDEGVKIKKKLEDFNWDHSFVKELPGDPRTDVISREVLHACYSKVSPSVEVDDPQLVAWSVSVAELLDLDPKEFERPDFPLMLSGAKPLPGAMSYAQCYGGHQFGMWAGQLGDGRAITLGEVLNSKGERWELQLKGAGRTPYSRFADGLAVLRSSIREFLCSETMHCLGIPTTRALCLLTTGQNVTRDMFYDGNPKEEPGAIVCRVSQSFLRFGSYQIHASRGKEDLDIVRKLADYAIKHHFPHIESMDRSDSLSFKTGDEDDSVVDLTSNKYAAWIVEIAERTATLVARWQGVGFTHGVLNTDNMSILGQTIDYGPFGFLDAFDPSYTPNTTDLPGRRYCFANQPDIGLWNIAQFSKTLAVAQLINQKEANYAMERYGDKFMDEYQAIMSKKLGLTKYNKEVISKLLNNMSVDKVDYTNFFRLLANVKANPNTPENELLKPLKAVLLDIGKERKEAWIKWMRSYIQEVGGSEVSDEERKARMDSVNPKYILRNYLCQSAIDAAEQGDFSEVNNLIRLMKRPYEEQPGMEKYARLPPAWAYRPGVCMLSCSS

SEQ ID NO: 18612 - protein, 357 aa, Streptomyces ambofaciens
MISGVIDVQEIDLDAVREQVDAVLEDFLEDKAGAAARRSHPPEVANTLRAFLAAGGKRVRALLCVVGWHAAGGSEDRAAVLRVAASLELFVAFALIHDDIMDDSAVRRGRPAVHRALCTRLGQSSRAERLGAGGALLVGNLALIWAQELLHTADLPLRRRRTVHALYDAMLEEVMYGQYLDVMGTGPDDDIDAALRIARYKTATATVERPLQLGAAVAGADDTTVNLCTALGLPLGEAFQIRDDLLDVFGSTDGACTPGLGDLREGKRTVLLALGLRAATPAQQRRLRSLVGRADLDEHGAAEVRAILEETGARRRTEHMITSRYEQALRVLDAAALPTAASRALRALAVTATQYTS

SEQ ID NO: 18613 - protein, 194 aa, Bradyrhizobium sp. ORS278
MDSTMAGERERGGRDRKEREERDSEFVDKLVHINRVAKVVKGGKRFGFAALVVIGDQKGRVGFGHGKAREVPEAIRKATDSAKRNLTRVALREGRTLHHDIFGRHGAGRVYLRAAPAGTGIIAGGPMRAVFETLGIQDVVAKSIGSSNPYNMVRATFNALKHQDSPRSVAARRNIKVSTLQARRVGGDAEAAAD

SEQ ID NO: 18614 - protein, 224 aa, Alkaliphilus metalliredigens QYMF
MKFFKVIRGDIKVIFERDPAAKSFVEVILCYPGLHAILIHRMSHGLYKRGWVVLPRVISNIARFLTGIEIHPGAKLGKGVFIDHGTGVVIGETTEIGDNVTIYQGSTLGGTGKEKGKRHPTIGNNVVISTGAKVLGPFKVGDNSKIGAGSVVLREVPENCTVVGIPGRVVIRDNKKILAFDAIDLEHGKLPDPISEELNSLNQRINKLEQMLKKVERSDKDEVV

SEQ ID NO: 18615 - protein, 316 aa, Coxiella burnetii RSA 493
MVLDNILQVIGKTPVVRLHRIGQSLPCELYGKCEFLNPGGSVKDRIGAAMIESAEKQGKIKPGDTLIEPTSGNTGIGIALAGAVKGYRVIITMPEKMSHEKQVVLEALGATIYRTPTEAAYDDPESHISLAKRLNQEIPNSYILDQYSNAENPDIHYQTTGQEILDDMGENLSMVVMGVGTGGTIIGVAKKLKEVNPSIQIIGVDPIGSILGGGDEIKPYLVEGIGYDFIPEVLDNNLIDEYIKINDKDSFLMARRLIREEGLLVGGSSGSAVWAACQAAQRLKEGERCLVILPDAIRNYLTKFVDDAWMKAQGFL

SEQ ID NO: 18616 - protein, 220 aa, Streptococcus thermophilus CNRZ1066
MNKKSFKLIGLLSLIAATILLVACQSDTKTEASKPKDVQWGYTGSTGPDHWGDLSKDYELSKNGKEQSPINITGAEDVDLPELNLNNQESEAQVENNGHTIEVSFKNPKNTLTIGKEVYKLQQFHFHAPAENEIDGKTYPLEGHFVYKTDNGKITVVSVLYNYGDKNQALQLIWDKMPQAANTETDLSQAISLDDFYPENKDYYNFEGSLTTPPCTEGVN

SEQ ID NO: 18617 - protein, 402 aa, Legionella pneumophila subsp. pneumophila str. Philadelphia 1
MKHSLATIEEAVATLKAGKMIILMDDEDRENEGDLVIAAEHATPEAINFMSRLGCGLICLPMAEELIDKLQLPMMARHNKSPYGTAFTVSIEAANGVSTGISARDRARTIQVAIDPKSGPSDIISPGHVFPLRARKRGVLERPGQTEGSVDLVKLAGLTPAAVICEIINEDGTMSRRDELALFSKKHQIPLVTIKDLIQYRVRHENLIHPVATTQIPLEENGVFTMTVFENQIDSCEHFVLVKPPLYGNQVPLVRIHSECITGDVFGSRKCDCGKQLELSLSQIGAEGGILIYLRQEGRGIGLANKLKAYALQEQGFDTVDANLELGLPADDRDYAVAYQILKYLGVEALRLLTNNPLKIASLERYGMKITQRIPLEIEPSRENHSYLKTKKIKLGHLLAID

SEQ ID NO: 18618 - protein, 155 aa, Legionella pneumophila subsp. pneumophila str. Philadelphia 1
MREIKTIVSDGVTFPIALVVSTFNELITSALKKGALDRLTELGFKSEDITLVEVPGAVEIPFVAQLLAKKQKVEVIVALGAVIRGETSHYDYVCDQVSQGCQRVMLDYNIPVIFGVLTTENDEQALARVGGTHGHKGRDAIDCAVSMRSIKQQLQ

SEQ ID NO: 18619 - protein, 159 aa, Alkaliphilus metalliredigens QYMF
MRVGIGYDVHRLVEGRKLIVGGVEIPHEKGLLGHSDADVLLHAIKDALLGAVALGDIGKHFPDTDEKYKGESSLYLLNEVGRMLAEKAYVANNIDATIIAQEPKMAPYIELMRRNIAEVLGIKVEQVNIKATTTEGIGFVGRGEGIAAQAIVSVGQSLG

SEQ ID NO: 18620 - protein, 474 aa, Lilium longiflorum
RHGQRAPPQISARSAVDQVRNRFERPLSFWVMPSVVMDQGKNNNTPDSGQDKPDEFDFSKLLHIKPRVLNIDRQTSCDERSLLEHSTGIGIIYPPLVFKNPESNSSRLLDHPEIVSTPGKRSAVNTPKAFNYFEPHGQHPMMDEGWDALKRSLVYFRGQPVGTIAALDHSEEALNYNQVFVRDFFPSGLAFLMKGEPEIVKNFLLKTLRLQSWEKKIDRFKLGEGAMPASFKVNHDPVRNQETLNADFGESAIGRVAPVDSGFWWIILLRAYTKSTGDTSLAENPDCQKGMKLILTLCLSEGFDTFPTLLCADACCMIDRRMGIYGYPIEIQALFFMALRCALLMLNKQDDEGRELAERIAQRLQALSFHLRSYFWLDFRRLNDIYRFKTEQYSDTAINKFNVMPDSLPDWVFDFMPTRGGYFIGNVSPARMDFRWFCLGNCIAIISNLATAEQSEAIMDLLEERWPELVGEMP

SEQ ID NO: 18621 - protein, 285 aa, Populus trichocarpa x Populus deltoides
MASLATSTLVYSTPVRIKTSSKPRSSSRTCKKTVPFLVTRADSSSLLLHAAKHTVDKHIQSGMVVGLGSGQASGMAIQYLGRLLRTGALKDIVGVPMSVTSASEAAKAGIPLDVYQDSSQIDFAFDDADIIEEETLVAIIGRQKSQSDESIIQEKSILKAANKLVFMITENQYVGGLEGSIPVLVQALNWMETAEEIDDLFLGDAEVWRRSSIGQAGPTGGDYPFITREGHNVLDVIFTSPVQSLAEVAESLDKVDGVVDHGVFSKFPCTVVIAAESGGLNIVDR

SEQ ID NO: 18622 - protein, 660 aa, Zymomonas mobilis subsp. mobilis ZM4
MPNAEFDFRPMFPNKKTPLLDKIKTPAELRQLDRNSLRQLADELRKETISAVGVTGGHLGSGLGVIELTVALHYVFNTPKDALVWDVGHQTYPHKILTGRRDRIRTLRQRDGLSGFTQRAESEYDAFGAAHSSTSISAALGFAMASKLSDSDDKAVAIIGDGSMTAGMAYEAMNNAKAAGKRLIVILNDNEMSISPPVGALSSYLSRLISSRPFMNLRDIMRGVVNRMPKGLATAARKADEYARGMATGGTFFEELGFYYVGPVDGHNLDQLIPVLENVRDAKDGPILVHVVTRKGQGYAPAEAAKDKYHAVQRLDVVSGKQAKAPPGPPSYTSVFSEQLIKEAKQDDKIVTITAAMPTGTGLDRFQQYFPERMFDVGIAEQHAVTFAAGLAAAGYKPFCCLYSTFLQRGYDQLVHDVAIQNLPVRFAVDRAGLVGADGATHAGSFDLAFMVNLPNMVVMAPSDERELANMVHSMAHYDQGPISVRYPRGNGVGVSLEGEKEILPIGKGRLIRRGKKVAILSLGTRLEESLKAADRLDAQGLSTSVADMRFAKPLDEALTRQLLKSHQVIITIEEGALGGFATQVLTMASDEGLMDDGLKIRTLRLPDRFQPQDKQERQYAEAGLDADGIVAAVTAALQRNSKPVEVVELTTKVTEDMTL

SEQ ID NO: 18623 - protein, 75 aa, Zea mays
  misc_feature (30)..(30): Xaa can be any naturally occurring amino acid
GTNVERLGSDPGTFVNHCLPYSVLYLIGNXFFGWNCLAPWFSYPTRTAIRRKFNLEGSCEALHRSCGCCGSCVKE

SEQ ID NO: 18624 - protein, 565 aa, Candida albicans SC5314
MEKSNNQIVTSEKAQDNISCSAVTTNSKQHLGFVDSFIDSFRRAPESNTSAENKRQTISKNELRLMAISTGLGTGLLVATGGRLRAAGPAGMVIAYAITGLVMLAPTVNSVAELAIAYPGLPGGFQSYYGKFIDESLGFALGWNYGFQWMCILALEFVTVSMTFKFWTTSVHADVFVAIFFIIVTLVNLGGAKVYAVTEAALNSIKIVFLVGFIIFGIIIDVGGGPNGFIGGKYYHSPGAFTSFKGLASVFVSGAFSLGGSEFISLSASETKHPKTAIRAASKLVYFRVIVLFLGSLTLVGLLVPRDSDNLMHGSGSSVSPYVLAAKLNGVKVIPHIINTVILLSVTSVACAAMYSSPRLIQSLAEQGLGPKWLDYIDKKGRPTRAWFITILAGAFGFIAAFKDHETVFMWLLSISGISFVMCWLFICVCHLRFRSALKLNGIDVKTLEYVSPTGIWGSYISIIINSLILVAQFWISLWPLGGDGKPNALSFFENFLGGPVFLICYIGHKLWTKNWKLYKKVEDIDVNKDRVVKDTEILHLENLEDKERYEKAPLWKKILIICFD

SEQ ID NO: 18625 - protein, 336 aa, Oryza sativa Japonica Group
MDLFFGPRLQPPLVAKAQAAAAAAPNPPPLVAAPAPAMPQVQVQAQLQQMQQQLAVLQPQLIFQAMPQLPAGVPGGAAGAVSPQPPVPAMAFYPPPPLAFRVTSGLAGVATGGTVSFQQPAPGTGGTASPTAAVQAAGDNKESASKRKRGGPGGLNKVCAISPELQTIVGETVMSRTQIVKQLWQYIRQNNLQDPDDKRKIICNDELRVVFGTDTTDMFKMNKLLAKHITPLDPKDQIREAKKFKPSNVATQPMPLINQPSVVISDALAKFIGMEGTVPQDDALRYLWDYIKANQLEDAITGSILCDSKLQELFGCESIPSSGLSELLAHHFIKET

SEQ ID NO: 18626 - protein, 571 aa, Candida albicans SC5314
MSSSSTASEVHKAPVVKNIEKQDMDMYSASSSSAPKTTWNNFIDSFHRADGKTSAESKDQRISKTELRIMSLSTGLGTGLLVASGSKLRAAGPAGVLVAYFITGICMLAPTINSVSELAIAYPGLPGGFQSYYAKFIDESLGFALGWNYAFQWMCVLALELVTSSMIIKFWTTTVNPDVFVAIFFVFVTLINMGGAKVYAVFEASFNCCKILLLVGFVIFGLIIDVGGGPQGFIGGRYYHDPGAFTSFKGLASVFVTGAFSLGGSEFISLSASETRHPRASIRAASKLVYFKVIVLFLGSLTFVGLLVAYNNDRLMGSGDAASHASPYVLAAEMNGIRVLPHIINAVILISVVSVATAAMYSSPRLVQSLAEQGLGPKWLDYIDKKGRPTRAWFITVLAGLFGFIAAYEKQETVFVWLLSISGISFIMCWLFICVSHIRFRAALKYRGITLDQLAYVSPTGVWGSYLSVLINSLILIAQFWISLWPLGGDGKPNANSFFENYLGAPVFLVCYIGHKLWTRNWKLFKKVEDIDIDTHRMICDPELLALEDLEDKERYQKAPIWKKILIKCFD

SEQ ID NO: 18627 - protein, 337 aa, Oryza sativa
MVPKVGINGFGRIGRIVFRNAINHGGVDVVAVNDPFIEVHYAAYMLKYDSTHGQFKGTIEIDGTSGLIVNGKKIRFYAERDPASIPWSETGAAYVVESTGVFTTTEKASAHLKGGAKKVIISAPSADAPMFVMGVNNDSYKSDVNVLSNASCTTNCLAPLAKVINDKYGLVEGLMTTIHSYTATQKTVDGPSAKDWRGGRTAAQNIIPSSTGAAKAVGKVIPSLNGKLTGMAMRVPTANVSVVDLTCRIEKAATYEDIKATIKAASEGELKGILGYTEDDIVSSDLNGDDNSSIFDAKAGIALNPNFIKLVSWYDNEWGYSHRVVDLIAYIAKVDGQ

SEQ ID NO: 18628 - protein, 270 aa, Neptuniibacter caesariensis
MDQQRLITPLIQICERASKAILEIYQGEHFSVETKQDNSPVTQADIAAHEIIKKGLFELTPDIPQLSEEEGISYQQRKNWSRFWCIDPLDGTKEFIHRNGEFTINIALIEDNKPVLGIIYIPVSDIVYWGGSQINAWKKQPNHPPAQIRSKPMGPELIVAASRRHGQDEHHNLLKPIEHRFQHVTNKGMGSSLKMCLIAEGLADFYPRLFPTSEWDTAAAQAIVEAAGGKLVNASDLHPLRYNERESLINPFFFVCGDPQFPLEEIRVKH

SEQ ID NO: 18629 - protein, 439 aa, Thermoproteus tenax
MSDYLEKIKAQIPNIQPFAGKYAEPVEGSYITYTGPGQLKVPDKVVIGYIEGDGTGPEVAYAAIKVANAAVERAYGKSRRVLWYEVLVGSKAEKILGSRLPDQSVEVLKKIRVFLKAPLETPVGGGFRSLNVTLRQIFDLYANIRPVKYFPGLPSPLKRPESVDLVIFRENTEDVYMGIEWPWNSPEAAKVREFLRRELKVDIRDDAGIGIKPISKFGTQRIARLALKFAVENKRRVVTIMHKGNIQKYTEGAFRDWAYEVAKNEFRDHVVLEEELAQYGGKVPPGKILVNDRIADNMLQQLLTRTGEYDVILAPNLNGDYVSDEAAGLVGGLGVAPGIDVGDWGMMAEPVHGTAPKYTGKNYVNPTATILALELLFRFIGWREAADLITRGVSKAYSEGYFTGDLARQMTDEERKVVKEVLGTQEFAEKVAEIIKTEL

SEQ ID NO: 18630 - protein, 160 aa, Mesorhizobium loti MAFF303099
MTISVGDKLPEATFKTMTADGAKAITSAEIFPGKKVVLFGVPGAFTPTCSNNHLPGYLENHDAILARGVDTIAVVSVNDVHVMGAWARFTGGEDKILFLADGSADFAKAVGLDNDLSAGGMGLRSKRFSMIVDDGKVTALNIETKPGVDESGAAHILGQL

SEQ ID NO: 18631 - protein, 352 aa, Idiomarina baltica OS145
MLVGNRTSDLVGQTDLLRVHSLSERSGSNIYLKCEFQNPGGSIKDRAAKQLIEDAMERGELKPGMTVVEGTAGNTGIGLALVAKSFGLKMLAVMPNDQSPEKERMIALHGGQLKTVDPVPFKNPNHFYHTARRIAEERDDCWWANQFENTSNARAHYLHTGPEIWQQLNGDIDTFVSVAGTGGTIGGNSRYFKEQNPDIDVWLADPDGSGIFEFLRTGEYVSNGSSMTEGIGIMRLVDNFRQARINHAVNLPDQDLISISRYVREQDGIVLGSSSALNLAAAYAAALNGQRGRNIVTFACDLGERSASKLYNDDYLKQKGLTIEPEPIEQLTERYQHLGDRLIEVNWSGDDS

SEQ ID NO: 18632 - protein, 221 aa, Erythrobacter sp. SD-21
MEKAGSPLEQVRSSIAQACNRARRDPGDITLVAISKRHTAATIEPLLIEGHRHFGENRVQEAAEKWPALREAHPAVQLHLVGQLQSNKAEEAAALFDVIHSLDRPSLVKALAKAFDKTGRLVPCFVQVDVGDEPQKGGCPVGDLPALLTQARDADIPLAGLMCLPPADIEPAPFFAFLDKLARDHGLEGRSMGMSGDYETAIMLGATHIRVGTALFGERPA

SEQ ID NO: 18633 - protein, 198 aa, Triticum aestivum
  misc_feature (35)..(35): Xaa can be any naturally occurring amino acid
  misc_feature (100)..(100): Xaa can be any naturally occurring amino acid
  misc_feature (144)..(144): Xaa can be any naturally occurring amino acid
PRVRLFCDYVFTLHCSIHIDMPTLSDEDKDVMRKXGAPTKIDFLSLSYTRHAEDVWQAWEFLSKLGDLSQTLILAKIENVEGLNHLDEILEEADGIILSXRGNLGIDLLPEKVFLFQKSALHKCNMAGKPALVTHVVDSMTDNXRPARVEATDVANAVLDESNESSDSESSDSEKPATEVKNSAGSYCTKEKPGMGRL

SEQ ID NO: 18634 - protein, 165 aa, Arabidopsis thaliana
MTHVEDDKEFKEKPLVQVLSDDNSEVKEAKDGGGEEVTGGDGEGEANVEEEDDEAENEDDDDDDDDDDDDDEDEDDEEGEEDLGTEYLVRPVGEVEDEDDASDFDPEENGLDEEEGDEVIEEGDVDEDISLSAGKSEPLSKRKRVAKDHSEQGDVTGDNIRPSKR

SEQ ID NO: 18635 - protein, 368 aa, Xylella fastidiosa 9a5c
MSKRDYYQVLGVPRTASEDDLKKAYRRCAMKYHPDRNPGDAAAEAAFKECKEAYEVLADTKKRKLYDTHGHAAFEHGVGGGNAPDMNDIFGDIFGNIFGGARASRRGADVGYMVELDLEEAVAGVERQIQIPTLVECTHCHGSGSEDGHVETCGTCRGSGQVRIQRGIFAMQQTCPHCGGRGVIIRNPCKVCNGAGRVEDHKTLSVKIPAGVDNGDRIRLSGEGEQGPEGVPPGDLYVEVRVREHPIFQRDGDDLHCEVPVRISQAALGDIVRVATLDGEAEIRIPAETQSGKLFRLRGKGVRSVRSRTEGDLYCRIVVETPVNLTAEQRKLLEQFEMTFAGEDARKHSPKSATFLDGVKSFWDRMTS

SEQ ID NO: 18636 - protein, 122 aa, Zea mays
  misc_feature (46)..(46): Xaa can be any naturally occurring amino acid
MVKICCIGAGYVGGPTMDVIALKSPDIEAVVVDISKPLIEAWNSDXLSIYQPELDDDGKDCMDKNLFFSTDAEKHVTEADIIFISTNTLTKTRAIAAGKAADLTYWESAARMITDVSKSDKI

SEQ ID NO: 18637 - protein, 328 aa, Glycine max
MNEAEEQLCEAARKGDTEKVRSLIDSGADVSHFDGEGLNPLMHAAKHGHAPVLTLLLSAGAPWNALSPSNLSAGDYAMQEGHNEAFELLVNAGIQAELILGTIARKENKNGDSGHDYLEDRVSFSEDKLMDSESKAVMMAWENPLMEAHAKAVCSGGGHVLNIGFGMGLVDSAIQRYAPASHTIVEAHPEVYERMLSSGWGQKESVKIVFGRWQDVLPQLETYDGIFFDTYGEYYEDLREFHQHLPALLKPGGIYSFFNGLCGSNAFFHVVYCNLVSLELENLGYSTQLIPLPVKDCLGEQVWEGVKQRYWQLDTYYLPVCQAVEDPE

SEQ ID NO: 18638 - protein, 390 aa, Legionella pneumophila subsp. pneumophila str. Philadelphia 1
MKAKVILVSGKQNTVLRGHPWIFPKAIAQYSGKLITGELVEIIGSEGESLGFGAYNEHSLYRVRVLALSNEQINSFDYKSLITHRIKQASLVRRCLDLPNEQTNAYRLFNSEADGLSGLTIDCFNDYCVIASSAYWVELNKSIIVHVLQELLPHNHIIWLPQNKPLSQDGWKEIHTEKSQGSTQVLEEGVLYHVEFAQTQKTGLFLDQRENHKRIAKLSRGKRVLDLYTFTGGFALHAAKAGALHVTAVDSSVQAIEQAKNNAVLNHLNTIEFIKADAREYLKMAGEYDVVILDPPKLVPSQKHLQQAKNYYRFLHREAFKYMKPGSLLMTCNCSSALSSQDFCSLVSAQAVAMGKQARILGVYGPASCHPTLAAFPEGNYLTAILLALV

SEQ ID NO: 18639 - protein, 247 aa, Brassica napus
RIRERTDALDAAGNTTAAIGKGFAIGSAALVSLALFGAFVSRAGVQTVDVLTPKVVIGLLVGAMLPYWFSAMTMKSVGSAALKMVEEVRRQFNTIPGLMEGTAKPDYATCVKISTDASIKEMIPPGCLVMLTPLIVGFFFGVETLSGALAGSLVSGVQIAISASNTGGAWDNAKKYIEAGASEHARSLGPKGSEPHKAAVIGDTIGDPLKDTSGPSLNILIKLMAVESLVFAPFFATHGGFLFRIFS

SEQ ID NO: 18640 - protein, 403 aa, Propionibacterium freudenreichii subsp. shermanii
MRTLSDLGDLRGKRVVIRCDFNVPLKGEEITDDGRIRAALPTLEALLGQGARVTAMAHLGRPKGKRDPKLSLAPVAKRLADLLGQHVEFATDTVGLSALKASANLNDGEIALVENVRFEPAETSKDDAERMELAKKYAELGNYFVSDGFGVVHRKQASVYDIAKLLPSAAGELVGKEVSVLSKITHDPERPYVVVLGGAKVADKLAVIDNLLKVADTLIIVGGMAYTFLRAQGKQVGGSILDASKVDACRGYLADAKAAGKSILLPVDVRVAKGMDLDARTVDGPVSVVSVDDIPADQEGLDIGPATEKLFAEQIAGARTVFWNGPAGVSEIDELANGTRAIARALATGDAFSVIGGGDSAAAVRKFGYTDDQFSWISTGGGASLEYLEGKELPGLAVLDKEN

SEQ ID NO: 18641 - protein, 813 aa, Lilium longiflorum
PYRIIKLLPQPSGSFLTTMAFSIALQLITLLAYLNAFVLGGKVFMVLMEEDPVITYKTKNSDDAQKYKQRVISQHDIFLESLLPIGSYKKLYSYTHLLNGFAIHATSDEAVEILRDAHGVRVVQEDVKMMKMTTHTPDYLGIQTGVWPELGGAERSGDGVVIGMIDTGINPNHPSFMNPWSREVADLKRFKGRCVPGDQFPLTSCNGKIVGAQYFAHGAIAVGEFNATRDYASPFDADGHGSHTASTAAGNYRVAVLSNGYNFGYASGMAPGAWIAVYKALYSFGGYMSDVVAAVDKAVEDGVDIISLSVGPSAVPSGPTAFLDILEVELLFATKAGVTVVQAIGNGGPSSSSILSFSPWIMSVAASITDRQYNNTIILSNGHSISGIGLSPPTPERELIPIAAAEDVCSRNTSFVVLRSCQSPDPFISSLVRGKLIICTLTTDSSSPMSIEAILSTIQKIGAVGVIITMDHDIEPEPPSGGASAFPVPGIVLINSDASEALWEYYSGHTLRGRNGAVISFGATGRILDGRRAIYTGQSPMVARYSSRGPDVNNALLQTADVLKPNILAPGTSIWAAWSSNSTEGENFALQSGTSMATPHVAGIAALIKQMHPNWSPAAIASAIMTTAQVVDSYDHALLAQQATTDPSTATPFDYGAGAINPAQAINPGLIFDADFKNYIQFLCAVPGVDEESVRRAVGVGCPSQHTDWCSDLNTPSVTVANLVGSRRVLRKVMSVGDEQETYKAMVKSPSGVSVTVTPSAFTINPNTSKGLAILLDAVEVTNAYTFGEVVLNGDKKHVVRIPLVVFVSSTLN

SEQ ID NO: 18642 - protein, 866 aa, Arabidopsis thaliana
MAFSSCFLLVLLQIFSALLLCLAQDQSGFISLDCGSPRETSFREKTTNITYISDANFINTGVGGSIKQGYRTQFQQQTWNLRSFPQGIRNCYTLNLTIGDEYLIRANFLHGGYDDKPSTQFELYLGPNLWSTVTTTNETEASIFEMIHILTTDRLQICLVKTGNATPFISALELRKLMNTTYLTRQGSLYGIDVFDRVWTPYNFGNWSQISTNQSVNINNDYQPPEIAMVTASVPTDPDAAMNISLVGVERTVQFYVFMHFAEIQELKSNDTREFNIMYNNKHIYGPFRPLNFTTSSVFTPTEVVADANGQYIFSLQRTGNSTLPPLLNAMEIYSVNLLPQQETDRKEVDAMMNIKSAYGVNKIDWEGDPCVPLDYKWSGVNCTYVDNETPKIISLDLSTSGLTGEILEFISDLTSLEVLDLSNNSLTGSVPENLSGNELNGSIPATLLDKERRGSITLSIEGNTGLCSSTSCATTKKKKKNTVIAPVAASLVSVFLIGAGIVTFLILKRKKRTKLGLNPNSGTGTTPLHSRSHHGFEPPVIAKNRKLTYIDVVKITNNFERVLGRGGFGVVYYGVLNNEPVAVKMLTESTALGYKQFKAEVELLLRVHHKDLTCLVGYCEEGDKMSLIYEFMANGDLKEHLSGKRGPSILTWEGRLRIAAESAQGLEYLHNGCKPQIVHRDIKTTNILLNEKFQAKLADFGLSRSFPLGTETHVSTIVAGTPGYLDPEYYRTNWLTEKSDVFSFGVVLLELVTNQPVIDMKREKSHIAEWVGLMLSRGDINSIVDPKLQGDFDPNTIWKVVETAMTCLNPSSSRRPTMTQVVMDLKECLNMEMARNMGSRMTDSTNDSSIELSMNFTTELNPGAR

SEQ ID NO: 18643 - protein, 262 aa, Propionibacterium freudenreichii subsp. shermanii
MARKPIMAGNWKMNLNHIDAVGLVQKLAFTLADKGYDPEQSECVVIPPFTALRTVQTLVEGDKLPIVYGAQDLSPHDDGAYTGDISSSMLTKLGCSYVVVGHSERREYHAETDEVVNAKARKALDAGLTPIICVGESLEVRKAGKHVEHVLAQVTGALAGITAEQAASLVIAYEPIWAIGTGEVATPEDAQEVCGAIRAAVADLYDAPTGDAVRIQYGGSVKPGTVAAIMAKPDIDGALVGRASLKADDFAAIVRFYAMAQA

SEQ ID NO: 18644 - protein, 263 aa, Bacillus cereus ATCC 10987
MQEVWKDIDAHAKQWIRDAGERLMASMKKALIIETKSNAADLVTNMDREIEQFLIGKIKETFPHHHILGEEGYGDEVTSSDGVVWLIDPIDGTMNFVHQKRNFAISIGIYENGIGKIGLIYDPVHDELYHALKGAGAFCNEVPIPLLQKGTVEQGIVALNAIWLTDNPLLNMESMMALVKKARGTRSYGCAALEMVYVATGRIDAYVTPRLSPWDFGGGQIIVEEVGGKVTTFSGAPLSIVEKSSVLVAKPGVYEEVLSFISK

SEQ ID NO: 18645 - protein, 329 aa, Oryza sativa Japonica Group
MPPSVATHASLLLKAAAAAAHLHPKPFFSPRAAPPRIPSAPAPPAAGGSRYRPTTTTTAAATATSATAACRWFRWPPPAQAPVRGLCSLPHSGGGGGGGEGMGSEGVGRRRRVVAPAVNGVAKDGAPQPPPPKLLTLPTVLTIGRVAAVPLLISTFYMEGPWAATATTGIFLAAAVTDWLDGYIARKMQLGTPFGAFLDPVADKLMVAATLVLLCTKPLEISLLRDGPWLLTVPAIAIIGREITMSAVREWAASQNTKVLEAVAVNNLGKWKTATQMTALTILLASRDKSLPAQDALVTSGIALLYVSAGLAIWSLVVYMRKIWRILLK

SEQ ID NO: 18646 - protein, 250 aa, Propionibacterium freudenreichii subsp. shermanii
MLWVGTSWKMNGTRASSRTYVEALKQADHSAWDGVQAFIIPPATVLAEVSELLGPDSDVLLGAQNAHWADAGAWTGEVSVPQVADAGAQLVEVGHSERRANFGDTDEVVNKKVRAIIGHGLRPVLCVGESQEVFDAGDSVKFITDQADSALQGVDPSSVVLAYEPIWAIGEHGREPQRDDLLRAFDALQSRYGDAVTAVIYGGSANPGNARELLGIPGVEGLFIGRAAWTGPGYVQMLGIAGEVARAHQG

SEQ ID NO: 18647 - protein, 523 aa, Vicia faba
MEPLSSTKQINNNNNLAKPSSLHVETQPLEPSPLRKIMVVASIAAGVQFGWALQLSLLTPYVQLLGIHHTWAAYIWLCGPISGMLVQPIVGYHSDRCTSRFGRRRPFIAAGSIAVAIAVFLIGYAADLGHSFGDSLDQKVRPRAIGIFVVGFWILDVANNMLQGPCRALLGDLCAGNQRKTRNANAFFSFFMAVGNVLGYAAGAYSKLYHVFPFTKTKACNVYCANLKSCFFLSIALLTVLATSALIYVKETALTPEKTVVTTEDGGSSGGMPCFGQLSGAFKELKRPMWILLLVTCLNWIAWFPFLLFDTDWMGKEVYGGTVGEGHAYDMGVREGALGLMLNSVVLGATSLGVDILARGVGGVKRLWGIVNFLLAICLGLTVLVTKLAQHSRQYAPGTGALGDPLPPSEGIKAGALTLFSVLGVPLAITYSIPFALASIFSSTSGAGQGLSLGVLNLAIVIPQMFVSVLSGPWDALFGGGNLPAFVVGAVAALASGILSIILLPSPPPDMAKSVSATGGGFH

SEQ ID NO: 18648 - protein, 474 aa, Propionibacterium freudenreichii subsp. shermanii
MALLQNFINNRFVASTSTESFNLVDPATAEVTGQSPASNQADVDAAYAAAKDATRTWGKMIPGERQRAMLKLADAIEAHSDELVAAQSRNTGQPKHLIASEEVTVGADQIRFFAGAARIMEGLASGEYMENMNSVIRREPIGVVGQVTPWNYPLMMAIWKIGPALAAGNTIVLKPSDTTPESTLLLAQLAAEFLPEGTFNVVLGRAATGAMVVGSKVPGLVSITGSVRAGIEVAKAAAENLTRCHLELGGKAPCIVFDDADVDAAAEALTTAGFFNAGQDCTSSTRLLVQAGVHDEFVAALAKYARSTRFGSPDDADALYGPLNNANQLARVQQAVDSLPAHAEVVTGGKQADRPGFYFEPTVLDGLNQDDALVQNEIFGPVLTVQTFDTEDQAVAMGNGVPYGLASSVWTRDHARALRMSAALDFGCVWINCHIPLVAEMPHGGFKSSGYGKDLSKYSVEEYTRVKHVMSSME

SEQ ID NO: 18649 - protein, 315 aa, Thermoproteus tenax
MSLVEELTPREAAGKALADLGDLRKDVVVVVADTGETTRARFFAERHPDRFFNVGIAEQAMAAISAGLAYAGFMPYALTFAEFMLRAWEIIRNSVARLNLPVRFIGTHAGFSDPYDGPSHQALEDIALFRVLPNFTVIAPADSCETYRAVMATAEVRGPVYVRVGRDFHIPATCDLYKVFEVGKGYVAADGSDVAIMTTGQMLGYAIDAAHILREKGISAAVLHFPTIKPLDLTLLSRYARAVKAIVTVEEHMVHGGFGSAVAEALANIGPKPLAMMGVKTFGRTAKSPEELYRYFGLTPENIAARAEELISLAR

SEQ ID NO: 18650 - protein, 499 aa, Propionibacterium freudenreichii subsp. shermanii
MRRAKIVCTLGPATSTQERMEEMIHAGLDVARFNMSHGDHSEHLRRLEETRAAAEAVGKTVGLLADLQGPKIRLGVFADGKAELALGQEFIITTDDVPGDAHRASTTYKGLPADVKAGDRILIDDGNIQLEATGVTDTDVITKVTVAGPVSNHKGINLPGVAVNVPALSEKDENDLRWALRNDFDMIALSFVRHAADIDRVHEIMDEEDMHLPVIAKLEKPQAIENLDEIIDAFDGFMVARGDLGVEMPLEQVPLVQKTIIRKARKWAKPVIVATQMLDSMISNPRPTRAEASDVANAVLDGADAVMLSGETSVGAFPVTTVETMANIVSTTEGEGLTDISKIKWDPHTTGGVIAMAAATSGVQLGAKFLVAFTQSGDTARRMSRLRNDIPLLVFTPEAKTAQWLTLCWGAQVFHTPSYSSNEEMVTAVNRTLQDLGLAAPDDVVVIIFGSPIGMVGKTNTMRIHRLKPIDWVEKVKLPSYMRGEDGPVDGTVVANDRR

SEQ ID NO: 18651 - protein, 538 aa, Streptomyces coelicolor A3(2)
MHEAPELTTAADPASEAFRANEEAHAALVQELRAKLAAARLGGGERARARHTARGKLLPRDRVDTLLDPGSPFLELAPLAADGLYDGAAPAAGVIAGIGRVSGRECVIVANDATVKGGTYYPMTVKKHLRAQEVALENRLPCLYLVDSGGAFLPMQDEVFPDREHFGRIFYNQARMSGAGIPQIAAVLGSCTAGGAYVPAMSDEAVIVRNQGTIFLGGPPLVKAATGEVVTAEELGGGEVHSRVSGVTDHLAEDDPHALRIVRQIVSTLPERGALPWGVEAAAEPKADPQDLYGVVPVDSRTPYDVREVIARVVDGSRFAEFKSEYGQTLVTGFARIHGHPVGIVANNGILFSESAQKGAHFIELCDQRGIPLVFLQNISGFMVGRDYEAGGIAKHGAKMVTAVACTRVPKLTVVVGGSYGAGNYSMCGRAYSPRFLWMWPNAKISVMGGEQAASVLATVKRDQLEGRGEEWPAEEEESFKAPVRAQYERQGNAYYATARLWDDGVIEPADTRQVLGLALTACANAPLGEPRFGVFRM

SEQ ID NO: 18652 - protein, 160 aa, Synechococcus sp. CC9311
MATFEGRFTDLGQVRIAVVVARFNDLVTAKLLSGCLDCLSRHGVDTTAESSQLDVAWVPGSFELPLVSQNLARSGLYQVVITLGAVIRGDTPHFDVVVAEASKGIAAVARDTGVPVIFGVLTTDTMQQALERAGIKSNLGWSYGLEALEMASLMKVLPGH

SEQ ID NO: 18653 - protein, 430 aa, Mesorhizobium loti MAFF303099
MGVEVSRLSNGLTVATETLPSIESVALGAWVKSGARNERDEEHGMAHLLEHMAFKGTKRRTAFEIASEIEDVGGEINAATSVETTSYYARVLSDDVPLAVDILADILQESEFDPQELEREQHVILQEIGAAHDTPDDIVFDRFTETAFRHQTIGRSILGTPDTVKSFTSKQLHDFIERQYGAERMVIVAAGDIKHDNFVREVEKQLGGFRSKADSTIPQYAQYVGGDFREDRDLMDAQIVLGFEGRAYHVRDFYASQVLSMILGGGMSSRLFQEVREKRGLCYSVYAFHWGFSDTGIFGVHAATGQSDIAELVPVIIDELQKAGENILQEELDRARAQYRAGLIMSAESPASRASQIARQLLLFGRPIAKEELMERLSALTVERLTDLSSRMFSTKPTLTAVGPVGTLAPYEAILDSLPGTQTTARRLAV

SEQ ID NO: 18654 - protein, 264 aa, Escherichia coli
MAISIKTPEDIEKMRVAGRLAAEVLEMIEPYVKPGVSTGELDRICNDYIVNEQHAVSACLGYHGYPKSVCISINEVVCHGIPDDAKLLKDGDIVNIDVTVIKDGFHGDTSKMFIVGKPTIMGERLCRITQESLYLALRMVKPGINLREIGAAIQKFVEAEGFSVVREYCGHGIGQGFHEEPQVLHYDSRETNVVLKPGMTFTIEPMVNAGKKEIRTMKDGWTVKTKDRSLSAQYEHTIVVTDNGCEILTLRKDDTIPAIISHDE

SEQ ID NO: 18655 - protein, 245 aa, Brassica napus
MARFLLLCFLFAAALTSSLTEAGDDNRVYSPCSDSTVAVGDGFTFGIAFAARASFFGTNRSVQYSPCDRRRLSLSGNSELAVFRPKVDEITLLTINTSSSSSSFRPDSSKGYMVAFAGAKYAARSVPIMVADNDHVVTSFTLVLEFQKGRLENLFWKKDGCSKCSGNAKFVCLNKEECAIKRQSCKNQGGQVDCSLGIQLAFSGTDKHYTALNSWYEVANLKQYSLYGLYSNLKGSLSSQFYNLF

SEQ ID NO: 18656 - protein, 183 aa, Zea mays
  misc_feature (38)..(38): Xaa can be any naturally occurring amino acid
  misc_feature (62)..(62): Xaa can be any naturally occurring amino acid
  misc_feature (66)..(66): Xaa can be any naturally occurring amino acid
  misc_feature (94)..(94): Xaa can be any naturally occurring amino acid
  misc_feature (104)..(104): Xaa can be any naturally occurring amino acid
  misc_feature (110)..(110): Xaa can be any naturally occurring amino acid
  misc_feature (112)..(112): Xaa can be any naturally occurring amino acid
  misc_feature (114)..(114): Xaa can be any naturally occurring amino acid
  misc_feature (122)..(122): Xaa can be any naturally occurring amino acid
  misc_feature (124)..(124): Xaa can be any naturally occurring amino acid
  misc_feature (130)..(130): Xaa can be any naturally occurring amino acid
  misc_feature (134)..(135): Xaa can be any naturally occurring amino acid
  misc_feature (138)..(138): Xaa can be any naturally occurring amino acid
  misc_feature (140)..(141): Xaa can be any naturally occurring amino acid
  misc_feature (144)..(144): Xaa can be any naturally occurring amino acid
MIALSFVRKGSYLVTVRQVLGHHANRIKLMSKVENQEXVVNFDEILRETDAFMVARGDLGMXIPVXKIFLAHNMMIYMCNIAGKPVVTATHMLXSIIISPMPTXAEALDXAXAXSDGTDCVXLXGESAAXAYPXXAVXIXXRFXIDGVCTMHDPPALIICLRLVSLFPLVPTRGLIIRRCFRV

SEQ ID NO: 18657 - protein, 224 aa, Azoarcus sp. BH72
MNTLQHPQNPRRCRICLVRHGETPWNAERRLQGHLDVPLNEVGHTQAEATARSLRGGRFAAIYASDLTRALQTAAPAARDLGLETQPSAALRERHYGLFQGLTYDEAAERHPDAYARFRAREATFAFPEGGESLADFAVRIDAALKALAHCHLGEQILVVTHGGVLDIAHRLASKLPLEAPRDFPILNAALNWLEYDGDGPAWHLVAWGVQDHLASARDELPNA

SEQ ID NO: 18658 - protein, 536 aa, Erythrobacter sp. SD-21
MTAPVLTSTLDREAPDAKARFEHNKSLAADLRSTVAAAALGGSEGSRDRHVGRGKLLPRERVERLLDPGSPFLEIGQLAANGMYGKDEINGAGMIAGIGRVSGRQVMIVCNDATVKGGTYYPMTVKKHLRAQEIAAENRLPCIYLVDSGGANLPHQAEVFPDRDHFGRIFFNQANMSAAGIPQIACVMGSCTAGGAYVPAMSDETVIVRNQGTIFLAGPPLVKAATGEEISAEDLGGGDLHAKKSGVVDHLAENDEHALTIVRDIVSHLGDNYAAATGVQLAEPRSPKFDADDLYAIVPEDVRAPYDVKEIIARLVDGSEFHEFKAQYGSTLVCGFAHIWGMPVAILANNGVLFSESAQKGAHFIELACQRRIPLLFLQNISGFMVGGKYEAEGIAKHGAKLVTAVATATVPKVTVVIGGSFGAGNYGMCGRAYSPRFLFTWPNARISVMGGEQAASVLATVHRDADSWSEEQAEEFKAPIRQKYEDEGNPYYATARLWDDGVIDPAQTRDVLGLAFAATLEAPIPEKPQFGVFRM

SEQ ID NO: 18659 - protein, 505 aa, Mesorhizobium sp. BNC1
MTISYDKVREVASTLRFPAQAFINGELCWAEDGDKFDTVNPATGEVLCSVAHCKKEDVDKAVIAARRSFNDGEWSRAEPEHRKEVLTRLSHLIRENAFELAVLESLDSGKTITDCLKEIGTEVANFFQWYGELIDKSFGKVAPTGESALALIVKEPAGVVGIIVPWNFPLLMTAWKVAPALAAGCSCIVKPAEQTPLSAIRMAELAQQAGLPDGVLNILPGLGETAGQAIGRHNDVDIISFTGSTEVGGFFLRYSGESNLKVVGLEMGGKSPFIVLDDADLNDDLVEHAVSSAFWNGGQNCSANMRQLVDTRVADEFVERVVARAEKYKVGDPLDPSTDIGAMVTEEHMKRVVGYIERGESEGARRLTGGARQGRGYFIEPTVFSGLRPEMTIAREEIFGPVLGVMPVKGLDDALRIASDTIYGLHATVFTRDLDRALHLARRLPCGTVSVNGFSEGDIKTPFGGYKQSGSLSRDNGTEAMDQYLQTKTIWITLRGPSNRGSIAG

SEQ ID NO: 18660 - protein, 475 aa, Bacillus anthracis str. Ames
MQQTTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVITILAFVVLGGSALLGFISYDGKEAAPLFSNFVSEGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPTSFQKVNKRGIPITALVVTIAVAGLSLFTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYINKKRQKPMKVEMEKANETNNQTR

SEQ ID NO: 18661 - protein, 680 aa, Arabidopsis thaliana
MFCRNVSVRRKKNSGTVPVYLNVYDLTPMNVYGYWLGIGIYHSGLEVHGVEYGYGAHEKSSSGIFEVEPKKCPGFTFRKSILVGETEMKAKEVRSFMEKLSEEYQGNKYHLITRNCNHFCNHVSLKLTHKSIPSWVNRLARLGFLCNCVLPACLNETKVKRVGKDGKLLLEGENTKKKKRKKKIRRSRSGPLSSSSSNARLDNTPTHNRSISTGNPPLSASPSCPLRPRLPSVASGAEDQNPPSRYLNASFCSEVQCHRLCFAYERMNQNEGDALVDSIKAKLAFLSSLSTKCCIYKVPNKLRRLNPDAYTPRLVSFGPLHRGKEELQAMEDQKYRYLLSFIPRTNSSLEDLVRLARTWEQNARSCYAEDVKLHSDEFVEMLVVDGSFLVELLLRSHYPRLRGENDRIFGNSMMITDVCRDMILIENQLPFFVVKEIFLLLLNYYQQGTPSIIQLAQRHFSYFLSRIDDEKFITEPEHFVDLLRSCYLPQFPIKLEYTTVKVDNAPEATELHTAGVRFKPAETSSCLLDISFADGVLKIPTIVVDDLTESLYKNIIGFEQCRCSNKNFLDYIMLLGCFIKSPTDADLLIHSGIIVNYLGNSVDVSNLFNSISKEVIYDRRFYFSMLSENLQAYCNTPWNRWKAILRRDYFHNPWAVASVFAALLLLLLTFIQSVCSILAL

SEQ ID NO: 18662 - protein, 456 aa, Zea mays
MGMGTEWPPTPAQQRKAVVSAGSALKLVLFVILAGLALRLLVGPPAYLLPPTAAPEGAARLFAVPERERTAGGGGGGIPSVETDDAVFTLTDSEPLTALGKKEGSTKPEESCDLFHGEWVPNSSGPAYTNASCRFIESPQNCMTNGRPDTDYLNWRWKPYGCEVSPFDGKKFLDGMKGKHWALIGDSILRNHVQSLLCLLSKVEDATEVYHDDTFRSRRWHFPSYNFTISLVWAPFLVKAKIFEDDDGVSTADLQLHLDVLETDWTSQWEKFDYAVISTGQWFFKTAVYWENGAAIGCHSCQNKTLEERPPEYSFRRALRVAFQFITSSPHKPVVFYRTWAPSHFENGEWFSGGTCNRTAPFKPGEAGDREWDNSMWRIEREEFHNAVPIGGDRLKLLDTFELSLLRPDGHPGPYRAYHPYEKGVTAKVQNDCLHWCLPGPIDAWNDVIMKMVAKD

SEQ ID NO: 18663 - protein, 172 aa, Populus trichocarpa x Populus deltoides
MSNPKVFFDMTVGGQPAGRIVMELFADIVPRTAENFRALCTGEKGVGKSGKPLHFKGSSFHRVIPNFMCQGGDFTAGNGTGGESIYGAKFADENFVKKHTGPGVLSMANAGPGTNGSQFFICTVKTEWLDGKHVVFGQVVEGMDVVKAIEKVGSGNGRTSKPVVVADCGQLS

SEQ ID NO: 18664 - protein, 698 aa, Oryza sativa Japonica Group
MEGCQLVARCSSSSSSSRMEVEEEAFFDTREELLPPSPAAALPWSGGLDSVRQRRERFMRSMGLERSPSLRQADFADVVGDVEEEGEVAAEAEIGRWSSQSDENECSMSSWSTEETTSYDDGASDDNSVSGSGKASRSFSSLSFIQRLMSRNGKPSGAPKTIDRRRNGWLRRLGVSACVVDSGAADEASTSSSDSEQIGAGRYERIKVHSYRKRSKELSAVYQGQVIKAHDGAILTMKFSPDGQLLATGGEDGVVRVWAVMQSEDCKIPLDDPSCVYLKARRKYGLAPVNAESEKKSKINGLKKSDSACIVVPTMVFQISEEPVHEFRGHSGDVLDLSWSSDKHLLSASTDKTVRMWEIGYANCIRVYPHSNFVTCVQFNLADENLFISGSIDGKIRVWDITRSSVVDWVDIRDIVTAVCYRPGGKGVVVGTITGNCRFYEISDNLLKLETQIALNGKKKSSLKRITGFQFCPSNPSKLMVTSADSKIRILDGTNVIQNYSGLRSGSCQLSATFTPEGQHIISASEDSNVYVWSHENQYECACKQAKTTQTSEHFRSNNAAIAIPWNGTKPRSPVPLSSQILPPQGDTFWSMSKAIKYNSSLCGKDSSIKKIVSTPAAPGIFNLNQEFFIESSCKSSATWPEEMLPSTTASVNLDESQFKLLRNCFQGTSNSWGQVIVTAGWDGRIRYFQNFGLPVHQ

SEQ ID NO: 18665 - protein, 422 aa, Saccharomyces cerevisiae YJM789
MNQCAKDTTHEASSIPIDLQERYSHWKKNTKLLYDYLNTNSTKWPSLTCQFFPDLDTTSDEHRILLSSFTSSQKPEDETIYISKISTLGHIKWSSLNNFDMDEMEFKPENSTRFPSKHLVNDISIFFPNGECNRARYLPQNPDIIAGASSDGAIYIFDRTKHGSTRIRQSKISHPFETKLFGSHGVIQDVEAMDTSSADINEATSLAWNLQQEALLLSSHSNGQVQVWDIKQYSHENPIIDLPLVSINSDGTAVNDVTWMPTHDSLFAACTEGNAVSLLDLRTKKEKLQSNREKHDCGVNSCRFNYKNSLILASADSNGRLNLWDIRNMNKSPIATMEHGTSVSTLEWSPNFDTVLATAGQEDGLVKLWDTSCEETIFTHGGHMLGVNDISWDAHDPWLMCSVANDNSVHIWKPAGNLVGHS

SEQ ID NO: 18666 - protein, 429 aa, Propionibacterium freudenreichii subsp. shermanii
MASIEFIEAREILDSRGNPTVEVEVVLDDGSSARAGVPSGASTGQFEAVELRDGDENRYGGKGVQKAVGNVVETIGEEVLGMEASRQRELDEAMIELDGTDNKAKLGANAILGVSLAAAKASAESAELQLYQYIGGPTANELPVPMMNILNGGAHADSNVDIQEFMIAPIGAKSFAEAMRIGAEVYHTLKGVLKERGLGTGLGDEGGFAPNLDNNREALDLIEDAIKAAGYKPGKDVALALDLAASEFYTDGRYEFEGKSRSTAEMIEYLEKLVNDYPLVSIEDPLDEEDWDGWSTLTERIGDKVQIVGDDLFVTNVERLQKGITEKAANALLVKVNQIGTLTETIDAVTLAHRNGFHTMMSHRSGETEDTTIADLAVALGCGQIKSGAPARGERVAKYNQLIRIEEDLDEAATYAGAGAFPKFDSTKW

SEQ ID NO: 18667 - protein, 424 aa, Chlamydomonas reinhardtii
MALRAVQPAEAENGVLGNNNVAKAAAGVKAAAGLQAQNKRRALGDLSNQQPAAAAGKPGLVKEKAAVPVPADGVKTRAAARRADGKDAPMPTAPGAALRPAQLVPRTRSQVANAQRVQGPSMSSLLSQRSEAFVGSQSVRAPPPSPLPDIDSGDRLNPLMAADYVNDIYYFYKRVERKYKVPSDYMTKQTDINDKMRAILIDWLVEVHLKFKLMPETLFLTVNLIDRFLNEKQVTRKNLQLVGVTAMLIASKYEEIWAPEVRDFVYISDRAYTKEQILGMEKVMLNTLKFHLTLPTTYNFLARDLKAANMHFDKDVTMLSSYLIELAQVDAGMLKNNYSLIAVAALHVSMCAYEKADCYPRALEKHCGYTQEEVTPVAMQLAELMQKAPTSSLTAVWKKYSSTKYNEAAKKPAPAHLLPAQPVA

SEQ ID NO: 18668 - protein, 266 aa, Mycobacterium tuberculosis CDC1551
MRPLARLRGRRVVPQRSAGELDAMAAAGAVVAAALRAIRAAAAPGTSSLSLDEIAESVIRESGATPSFLGYHGYPASICASINDRVVHGIPSTAEVLAPGDLVSIDCGAVLDGWHGDAAITFGVGALSDADEALSEATRESLQAGIAAMVVGNRLTDVAHAIETGTRAAELRYGRSFGIVAGYGGHGIGRQMHMDPFLPNEGAPGRGPLLAAGSVLAIEPMLTLGTTKTVVLDDKWTVTTADGSRAAHWEHTVAVTDDGPRILTLG

SEQ ID NO: 18669 - protein, 423 aa, Propionibacterium freudenreichii subsp. shermanii
MPRQTITTLDAMEILDSRSRPTLMVRLSLSDGTRARAMVPSGASTGTHEAVELRDHDPHRFGGLGVLAAVDHVTHEIADAIVGRRFESVGELDESLLALDGTPNKSRLGANAILGVSMAFTRALAASGGNELFEYLPGIGGQPPRLPVPCFNVLNGGVHAANPLDFQEFMICPTGMDSMTDAVRAGSEIYSALRARLKDSGQPVGLGDEGGFAPDFAEPEQALDTIVAAIGDAGYTPGLEGVAIAIDPASSEFRQADGRYLVNGRSFTSAQMIERYQAIVHGYPVWLLEDGLAEDDWDGWQQLTRELGSRVELVGDDIFCTNPELIRKGIERHVANASLIKLNQIGTVTETLDAMNICAAAGYRQFMSHRSGETPDAFIADLAVATGCGHIKSGAPARGERVAKYNRLLEIAADHPELAYGLG

SEQ ID NO: 18670 - protein, 386 aa, Chlamydomonas reinhardtii
MALRAVQPAEAENGVLGNNNVAKAAAGVKAAAGLQAQNKRRALGDLSNQQPAAAAGKPGLVKEKLVPRTRSQVANAQRVQGPSMSSLLSQRSEAFVGSQSVRAPPPSPLPDIDSGDRLNPLMAADYVNDIYYFYKRVERKYKVPSDYMTKQTDINDKMRAILIDWLVEVHLKFKLMPETLFLTVNLIDRFLNEKQVTRKNLQLVGVTAMLIASKYEEIWAPEVRDFVYISDRAYTKEQILGMEKVMLNTLKFHLTLPTTYNFLARDLKAANMHFDKDVTMLSSYLIELAQVDAGMLKNNYSLIAVAALHVSMCAYEKADCYPRALEKHCGYTQEEVTPVAMQLAELMQKAPTSSLTAVWKKYSSTKYNEAAKKPAPAHLLPAQPVA

SEQ ID NO: 18671 - protein, 1439 aa, Candida albicans SC5314
MNSIDVTKLKKLAKDDLFKRDIFGRTILHICILVNNSDALKSLTKNPDFKTLLKLNDYENGWNCLHYIFFHKRLQCLKVLIDYLQGTIVQGNIFATNSPLLELLKFKDRNGHTPLNLLNNDFKDLLWFPEYITDKNEFHMTYKYERIKSTKDVVQPEYEPDTLPFLKSSEILWTDKRGASEIYVFGCNSNNQLGVGDSTDRATPALLYHDNFKFATDLTGSISERFKRPRYKRITISKNHSVVVTQDGELFSCGVGSRGRLGHGLTDLNNYFKFKRIEFFNDKTIKDVAISSNHSIALTTDNEVYAWGLNSFNQLGVPNMNNKKSTNYLDKFIATPIMVGGELRKMQNIIGIEVSKIHSLAWSKNYLCFWGLNVGQMGISYTNGDIEVKVQERSVRGETQVNPKAIQLRDDIKCVSTSELCTCVVTTLNDVHVYYNYQHFKLPKIPMKGHGDKHFDYFKPRRITEAAVIKKIVTRGPENSMILLKNGSVFSFSVNANDIKNTKYTSIWKAYDHDMVATDIDISTDGSVVLCTRSGTVFIKSTLSSNQRKNSMSGATLPIPLTKNKFKKIENVNNVVRVTCDPKFLSFGFMRDDIDLLPLELPQNDFFTDIETLSPAVEYNFNRKQNKLFDTQDHLYIANFFTASRNNTHEDDADDAEYDKLYSNQDASVINKIEEIYNSKFDPRASKRVKALSTYENIVSEEVYSTIKRCSGYGEDYVDGLKDILSNNENLFDANFEFAFAQDAKFGFHSRVLEFRSSVFQKLLQLNDKNETLIGDNIKIVWIPEQSTLRVLTTISPVAALMFMHSVYSGRKMDNLEQNVFSYSSPELVRLRINQYQSLCSLFGIGCDRLSVTDAFQDLLNSNTGDVVIKASDGDVFAHAFVLKARSAFFETLLSERWDTEEKGNVQYVDFTGLTKFQVTLILRHLYGVSNESLLDCFQYDFGEKDYFINDLLELIEVADELLLFQLKSVLQLAICDMISLDNVLVLLVHGFTLNARQLFLNCCWYIFNNLEVLMFAPGFKEIPNETMQLLEVFIDKLGNVQNGTKNWIDQNPNILLEHIENIEEFNEYFMSDRKGFSSFKPLIDNGYIDAIKTKETVKKRKSRKSSTSAFNKDISDFRQGLRRENNGESFPPTIIDENDGFILVENKTKQRNASSSSPNILNMNGIVEPTNKIGNLSVIGKLTSIHPNPESFVQSSGLPSTSNWATKPQSSSIESNTLLPAAISTTLTTAKSKPTKVKIGPVTKLSQKQRKRLAAAAANDANLEQIDQKTTKESSTIAPWSTCVADTPISNSQNINNLPALGSSKPKKKFISISRPQSTKKSPSLISIPSSTASTPFSMAAAITPDSSFNSVYSTPSLTEVMIHESLKLEQAKLQETERKTLVEIQQEQEFAKWWEEESKRVQEEMQRLEVADTKKKKKKKNTSPKPQKYRKPIKSDS

SEQ ID NO: 18672 - protein, 470 aa, Bacillus cereus ATCC 10987
MVVGDFPIELDTVVVGAGPGGYVAAIRAAQLGQKVAIIEKANLGGVCLNVGCIPSKALINAGHRYENAMHSDDMGITAENVKVDFTKVQEWKNGVVKKLTGGVEGLLKGNKVEIIRGEAYFVDANTLRVMTEDAAQTYTFKNAVLATGSTPIEIPGFKYSKRVINSTGALSLPEIPKKLVVIGGGYIGMELGTAYANFGTEVTVVEAGDEILAGFEKAMSSVVKRALQKKGNVTIHTKAMAKGVEETETGVKVSFEVKGEIQTVEADYVLVTVGRRPNTQEIGLEQVGVKMTDRGIIEIDEQCRTNVPNIYAIGDIVPGPPLAHKASYEGKVAVEAISGHASAIDYIGIPAVCFTDPELASVGYTKKQAEEAGMTVTVSKFPFAANGRALSLNSTDGFLQLVTRKEDGLLVGAQVAGAGASDIISEIGLAIEAGMTAEDIAQTIHAHPTLGEITMEAAEVALGMPIHIVK

SEQ ID NO: 18673 - protein, 798 aa, Saccharomyces cerevisiae YJM789
MSQKQSTNQNQNGTHQPQPVKNQRTNNAAGANSGQQPQQQSQGQSQQQGRSNGPFSASDLNRIVLEYLNKKGYHRTEAMLRAESGRTLTPQNKQSPANTKTGKFPEQSSIPPNPGKTAKPISNPTNLSSKRDAEGGIVSSGRLEGLNAPENYIRAYSMLKNWVDSSLEIYKPELSYIMYPIFIYLFLNLVAKNPVYARRFFDRFSPDFKDFHGSEINRLFSVNSIDHIKENEVASAFQSHKYRITMSKTTLNLLLYFLNENESIGGSLIISVINQHLDPNIVESVTAREKLADGIKVLSDSENGNGKQNLEMNSVPVKLGPFPKDEEFVKEIETELKIKDDQEKQLNQQTAGDNYSGANNRTLLQEYKAMNNEKFKDNTGDDDKDKIKDKIAKDEEKKESELKADGEKKNSNLSSPARDILPLPPKTALDLKLEIQKVKESRDAIKLDNLQLALPSVCMYTFQNTNKDMSCLDFSDDCRIAAAGFQDSYIKIWSLDGSSLNNPNIALNNNDKDEDPTCKTLVGHSGTVYSTSFSPDNKYLLSGSEDKTVRLWSMDTHTALVSYKGHNHPVWDVSFSPLGHYFATASHDQTARLWSCDHIYPLRIFAGHLNDVDCVSFHPNGCYVFTGSSDKTCRMWDVSTGDSVRLFLGHTAPVISIAVCPDGRWLSTGSEDGIINVWDIGTGKRLKQMRGHGKNAIYSLSYSKEGNVLISGGADHTVRVWDLKKATTEPSAEPDEPFIGYLGDVTASINQDIKEYGRRRTVIPTSDLVASFYTKKTPVFKVKFSRSNLALAGGAFRP

SEQ ID NO: 18674 - protein, 429 aa, Bacillus cereus ATCC 10987
MAFEFKLPDIGEGIHEGEIVKWFIKPGDEVNEDDVLLEVQNDKAVVEIPSPVKGKVLEVLVEEGTVAVVGDTLIKFDAPGYENLKFKGDDHDEAPKAEEAKEEAPKAEATPAATAEVVNERVIAMPSVRKYARENGVDIHKVAGSGKNGRIVKADIDAFANGGQAVAATEAPAAVEATPAAAKEEAPKAQPIPAGEYPETREKMSGIRKAIAKAMVNSKHTAPHVTLMDEVDVTELVAHRKKFKAVAADKGIKLTYLPYVVKALTSALREYPMLNTSLDDASQEVVHKHYFNIGIAADTDKGLLVPVVKDTDRKSIFTISNEINDLAGKAREGRLAPAEMKGASCTITNIGSAGGQWFTPVINHPEVAILGIGRIAEKPVVKNGEIVAAPVLALSLSFDHRLIDGATAQKALNQIKRLLNDPQLLVMEA

SEQ ID NO: 18675 - protein, 418 aa, Chlamydomonas reinhardtii
MALRAVQPAEAENGVLGNNNVAKAAAGVKAAAGLQAQNKRRALGDLSNQQPAAAAGKPGLVKEKAAVPVPADGVKTRAAARRADGKDAPMPTAPGAALRPAQLVPRTRSQVANAQRVQGPSMSSLLSQRSEAFVGSQSVRAPPPSPLPDIDSGDRLNPLMAADYVNDIYYFYKRVERKYKVPSTDINDKMRAILIDWLVEVHLKFKLMPETLFLTVNLIDRFLNEKQVTRKNLQLVGVTAMLIASKYEEIWAPEVRDFVYISDRAYTKEQILGMEKVMLNTLKFHLTLPTTYNFLARDLKAANMHFDKDVTMLSSYLIELAQVDAGMLKNNYSLIAVAALHVSMCAYEKADCYPRALEKHCGYTQEEVTPVAMQLAELMQKAPTSSLTAVWKKYSSTKYNEAAKKPAPAHLLPAQPVA

SEQ ID NO: 18676 - protein, 251 aa, Propionibacterium freudenreichii subsp. shermanii
MHMTSKLILLRHGESEWNAKNLFTGWVDVDLNEKGVREASHGGELLAQEGLLPDIVHTSLLRRAIHTSYLALDKADRLWIPVKRSWRLNERHYGALQGLNKSEIRDQYGEEQFMAWRRSYDVPPPAIEPDSKFSQFNDPRYADIPADERPLHECLKDVVERMLPYWESSIVPDLKAGKTVLVAAHGNSLRALVKHLDNIDDQTISGLNIPTGIPLFYELDDDMKPLVPGGRYLDPEAAAAGQKAVASQGKK

SEQ ID NO: 18677 - protein, 368 aa, Magnaporthe grisea 70-15
MDLRVGNKYRIGRKIGSGSFGDIYLGTNIISGEEIAIKLESVKAKHPQLEYEARVYKSLAGGVGIPFVRWFGTECDYNAMVLDLLGPSLEDLFNFCNRKFSLKTVLLLADQLISRIEYIHAKSFIHRDIKPDNFLMGIGKRGNQVNVIDFGLAKKYRDPKTHFHIPYRENKNLTGTARYASINTHLGVEQSRRDDMESLGYVMLYFCRGSLPWQGLKAATKKQKYDRIMEKKMTTPTEVLCRGFPNEFAIYLNYTRSLRFDDKPDYSYLRKIFRDLFVREGFQYDYVFDWTVYKYQKNAQAIRQGEDKQGREDPSQQAQPGTVAQSSRPRNKNLIAGEDTPNTRGAVGGSDRMLRSAYKNAESAYRPK

SEQ ID NO: 18678 - protein, 556 aa, Prosthecochloris aestuarii DSM 271
MYKPKLFVLLRELNRERLMNDIVSGILVGIVALPLAIAFAIASGVSPEKGLITAVIGGFLVSLLGGSRVQIGGPTGAFIVIIYSIVQQYGVNGLMLATIMAGIILVFMGLAQFGSLIKFIPYPVIVGFTSGIAVIIFSTQIKDFLGLDTGTLPPDFLDKWATYIAHISTVHLPTFLIGLLSLSIILLWPKVSRKIPGSIIAIIATTTMVQLLHLDVATIETRFGDIPSTIAMPSIPVFDLATIQQLIMPATTIAILAAIEALLSAVVSDGMIGGRHKSNMELIAQGVANIASPLFGGIPVTGAIARTATNVKNGGRTPVAGIVHALTLLCIMLLFASWAKLIPMATLAAILIVVAWNMSEYHVFLRLLKSPKSDIIVLMTTFGLTIIFDLTIAIEVGLLLAVILFMQRMSGITNIEVITRELKDREEESDDPNTIITRTIPDGVEVYEINGPFFFGAAAKFKESMLIIEKPPSVRILRMRNVPVIDATGLNMLRELVSDSKKRGTQTVISGIHPEPLAALKQYGLLKEIGKENVFSHIDQALERAAQLSVSRGPDK

SEQ ID NO: 18679 - protein, 188 aa, Prosthecochloris aestuarii DSM 271
MNFNPWHHVEIGKDQPDVVNSVIEISKGSKTKYELDKKSGMLKLDRVLYSSVFYPANYGFIPKTLGEDHDPLDIVVLSQCAIVPMCLVRARVVGVMRMIDHGEGDDKIIAVADDDMSMSTIQNVHDISQHFNSELKHFFEEYKALEKKTVLVEDFQDADTAKEIIQQSILNYQKTFGVAQEIKPVPVI

SEQ ID NO: 18680 - protein, 502 aa, Mycoplasma penetrans
MKKGPVLLAVLDGYGFSKDTKGNAILNAKTPFMDNLVKEYDHCYIEASGEYVGLPDGQIGNSEVGHLTIGAGRIVYTGLSLINQDIKTKKFDSNKTLLEAINHAKKNNSNIHIMGLLSPGGVHSNEQHIFEMIRIVSENGLKPVIHVFGDGRDVAPQSIISSLERLNDVLKKYPGTIATISGRFYSMDRDKRWERTKQAYDNLLGISNNYFDNPIDYVNKQYSENIFDEFLVPARINDSNVVIKDNDAVIHANFRPDRARQISHLFCGSTVYEEKNDHPLKNLYYAIMMTYEGITPTSILFPTVVVKNTFGEVVANSGLTQLRIAETEKYAHVTFFFDGGVEVDLKNESKILVDSKKVKTYDEVPAMSAVEITDKLIENLDKFDVIVLNFANADMVGHTGKYNEAVLAIEALDSQLARIDQKIKELNGTMFITADHGNAEVMLDDDNNPVTKHTTNPVIFISNNKDVKFNKPGSLGNVAPTILDFMGLEIPADMDKKSLLKK

SEQ ID NO: 18681 - protein, 892 aa, Mesorhizobium loti MAFF303099
MTKWVFTFGDGAAEGRAGDKNLLGGKGANLAEMCSLGLPVPPGFTITTEVCNAYYANGRAYPAGLEADVAVALDHIGRLTDRRFGDPSKLLLVSVRSGARASMPGMMDTVLNLGLNDETVEALATDSGDARFAYDSYRRFIQMYSDVVMGLDHEVFEEILEDQKASLGHELDTELTAIEWQGVIALYKAKVEEELGRPFPQDPQEQLWGAIGAVFSSWMNNRAITYRRLHDIPESWGTAVNVQAMVFGNMGETSATGVAFTRNPSTGEKQLYGEFLVNAQGEDVVAGIRTPQNITEAARIAAGSDKPSLQKLMPDAFQSFVSISDSLEKHYRDMQDLEFTIERGKLWMLQTRSGKRTAKAALKIAVEMARDGLITKEEAVARIDPASLDQLLHPTIDPKAARDVIGVGLPASPGAATGEIVFSSGDAEDLKAQGRKAILVRIETSPEDIHGMHAAEGILTTRGGMTSHAAVVARGMGKPCVSGAGSLRVDYKAGTLLSMGQTFRKGDIITIDGGNGQVLKGAVAMLQPELSGDFAAIMEWADAVRRMKVRTNAETPLDARMARSFGAEGIGLCRTEHMFFDGARIVAMREMILADTEKDRRIALAKLLPMQRSDFLELFEIMAGLPVTIRLLDPPLHEFLPKTEAEIAEVAAVMDVSPDKLRQRTEALHEFNPMLGHRGCRLAVSYPEIAEMQARAIFEAAVEAGQKAGALVVPEIMVPLVGLVKELDYVKARIDAVAKSVMEESGVKIDYLTGTMIELPRAAIRAHVIAATAEFFSFGTNDLTQTTFGISRDDAASFLETYRQKGIIEQDPFVSLDVDGVGELVRMAAQKGRATRPDIKLGICGEHGGDPASIRFCEEVGLDYVSCSPYRVPIARLAAAQAAVQVSKAGRG

SEQ ID NO: 18682 - protein, 256 aa, Nocardia farcinica IFM 10152
MTTVDPGTDTAHRLTRKGAELTVRVRELPADRDGGSVLVFGEIGQDCLVRIHSRCLYGDALQSDDCDCGPELERSMDLIQAEGRGVLVYLDQEGRGAGLVAKARGLREAERTGADTFTAYTRLGYPEDARSFRLAAAAIAELGLRRVRLLTNNPDKAAALTDLGVAVTVVPLTTRPRSARARKYLQDKRAHRRHWLPEPSAPWAAGLAGPESTMVLPVLPDDAGWDEDGAGAVGGTRRSRWGWLRGEGAGTAARRS

SEQ ID NO: 18683 - protein, 249 aa, Azoarcus sp. BH72
MYKIVLLRHGESTWNKENRFTGWTDVDLTELGVGEARAAGQLLKREGYSFDLAFTSVLKRANKTLNIVLEELDALWLPVEHSWRLNERHYGALQGLNKAETAAKFGDDQVLVWRRSYDIPPPALEEGDERLNYDDPRYGSLPRARFPRTECLADTVARVVPYWETVIVPQILSGRRILIAAHGNSLRALIKYLDGISDGDIVGLNIPTAQPLVYELDVNLKPVKSYYLADEDTIRAAQAAVAGQGKAKG

SEQ ID NO: 18684 - protein, 446 aa, Bacillus megaterium
MHIIAVGLNFRTAPVEIREKLSFNEQELASAMKTLSGQKSILENIIVSTCNRTEIYAVVDQLHTGRYYVKAFLAEWFGIDKEEFSPYLTIYENDGAIEHLYRVACGLDSMVIGETQILGQVRSSFLLAQEEETIGTVFNQLFKQAVTLAKKAHHETEIGANAVSVSYAAVELAKKIFGDLSSKHVLILGAGKMGQLAVQNLYGSGAKKVTVVNRTFEKAQELANRFSGEAKPFADLQHALSEADILISSTGANDYVVTKQMMSEAERTRKGRPLFMVDIAVPRDLDPELDELETVFLYDIDDLNGIVESNLQERQKAADEIEIMLEAEIVAFKSWLGTLGVVPVISALRQKALTIQAETMKSIDRKLPDLSERERKVLNKHTKSIINQLLRDPIPHAKELAGEKHAEESLELFMKIFNIEQEVALQKEKEEQLHTSITSHSVAYQS

SEQ ID NO: 18685 - protein, 257 aa, Zea mays
  misc_feature (168)..(168): Xaa can be any naturally occurring amino acid
MDEWIRQAEVWVRQSESWIRQQPPEHSVVAAEVVAVTILLLIVASYLKSSKPSTIVLSGLSGSGKTTIFYQLRDGSSHQGTVTSMEENSDTFVLHSEQERKGKVKPVHIVDVPGHARLKPKLDEVLPKAAGVVFIVDAQDFLSSMQAAAEYLYDILTKATVVKKRIPXVLIFCNKTDKVTAHSKEFIKKQLEKELNKLRESRNAISSADISDEVQLGVPGEAFNFSQCQNKVAVAEGAGSTGNVLAVEQFIREHVRA

SEQ ID NO: 18686 - protein, 389 aa, Solibacter usitatus Ellin6076
MDPAAQIPLAMLLVFASAKIMAEIFERLGQPGIVGEILAGVLIGPHVLGWLAPSEFLRTLSDLGVMFLLFRVGLEIRSSELMKVSGIGFLVALAGIVLPFLTGWGISTLWGEPQLESIFTGAAMVATSVGITAQVLAARGLLSTRAARIILAAAVIDDVLGLLVLALVSGLAKGAINYLDLAITAALAIGFTVFVAQFGTRTVRRMMPKMNARMRLVESEFALAMTLLFALSLLAVYAGVAAIVGAFLAGMALSETAEGRLKELTNGVAELLVPFFLVGIGLNFDVTAFAGGRNLALAATIVAGAVLSKFIGCGLGAISMGRTDAVRVGVGMIPRGEVGMVVAQIGLNMGVMAHSVYGIIVFMSVATTLIAPPLLKVAFRGSRDTISNT

SEQ ID NO: 18687 - protein, 327 aa, Haemophilus influenzae R2866
MPQNLPHFYRSRFSVAPMLDWTTRHCRYFHRQFSKHALLYTEMVTAPAIIHAKYDHLDFDLQENPVALQLGGSDPEQLKYCAKLAEERGYHEINLNVGCPSDRVQNGMFGACLMAKADLVADCVEQMQSAVKIPVTVKTRIGIDELDSYEFLCDFIEKVQGKGCQEFIIHARKAWLSGLSAKENREIPPLDYARVYQLKRDFPHLTIAINGGIKTIEEMKQHLQYVDGVMVGREAYQNPSLLGQIDQALFDPNAPIVTAHEAVQSMLPYIEQQLNQGIHLNHIVRHMLGAFQNCKGARQWRRYLSENAFKQGAGVEVIETALSFVEH

SEQ ID NO: 18688 - protein, 262 aa, Legionella pneumophila subsp. pneumophila str. Philadelphia 1
MKSLPIYQVDAFASNLFKGNPAAVCPLDKWLSDETMQAIAAENNLSETAFFVREDEGYRLRWFTPNEEVALCGHATLASSYVLFNQLGFSGKEILFHSLSGKLWVKNTEQGLVMDFPALPYEEIDFRRELEHLNLKKPFKVLQSQFDLMFVYQNAEEVSEAKPDLNAVAHLDYRGLILTAPGTSTDVYSRCFYPGCNVPEDPVTGSAHCVIAPYWCERLKKNHITALQGGLRQGDLYCEVKENRVLLYGNCHLYLEGRIYLP

SEQ ID NO: 18689 - protein, 302 aa, Erythrobacter sp. SD-21
MTQPQNPSAGDASAKAQTLIEALPYFQRYAGRSFVVKYGGNAMGDEDAAREFAEDVVLLKAVGINPVVVHGGGPQIGAMLEKLGVETQFIDGLRVTDKATAEVAEMVLSGAINKAIVGSIARAGGKAVGISGKDGGLVTARKVERTTKDPESNIERALDLGFVGEPSAVDTTIIETATAAGMIPVVAPIGSDEEGHTYNINADTMAGALAAALGAARLLLLTDVSGVLDKEGKLLTDLSPSDIAHLRADGTISGGMIPKLETCVSAVEAGCEAAVVLDGRVPHAMLLEFFTARGAGTLISAA

SEQ ID NO: 18690 - protein, 373 aa, Alteromonadales bacterium TW-7
MSDFIKSKAAIAWGPNQPLSVEEVDVMMPKKGEVMVKITATGVCHTDAFTLSGEDPEGIFPAILGHEGAGVVYAVGEGVTSVEVGDHVIPLYTAECGECKMCTSGKTNLCSAVRETQGKGLMPDGTTRFFKDGQPIYHYMGTSTFSEYTVLPEISLAKVNKEASLEEICLLGCGVTTGMGAVTNTAKVKEGDTVAIFGLGGIGLSAIIGAKMAGASRIIGVDINTSKFDLATKLGATDLINPKDFDKPIQEVIVEMTDGGVDYSFECIGNVDVMRSALECCHKGWGESVIIGVAGAGQEISTRPFQLVTGRVWRGSAFGGVKGRSQLPEIVERYMAGEFALNDFITHTMSLEEINDAFDLMHEGKSIRTVIHY

SEQ ID NO: 18691 - protein, 583 aa, Chlamydomonas reinhardtii
MFSLCSLTHTHTHPQVNNLREIQALRRLSPHANIIKLLEVLYDQPTGRLALVFELMDMNIYELIRGRRHYVAEERIKNYMYQLMKSMDHMHRNGIFHRDIKPENILIMDDCLKLADFGSCRGIYSKQPYTEYISTRWYRAPECLLTDGYYNYKMDMWGVGCVFFEIVSLFPLFPGTNELDQITKIHNILGTPPPDLLAKMKKRSAHMDFNFPPKEGSGVAKLIPHVNPECVDLIVKLLMYNPDERLSARQALRHPYFRDLREAEKRQKALLAPDVSNHFTAMEADKARQQQTVSSTGSDHEHPTSAGGDGGAGTGAVGTHDGSAAAAAAAAALPSISGARGHAGPEGGHDNDMGGMDASGGGGGGGYGRLPGLAAQSSMASVDGDEASLPPIANLSLGKANMTGSTVGGAAHASTRRSTLNTYYEPGAGGGGGTGGAGGGGGGAGPGPAGYGKVAKAAAVGGAGSVAGGGGVVGGAGVGGGGAVGSGTVGRRQSVGVVVGKYGSVNKQASQGHGGGGPGVAGAAGMAVTGGHAGGGVGGGGGGAVGVGGVGVNKYKANVGKTNSKYISPYSLRQLAGQNAGQG

SEQ ID NO: 18692 - protein, 316 aa, Bacteroides fragilis YCH46
MAKIAKKLTELIGHTPLMELSGYSRKYGLQENIVAKLESFNPAGSVKDRVALSMIEDAEERGVLQPGATIIEPTSGNTGVGLAMVATIKGYRLILTMPETMSLERRNLLKALGAQIVLTNGQKGMAGSIAKAEELKKSIPGSVILQQFENPANTEVHARSTGEEIWQDTDGEVAVFVAGVGTGGTVCGVARALKKHNPNVYIVAVEPASSPVLEGGKAVSHRIQGIGANFVPGIYDASVVDEVMPVPDDEAIRGGRELASTEGLLVGISSGAAVYAARQLAGRPEFKGKMIVTLLPDTGERYLTTELFAFDAYPLD

SEQ ID NO: 18693 - protein, 1573 aa, Chlamydomonas reinhardtii
MSKRMRAGRARAGWALASLFALALLLMPVLLLAAEGDTLSRAGRSLAEYRPHALESSASAGDGPGPLLVTLLDGRVVAVVPDSGQVLWSYDTGSPLVTVKQGHAMSPGVRIFPGVDGGLYAYGALAPAAPPGGGGGGSGGGSGAEGADGGGPGAEGEAEGASGPPGTKLERLPITLPELVDASPSLTDDGSVILGRRLTRVYVLDRDSGALLQTLAEGGGAAAAAAAGGGGGGAGGGHFAGFEGVETWNATYSRLVNLRPPGSSSSSSNTPAAATAGGFPPRGAGQAAAAALPEFTVGADHTLQAHDAASGIRRWAIAFDTPPVGVFAAQHGDTNYLDPTVVAGGGAGSGKVAAGGAAAAAAARRGGKGGAAAPGGALPAAAGAAGGGKMGKVLVGQLKGSLYALPADHVTLDASLEAQPWGALALAGPPGGGAAGVPQLPAAGGAADNAVAVIGGAGTATSTTDVVTYMTDADSGEGVVSGLVCPPGVHLLAFVDEPPAERPPLPWLPDAAKAAARSGGGGALAPAANIGGGGAAGNASGSGVGGGGGSWAAGGGGGGGSVVVVVAAGVAGAAAVLVVMHVRGGGAAGSTAASTGKAGGGSDVGGLAVEAVSANGGGGGGAYGKVGKGAGGARAQQQQGQRRKKGGAGGGGGGGGIRSHRSSDGGGGALPAIDEDAEVVVPPPPGQLAAVAAAAAAMPPPGSPTPANASQHLPSAEARVRVNPDGSLLIGRLRVGPAILGYGSSGTVVYEGCLDGRQVAVKRLLRQFTELARKEIEVLILSDEHPNVVRCFALEEDREFVYLALERCRSTLCDFLATPAGRSQFVDPASRQPTARCTAAMLDICRGLAALHERGIVHRDLKPHNVLLTETLGSCGWSRAKLSDMGLSKQLVPEQSSFHLLESSTHGAGGSSGWQLSCPYRSPCGGLGGGRHPFGDNTYERDANILNGAPAVAALAAAAGPEAANLVWACLAKDPAARPCMAAVLGHPLWWGEERRLGFLIDLSDRIENEDREPDQSLLEALECHARVALSGPAVALEGAVAAGGEAAATTSSAGGAAAPALPPAIAAALAPIPNWGAALPPELLGNLGRYRRYDYTSLRDLMRVVRNKRNHFREMPQQLQAMLGPIPGGFLRYFAARFPRLLLAGYAFSLRYLAAEPNLQQYWGGGGGAGGGGAGGGGGGGGRGGGGGGSMGGAGEATTGAGSRQPFVQTFVSVYGPNLRPIKTALVLPATANSNGINGSSSTSSLSTAAAANGSSSAAPAAPAAAGGGSSERDGTSGGADASGAEGAAAAGGGAWGAVAVAAAAERSLSASSTEPTPAEAATATAANATPSNTPSKAAKSKKQPGGGGGGAAAAAAEPQQPGTPPPPPPAAEAEAAVAPSTAAAPSTPATSTPGAAATTAATPAPAFSSPAPAPSAPAPSSFATAAAAASATAATASNTTTASNTTTNNNNNNNSISTAVLVGYEPSGDDGDCHVREFPRRPGKQLCDFYVKTGHCKFADTCVFDHPVEHAVRLTALGLPLRPAEPVCTFYLKNNECGFGPACKFNHPMLRPVFAGSAASDAAAVPAGADQ

SEQ ID NO: 18694 - protein, 809 aa, Helicobacter hepaticus ATCC 51449
MKYIKFFKELNNKDVPIVGGKNASIGEMFQELVSEGIKVPNGFAITSEAYWYLLDSGSIREKIIDLLDGVDVTEIDVLKTRSKKIRELIFGTPFPDDLRKEIFQAYEILSGEYGMKEADVAVRSSATAEDLPDASFAGQQDTYLNVKGKTELIHYIKSCLASLFTDRAVSYRASRGFDHFKVALSVGVQKMVRADKGSAGVMFSIDTETGFKDAVFITSSWGLGENVVGGTVNPDEFYVFKPTLKEGKRPIIKRQLGHKHQKMVYAPRGSEHPTKNIKTTQREMKTFSITDTDILTLARYAIKIEEHYTKEAGEYRPMDMEWAKDGDSGEIFIVQARPETVQSQKSKKSDGQKLEKFKFVNPEVKKEIILVGKAIGGKIGSGKVRIINDIEHMDSFKEGEILVTDNTDPDWEPAMKKAAAVITNRGGRTCHAAIVAREIGVPAIVGAIGATDRLYSGMEVTISCAEGEEGYIYDGIHEYEIETIELNNLGNPKTKIYMNVGNPEKAFSFSQIPNHGVGLARMELIILNQIKAHPLALLDIQNGNTKGLKEKSEIEKIISGYENPKDFFTKKIAEGIGMICSAFYPNPVIVRTSDFKSNEYRGMLGGMGYEPHEENPMLGYRGASRYYSEQYRIAFEWECQALAMVRNEMGLTNMKVMIPFLRTPEEGKKVLEIMRRNGLESGKNDLEIYVMCELPVNVILADDFLSMFDGFSIGSNDLTQLTLGVDRDGQLVSHIFDERNPAMFAMFKKAIESCKRHNKYIGICGQAPSDYPEVTEFLVKEGISSISLNPDSVIATWQKVVEVEKSLKK

SEQ ID NO: 18695 - protein, 477 aa, Aspergillus oryzae
MPPNKSVAVIGTGPAGAIAVDALVQEKSFDVVRVFERQEKAGGCWVSRENEEPVPLDIDNLSARTADGPVPIPDNLPRHVPTLSQHRYFDSHVYPTLHANVAASVMEYSQEQIPDILSEWSVNIHGPDTPFRHHTVIRQYIEDLLNRNGYQDFVEYNTTVERAEKDPQTGKWTLTLRRAGEPNGLDYWWTETFDALVVASGHYAVPYVPVIKGLKEFAEKYPGSVEHTKQYRGPEKYKGKRVITVGASVSAADTAVSLVNHAKGPVYAVVRGKYNTYFGDEAFKHPQIERRPPISHITTDNGARTVHFENGTSVSDVDHIIFGTGFTWTLPFLPNIPIRNNRVPDLYLHVFHQRDPSLVFLGAVGAGLTFKVFEWQAVAAARVLAGKAQLPSLEEQRKWEQDRIAKKGDGPGFMMINPDFEAYFEQLRQLAGEPAEGEPGRRLPPFKQQWVDDFNAGHERRIRMWKKANEAGRASKL

SEQ ID NO: 18696 - protein, 466 aa, Burkholderia xenovorans LB400
MPQHFNAVVIGTGQGGSPLAVRLGQSGRKTAVIERAAFGGTCVNVGCTPTKSYVASARAAHVARHCAELGVQVSGAISVDLAAVKARKDRIIGQSRDGVEKWLRGAQNVSVFNGHARFTGAHTLAISGPDGTVLEEISADEIFINTGTRAVVPPLEGIGRIRYYTNSNLLELTELPDHLVIVGGSYIALEFAQIFRRFGSRVTVLVRGERVLTREDADFAESVRKVLAREGVEFRFGVQPSRVEPHPHHPDEVCIGFEQNIPALEASHLLFATGREPNTDDLGLAAAGITTDRHGTIPVDGQLRTNVPGVWAIGDVNGRGAFTHTSYDDFQIVAANLLDGGARSVDTRIMAYAVFVDPPLARVGASEAEVRKAGRPALIATMPMSRVGRARERGETDGFMKVMVDRESRQILGAAIHGIEGDEAIHTFIDIMAAGAPYPTLQYAMHIHPTISELVPTLLDGLKPMQ

SEQ ID NO: 18697 - protein, 338 aa, Bacillus licheniformis ATCC 14580
MKAAVMTKPYSIEFHDIPRPEPASGEVLVKIKAAGICGSDVHFYDGSNPYAQYPQIFGHELAGIIEKTGAGVRGRSAGERVVIEPAIPCGGCYPCRKGRTNACMNIDMIGSVRRGGFADFIIVPETHVHPIPEQMDFATAALCEPFSIGAQAVRRADIQTGETIVILGMGPIGLTILAQVKKRFDVRVIAVDPVRERLELAEAFGADAVIQPGEEDAEQMILKLTGGEGAGIVFEAAGIPATIEQSVRLAAAAGRIVIVGLTGRNVTIPGLLLTKKDIEIYGTKHSVNQFPGVIQFLNENPEIARAFVTEIMPFMEIEEALKKAKNCPHQVTKIILSY

SEQ ID NO: 18698 - protein, 241 aa, Propionibacterium freudenreichii subsp. shermanii
LFRVSGDLSRKKLLPAVYDLANRGLLPPGFGLVGVARRDYTDAQFAEIVKQDVRENARTPFREETWKQLVTGIRFVWGDFDDEGTFKRLRSTLDELDNRQGADGNHAFYLSVPPRMFEVVVDQLEKFGMVDQSQGWKRVVIEKPFGHDLASAKDLYRAVSKAFPPESVFRIDHYLGKETVQNLLALRFANQMFEPIWNNNYVGHVQITMAEDIGIGGRAGYYDGIGAARDVIQNHLLQLMA

SEQ ID NO: 18699 - protein, 1183 aa, Oryza sativa Indica Group
MVETRRSSAAAASKRSLPVPFLLLRPSPEAPQDQGGDKAAVAVVESSRKKKEQQQQQQQQQQQATPWAKLLSQSSQSPHLPISVPQFSVAKLAALAYNVLLIFYVLSASLDVHSLEIALSIFLFYLLLSFTFLQIFQHPLNDKIPKMVPPSPVTLLEPPVAGVKRLRMENRTGDTSAVAGTELLASVSDQLKDLSAAPPASAGENNQRLVRPMASSASDKSKGNGIIPDKECENGENANEVNSNVEDSPLDVAAAPVVSPDAVPNDISQHNGFGSDAHLGAEIGKIATYKIRPVLRMIAGTTISEFDLTGDLFKALEDQRDLIRHLNSSASLPPSRCQAFKDGMKQGIISPNDIDVTFENFPYYLSDNTKNVLLSCAFIHLEKKEFIKQFSEISSINQRILLSGPAGSEIYQETLIKALAKHFGARLLVVDSLLLPGAPSKDPESQKDAAKSDKSGDKAGSEKLAILHKNRSSLADAMHFRRPAVQPSSVHADIVGTSTLHSASLPKQESSTATSKSYTFREGDRVRYVGPAQQSSLSQRGPSYGYRGRVMLAFEENGSSKIGVRFDKQIPDGNDLGGLCEEDHGFFCSADLLRPDFSGGEEVERLAMAELIEVISEEHKAGPMIVLLKDVEKSFTGITESLSSLRNKLEALPSGVLIIGSHTQMDSRKEKAHPGGFLFTKFASSSQTLFDLFPDSFGSRLHERNKESPKAMKHLNKLFPNKISIQLPQVLISLVILFKYYAQDETLLTDWKQQLDRDVETLKAKSNVGSIRTFLSRNGIECSDLEELFIKDQSLTNENVDKIVGYAVSYHLKHNKVEISKDGKLVLASESLKHGLNMLQNMQSDNKSSKKSLKDVVTENEFEKRLLADVIPPNDIGVTFDDIGALENVKDTLKELVMLPLQRPELFCKGQLTKPCKGILLFGPPGTGKTMLAKAVATEAGANFINISMSSITSKWFGEGEKYVKAVFSLASKIAPSVIFIDEVDSMLGRRENPGEHEAMRKMKNEFMVNWDGLRTKDKERVLVLGATNRPFDLDEAVIRRFPRRLMVNLPDASNREKILKVILAKEELAPGIDMDSLATMTDGYSGSDLKNLCVTAAHYPIREILEKEKKEKNVAKAEGRPEPALYGSEDIRPLTLDDFKSAHEQVCASVSSDSANMNELLQWNDLYGEGGSRKKKALSYFM

SEQ ID NO: 18700 - protein, 182 aa, Pseudomonas syringae pv. phaseolicola 1448A
MTFDQSNFKSLIRPVIDFPKPGVVFRDITPLFQSPKATRQVIDSFVQRYIEADFSHIGVMDARGFLIGSVVAYQLNKPLVLFRKQGKLPADVLSEAYQTEYGEAYLEVHADSLCEGDSVIMFDDLIATGGTLIAAANLIRRMGAEVHEAVAIIDLPELGGSKRLNDLKIPTFCLTEFALDEQ

SEQ ID NO: 18701 - protein, 670 aa, Saccharomyces cerevisiae YJM789
MMSNVANASQRQENPYIIPLPPSSTVETSTEPPRTLWMGDLDPSFDEATIEEIWSKLDKKVIVKLIRAKKNLLIPCSSTSSSNNNTSEENAENQQSASNSTDQLDNSQMININGISFIDPSTTQLHHAGYCFVEFETQKDAKFALSLNATPLPNFYSPTTNSQTNPTFKRTFRLNWASGATLQSSIPSTPEFSLFVGDLSPTATEADLLSLFQTRFKSVKTVRVMTDPLTGSSRCFGFVRFGDEDERRRALIEMSGKWFQGRALRVAYATPRNNMMLQLQEQQQQQQQLQQQHQQLDQEDNNGPLLIKTANNLIQNNSNMLPLNTLHNAPPMHLNEGGISNMRVNDSLPSNTYNTDPTNTTVFVGGLVPKTTEFQLRSLFKPFGPILNVTIPNGKNCGFVKFEKRIDAEASIQGLQGFIVGGSPIRLSWGRPSSSNAKTNSTIMGASQYMSSNGLRAPSAASSVDNSKQILEQYAEDKRRLFLHQQQQQQQQQDGNFSMEQMAHNNYYNYNNYDYHRNKNGSHSDLVNLQRSNVPYMQEDGALYPHQYSSPSYSLHPTGNQFSNANNNLPQFGNAMSISMQLPNGNSNKTASSMNTNPNTNMIMNSNMNMNMNVNPVPYGMGNGANMYDVSRMMTPPLNIAPNSNNSKSSIMNKHPNRNNVPPIHPSLLH

SEQ ID NO: 18702 - protein, 337 aa, Bacillus licheniformis ATCC 14580
MKQIVCEKPYRFKMTDVKMPELKDGEALVRIKRIGICGTDFHAYCGRQPFFSYPRVLGHELSGEIVSIDNSGGTLKPGDQVSIIPYLECGACIACRNGRPNCCVNLNVLGVHTDGGMREYINVPADHLLKTEGLTLSEAAVVECLSIGAHAAERANIKKGETVLVVGAGPIGLSVMKFAKLKGAKVIAMDVRKERLTFSRRWAEADEVVLGGEHAADEIKRLTNGDFPTAVFDATGHPASMNSAYQYAAHGGRLIYVGLVNDHLAMPDPEIHMRELTILSSRNALRRDFETVMKAIMDGGADANRFVNGQMAFHDVVDGFQSALAPETNPVKVLIHL

SEQ ID NO: 18703 - protein, 222 aa, Propionibacterium freudenreichii subsp. shermanii
MSMRITPSVLNADLADLAGEVARIPSADAVHIDVMDNHFVPNLTLGLPVVSSLQRHTKLPFDIHLMIEDADSWAPQYAEAGCESVTFHAEATSAPVRLAREIRRLGSAASLALRPATPIEPFADLIAEFDQVLIMTVEPGFGGQKFLDIMLPKIRRTRAIAAASGVELAIQVDGGVSVDTIGRCAEAGADVFVAGTAVFRATDPDEMVTTLRQTAMQAAHSH

SEQ ID NO: 18704 - protein, 925 aa, Oryza sativa
  misc_feature (335)..(335): Xaa can be any naturally occurring amino acid
  misc_feature (365)..(365): Xaa can be any naturally occurring amino acid
MEEAAAAVHRRWRRRLLPKLMLLLCAVVHGQQPDSLGFISIDCGIPDGGGYSDESTRGLRYVPDAGFLDAGAGLSAGINPPYTDRDLAARYLTVRYFPGAASAAGERGGCYTLRQLSPGGRYLVRATFYYGNYDGAIAMLPVVFDLHLGANRWTAVNVTAADAIYIFEAVVSPPADFLQVCLVNIGKGTPFISGLDLRPLKPELYPEATANQSLLLLNHDRPPARFAFNRYQFWRPASYYKLFRYPFDPYDRLWQPYGDDPSWTNITVAAAVDVTNISRSDDPSPILRSAATPANATVRRLDFPWSSDDAATTTYLLLLYFAELQRLPAGAARRXFDVLVDGDASAGGGRRGYTPRYLAAEVVRXDAKAMMEIRDNYELKKNWMGDPCAPKAFAWVGLNCGYSSSDPALVTALNLSSSVLIGPVNLSFGDLKSLQYLDLSNNSLSGPIPDFLVQMPALKFLDLSSNKLSGSIPSDLLQKRENGSLVLRIGNNANLCYNGANNTCAPESKQSKRILVIAIAVPIVAATLLFVAAKFILHRRRNKQDTWITNNARLISPHERSNVFENRQFTYRELKLMTSNFKEEIGKGGFGTVFLGYLEDGTPVAVKMCSKTSSEGDKKFLAEAQHLTRVHHRNLVSLIGYCKDKKHLALVYEYMQGGNLEDRLRGEASIAAPLTWHQRLKIALDSAQGLEYLHKSCQPPLIHRDVKTRNILLSGDLDAKIADFGLTKVFAGDVVTHVTTQPAGTLGYLDPEYYHTSRLSEKSDVYSFGVVLLELVTGRPPAVPLGDGDGGGGESVHLAVWARQRLAEGDIESVADAAMGGCFEVNSAWKVAELALRCKERPSRERPAMADVVAELKECLELEASRALGRGHSCYSSGSGGGSSVATTTTTSGAANISAAASAASVSDAQIGELRQESVLELGPR

SEQ ID NO: 18705 - protein, 401 aa, Saccharomyces cerevisiae
MENQEKPLSVDEEYDLWKSNVPLMYDFVSETRLTWPSLTVQWLPTPVQELDGGFIKQELIIGTHTSGEEENYLKFAEINLPKEILSNEDPQEEAGEEYQSSLPAPRSNIRITAKYEHEEEITRARYMPQDPNIVATINGQGTVFLYSRSEGLQSTLKFHKDNGYALSFSTLVKGRLLSGSDDHTVALWEVGSGGDPTKPVRTWNDLHSDIINDNKWHNFNKDLFGTVSEDSLLKINDVRANNTTIDTVKCPQPFNTLAFSHHSSNLLAAAGMDSYVYLYDLRNMKEPLHHMSGHEDAVNNLEFSTHVDGVVVSSGSDNRLMMWDLKQIGAEQTPDDAEDGVPELIMVHAGHRSSVNDFDLNPQIPWLVASAEEENILQVWKCSHSLPIVGGPPKVNKDIIS

SEQ ID NO: 18706 - protein, 302 aa, Physcomitrella patens subsp. patens
GHEKPEKPARSRNQSFVSGLAYCISSCGMILLNKTVLSGYGLKGGIALMFYQNVISVLLVVLLEFSGAIVTEPVTWRLVKVWFPVNCLFVGMLVTSTYSLKFMNVAMVTILKNVTNLITACGEIYFFNKHHSNKVWASLLLMVTSAISGGITDLSFHAVGYAWQIVNCFCTSAYSLRLRKVMDLAKQKTVSGTLNEFSMVLLNNLLSIPLGFILILIFERDIFSMPALRIPMFWVVATMSGVLGLAISFTSMWFLHQTSPTTHSLVGSLNKIPLSLAGIMIFKVPTSVPNMFSIFFGKLAAV

SEQ ID NO: 18707 - protein, 438 aa, Thermoproteus tenax
MPSLTAPSSSSLYLSRIFSTKNLFMRPSSFTDTLGFRTSSSSYISAIPSSSPSFDFNTWTSNGFLATSLFSFSCAAVVKDLCPIASSIKESNRLYRRTSFSNCAIFSSRIFLSSSNSSTTIVILTSIKSIVALVASIGNLNYDIYIKTHELPGLDQSVDALDLYTGGGGSAANFSVAIARLGHRARFIGAVGDDVIGEIILKELESEGVEVRYVKKIGGLRSGVVVVIVQPDGGKRMIAYRGANMGLSPDDINEASLGGVDHVHVASGRVELILKAKEVAKRDGKSISVDGGTSLARKGLEVAAKALSGVDVVFMNQAEAKLLSSSSDHRAALDVIARNIDAREIVVTLGDRGAMALSGGEFLYVDAFRLQALDTTGAGDTFAAAYIAARLMGLSLYERLLFANAAASIKVTRPGARSSPRLSEVLEFLRSLGYRLAE

SEQ ID NO: 18708 - protein, 133 aa, Vitis vinifera
MLSRLIKKSGKKAPKTPATPQVQSTGSKTLFVSNLSFSIQKEDVEHFFKDAGEVVDVRFSSDADGRFKGFGHVEFATPEAAQKALKVNGKDLLGRAVRLDLARKRGAYTPYNGKESNSFQKGGSQAQTIFVRG

SEQ ID NO: 18709 - protein, 819 aa, Serratia marcescens
MRVLKFGGTSVANAERFLRVADIMESNARQGQVATVLSAPAKITNHLVAMIDKTVAGQDILPNMSDAERIFADLLSGLAQALPGFEYDRLKGVVDQEFAQLKQVLHGVSLLGQCPDSVNAAIICRGEKLSIAIMEGVFRAKGYPVTVINPVEKLLAQGHYLESTVDIAESTLRIAAAAIPADHIVLMAGFTAGNDKGELVVLGRNGSDYSAAVLAACLRADCCEIWTDVDGVYTCDPRTVPDARLLKSMSYQEAMELSYFGAKVLHPRTITPIAQFQIPCLIKNTSNPQAPGTLIGKDSTDADMPVKGITNLNNMAMINVSGPGMKGMVDMAARVFAVMSRAGISVVLITQSSSEYSISFCVPQGELQRARRALEEEFYLELKDGVLDPLDVMERLAIISVVGDGMRTLRGISARFFSALARANINIVAIAQGSSERSISVVVSNDSATTGVRVSHQMLFNTDQVIEVFVIGVGGVGGALIEQIYRQQPWLKQKHIDLRVCGIANSRVMLTNVHGIALDSWRDALAGAQEPFNLGRLIRLVKEYHLLNPVIVDCTSSQAVADQYVDFLADGFHVVTPNKKANTSSMNYYQQLRAAAAGSHRKFLYDTNVGAGLPVIENLQNLLNAGDELVRFSGILSGSLSFIFGKLDEGLSLSAATLQARANGYTEPDPRDDLSGMDVARKLLILAREAGYKLELSDIEVEPVLPPSFDASGDVDTFLARLPELDKEFARNVANAAEQGKVLRYVGLIDEGRCKVRIEAVDGNDPLYKVKNGENALAFYSRYYQPLPLVLRGYGAGNDVTAAGVFADLLRTLSWKLGV

SEQ ID NO: 18710 - protein, 412 aa, Thermoproteus tenax
MDTTIEELLARRILTGRGDQTIEVEVYTADGFGKAAAPAGASKGKHEVAFLPEGGIDAALSAFERLVSPELAGVDAAEQYAVDGKLEEVDGTGRFERIGGAVAIAVSMAAARAAANTLGIPLFRHLGGAPARTLPLPLGNAIGGGKHSRGLGPDLQEFLVIPLNPPDIATAVLANLEVHKRALKYIVKADPHFTGGKNDEGAWTPRISAETALKILKESAAEVSKEIGVEIGLGVDAAASSLWNGSKYVYQNEGKERGPREQLEYMARLLDEFGLVYLEDPFHEDDFQSFAELTSRFKDRLIVGDDLYVTNAARIERGGREGATTAALIKPDQTGTLTRAHEAVKTARRYGMRIVVSHRSGDTEYDTLAHIAVAFGAEVIKTGIVGGERTAKLNELIRIGDYLGKWGRISSL

SEQ ID NO: 18711 - protein, 535 aa, Shewanella sp. ANA-3
MTQLSSRINARSDEFKAKSDDMAALVADLKTKLAKIELGGGPVALERHLARGKLLPRQRVEKLLDAGSPFLELSQFAAFDVYDEEVPAAGIIAGIGRVSGVECMIIANDATVKGGTYYPITVKKHLRAQEIASRCHLPCIYLVDSGGANLPRQDEVFPDRDHFGRIFYNQAQMSAKGIPQIAVVMGLCTAGGAYVPAMADESIIVKEQGTIFLAGPPLVKAATGEEVSAEELGGADVHTKISGVADHLAQNDEHALELARRAVLRLNHQKQINSLLSPVKPPKFDISELYGIVGTDLKKPFDVKEVIARIVDDSDFDEFKANYGATLVCGFARIHGYPVGIVANNGILFSESAQKGAHFIELCCQRKIPLLFLQNITGFMVGKKYEHEGIAKHGAKMVTAVSCANVPKFTVIIGGSYGAGNYGMCGRAFEPTMMWMWPNARISVMGGEQAAGVLATVRRDGLARKGEEWSAEDEKAFKAPIIAQYDKEGHPYHASARLWDDGIIDPAQTRDVVGLALSAALNAPIEDTRFGVFRM

SEQ ID NO: 18712 - protein, 357 aa, Xylella fastidiosa 9a5c
MSKQILILPGDGIGHEIVAEAVKVLEHVNVRHTLNLRLSFDALGGAAYEKYGSPLADETLARARDADAVLLGAVGGPQWDTIDPALRPERGLLKIRAQLGLFANLRPALLYPQLADASTLKPEVVAGLDILIVRELTGGLYFGQPRGSRISKNGEREAFDTLPYCESEIRRILKVGFEMARLRGKKLCSVDKANVLASSQLWRTVAGEMAKDYPDVTLSHMYVDNAAMQLVRHPKQFDVIVTENMFGDILSDQASMLTGSIGMLPSASLDANNKGMYEPCHGSAPDIAGQGVANPLATILSVAMLLRYSMGHIKTADAIEHAVGVVLDSGLRTADIWSEGMTKVGTVAMGDAVVAAL

SEQ ID NO: 18713 - protein, 765 aa, Zea mays
MAVLGTAAVEVLIPVAALVGIAFALLQWYVVARVPVPSHAGEDGGGGGNKNVREEEEHVEEDGMDYLLVEARCAEIQRAISVGATSFLLTEYKYLAVFTAAFAVVIFVFLGSAQRFSARPGPCAYDPSRECRPALANAAFSAVAFLLGAATSVLSGYLGMRVATFANARTALEARHGVGRAFAAAFRSGAAMGFLLASSALLVLYAAVNLFGLYYGDDWGGLYESITGYGLGGSSVALFGRVGGGIYTKAADVGADLVGKVERNIPEDDPRNPAVIADNVGDNVGDIAGMGSDLFGSYAESSCAALFVASISSFGAEHNLTAMMYPLLISAVGLLVCAITTVVATDVTEVKGSDEVGPALKRQILISTVLMTAGIAAVTFLALPPSFTLFDFGNDKHVKNWHLFICVSAGLWAGLVIGYVTEYFTSNAYGPVQAVARSCRTGAATNVIFGLAVGYKSVIVPIMAIAAAIYASFRLAAMYGIALAALGMLSTIATGLAIDAYGPISDNAGGIAEMAGMPHRVRERTDALDAAGNTTAAIGKGFAIGSAALVSLALFGAYVSRAGITAVDVLSPRVFVGLLLGAMLPYWFSAMTMRSVGSAALRMVEEVRRQFDTIPGLAEGLAVPDYATCVRISTDASLKKMMAPGALVMFSPLVAGTLFGVETLAGLLAGALVSGVQVAISASNSGGAWDNAKKYIEAGLSEEARSLGPKGSEAHKAAVIGDTIGDPLKDTSGPSLNILIKLMAVESLVFAPFFAAHGGIIFDHL

SEQ ID NO: 18714 - protein, 150 aa, Triticum aestivum
AYLGDTLEQVCTKKQVATGPEFPGYRRPTRPLARICKGGCIIRASFLDRIKKAYDRNGELANLLIDPEFAQEIMDRQAAWRRVVCLAINNGVSTPGMSASLAYFDSYRRDRLPANLVQAQRDYFGAHTYERVDMPGSFHTEWYKIANSKI

SEQ ID NO: 18715 - protein, 336 aa, Bacteroides fragilis YCH46
MKALVTGAAGFIGSYTVKALVAQGCEVVGLDNINSYYDVQLKYDRLADTGITKESIEKDILLPSAKYPSYRFIKMDLTDREGLTNLFKDEHFDIVVNLAAQAGVRYSIENPYAYIESNIVGFLNLLECCRHYPVNHLVYASSSSIYGLNDKVPYAETDKADSPVSLYAATKKSNELMAHAYSKLYSIPTTGVRFFTVYGPWGRPDMAPCLFMKAILNGDPIKVFNNGQMRRDFTYIDDIIAGLMKIIAHPSADPIPFYIYNIGNSAPVELMDFISVIEKTAGKTAIKQMMGMQPGDVVCTYADTGRLEKDFGYKPSTSIEEGIQKFYDWYVGYFNK

SEQ ID NO: 18716 - protein, 574 aa, Yarrowia lipolytica CLIB122
MGLNFINKLTKSASPSYDEKERENVSVNSADGLGTEPRIMEAGDPHGSDSSILNLGNGEIIDKTSDDRKQIGVMSAVFLIFNRMVGTGIFATPSTIYLLSGSVGLALIMWVVGALIAGAGLMVYLEWGTTIPKNGGEKNYLEYVYRKPKFLITAMFASYVFLLGWAAPNSVIFGEYILNAAEVEVTRWNQRGIGLGCLSFCFLIHSISVKWGLRLQNFLGVFKLIVIALITIVGWIALGGGLKHVKDPHANFRNAFSGSEKATGYGIVMALYNVIWSFIGYSNANYALSEAKNPVRTLKIAGPLALIMVAIFYMFCNISYFAVVPREQIGESGRILAATFFRVAFNESAEKAMSVFVALSALGNVLSVIFSQGRIIQELGREGVLPFSSFFASNKPFNSPFPGLFEHYCVSIVILLAPPPGDAYNFISNLITYPLSAINVVVSLGLLWVHFDRWRHARNPNLPPSIFADFNPPIKATIPVTIFFMLASLYLVVAPFLSPDADQSVYKDLPYWLHCVVGIALFAAGAVYWLFWAIIFPKLFNYKLVKQTVIGSDGWSRTVITRVKNGEIGEGEEF

SEQ ID NO: 18717 - protein, 686 aa, Oryza sativa
MRAAWRPASGRRVALAAMVVLSVVVAAAMADDLAGDARALLAFRDAVGRHVAWNGSDPGGACSWTGVTCEGGRVAVLRLPGAALAGRVPEGTLGNLTALHTLSLRLNALAGALPGDLTSAAALRNVFLNGNRLSGEFPRAFLALQGLVRLAIGGNDLSGSIPPALGNLTRLKVLLLENNRFSGEIPDLKQPLQQFNVSFNQLNGSIPATLRTMPRSAFLGTGLCGGPLGPCPGEVSPSPAPGEQPVSPTPANNGDKGGNGGESGKKSKKLSGGAIAGIAIGSAVGAALLLFLLICLCCRSGRTKTRSMEMPPPPSSAPAVVAAGRKPPEMTSAAAVAPMATVGNPHAPLGQSTSGKKLIFFGSAAAVAPFDLEDLLRASAEVLGKGAFGTTYKAVLESGATVAVKRLKDVTLTEPEFRDRIADIGELQHEFIVPLRAYYYSKDEKLFVYDFMPMGSLSAVLHGNRGSGRTPLNWETRSSIALAAARGVEYIHSTSSSASHGNIKSSNVLLNKSYQARLSDNGLSALVGPSSAPSRASGYRAPEVTDPRRVSQKADVYSFGVLLLELLTGKAPSQAALNDEGVDLPRWVQSVVRSEWTAEVFDMELLRYQNVEEQMVQLLQLAIDCVAQVPDARPSMPHVVLRIEEIKKSSERLEGRDPQQQASNLEAGDDQTSKPESAEGLNPFAP

SEQ ID NO: 18718 - protein, 269 aa, Mesorhizobium sp. BNC1
MGKRVVLVGCGNMGYAMMKGWLAAGKLSAADISVVEPNDELRARAADCGVSVAAQPDALPWREADLVIFAVKPQMVHQVVPDYRFFAPGATFLSVAAGAGISLFEELLGHNAAVVRCMPNTPAAIGKGMLVIVSNGNVRPQTKEFVNELLATNGAVATIEDESLMDTVTAVSGSGPAYVFHFIECLTAAGEQAGLPSQTAKQLAMQTVYGAAVLAKESGEEPGMLREQVTSPNGTTAAALKVLMGEERLQRLLGEAVEAARQRSIELGK

SEQ ID NO: 18719 - protein, 353 aa, Bacteroides fragilis YCH46
MDFKIAVLAGDGIGPEISVQGVEVMSAVCEKFGHKVNYEYAICGADAIDKVGDPFPEETYRVCKNADAVLFSAVGDPKFDNDPTAKVRPEQGLLAMRKKLGLFANIRPVQTFKCLVHKSPLRAELVEGADFLCIRELTGGMYFGEKYQDNDKAYDTNMYTRPEIERILKVGFEYAMKRRKHLTVVDKANVLASSRLWRQIAQEMAPQYPEVTTDYMFVDNAAMKMIQEPKFFDVMVTENTFGDILTDEGSVISGSMGLLPSASTGESTPVFEPIHGSWPQAKGLNIANPLAQILSVAMLFEYFDCKAEGALIRKAVDASLDANVRTPEIQVEGGEKFGTKEVGAWIVDYIRKA

SEQ ID NO: 18720 - protein, 360 aa, Arabidopsis thaliana
MATAMEEPRKLRGHKSTATCCIASRDRPGIVLTSGEDGCICWFDLRCKDVQFIIDVGTEPVSSLCFKTGNENILYASCGNEIKSFDVHTLSATSWKPLESYNYNKDEVNQVVCNGRSSFLASADDSGDVKMIDLGQKCLYKTLRAGHTSICSSVQFIPWRPWEVITGGLDSKLVLWDFSKGRSQKIIDFGSDTNNNSGQCLNPAFVHSIAIPEMDMVDKLDKICAVARGDGIVNLINIESELSRKGTSSKGSSSSSSNNVVKRVCLDYSVGGHNSAVSCVAFSLFQEKGRFLISGGNDKTVKIWDCFKCLDPNNNNNNSDLLHLNINLSKKVNWLCTNQSDSENLVVCDTTRVVKVYSIS

SEQ ID NO: 18721 - protein, 189 aa, Picea sitchensis
MAGSNGPNWDGLLKWSLSHSDGTESTRQLSDEDRRWFMEAMQAQTMDVVKRMKEISIVMQTPQEVLEAQGVTVEEMEGLLEELQEHVESIDMANDLHTIGGLVPLLGYLKNPHASLRARAAEVVSTIVQNNPKSQQLVMEANGLELLLSNFISDSDITVRTKALGAISCKFNADIFMIFSDDLKYLIII

SEQ ID NO: 18722 - protein, 99 aa, Brassica napus
  misc_feature (31)..(31): Xaa can be any naturally occurring amino acid
MATGMGQIYQRDGGNLFFLNPTNRFFFVPFXKEELVKDCFPKGPKLVQAIADPFLNFPFTESVVGPLVQLPLLTTKLLKENHLPRPKPPPKWKEFVFKK

SEQ ID NO: 18723 - protein, 170 aa, Oryza sativa
KWGWRWQWTPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 18724 - protein, 356 aa, Magnaporthe grisea 70-15
MADIMSTNDIKLPEPFASIPRETFLFGPSPIQHLERISEALGGKVNVYAKRDDCNSGLAYGGNKTRKLEYLAAEAKAQGADTLVSIGGVQSNHTRQVAAVSTKLGLKAVLVQEHWVPDWSDPVYGKVGNIQLSRLMGADVKLDPSGFGIEHKNSLAAAVAELQSQGRRPYAIPAGASDHPLGGLGFARWAFEVEEQERQMGVFFDTVIVCAVTGSTMAGMVAGFKLAQKKCGSKPRRVIGIDASATVPQTKEQVLRIAQVTGRKIGLEDGVDNVTTEDVELDDRYHAGIYGVPDQQTKDAIRFGASTEAFITDPVYEGKSLAGMMDMIRKGEIKPGSNVLYAHLGGQLALNAYSDM

SEQ ID NO: 18725 - protein, 485 aa, Propionibacterium freudenreichii subsp. shermanii
MTQTAPSSQTKANIGVVGMAVMGSNLARNLAHHDYTVAVFNRTYARTQKLIAEHGNEGSFIPSEKIEDFVNSIATPRSIILMVKAGAPTDATIDELLPLLSPGDIIMDGGNSYFGDTIRREKAIAAKGFHFVGAGISGGETGALEGPSIMPGGSPESYKILGPMLETISAHYHGDPCCAWMGPNGAGHFVKMIHNGIEYSDMQVIGEAYELLRGVGLTNAECADVFAEWNKGDLDSYLIEITSIVLRQKDPRTGADLIDVIKDRAQMKGTGTWTVQTALELGVPTNGIAEAVFARAESSHDDLRAAARKYLAGPDGTVSVDDRTAFIEDVRKALWCSKVVSYAQGFDEIRTGGQEYDWNINVAEAAKIWRAGCIIRAKLLERIRQAYTDDPDLVSLMAASSVSAEMEANQSAWRRVVSKAAESGVPAPVFSATLAYYDMARAPRVNAALTQAMRDYFGSHTYERVDDHGHFHIEWTGDHSETRID

SEQ ID NO: 18726 - protein, 324 aa, Chlamydomonas reinhardtii
MDAYEKIEKIGEGTYGKVYKARDINTGKLVALKKCRLEMEEEGVPSTTLREISLLQMLSESNHIVKLLCVEHTEENNKPCLYLVFEYLNTDMKKWMDRHGKGPAHPLPSMHIKSMVYQLIKGVAYCHMHGVLHRDLKPQNLLVDDEKMCLKVADLGLGRHFSVPLKSYTHEIVTLWYRAPEVLLGATHYATPVDMWSVGCIFAELVRKAPLFPGDSEYQQLLHIFKLLGTPSEDTWPGVTKLRDWHEWPQWQPQDLHRIFPSLDDSGIDLMKRCFAYDPAIRISAKEAINHPYFDDLDKVTVDALESQEVRDRMAEAAAANVVC

SEQ ID NO: 18727 - protein, 154 aa, Populus trichocarpa x Populus deltoides
MQQAIPYKSWPPLYTNNKPLISPFQLIAGRHSNGGVVATQEVLKGSGNMSKMVQENAIIVFARRGCCMSLVAKRLLLGLGVNPAVYEIDEADEISVLEELEMICNDGGKGSKKKVQFPALFIGGKLFGGLDKLMAAHISGELVPILKEAGALWL

SEQ ID NO: 18728 - protein, 520 aa, Burkholderia thailandensis E264
MSHKRNTFALFDCTAGRRDAAGGRNFIGLSARVHPEKRPAQAERITYPKFRRRPFVVSDRRTRAPPVRTPRPPPGRVRQTVRRTAIMNSRPLAVRRASRRPSASGGPGGGGRWAAFVGAGVLVAVGYMDPGNWATALAGGAGYGYALLGVVIAASLMAMLLQWLAARIGVVSGRDLAQLCRERFDPRATVPLWIAAEIAIVACDVAEVVGAAVALQMLLGVSLTAGVLISAIATLAMLALERHGRRTLEAAIASLILFVGLCFVIEVALARPDWHAALAGAAPSPRLLREPGMLWLAAGILGATVMPHNLYLHSMLVKHHASERDEQSIRRALFGVNLDTFVSLGFAFVINAALLIVAAAVFHASGHDEVTDLADAHRLIAPLVGNHWAGLLFAAALLACGLSATVTGTLAGQAIMEGFLKLSLPRWQRALLTRALAIGPALAAVGLFGQHGSNQLLVASQVVLSLQLPLAMVPLIVFASSRALMGNWRVRGLPLAAAWACAAVILLLNGALVWQIAAAQ

SEQ ID NO: 18729 - protein, 254 aa, Bacillus cereus ATCC 10987
MKEKVVIVTGGSSGMGKGMATRFAKEGARVVITGRTKEKLEETKLEIEQFPGQILPVQMDVRNTDDIQKMIEQIDEKFGRIDILINNAAGNFICPAEDLSVNGWNSVINIVLNGTFYCSQAVGKYWIEKGIKGNIINMVATYAWDAGPGVIHSAAAKAGVLAMTKTLAVEWGRKYGIRVNAIAPGPIERTGGADKLWISEEMAKRTIQSVPLGRLGTPEEIAGLAYYLCSDEAAYINGTCMTMDGGQHLHQYPF

SEQ ID NO: 18730 - protein, 342 aa, Mesorhizobium loti MAFF303099
MKVLVTGAAGFIGYHVARRLLERGDEVVGIDSVNDYYDPRIKQARLRLLAEASRGSNAGYHFIHGNLAEREIVDGCFADHDFDRVIHLAAQAGVRYSLENPRAYVESNIVAFTNMLEACRNAGMAHLTYASTSSVYGANTDMPFSEHRPADHPLQFYAATKRANELMAHSYSHLFGLPTTGLRFFTVYGPWGRPDMALFLFTRSILAGEPIKLFNNGNHTRDFTYIDDIAEGVIRASDSPAAGNPAWDSGHPDPATSSAPWRIFNIGNNNPVKLTAYVEALESALGRKAVIELLPLQAGDVPDTFADTTALQEAVGYRPGTSVSDGVGRFVEWYKAYFGWGG

SEQ ID NO: 18731 - protein, 510 aa, Mycobacterium tuberculosis CDC1551
MATQISHFIDGQRTAGQSTRSADVFDPNTGQIQAKVPMAGKSDIDAAVASAVEAQKGWAAWNPQRRARVLMRFIELVNDTIDELAELLSREHGKTLADARGDVQRGIEVIEFCLGIPHLLKGEYTEGAGPGIDVYSLRQPLGVVAGITPFNFPAMIPLWKAGPALACGNAFVLKPSERDPSVPVRLAELFIEAGLPAGVFQVVHGDKEAVDAILHHPDIKAVGFVGSSDIAQYIYAGAAATGKRAQCFGGAKNHMIVMPDADLDQAVDALIGAGYGSAGERCMAISVAVPVGDQTAERLRARLIERINNLRVGHSLDPKADYGPLVTGAALARVRDYIGQGVAAGAELVVDGRDRASDDLTFGLPEGDANLEGGFFIGPTLFDHVAAHMSIYTDEIFGPVLCMVRARDYEEALRLPSEHEYGNGVAIFTRDGDAARDFVSRVQVGMVGVNVPIPVPVAYHTFGGWKRSGFGDLNQHGPAAIQFYTKVKTVTSRWPSGIKDGAEFVIPTMS

SEQ ID NO: 18732 - protein, 405 aa, Halobacterium sp. NRC-1
MGPMETYVVTEPALVERLLVSDAAEFRKPEFQADAIDDLLGDGLLLSEGESWREQRGRANPAFSMARVAGFDADIAAHAADRVDDWPVGDTVDVEAAMTHITLDVILDVMLGVSLPEARVDAIGDALEPVGARFEPDPVRFAVPEWLPMPDDREYAAAVATLDDLVDDIVAAREGTASGGDGDDPMDLLSVLLRARDRGEQSLDRLRDEVMTTLLAGHDTTALTLTYTWFLLSEHPDVEARLHAELDGALDDGAQPTVAQLQDLDYLEWVLQESMRLYPPVYNVFRTPIEPVELAGSEVPAGAPIMLPQWAIHRSPDHWDDPEAFDPERWRPERRADRPRFAYFPFGGGPRHCIGKQLALLEAKLIVATVASDYRLRYEGDTPLSFVPSLTIHPEQEMRMRVEPR

SEQ ID NO: 18733 - protein, 819 aa, Serratia marcescens
MRVLKFGGTSVANAERFLRVADIMESNARQGQVATVLSAPAKITNHLVAMIDKTVAGQDILPNMSDAERIFADLLSGLAQALPGFEYDRLKGVVDQEFAQLKQVLHGVSLLGQCPDSVNAAIICRGEKLSIAIMEGVFRAKGYPVTVINPVEKLLAQGHYLESTVDIAESTLRIAAAAIPADHIVLMAGFTAGNDKGELVVLGRNGSDYSAAVLAACLRADCCEIWTDVDGVYTCDPRTVPDARLLKSMSYQEAMELSYFGAKVLHPRTITPIAQFQIPCLIKNTSNPQAPGTLIGKDSTDADMPVKGITNLNNMAMINVSGPGMKGMVGMAARVFAVMSRAGISVVLITQSSSEYSISFCVPQGELQRARRALEEEFYLELKDGVLDPLDVMERLAIISVVGDGMRTLRGISARFFSALARANINIVAIAQGSSERSISVVVSNDSATTGVRVSHQMLFNTDQVIEVFVIGVGGVGGTLIEQIYRQQPWLKQKHIDLRVCGIANSRVMLTNVHGIALDSWRDALAGAQEPFNLGRLIRLVKEYHLLNPVIVDCTSSQAVADQYVDFLADGFHVVTPNKKANTSSMNYYQQLRAAAAGSHRKFLYDTNVGAGLPVIENLQNLLNAGDELVRFSGILSGSLSFIFGKLDEGLSLSAATLQARANGYTEPDPRDDLSGMDVARKLLILAREAGYKLELSDIEVEPVLPPSFDASGDVDTFLARLPELDKEFARNVANAAEQGKVLRYVGLIDEGRCKVRIEAVDGNDPLYKVKNGENALAFYSRYYQPLPLVLRGYGAGNDVTAAGVFADLLRTLSWKLGV

SEQ ID NO: 18734 - protein, 500 aa, Oryza sativa Japonica Group
MDLTTGAIWLFLAQLFVAATMLSKIATRERTRTTGTKFSRPPPPPLARGAPLVGVLPSLLANGPVEFIRHHYEKMGSVFTVSLLQQKVTFLVGSEASSHFYKGLDSEISQDEVSQFTIPTFGPGVAFDVDYATRHEQFRFFGDIMKPAKLRTYVDLMVAEVEGYFARWGQSGTVNMKQEFEQLVTLIASRCLLGEEVRDKMFDEVSTLLRELNDGMRLVTILFPRLPIPAHRRRDRARARLGEIFSDIVRSRRGSSGGGGGGGGARHDDMLQCLIDARYKDGRATTETEVAGMLVAALFAGQHTSSSTSTWAGARLLTNPDHLRAAVEEQARLLRRHGGDRVDHAALAAMDTLQRCVKETLRLHPPALMLLRHARRSFVVRGGSGEREYEVPEGHTVASPLLLHNALPRVYRDPGEFDPGRFGAGREEGAGGLAYTAFGGGRHACVGEAFAYMQIKVIWSHLLRNFELQLVSPFPETDWTVVMPGPKGKVMVTYNRRKLT

SEQ ID NO: 18735 - protein, 508 aa, Shewanella sp. ANA-3
MQNHSNLNDIGVIGLGVMGKNLALNIADNQYRVSAFDLDPVKVNGVLQQEKQERVGQELRITGCANLSEMLASLAHPRILVLSVPAGAPVDGVCHALISAGIEADDIVIDTGNSLWTDTVEREKRYQGKFIFFSSAVSGGEVGARFGPSLMPSGDLGAWQNVAPIWKAIAAKVDPQTGLPIERFEPGNPVTDGEPCTTYIGPAGAGHYVKMVHNGIEYADMQLICEAYQLMLDGLGMSAAQVGEVFERWNKGSLNSYLMGISAEVLKQADPLTGQPLVEMILDKAGQKGTGLWTAVSSLQIGCPAPTIAEAVYARAVSTQKSLRVELSKKLAGPASVAMDDAQKASLIDALESALYCAKVCCYAQGFQLMAMTAQEQKWQLDFAEIAKIWRAGCIIRATFLQSITQAYQADADLSCLLMADIFATTLSEKQTEWRSAVAAAVMQGIPVPCISSALAYYDSYRSETLPANLLQGQRDFFGAHTFERLDKPAGEKYHLDWSAPNRVLIKL

SEQ ID NO: 18736 - protein, 819 aa, Serratia marcescens
MRVLKFGGTSVANAERFLRVADIMESNARQGQVATVLSAPAKITNHLVAMIDKTVAGQDILPNMSDAERIFADLLSGLAQALPGFEYDRLKGVVDQEFAQLKQVLHGVSLLGQCPDSVNAAIICRGEKLSIAIMEGVFRAKGYPVTVINPVEKLLAQGHYLESTVDIAESTLRIAAAAIPADHIVLMAGFTAGNDKGELVVLGRNGSDYSAAVLAACLRADCCEIWTDVDGVYTCDPRTVPDARLLKSMSYQEAMELSYFGAKVLHPRTITPIAQFQIPCLIKNTSNPQAPGTLIGKDSTDADMPVKGITNLNNMAMINVSGPGMKGMVGMAARVFAVMSRAGISVVLITQFSSEYSISFCVPQGELQRARRALEEEFYLELKDGVLDPLDVMERLAIISVVGDGMRTLRGISARFFSALARANINIVAIAQGSSERSISVVVSNDSATTGVRVSHQMLFNTDQVIEVFVIGVGGVGGALIEQIYRQQPWLKQKHIDLRVCGIANSRVMLTNVHGIALDSWRDALAGAQEPFNLGRLIRLVKEYHLLNPVIVDCTSSQAVADQYVDFLADGFHVVTPNKKANTSSMNYYQQLRAAAAGSHRKFLYDTNVGAGLPVIENLQNLLNAGDELVRFSGILSGSLSFIFGKLDEGLSLSAATLQARANGYTEPDPRDDLSGMDVARKLLILAREAGYKLELSDIEVEPVLPPSFDASGDVDTFLARLPELDKEFARNVANAAEQGKVLRYVGLIDEGRCKVRIEAVDGNDPLYKVKNGENALAFYSRYYQPLPLVLRGYGAGNDVTAAGVFADLLRTLSWKLGV

SEQ ID NO: 18737 - protein, 255 aa, Idiomarina baltica OS145
MQKQQTVLITGASSGLGEGMAREFASKGYHLCLCARRIERLEALKSEIEQAYPKANVYIAALDVNQHDDVFDVFERFKSEAGAIDKIVVNAGMGKGASLGTGYFAANRATAETNFVAALAQCEAAMGIFRAQERGHLITIASMSALRGMPRAMTVYAATKAGLASMSEGIRADLLKTYGNNSPIKVTTLFPGYIRSEINEKVKNTPFMIGTEEGCRKMVKAIEKAPVKAYVPGWPWCVIGFLMKRLPLSWVLKLT

SEQ ID NO: 18738 - protein, 139 aa, Wolbachia endosymbiont of Drosophila ananassae
MAIEKTLSILKPDAVKNNITGKINSYIESSGLKIIAQKMMLLTKKQAELFYEIHKDRPFFGELVEFMTSGSVIVQVLVGENAVSKYRQIMGATNPKQADKGTIRGDFADDISENRVHGSDSLENARKEIAFFFAECELV

SEQ ID NO: 18739 - protein, 171 aa, Magnaporthe grisea 70-15
MMSDYEVTLVNDNSKNSMLCSRVRKKHPLKAEPGRFTWSSQISTHTSPLASDLSTGSSTQTSTSCTSGSVCLDVINQTWSPMFDMINIFEVFLPQLLRYPNPTDPLNGEAAALMLREPKSYEAKVKEYVQRYASKEAAADAGNESEDDSDMSSVASFGDEDEEPAGTMDDV

SEQ ID NO: 18740 - protein, 153 aa, Zea mays
ASGDHSSSEHKVKDPNGAQVRDSRDKTSDKFEFIVQKRGVHRFCFTNKSPYHETIDFDVHVGHFSYFEQHAKDEHFAPLFEQIAKLDEALYNIQFEQHWLEAQTDRQAILNENMSRRAVHKALFESAALIAASVIQVYLLRRLFERKLGTSRV

SEQ ID NO: 18741 - protein, 383 aa, Thermus thermophilus HB8
MSGSLLLLFVFLSAFLAPPLSRLLRMPVPVGELVIGLLLGHFLAQGVALPEILGFLADFGFLLLMFLAGLEVDFNLLRQLERRHFVFYALYVVGMFLGAGLLAGLLGVGLAQALILALVSIGLMVATLRDMGILGRAFAKRVLILGVLGEVASLFGLTAMEKAAHYQGLLSLLKEVGIIALFFLLLFLAFRLAGLFLWWYPEVGRRLVYEEDPSAMGIRLSLALMFAAAVMSGLVGLESVLGAFLAGMILSYFLQKKHDLEAKLSAMGYGFLIPIFFIRTGMGIDLSGLDGRLLLEVGQALLLMLLIRLLPAPFLLLGGFRLREAFLAALLLAYPFTLMIAGTEIARSAHLLDERAALVLLLAAALSSLLFPWAAKMLLRFLR

SEQ ID NO: 18742 - protein, 353 aa, Arabidopsis thaliana
  misc_feature (13)..(13): Xaa can be any naturally occurring amino acid
  misc_feature (242)..(242): Xaa can be any naturally occurring amino acid
  misc_feature (276)..(276): Xaa can be any naturally occurring amino acid
  misc_feature (285)..(285): Xaa can be any naturally occurring amino acid
  misc_feature (296)..(296): Xaa can be any naturally occurring amino acid
  misc_feature (307)..(307): Xaa can be any naturally occurring amino acid
  misc_feature (316)..(316): Xaa can be any naturally occurring amino acid
MEEEKAAAYSDEXLTRKGEGAARFKQGLGFSTGANAVPERGSAIASSSSFLNQFVKASNHTKSTDNKDSEIRSIRDKLKKKPEDPRVPERSYRESSERRRYRSRERDERDKSHRRRSRSSERRSSYVDRERRRSRSRSAERRNRYGDRESRRRSNRSRSLSPRRERRSREDVKEKKPDYSRLIKGYDEMSAAEKVKAKMKLQLDETAEKDSSKGAGWERFEFGKEAPVDDEELEEGADDDTXLVKRMGQSYRASDSLYGLIKTCKAKREEQLKAPXPDEAMFGVXPTGQTPTGDTXGDDVTRDNLMXKDDEGESNXSGAISLLSEKVKICELSSFLLLSNQSRFLELHFRVCT

SEQ ID NO: 18743 - protein, 385 aa, Thermus thermophilus HB8 [sequence omitted]

SEQ ID NO: 18744 - protein, 638 aa, Haemophilus influenzae R2866
MIIFSNLSLKRGQTELLENASATINPKQKVGLVGKNGCGKSSLFALLKKELTPEGGEVNYPANWRVSWVNQETPALDISAIDYVIQGDREYCRLQQELEQANERNDGNAIARIHGQLETLDAWTIQSRAASLLNGLGFSQEETTQPVKAFSGGWRMRLNLAQALLCPSDLLLLDEPTNHLDLDAVIWLERWLVQYQGTLVLISHDRDFLDPIVTKILHIENQKLNEYTGDYSSFEVQRATKLAQQTAMYRQQQQKISHLQKYIDRFKAKATKAKQAQSRMKALERMELIAPAYVDNPFTFEFRPPQSLPNPLVMIEQASAGYGCGESAVEILSKIKLNLVPGSRIGLLGKNGAGKSTLIKLLAGELTALSGTVQLAKGVQLGYFAQHQLDTLRADESALWHMQKLAPEQTEQQVRDYLGSFAFHGDKVNQAVKSFSGGEKARLVLALIVWQRPNLLLLDEPTNHLDLDMRQALTEALVDYEGSLVVVSHDRHLLRNTVEEFYLVHNKKVEEFKGDLEDYQKWLSEQNSTSENKVSEKVGDNENSVQNRKEQKRREAELRQQTAPLRKKITQLEEKMNKFSSELASIENQLADAELYNAENKEKLTALLAQQVDVKKALDDVETEWMTAQEELEEMLQA

SEQ ID NO: 18745 - protein, 316 aa, Alteromonadales bacterium TW-7
MTQKNQFGPNGWTPENLSALHGKTYLITGANTGAGFQATRILLSKGANVVMLNRNPNKSVLAITKLKDEFGSGANVSFITLDLADLTSVRTACTEILIKVPQINALICNGAIAQVEQQQFTADGFESQLGVNHYGHFLLCGLLFERINTSKGRIVVVSSEGHKMGLKTIQFEDMNWDKNYNANKVYSQSKLAQMMFAYELQNKVKAADKNVEVYVCHPGASNTSLIRETASFATRLSWSFMVKLGVAQSAEKGAYPEVMCSAQSNLKQHAYYGPTGFLNFGGPVGECKLESFVLDKKVLTKLWTLSEQQTAFKWQL

SEQ ID NO: 18746 - protein, 392 aa, Triticum aestivum
  misc_feature (288)..(288): Xaa can be any naturally occurring amino acid
  misc_feature (317)..(317): Xaa can be any naturally occurring amino acid
MGVYLSTPKTEKLSEDGENDQLKFGLSSMQGWRASMEDAHSALLDIDEDTSFFGVFDGHGGKVVAKFCAKYLHREVLKSEVYLAGDLGAAVHGAFFRMDEMMRGQRGWRELQALGDKINQFTGMIEGLIWSPRGSDSNDRHDDWAFEEGPHSDFSGPTCGSTACVAMIRNSQLVVANAGDSRCVISRNGQAYNLSRDHKPELEAERERILKAGGYIQMGRVNGTINLSRAIGDMEFKQNKFLSPDKQMLTANPDVNTVELCDDDDFLVLACDGIWDCMSSQQLVDSIXHEHLKDPRAPFLQCVEKGSHNAWLPSTLXGEGCHNMTMILVQFKKPIDHGKNAGGGEQSAVGDKNVSAGEQSAVADKSASASDQSAVEDKNASVVDNQLSGQEC

SEQ ID NO: 18747 - protein, 490 aa, Mesorhizobium sp. BNC1
MTSQTIPVEPFDLVVFGATGDLCERKLLPALYQRQRAGQFSEPTRIIGSSRSELSDDQYRSFALDAIKAHVAKAEIDNRELDRFLTRVSYVSADATTGRGFKELKAAIGDSANVRAFYLAVAPSLFGSIVAQIDAHHIATPTSRVIVEKPIGRSLETAREVNDSIGRVFDEARIFRIDHYLGKETVQNLMALRFANALYEPLWNSAHVDHVQITVAESVGLEGRAGYYDKAGALRDMVQNHMLQLLCLVAMEVPASLDADAVRDEKLKVLRALRPINQLNSERVTVRGQYRAGASNGGAVKGYLEELGNGGSDTETFVAVKAEIGNWRWADVPFYLRTGKRMATRVSEIVIQFKPIPHSIFGDAAGRIFANQLVIRLQPDEGVKQWIMIKDPGPGGMRLRQIPLDMSFAESFHERNPDAYERLIMDVIRGNQTLFMRRDEVEAAWRWIDPIHAAWEERSQSVQPYTAGTWGPSASIALIERDGRTWHESF

SEQ ID NO: 18748 - protein, 370 aa, Helicobacter hepaticus ATCC 51449
MKKIKYRLKAEWEEQIAILMAFPHKNSDWAIHIEVARECFVRIIEQILYFESVILCVDINDDEGMALLHTHFKKHITFAQNETFKSYNQQYGLHIVRVPTNDTWARDFGGISVEAEGGIALFDFVFNGWGLKYPANYDNQITQNIVCEAFKNTHLSPLVKRIFSSYRPIKTDMILEGGSIESNGAGVLLTNTQCLLEKNRNSHLSQDEIESKLKEYFGLDSVLWLTQGYLAGDDTDSHIDTLARFISEDTIAYITCDDKQDEHFESLKSMEAELRALKQSNGEPYKLIPLPFTQAIYDEQGQRLPASYANFLFVNGGLLVPTYGDKNDKKALEILSLALPTRRVVGVDCRSLILWHGSLHCVSMQVYDTL

SEQ ID NO: 18749 - protein, 475 aa, Mesorhizobium sp. BNC1
MLDDSKAGRTNRGGRRTPAFLKNLRGVKGWKEARAWLEWRGIEDIECIAPDQAGVARGKMMPSKKFISNTSLALPSAVFMATISGEYPEDGNGFTYPEDDGDLKLVPDLSTLSVVPWETDPTAQVICDLAHQDGRAVEFSPRNVLRRVVAKYAEHGLKPIVAPEIEFYLVHKNPDPDYPLTPPVGRSGRPIGGGQGYSIAGVNEFDELIDDIYHFSEGQGLEIDTLIHEEGAGQLEINLRHGDPVELADQVFLFKRTIREAALKHEMYATFMAKPIQDQPGSAMHIHQSVVTLKGGRNVFSDENGEETDVFRHFIGGLQQHIPNALIMLAPYVNSYRRLTQAGSAPVNTRWGYDNRTTAFRVPRSDPNSRRVENRIPSSDANPYLALAASLACGLIGILQKIEPDAPAGTAVNTDVINLPRGLLEAVALFEADESLRNIVGDLFASTYAAIKRAEFETFMKVISPWEREYLLLNV

SEQ ID NO: 18750 - protein, 171 aa, Populus trichocarpa x Populus deltoides
MSAEVEYRCFVGGLAWATTDQVLQEAFSQYGEIIDSKIINDRETGRSRGFGFVTFGNEKAMRDAIDGMNGQDLDGRNITVNEAQSRGSGGGGGGGGYNRNSGGGGYGGGGRREGGGGYSRGGGGYGGGGSGYGSGGGGGGGGYGGGRDRGYGDGGSRYSSRGESEGGSWRS

SEQ ID NO: 18751 - protein, 86 aa, Arabidopsis thaliana
MASSMLSSAAVVTSPAQATMVAPFTGLKSSAAFPVTRKTNKDITSIASNGGRVSCMTQAGVSRPKAVKALKESNGDIVSAIMELTT

SEQ ID NO: 18752 - protein, 166 aa, Helicobacter hepaticus ATCC 51449
MGENPNKINVIIEIPYGSNIKYEVDKESGLVVVDRVMYGAMFYPANYGFVPNTLADDGDPVDVLVLNSYPLQAGSMIASRLIGVLIMEDESGMDEKLIAVPVSKIDPSFEKIQSLADLPQITLDRIKNFFETYKTLEPNKWVKVKEYKDKTAAQEILDKSIKAYKG

SEQ ID NO: 18753 - protein, 885 aa, Propionibacterium freudenreichii subsp. shermanii
MSEKYIYDLSEGDASMKSLLGGKGAGVAEMMRLGVPVPDGFTVTTQACIETMNNGGTWPAGLRDQISDALARFEERAGRKLGASEKPLLVSVRSGAVVSMPGMMDTILNLGISDESVAAVAAEANNERFAWDCYRRFIQMYGEVVEGLDAHIYEDALTAMKQRKGASQDTDLTAEDLKELTTEFKQISDDALGGAWPSDPREQLMRAVEAVFNSWQNPRAKVYRKANHISDDLGTAVNVMQMVFGNRGETSATGVCFTRNPSTGENALYGEFLTNAQGEDVVAGIRTPRPLIEMKEVLPQAYGELVDTMHKMETHYRDMQDMEFTVENGKLYMLQTRNGKRTAAAALKVASDLVDEGLIDKEEAVRRIEPDQLDQLLHPAIDPGQSATPITKGLPASPGAAVGAAVFDADTAAERGEAGEPVVLIRFETTPDDIHGVLQAQGVLTAHGGMTSHAAVVARGFGKPCVAGATDIKIDTEAKTMTVGGVTVHEGDTLTLNGSTGEVFNTALKLIPPRLNEDFLKVVGWADEIRDLGVEANADNGTDAAKARELGAEGIGLCRTEHMFFGDDRLPAMHEMILSENDEQRQVALDKILPMQQSDFEAIFTAMKGLPVTVRLLDPPLHEFMPDLVTQALKVQEMELKGADPTKLAEERRTLAQVKKLHEQNPMLGTRGCRLGMLYPQIPDMQARAIARAALAVLDREGETVDLQIMVPLVHLRQELQRQREIVVAAVDDELDKAGQKLDYLVGTMIELPRAALVADQIAQEADFFSFGTNDLTQTTLGISRDDAENGFLGWYEAQGVVKRDPFATIDVDGVGQLVRMGTEKGRAANPKLSVGVCGEHGGDPDSIAFFQSVGLDYVSCSPFRVPIARFAAAKAKLAQADASK

SEQ ID NO: 18754 - protein, 342 aa, Mycobacterium tuberculosis CDC1551
MEAAGMCRSDHHLVTGDIPMAGFPVLGGHEGAGIVTEVGPGVDDFAPGDHVVLAFIPSCGKCPSCQAGMRNLCDLGAGLLAGESVTDGSFRIQARGQNVYPMTLLGTFSPYMVVHRSSVVKIDPSVPFEVACLVGCGVTTGYGSAVRTADVRPGDDVAIVGLGGVGMAALQGAVSAGARYVFAVEPVEWKRDQALKFGATHVYPDINAALMGIAEVTYGLMAQKVIITVGKLDGADVDSYLTITAKGGTCVLTAIGSLVDTQVTLNLAMLTLLQKNIQGTIFGGGNPHYDIPKLLSMYKAGKLNLDDMVTTAYKLEQINDGYQDMLNGKNIRGVIRYTDDDR

SEQ ID NO: 18755 - protein, 226 aa, Thermoproteus tenax
MKHLLARKAAEYIREGSIVGLGSGSTAKAFIEELAKRVREDGLTVTLVSTSVDSELKAAEVGLDKYLAPLWAVDRIDIAVDGADELTRDRLFLKGGGGAMFREKVVDYRASTLIIIAESHKLVDRIPARHPIPIEVLPAAWRLVADDIVKRWGGKAVLRVCQCGGKLGPLVTDNGNYILDWAPPGPIDPALEDELRGIPGVIESGIFSKRRDAVVLLADERGVFEL

SEQ ID NO: 18756 - protein, 302 aa, Mycobacterium avium 104
MTRGLVIGESLIDIVEDAEYVGGSPLNVAVGLGRLGRDVDFLTYLADDDHGRRIAAYLKDAGVQLVSESRAAERTATARSTIAADGSADYEFDLDWRLSGIPPVAPPLFVHTGSIAAVRDPGCLAVAALIDTYRVSATVTFDPNVRPSLIADRELAVSRIEHLVERSDIVKVSAEDLHWIDPDRSPEQLAQTWLGLGPAVVAVTMADRGAVGYCAAGTARVPTRAVRVVDTVGAGDSFMAGLLDALWEAGLLGGDRRGALRDIGIDTLTSALDAASLSSALTIARAGADLPDRAAVQAALRR

SEQ ID NO: 18757 - protein, 388 aa, Idiomarina baltica OS145
MNLHEYQGKQLFKEFGLPVSEGFACDTADEAVEAAKRIGGDTWVVKCQVHAGGRGKAGGVKLVKSTDEVRAFAEQWLGKNLVTFQTDENGQPVAKILVESCTDIADELYLGAVVDRGSRKIVFMASTEGGVEIEKVAEETPEKILKVEIDPTVGAQPFQGRELGFKLGLSADQVKQFTKIFLGLAKMFEQYDLALLEINPLVITDEGNLHCLDAKVGIDSNALYRQPKIREMHDPSQDDAREAEAAKWELNYVALDGNIGCMVNGAGLAMGTMDIVKLSGGEPANFLDVGGGATKERVSEAFKIILSDSSVKAVLVNIFGGIVRCDMIAEGIIGAVEEVGVKVPVVVRLEGNNAELGTQKLNESGLNIIAAESLSDAADKVVAAAGGQ

SEQ ID NO: 18758 - protein, 484 aa, Candida albicans SC5314
MTPPKRRESSSSITNILTLNNLELGATAGEVRGAGAISEENGLVHHQHHLEDSEHYHTTQVEIESHFSTDDEINHPGNNFNDDQISHLPTIKIKYHRSNSVHSISSANSFDGANNISGDISLLPTIKVLGTGGTIASKGVSSHQTAGYEVDLTIEDLVSTIPDLSQTCQLEYEQVLNIDSKEMDNSSLLKLYHKIQLDLPHYDGIVITHGTDTMEETAFFLQSTINTFKPIVLCGSMRPSTAISSDGPMNLYQAIAIASNRESRGRGVLIALNDRIGSGFYITKSNANSLDTFKSIGQGYVGNFVNNEIRYFFPPAKPLGLTMFHINDLFSSSSSSSAIGGNDIIPCLPEVTIIYAHQGLNNEIFKFVINDLKSKGIILATMGAGSMSDKTNQYLSDLLINNPNYPIVYSKRSMDGMVPIGSLPKVLAVIKDAADNGKPATKKVPFVNAIAGGYLNPQKARILLQLCLNEGMDLSKIKNVFKTV

SEQ ID NO: 18759 - protein, 521 aa, Idiomarina baltica OS145
MAIDIKVPQLPESVADATIATWHVKPGDKVSRDQNLVDIETDKVVLEVVAEADGVIGEIIADEGTTVTAEEVIGKIEEGAGDDSNDDSDSKDSAEEDKKEESSSKDDNASEKSGSGEGSGEKIEVKVPQLPESVSDATIATWHVKAGDAVKRDQNLVDIETDKVVLEVVAPADGVLAEITQDEGATVGADDVIGTVEAGAAASGSADKSSAKSEETSTEQKDEGDSEVAGPAVRRLLGEHGLKPSDVKGTGKGGRVTKEDVEKHVKGQQSKSSSSSSQSASQQPQAAGDRDQKRVPMTRLRKRIAERLLQAKNDTAMLTTFNEINMKPIMDLRKKYKDVFEETHGTRLGFMGFYVKAVTEALKRFPDVNASIDGDDIVYHNFFDVSIAVSTPRGLVTPVLRDTDKMSIADMENGIRELAIKGRDGKLTLEEMQGGNFTITNGGVFGSLLSTPILNPPQSAILGMHKIQERPMVVDGKIEILPMMYLALSYDHRIIDGKQSVGFLVTVKELLEDPQRLILDI

SEQ ID NO: 18760 - protein, 371 aa, Pyrococcus furiosus DSM 3638
MKFPRKGIPQEEVMRELEKYTSKDLSFSSGKILGSMCTLPHELAKEVFCMYMDRNLGDPGLHPGTKKIEEEVIEMLSDLLHLERGYGHIVSGGTEANILAVRAFRNLADVENPELILPKSAHFSFIKAGEMLGVKLIWADLNPDYTVDVKDVEAKISENTIGIVGIAGTTGLGVVDDIPALSDLARDYGIPLHVDAAFGGFVIPFAKELGYDLPDFDFKLKGVQSITIDPHKMGMAPIPAGGIVFRHKKYLRAISVLAPYLAGGKIWQATITGTRPGASVLAVWALIKHLGFEGYMEIVDRAMKLSRWFAEEIKKTPGAWLVREPMLNIVSFKTKNLRRVERELKSRGWGISAHRGYIRIVSHASCDGGHD

SEQ ID NO: 18761 - protein, 340 aa, Thermoproteus tenax
MFKTHTFSGVMKLAVIPGDGIGPEVVSATLKVIEAAARRFSIPLDIKVVEAGDVAARKYGKPMPDEAWKIVDSADAVLKGPVGETAYDVTSAIRMKYVLYANIRPAKNLPGVPAVKPIDCVFVRENVEDVYVGAEYRVGDVAIALKVITREGTARVARVARRYAEMRRRKVTIVTKSNVLRVVDAFFRDVARGELDGLQVEEMYVDAAAMELVRNPSRFDVVLTTNQYGDILTDLAAQVAGSLGLAPSANIGDKKAMFEPIHGAAFDIAGKGIANPIATILSAAMMFEWMGRQDAANAVRGAVEEALRRGVATPDIGGRATTEEVGRQIAAIVESWPTTS

SEQ ID NO: 18762 - protein, 235 aa, Zea mays
MAAPPATAPAASRCLSGAKSCWAAERSSSSFAVSAPSTDLRQSRSRILSVRAKVATGVQRASTVDDGAKRPWKLSDARLVLEDGSVWRAKSFGASGTQVGEVVFNTSLTGYQEILTDPSYAGQFVLMTNPHIDDEESNQCFLGGLIIRNLSICTSNWRCKETLEEYLTKRNIMGIYDVDTRAITRRLREDGSLIGVLSTDQSQTDNELLEMAKKWKIVGVDLISGVTCDAPYEWL

SEQ ID NO: 18763 - protein, 1300 aa, Shewanella sp. ANA-3
MKTKIALAVSMALLSAAANAQTVLSPTGETLQLDIPAELSNDSTRGQLTAVNNQDVKFIPEPDLAEGEYTYIVRLRDSAVANYQGDIPGFKATSPQHVQPTSQAKSTGKTGNVKLNAAAPEVKNYVSFLKVKQERFLTSASAAIGSRLEPLTTYQYAINGVAVRMTQAQAIKLAELPEVVYIEREKVEQLETDVSQALIGSPKVWDGSATGTKAMGEGVIVAIIDSGINSDHASFADVGEDGYDHTNPLGQGIYVGDCKTDFASMCNDKLIGVRSYPEITDVYDDEKVFGATPPAKNGEDYGGHGSHVASTAAGNILLNVPYVEGEVGKLEGSGIPTGLTFAQMSGVAPHANIIAYQVCKPGDQEDTYNGCSTAPILKAIDDAIKDGVDVINFSISGGGNPWNSATEQGFLAVRNAGIFAAVAAGNTRANIAQVPYSSSKNAPWYTSVANSTHNREVVRELEFNGKTFEFTPGSGPVQTDVVKGLPVFAGAVDATNVEGCKVFPADAFKDKIAVIKRGSCDFATKVSGALTAGAKAVIVYNRDGEGNARLTMSALEKLNVPAVFIGNTDGVALLEAMAANPAVELTLTPTPQAISREADVLSASSLIGPNATNDVIVPSVAAPGTDIYAAYADQQFGHDKSGTNPADFTLMSGTSMASPHVAGAGSLLKSLHKDWTPDNIRSALMLTATTAQAMKKADAKTVADPFDVGAGRIRVDLAAKTGLVMDESALNYEIANPVVNGDPRKLNVPSMADSRCVNTCTWTRTVTATQDGSWTAKGQAVTDKLALTVSPESFTLKKGASQTITVTADVTQVGADWGFGNLVLESASFPTATMPIAAKIGKRNLPNLVNIEATRNADEINLEGLKAVDFASVGAEVTGLKLSQTIESSVKQDSNNASYTDDLADGVKVFKFDVNENALFFRTSISYTTSPDLDMYVLLDKNDGSKLVRVGSSAKDGSEESVLLNNPVKGSYYVIVQNYSASSATADDVFGLKQLTFYNNETAADNLTATLSGDTKDFDVKLAWKDALKVGDDGLAMLTLTTGDDKVAPVKLPVIFERVGDDVLSPLGNALSGQLTPGVAKVMKTRIEANRTQETRVYNLEAMLPEGHEVANISHDGKQDGNKITWTVEMPSGADAKDISFELVPRKASVDNQLSLTNKVNNASSETLTQSYQFDVSEVAPVAKVEAPTTVQEGKPLFIDASKSSDANNDPLTYKWTQLGGTSFNFDPTAAKLNLVAPSVNGAAQTVSFQLTVSDNHGNSDSSLVSVSITDTPPKKDDGGALGWLSLLLLPFAFGRRKQR

SEQ ID NO: 18764 - protein, 393 aa, Pyrococcus furiosus DSM 3638
MNYILHLSILLVVAKLLEWLFEKKDIHPIIAHILTGIILGPFLLGIIYPNEELKVLSEFGLIMMMLYMGLTSNFSAIAQNKVKAIVVASLGVAFSFILGFTTVYLFGKGISAALFVGITLGNTAIEVTSGVIMKERIKREISSVLMGAAFADDIIAVYLIGILTGMIKGQTSLLSLAILTIKIVAFILSVLIFSEFVFKKSSLIYNLVIKDLNVFFTFTIILTFSLAVIAEGIGLNRIIGAYLAGLTISRLRERKDPLIISRIKLNELINELQVVLTEFFIPLFFIYVGLMFDPDTSEINLLLIALLYASAILGKLIGCGLGVKVFKGSWKDAVIVGIGMGGRGSLDLALLKFGLESGMIGEDLFATTVIVSMLTALSTPIFFRKTVKKLSEE

SEQ ID NO: 18765 - protein, 320 aa, Oryza sativa Japonica Group
MEEEPSATCRYFCHMCSLIVRPEMGIEEVKCPHCHSGFVEEMVGGDDDDGRRSGNAAAGGRGAASEENADDEATPAPPPWAPMLIDLLGVSSRRHGLDDGSSDLAAFARRQYRNIAFLQLLSALQDDDEAGGDTPGDSGRERLVLVTPADGNGAAATSGFTLGDLFLGPGLDLLLDYLADTDPNRQGTPPARKEAVAALPTVRVHDAAGATCPVCLDEFEAGGEAREMPCKHRFHDGCILPWLEAHSSCPVCRYQLPTDDEPTAGNVVVAAEGGDELIGNARGGGGDGDGDGGSSGRRRWLSWPFGGLFSHRSSRRSSSS

SEQ ID NO: 18766 - protein, 158 aa, Haemophilus influenzae R2866
MIRIGHGFDVHAFGEDRPLIIGGVEVPYHTGFIAHSDGDVALHALTDAILGAAALGDIGKLFPDTDMQYKNADSRGLLREAFRQVQEKGYKIGNVDITIIAQAPKMRPHIDAMRAKIAEDLQCDIEQVNVKATTTEKLGFTGRQEGIACEAVALLIRR

SEQ ID NO: 18767 - protein, 882 aa, Pyrococcus furiosus DSM 3638
MKLERVTVKNFRSHSDTVVEFKEGINLIIGQNGSGKSSLLDAILVGLYWPLRIKDIKKDEFTKVGARDTYIDLIFEKDGTKYRITRRFLKGYSSGEIHAMKRLVGNEWKHVTEPSSKAISAFMEKLIPYNIFLNAIYIRQGQIDAILESDEAREKVVREVLNLDKFETAYKKLSELKKTINNRIKEYRDILARTENIEELIKENEQELIQVLQEISKIEEVLPSKRSKVDMLRKEVLRLEETKVEIENSERLLEKRRGDKRTLEERIKNTEEYLEKLKEKEKELEEQVKEITSIKKDVDAYLALKEFKNEYLDKKYKIEKELTRVEELINEIQKRIEELNEKESEKEKLENEKKEILNKLAILEKDHQLYEEIKAKKENLRQLKEKLGDKSPEDIKKLLEELETKKTTIEEERNEITQRIGELKNKIGDLKTAIEELKKAKGKCPVCGRELTDEHREELLSKYHLDLNNSKNTLAKLIDRKSELERELRRIDMEIKRLTPLLTVAEQIRSIEEELNVVNLEKIEKNATEYEKLLEELRTLEGRIRGLAEDLKKLAPLEKKLAALIHKKQELEKELKELNTKLESFGFKSVEDLDSKLRELEEIYKRYLTLLNSKKELEITQREIAKAKETLEMSFEELAEVEADIERIEKKLSQLKQKYNEEEYKKKREEKEELEKELARLEAQKKELEKRRDTIKSTLEKLKAEKENRERVKKEIKDLEKAKDFTEELIEKVKKYKALAREAALSKIGELASEIFAEFTEGKYSEVVVRAEENKVRLFVVWEGKERPLTFLSGGERIALGLAFRLAMSLYLAGEISLLILDEPTPYLDEERRRKLITIMERYLKKIPQVILVSHDEELKDAADHVIRISLENGSSKVEVVS

SEQ ID NO: 18768 - protein, 675 aa, Coprinopsis cinerea okayama7#130
MIWDVTCAIFESDAAPLLGFGFGQLDLFVRATMNEYIEEHIKRHGRRLDYFERKRKREARAVHKQSAVAQKLFGIKAKILHAKRHAEKVQMKKTLKAHDERNVKQPDTAAVSQDALPTYLLDRENQKDAKALSSAIKQKRKDKAAKYSVPLPKVRGIAEDEMFKVMRTGKSKSKSWKRMVTKATFVGEGFTRKPPKMERFVRPMALRYKKANVTHPDLKATFQLQILGVKKNPQSPMYTQLGVLTKGTVIEVNVSELGMVTTGGKVVFGKYAQITNNPENDGCINAVLSMTTETQASPEIIEVDIDAEDSATIFGEHLVNSILEHEPLDTIKQILESGAPVWYSSQAEGTSALHAAAYTRNPELARILIEKGAIWNAAGEIALSQNDTETYTIIRDAGIRAELLLNLLSSKALKAGKTTDANQLEADNLLLREEDLTAAGSTETFLSSKLTYSVDKYGQKVCTVQAGDDEVGVMMGWEKGIMEETVKKLCDGHPNSKELRVLNVGFGLGIIDELFQSLPTRPEHHVIIEPHPDVLKHMKETGWYEKPGVKILEGKWQDYIESEELLAFGGFDVVYTDTFSEDYATLRLFFEHLPNILAGPESRFSFFHGLGATNALFYDVYTHISEMHLLEVGLKVEWSDVDVVGDEEEDRWGESREYFKVPLYRLPVASMAPVS

SEQ ID NO: 18769 - protein, 524 aa, Erythrobacter sp. SD-21
MDQAHLPDSILIVDFGSQVTQLIARRVREAGVYSEIAPFTQAEEAFHRLKPRGVILSGSPASVPDADSPRAPEVIFDSKVPILGICYGQQVMTDQLGGEVRPGHETGEGGEFGRAFCEVTEKCVLFDGLWKPGETHQVWMSHGDKVTRIAEGFRIVATSPGAPFALIADDERRYYGTQFHPEVVHTPDGGKLLANFVRHVCGLTSDWTMAEFRKTKIEEIRAQVGDGKVICGLSGGVDSAVAAVLIHEAIGDQLTCVFVDHGLMRMNEAEQVVTLFRDHYNIPLVHVNAEEMFLGGLEGQTDPEKKRKFIGGAFIDLFEAEAKKIGGADFLAQGTLYPDVIESVSFTGGPSVTIKSHHNVGGLPERMNMELVEPLRELFKDEVRDLGRELGLPEVFVGRHPFPGPGLAIRIPGEVTKERCDILRKADAIYLEEIRNAGLYDAIWQAFAVLLPVKTVGVMGDGRTYDSVCGLRAVTSTDGMTADIYPFDAAFLSRVATRIINEVKGINRVVYDYTSKPPGTIEWE

SEQ ID NO: 18770 - protein, 112 aa, Coxiella burnetii RSA 493
MSEHVHTASDENFETEVLQADMPVLVDFWAEWCQPCKMISPVVEEIAKEYAGRVKVFKLNVDENAQTPTKYGVRGIPSLLIFREGEVVDRKVGALNKSQLAAFLDESLHFSS

SEQ ID NO: 18771 - protein, 149 aa, Oryza sativa Japonica Group
MAAAALRDQLTALLSSMFSQGLVDEQFQQLQMLQDEGGTPGFVSEVVTLFCDDADRIINEIATLLEQPVVNFDKVDAYVHQLKGSSASVGAQKVKFTCMQFRQFCQDKSRDGCLMALAVVRNDFYDLRNKFQTMLQLEQQIQAYDPKQQ

SEQ ID NO: 18772 - protein, 274 aa, Coxiella burnetii RSA 493
MNTSNITFIGGGNMARNIVVGLIANGYDPNRICVTNRSLDKLDFFKEKCGVHTTQDNRQGALNADVVVLAVKPHQIKMVCEELKDILSETKILVISLAVGVTTPLIEKWLGKASRIVRAMPNTPSSVRAGATGLFANETVDKDQKNLAESIMRAVGLVIWVSSEDQIEKIAALSGSGPAYIFLIMEALQEAAEQLGLTKETAELLTEQTVLGAARMALETEQSVVQLRQFVTSPGGTTEQAIKVLESGNLRELFIKALTAAVNRAKELSKTVDQ

SEQ ID NO: 18773 - protein, 296 aa, Populus trichocarpa x Populus deltoides
MSFTGAPPLPAVTAAATTTSKQYFCYQCNRTVSITPSSYDDPFCPICHDSFIEEFETQNPQNPNPFSDSYFNDPFDPFSSLFPLLFQNSGNFSHPEFPTRPGFSDPNAFNPLEFLRSHLQNLHSGGGRVQFVIDNNGHEPGLRFPDGNFGDYFIGSGLEQLIQQLAENDPNRYGTPPASKKAIEALPTMKVTEEMMKSEMNNQCAVCKDEFEGGEEVKGMPCKHVFHEDCIIPWLNMHNSCPVCRYELPTDDPDYENRSPGGQGSGGGSAGGMERRFTISIPRAFGGSGGGGQSSS

SEQ ID NO: 18774 - protein, 228 aa, Coxiella burnetii RSA 493
MSISENIKRITTEIRQAEKEFSRSPNAVSLLAVSKSQSLDKIKEAIAAGQRQFGENYLQEALVKIKALRAHPLEWHFIGVIQTNKTRLISTNFDWVQSVSRLEVASELHHYRPLELPPLSICIQVNISEEKTKSGVDLTNLSEFAKAVSQFDRLRLRGLMTIPAYQKDFNAQKATFEKLKEAQQQLIKKGLPLDVLSLGMTHDFRAAIAAGSTMVRIGTGIFGPREDR

SEQ ID NO: 18775 - protein, 440 aa, Mesorhizobium sp. BNC1
MTYILHRQIHGQLPVAAGGRGVKLFDSAGKEYIDASGGAAVSCLGHNHPDVVAALKRQAEKLAYAHTSFFTNEPAEALAERLVKAAPEGISHAYLVSGGSEANEAALKMARQFFVEKGEAQRRHIIARRQSYHGNTLGALAAGGNEWRRAQFRPLLIETHHIDPCYAYRYRQQGESDEEYGLRAAQQLEDKILELGPDTVMAFIAEPVVGATAGAVPAVSGYFKRIRDICDRYGVLLILDEVMCGMGRTGTLFACEEDGVSPDLVSIAKGLGGGYQPVGAVLLSRQIFDAFAQGSGLFQHGHTYICHPMACAAALAVQEVIERDNLLANVREMGSYLRARLEARFGNHAHVGDIRGRGLFLGLELVADRATKEPFDPARKIHAGVKKEAMARGLMVYPAGGTIDGARGDHVLLAPPFILDKETADTIVDRLGEAIDAALG

SEQ ID NO: 18776 - protein, 476 aa, Anabaena variabilis ATCC 29413
MRRTKIICTVGPATSAPERLEALVEAGMNVARLNFSHGAYDFHAQTAQYLRQISADRQKPVAIMQDLCGPKIRLGTLPPEGLTVEAGQEVTFVLQEKGNSLDELPLPLPTLFAMVRPGEPILINDGRVKLIVTDRDADRIRAIAKIGGLLSTRKGVNLPATRLPVSSITEKDLQDLRFGIELGVDWVAVSFVRSPYDLEPAQRMIEAAGKTIRVIAKIERPEAVEQIDSIIDVADAIMIARGDLGVEMPIHEVPLIQKDIIRRCNQAGKPVITATQMLESMISAPDPTRAEATDVANSILDGTDAVMLSGETAVGQYPVAAVQTMHDIATTTEKSLQEGSKNCLSHEAGGLSVTESVAEAVCRIAYETGAKAILCNTTSGSTAKLVSKYRPTTPIFALTPDETAYHQLALSWGVEPLLTPPVHNAEEMFMNLINTAVRTGLVHDGDKVVITSGVPIGKSGTTSLIKVHSIGQPITA

SEQ ID NO: 18777 - protein, 442 aa, Bacillus licheniformis ATCC 14580
MNAEANGLKKEIGLLFALSLVIGTIIGSGVFMKPGSVLSYSGNAQIALFAWLLGGILTLAGGLTIAELGAQIPKTGGLYTYLEEIYGEFWGFLCGWVQIIIYGPAIIGALGLYFGSLVANLFSWDKSWTALIGIITVAFLCIVNIVGTKYGGAVQTITTIGKLIPIVCIIVFGLWQGDEYIFSSVTESIASQNFGAAVLATLFAYDGWILLAALGGEMKNPEKVLPKAMTGGILIVTACYLFINLALLHILPADQIVKLGENATSTAATMLFGPLGGKLISIGIIVSIFGCLNGKVLSFPRVIFAMAEKKQLPFSRWISHVHPAFHTPWIAVIVQMIIAVILMIISNPEKLSEVSIFMIYIFYVMAFFAVFILRRRKNGQGRSYSVPLYPYLPVAAILGSLFVLVSTLITDFYSCLWSILIGLVGLPVYFWMKKRNKNGSAA

SEQ ID NO: 18778 - protein, 343 aa, Anabaena variabilis ATCC 29413
MAKLKVGINGFGRIGRLVLRAGINNPNIEFVGINDLVPPDNLAYLLKYDSTHGKLRSQVEAKDDGIVIDGHFIPCVSVRNPAELPWGKLGADYVVESTGLFTDSEGASKHLQAGAKRVIISAPTKDPDRVRTLLVGVNHDLFDPSKDVIVSNASCTTNCLAPIAKVINDNFGLTEGLMTTVHAMTATQPTVDGPSKKDWRGGRGAAQNIIPSSTGAAKAVALVLPELKGKLTGMAFRVPTPDVSVVDLTFKTAKATSYKEICAAMKQASEGSLAGILGYTDEEVVSTDFQGDTHSSIFDAGAGIELNSNFFKVVAWYDNEWGYSNRVVDLMLSMIQKEQLAAV

SEQ ID NO: 18779 - protein, 270 aa, Bacillus licheniformis ATCC 14580
MNKIGFIGYGSMAQMIAVKLLDQGKIRDDMVVVSSRNDGKTEELKKLYPNVACQSADELAKQCGLIFICVPPMAVKETLEKIQPFLQEDVHIVSIAAGVELDRLHDWTSGQVTRYIPTLTSEAGIGVSLVVHGERVAEADKSRLEEYLSAFSTVKQINERDIDAASNLTSSSPGFIASIFEEFAQAAVRNSSLTKEEAFQFLIHSLLGTGKLLMEKDMTFAQTLDRVATKGGITAEGAEVIQDAMPEVFDELFARTMKKYEVIKDAVRRQ

SEQ ID NO: 18780 - protein, 307 aa, Mesorhizobium loti MAFF303099
MILCCGEALIDMLPRITTQGEPAFAPYVGGAVFNTAIALGRLGAPAGFFSGLSSDLFGGQFRDALGASKVSSTYAHTSPRPTTLAFVRLTNGQATYTFYDENTAGRMLTIDDLPSLGNEIEAMLFGAISLISEPAGGAYEEFMRREHASRVMMLDPNIRPNFIPDKAKHLRRIREMMAMADIVKLSDEDLHWFGEAGSHEDVIRNWLDRGPKLIVVTHGSEGAVGYTKDHTVTVMPEKVEVVDTVGAGDTFNAGILASLHEQGLLTKAAIGGLPQDAIRKALALGAKAAAVTVSRAGANPPWRHEIA

SEQ ID NO: 18781 - protein, 198 aa, Glycine max
  misc_feature (74)..(74): Xaa can be any naturally occurring amino acid
  misc_feature (105)..(105): Xaa can be any naturally occurring amino acid
  misc_feature (128)..(128): Xaa can be any naturally occurring amino acid
  misc_feature (153)..(153): Xaa can be any naturally occurring amino acid
  misc_feature (175)..(175): Xaa can be any naturally occurring amino acid
MSFAYQTDGYQLVASQAPPIFMRKGKSIVLGVFVLLRWYSVPLAAGLSEGISLGMHEALVLRDGRSDYLGKGVXKAVDYANTDLGPALIGKDPPEQTDIDNLMVXQLDGTANERGRSKLKLGTNAILXKCVEICINEASMLKNPIYKHIVNIXGDKKPDLPVPASKVNKGGSHAXDKLAMNEGIALPVGATYVKETMM

SEQ ID NO: 18782 - protein, 455 aa, Oryza sativa Japonica Group
MSSSSSSGWSSKKVCVVGAGMAGLAAARELRREGLDVTVLEQSADVGGQWLYDAATDGRDPLGMAGVHSSIYSSLRLNSPREVCGFSDFPFRPTNGGGGDARRYPVHGELLRYIREFCDVFGLMDAVRLDTTVVRVAMAPPRRDGSLRWTVRSKHNGDAETEEVFDAVVVATGQYSQPRLPSIDGMDKWRRRQLHSHSYRVPDSFAGEVVVIVGCNLSGKEVALELLRVAKEVHLSSKSTKEAMTPSMSKMLARYDNLHLQPLVEHLCEDGRVVFDDGSFVVADAVIYGGEGHRRRQPRRAAVRARVPTGARAVALLRGHPGQGDPAAVRRGAGEVGGAGAVRAEDAAVAGGDAARRRGVQPRQGGRRLAEAADARPVLGPGVLRRVRRAPLRLPADGAVEEGADLVVHLRHVRRHRELPRRLPRQRHRPRRPAPARLGFLSSPRAAAAGEGRRP

SEQ ID NO: 18783 - protein, 521 aa, Solanum tuberosum
MAASIGALKSSPSSNNCINERRNDSTRAVSSRNLSFSSSHLAGDKLMPVSSLRSQGVRFNVRRSPMIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIVI

SEQ ID NO: 18784 - protein, 643 aa, Staphylococcus epidermidis ATCC 12228
MKNNNETRRFSIRKYTVGVVSIITGITIFVSGQHAQAAEMTQSSSDFNEQSQQTEQVEHKEDTTHLSYELNQEGDTASQSKTNQENQSDENVQKKNNQTQQDSTQTSPLNDQEQTLKGQQSKDNHVTPNSRQDTYPKGQNQDDKGKQQFKDNQHSQTEHQPNTQNQNNDQDSSDKKQHPSDQTQAPSSKGTQPKQSQSIGDRDKTVKQPSSKVHKIGNTKTDKTVKTNQKKQTSLTSPRVVKSKQTKHINQLTAHAQYKNQYPVVFVHGFVGLVGEDSFSMYPNYWGGTKYNVKQELTKLGYRVHEANVGAFSSNYDRAVELYYYIKGGRVDYGAAHAAKYGHKRYGRTYEGIMPDWEPGKKIHLVGHSMGGQTIRLMEHFLRNGNQEEIDYQRQYGGTVSDLFKGGQDNMVSTITTLGTPHNGTPAADKLGSTKFIKDTINRIGKIGGTKALDLELGFSQWGFKQKPNESYAEYAKRIANSKVWETEDQAVNDLTTAGAEKLNQMTTLNPNIVYTSYTGAATHTGPLGNEVPNIRQFPLFDLTSRVIGGDDNKNVRVNDGIVPVSSSLHPSDEAFKKVGMMNLATDKGIWQVRPVQYDWDHLDLVGLDTTDYKRTGEELGQFYMSMINNMLKVEELDGITRK

SEQ ID NO: 18785 - protein, 495 aa, Erythrobacter sp. SD-21
MSETVDLLVIGGGINGAGIARDAAGRGLSVLLVEKDDLASHTSSASTKLVHGGLRYLEHFEFRLVAESLREREVLLEAAPHIIWPLRFVLPHEPKMRPKWMLLAGLALYDRLGGRGRLPRSKKVSLKTAPHRAILQDRLTAGFEYSDCWVEDSRLVVLSAMDAEARGATIATRTRCTALARHEDHWLATLHDAKGERVARAKAVVNAGGPFVDRIAKAALGQGTPAHLRLVKGSHIVVPRAYPGEHAYIFQHADKRIVFAIPYERDYTLIGTTDMLYDGDLDHVEISAEERRYLREAVTHYFKSGVTEEDIVHTYAGVRPLYEDKAASNSTVTRDYVFEVEASGGAPILSVYGGKITTYRKLAEHALAKLSRHMEIPGEAWTRGAPLPGGEMKDADFANFLWEASERLDWIPPEMLLRLARAYGTRIDTLIGDAASLDNLGTHFGGDLYEAELAYLVAHEFTRTAEDVLWRRSKLALHLSQEAQEAVTRWFEERG

SEQ ID NO: 18786 - protein, 336 aa, Sulfolobus tokodaii
GFTVALIQGDGIGPEIVSKSKRILAKINELYSLPIEYIEVEAGDRALARYGEALPKDSLKIIDKADIILKGPVGESAADVVVKLRQIYDMYANIRPAKSIPGIDTKYGNVDILIVRENTEDLYKGFEHIVSDGVAVGMKIITRFASERIAKVGLNFALRRRKKVTCVHKANVMRITDGLFAEACRSVLKGKVEYSEMYVDAAAANLVRNPQMFDVIVTENVYGDILSDEASQIAGSLGIAPSANIGDKKALFEPVHGAAFDIAGKNIGNPTAFLLSVSMMYERMYELSNDDRYIKASRALENAIYLVYKERKALTPDVGGNATTDDLINEIYNKLG

SEQ ID NO: 18787 - protein, 515 aa, Yarrowia lipolytica CLIB122
MLRALNTVQRLSSTRAMSTSSISSLLKNPNLLRNQGYVNGQWVSSKTGDTFSVENPATGETLGQVPEFSVAEADEAVQHAQTAFKTFKHTTGRERSKMLRKWYDLMQENAGDLATLVTLENGKSLADAKGEIGYGASFFEWFSEEAPRIYGDIIPSANPANRIYTIKQPIGVCGIITPWNFPSAMITRKAAAAVAAGCTMVIKPGSETPYSALALAYLAEQAGIPKGVVNVVTTKKNTRAFGNALCENPTVKKVSFTGSTGVGKTLMGASASTLKKLSFELGGNAPFIVFEDADIDRAVDGAIASKFRGTGQTCVCANRIYVHESIAEKFAERMAAVVKDFKVGNGLDPNTTHGPLIHEGAKGKIQEQVDDAVKKGGKVLIGGSDAPEIGKAFFQPTVISGAKSDMLIASEETFGPIAAIFPFKTDAEVIELANKAEVGLAGYFYSKDVYRIQQVAEALEVGMVGVNTGLMTECALPFGGIKESGFGREGSKYGLDDYMVLKTIVVSGVEPHIQP

SEQ ID NO: 18788 - protein, 315 aa, Zea mays
  misc_feature (120)..(120): Xaa can be any naturally occurring amino acid
SHPGWTRVIVEKPFGKDLDSAEELSAQLGELFEEHQLYRIDHYLGKELVQNLLVLRFANRLFLPLWNRDNIDNIQVFCLVAMEKPVSLKPEHIRDEKVKVLQSVNPIKPEEVVLGQYDGXYKDDPTVPDDSNTPTFASVVLRVHNERWEGVPFILKAGKALSSKKAEVRVQFKDVPGDIFRSKKQGRNEFVIRLQPSEAMYMKLTVKKPGLEMATEQSELDLSYGMRYQNVKIPEAYERLILDTIRGDQQHFVRRDELQAAWKIFTPLLHDIDDGKLKALPYEPGSRGPKEADELSARVGYVQTHGYIWVPPTLA

SEQ ID NO: 18789 - protein, 1648 aa, Shewanella sp. ANA-3
MNNQQFKRTAIASLTALYVSGACTFALADPGMEKVAGSSFYTPTFTAEDVLKVTNERKAELSGDIYVGTPGQLNRVKKARSPQEIFQPEANSQGVQTYIVQLEAEPLATYEGDIPGFAATKAPVNRSIIAKGRVSVNTAAAQSYKSFLLGKQDKFVSSVRQAGVNLKINKQFTIASNALVVEMTQEDAIRMSHQAGVKRISPNRIFELRTDRGPEFIGADQMWQGTATQGGLPVKGEGMVVGIIDTGINTDHVAFADDEEYARLNPYKGQAIGDCGAFPELCNNKLVGLHSYPEITDVYAAPEFQTSSGAKKRIRPANAEDYAGHGSHTASTVAGNTLKDTPLQGFTGDKVSDGVDVPFTFPQTSGVAPRAHIIAYQVCWPGTSGDPYAGCPESAILSAFEDAIADGVDAINFSIGGAENMPWGDPMELAFLSAREAGISVAAAAGNSGAYWTADHSSPWVTTVGATTHDRKLKAGIKSLTGFEGTGKPTTAIQGTSFSGAITGEVVLAEKYADPNTKDSYTAASCNVPFPAGTFTSDQIVVCERGDIARIEKAKNVAAGGAGGVILQNMSSSVDNLEADMYVIPGIQVKYADRLKIRNWVLKNPGTARATITDFTNEYSFDASAGNNLATFSSLGPSKTNNTLVPDLTAPGVDIYAANADDQPFTNNPSASDWTFMSGTSMAAPHVTGAMTLLTQLHPDWTPAEIQSALMLTAGPVVLNTGYELVEPYYNFMAGAGAINVARAADTGLVMDETIDNYRNADPTNGGVVNWLNLPSMVEMECEKTCSWMRTVKATRDGTWTVEGVGKEEGFEVSVSPASFSLKAGESQSIIITAKTPNLIEHKVEPTDASAPWSEVLNKNAFFNGQVLLKEINGSSPDVHMPVVVASVADQLPVAHRFEITRDQGTESLVVNTDSYSQLTPRFYGPVKPEISSNKLTAVSAILSKANIDKGWDIRPVVVPEGTKRFVVEVQKAEFVSTLENLNPRYTEMHPFIMVGLDKNGSNTFVPEGDNPTSSAIRAEYIDELMCISSSQSEHNYCSFENPTPGTYWVATAMAYGAGQGDVAVETGYALVMENDDKGYLNMSGPASHDGNGNYEIGLHWNIPETKAGDVYYGGFDLGNMPGAEGTLGFTALDIRRADDAVTWSVSQDKARSMDVIDVKLNIAPNLETQDRNYKFEMKLPEGMRLATGTIKTNNDDVTKAIVADEHNLTLSGLQLSTRNVGREYKVSTSLTDKMCHTPLIDEYSKGGYIDLWGEFRIQPNADWFVGDFNNAFDVPINWLFYKQNAKFEVYNQPNAGYMRMHTVGALQFNTGYWYMSQHRGPGFLNEALAPFWRGTFTSKYRRDPSEPWGLTIATQYAEDRPDLGDLLFLEFDNVTDSKTGEEFDFETILRSGIDDRPGQYEIIYAYSNLGANVAKGAVFVEGFDSPWSRTVGPKNGNLYEVLGFDDLDEKLQNDLVVCYDYVGPEQSRMEVSFKVAVQPEATGKTLNVELNYDLEGAAPTTLVHTVNVNGNIKLAPIANQVVAENTRLEGLSVSYVDANKVPNTVEVTGEHISAEIKGSQFTLIPEANFHGDTLVTVTVRDNEISSDAASTSFMLTVESDGVEPTPVTPVTPETPEPESSSGGALGWSLLSLLSMAFIRRAKKATRA

SEQ ID NO: 18790 - protein, 193 aa, Glycine max
MASTDKHGDTEYRTSSSTPAPAGVDYFKFDVILRFVLFAASLVAVVVIVTGNQTEVILVPQPVPWPAKFRYTPAFVYFVAALSVTGLYSIITTLASLFASNKPALKTKLLLYFILWDALILGIIASATGTAGGVAYLGLKGNSHVVGWNKICHVYDKFCRHVGASIAVALFGSIVTVLLIWLSAYSIHSRVPK

SEQ ID NO: 18791 - protein, 188 aa, Triticum aestivum
SIHQQAKPIKLTDFQGKYVVLFFYPLDFTFVCPTEILAFADAHSEFEKHNTVLLGASTYFLFSHHAYTQQPRNKGGLGDINLPLIADYSKTIARIYGALITKGPDAGVASRATFIIDGKGILRHASYNDLPVGRNVDEVLRLVQAFQFSDEHGEVCPAKWRPGGKTMKTDHNSDVTQKYWAEEHAKGQ

SEQ ID NO: 18792 - protein, 277 aa, Zea mays
  misc_feature (82)..(82): Xaa can be any naturally occurring amino acid
  misc_feature (110)..(110): Xaa can be any naturally occurring amino acid
CAPPPRLRAPWNALSPSGLSAGDIASDPDTYDLLLDHALRSELVLGTVARRQAAPANGPPAESYLESRVSFSEERVMDAERXPKQAVYGWTPLMAHARAVCQGGGKVLNXGFGMGLVDEAIQRYGPEEHTIVEAHPEVYERMLKLGWGEKKNVRIVFGRWQDVMPQLGSYDGIFFDTYGEYYEDMREFHQHLPKLLKPGGIYSYFNGLCGDNAFFHAVYCQLVALELANLGYSTQFIPLPVKDCLAEEVWKGVKRKYWQLDTYYLPACQSESESTIS

SEQ ID NO: 18793 - protein, 383 aa, Pyrococcus furiosus DSM 3638
MLRCTSCGRMYSFDSPYQRCECGEPLELELFNGMYKKKGKRVWERFSEFFPLELDPELSLGEGDTPLTRAKKLSKELGIELYLKNETINPTWSFKDRGTYLGIHRAIQLDFRRIGTVSTGNMAASVAAYGAHSELEVYILVSSTIPEEKIKALAPYGAKIVKVHGDYGELYYRALEIGQKKGIYFINSDDPFRVEGYKSISFEISEEITPDYVIVPTSSGGLFRGIVKGFLEAKNSGLIEKLPRFFVVQAEGCSPICKAFNAGKEKIERFENPHTIAHAIENPYPPSGNAVLRLLKKLNGICTTVTDEEILEAQKILGREGIFVQLASATGIAAVKKLRRKGIIKEGAIVVSILTGSGLKTLRYIKQPKVEECSLQRLEECIG

SEQ ID NO: 18794 - protein, 377 aa, Idiomarina baltica OS145
MSKYIFIMLAVLFTHLSMAQNEINEKQSHEQIATFAGGCFWCVEEAFEQMNGVREVISGFSGGTELNPTYQEVSAGKTGHTESVQVYYDPNIVSYAALLQKFWRIIDPTDNKGQFVDRGQQYRPEIFYHTDQQRKIAQQTKQYLAEHGPFKKPIVVPITRFKSFYPAEDYHQNYYDKNPIRYKVYTFNSGRYDFIEKFWGDTSDIDYQQYTNQNPNGVNQSNAAQARWKSYSKPSDEVLQQKLTDIQFEVTQEDGTEEPFNNAYWDNKRPGIYVDILSGEPLFSSTDKYKSGTGWPSFTQPITSDAVVEKEDNSWFYTRTEIRSRYGNNHIGHVFSDGPKPTGLRYCMNSAALEFIPLDEMKEHGYGDYIKYVTADN

SEQ ID NO: 18795 - protein, 503 aa, Streptomyces ambofaciens
MYARSWSTPAREGSVGRPSFVTDHGLWDEERLAAAERVEAALADVDYVRLVFGDPHGLARSKTLTTDAFRTVLRNGMNFSPGPFLFDTGHAVAVDFLGEHGIGVDEISGAGNFLLVPDPVTFQVLPGRGPRTAWVLGDEYLRDGTPHPLSSRAVLRRVLERYTALGLEPALGLEVEWYLTRRLDDEPGNQGNGFGLQGQAPRVAAVNAGYQFNLDAAYDTVAPITGPLGLYLQKLGLPLRSLEHESGPGQVETTFSPMSALDTADAMLLFRTVTKRYCARRGHHASFMSQPQLEAADPSGWHLNQSVVDTATGRNLFSAEGLSGGLSPSGKSYAEGLLTWARELFLLSVPTVNGYRRLAAEHALAPTRLGWSFEDRTAMLRVVGNGAGAHIENRMGEPCANPYLNIAAQLFAGLEGLQAQPTDPGPAAPAGPPQPQTVPQSLEEALDAFRAGRAARLLGAPLAACMTKLKESELRRYTAWSSEHPPVPGQVTDWEQREYFGAY

SEQ ID NO: 18796 - protein, 397 aa, Shewanella sp. ANA-3
MSIEIKVPVLPESVADATIATWHVKVGEQVSRDQNLVDIETDKVVLEVVAPEDGHIGEFLFQEGDTVLGEQVIAKFIAGAVSGQEVTKAEAEAAAPVAAAATEESNDALSPSVRRLLAEHNVDASKVKGTGVGGRITKEDVEAFIKSAPKAAAPAAPAVQPLAAGRSEKRVPMTRLRKTIANRLLEAKNSTAMLTTFNEVNMKPIMDIRKQYQDIFEKRHGIRLGFMSFYVKAVTEALKRFPEVNASIDGDDIVYHNYFDVSIAVSTPRGLVTPVLRDTDTMSLADIEKAVRDLAIKGRDGKLTVADMTGGNFTVTNGGVFGSLMSTPILNLPQSAILGMHAIKDRPMAVNGQVEILPMMYLALSYDHRIVDGRESVGFLVAIKDFLEDPTRLLLDL

SEQ ID NO: 18797 - protein, 223 aa, Salinibacter ruber DSM 13855
MPAPRAPMPMNPPVVIGIAGGSGSGKTTVLNHILEEFGSDPIAILDHDAYYHDLSHLSREKRAQFNFDHPDALETSLMREHLDRLIEGEAIEKPVYDFTTHTRREETETVEPRPVIIIEGILVLAESALEERMDIKIYVDAADDIRLMRRIRRDMQERDRSIEGILRQYERTVRPMHLEFVEPSKREADIIIPRGGHNEVAIQMVMSRIQELLRLVEQGTLQA

SEQ ID NO: 18798 - protein, 388 aa, Shewanella sp. ANA-3
MNLHEYQAKSLFAEYGLPVSEGFACDTAQEAVEAAGRIGGNLWVVKCQVHAGGRGKAGGVKVTGDKEEIRAFAEHWLGKNLVTYQTDEKGQPVAKILVESCTDIANELYLGAVVDRATRRVVFMASTEGGVEIEKVAEETPELIHKAIIDPLTGPQPYQARDLGFKLGLNPTQMKQFTKIFMGLATMFVDHDFALLEINPLVITTEGNLHCLDGKIGIDGNALFRQAKIKAMHDPSQDDAREAHAAMFELNYVALDGNVGCMVNGAGLAMGTMDIVNLHGGKPANFLDVGGGATKERVAEAFKIILSDSNVKAVLVNIFGGIVRCDMIAEGIIGAVKEVGVKVPVVVRLEGTNAELGREVLAKSGLDIIAANSLTDAAEQVVKAAEGK

SEQ ID NO: 18799 - protein, 82 aa, Arabidopsis thaliana
MVGSGAPQRGSAAATASMRRRKPTSGAGGGGASGGAAGSMLQFYTDDAPGLKISPNVVLIMSIGFIAFVAVLHVMGKLYFVK

SEQ ID NO: 18800 - protein, 419 aa, Streptomyces avermitilis MA-4680
MHVCVLGQGYVGLPLALRAAEAGHTVTGYEPDRKRCEQLAAGSSYIEDIESTRLQRVLRSGAYTASSDPKDLKGFDVAVITVPTPLTDRAPDLSCVREAGGVLAEWLEPGATVVLESTTHPGTTRDLLIPLLEEGSGLVAGQDFHVGFSPERIDPGNADWRLENTPKIVAGLTDACLRQVKAFYDSVTEVTVPASGLEEAELAKVFENTYRHVNIALVNELSRMAHTLGVDVWHTLELAATKPFGFTKFLPGPGVGGHCLPIDPVYLSHHVKARHGQTFRLIELAQDINESQPDYVVRRLQDSLSRRFRRSVHGARILALGAAYKPGTADARQSPAVQVIDRLRTMGADVTVVDPYLSDGGSREIPFAAVEDGTSVADFDAVVLLTPHGEFDLTQLAAEAAYVLDTRGVMATAPHVERL

SEQ ID NO: 18801 - protein, 411 aa, Nicotiana plumbaginifolia
MNALAATNRNFKLASRLLGLDSKLEQCLLIPFREIKVECTIPKDDGSLATFIGFRVQHDNARGPMKGGIRYHPEVDPDEVNALAQLMTWKTAVANIPYGGAKGGIGCSPSDLSISELERLTRVFTQKIHDLIGVHTDVPAPDMGTNPQTMAWILDEYSKFHGYSPAVVTGKPIDLGGSLGRDAATGRGVLFAAEALLRDHGKSIAGQRFVVQGFGNVGSWAAQLITEQGGKIVAVSDITGAIKNKNGIDIASLLKHVKENRGVKGFHGADSIDPNSILVEDCDVLIPAALGGVINRDNAKDIKAKFIVEAANHPTDPEADEILAKKGVVILPDIYANSGGVTVSYFEWVQNIQGFMWDEERVNTELKAYMNRGFKDVKDMCKTHNCDLRMGAFTLGVNRVARATTLRGWEA

SEQ ID NO: 18802 - protein, 523 aa, Salinibacter ruber DSM 13855
MDSSKRHLLLILDGWGLADDPSVSAVEQADTPFVDHLYDEYPHGVLKASGLEVGLPDGQMGNSEVGHTNLGAGRVVYQEILRISKAIEDGSFFENDALVRAARHAKASDQKLHLMGCFSDGGVHSHLEHLYGLLELARREGLAPAQVNVHAFTDGRDTDPHGGVDYVEQFQKKADEIGVGRLASIVGRYYAMDRDERWARTERAYRLLTDGTGAAFDDPVTALKASYDDGVTDEFVEPRRIRADDADAFGDHGTRIEDGDAVVYYNFRSDRARQLTRAFTEADFDGFERERPDDLLFVTMSPYDDEFDLPVAFEKLNLEGTLGEVLSARGGRQLRAAETEKYAHVTYFFSGGREAPFDGEDRVLVPSPKVDTYDQQPEMSAPELADRVSRSLREADYTLAVLNFANPDMVGHTGDFEAAVAACEAVDRGARQVVEAARDQGYSVSIIADHGNADRLQNPDGSPHTAHTTALVPHIILKDGFEGPVRDGKLGDVAPTILTLLGEDVPDAMDGEVLVPAERAAAS

SEQ ID NO: 18803 - protein, 186 aa, Zea mays
  misc_feature (156)..(156): Xaa can be any naturally occurring amino acid
MRGMKSLTIWAIFAAVLSQQLFASVASIKFEDEKTYYSPPDPNAGSPPSGTPPSHGGYTPTPSTPSHTPPSNCGSPPYDPSPPSHTPTPSTPSHTPSTPSHTPSTPSHTPTPSTPSHTPTPSHTSPPCHCGTPPSHPSTPSRASRPSHPSRAFTPXTPSNPPSGGYYSSPPPSTPVIETPPTPIVD

SEQ ID NO: 18804 - protein, 213 aa, Vitis vinifera
MTVSITALDLSSETHALYEVIFFGDSVQTLVTNTPNIVDSWIQNVESSNPHNGLDRLIVGLDVEWRPSFNPQIENPVATLQLCVGRSCLIFQLLHAPAIPASLNAFLRNPGYTFVGVGIDDDLEKLVGDHGLGVSNAVDLRGLAAHELNKMELRNAGLKRLGLEVLGKEVQKPRRVTLSRWDNFYLSTDQVQYACVDAFLSSEIGTTLNASRR

SEQ ID NO: 18805 - protein, 388 aa, Vitis vinifera
MKINIFFSKIPECLRVTYPESLKDAYECATGNFGIPQNEHGGTVVGTVVYPQANQKSCSRSHHFDVSFKSQPADLPIFLLADRGNCYFALKVWSAQNAGAAAVLIADNIAETFPNFVDHAPEMRLGCWRLSIFGDFSALGSGFLSFHAHRLPSSNPLSLWTASAKILTKSRKIKKSEAIAMAVAELERCRTHELFRVAFHDDCIETLVTHVPHMVDSWIGDIEHIHRHRLHKLIVGLDIEWRPNNARYTNPVAILQLCVGRRCLIFQLLYAPEIPTSLIDFLGDTDYTFVGVGIQADSQKLLNDHNLRVGNVVDLAVLAARVLNTRELRNAGIKRLAREVLGREVEKPKHVARSRWDTDWLSDAQVHYACVDAFVSFEVGRCLNASAD

SEQ ID NO: 18806 - protein, 204 aa, Triticum aestivum
  misc_feature (151)..(151): Xaa can be any naturally occurring amino acid
MPPPPHPNGGKVTPNLAMDAEGTRLLNLTVLQRLDPAVEDILITAAHVTLYDFNIDLNQWSRKDVEGSLFVVKRNSQPRFQFIVMNRRNTDNLVEDLLSDFEYELQPPYLLYRNATQEVNGIWFYNQQECEAVASLFGRILNAYAKVPPKXPKVPSIKSEVCGNPKHDHIHLSTINGPPINLPSVLHYSLEVLRSPLWLKSHLP

SEQ ID NO: 18807 - protein, 336 aa, Pseudomonas putida GB-1
MKAAVVAPGRRVDVVEKTLRPLQHGEALLKMQCCGVCHTDLHVKNGDFGDKTGVVLGHEGIGVVQEVGPGVTSLKPGDRASVAWFYQGCGHCEYCNSGNETLCREVKNSGYTVDGGMAEACIVQADYSVKVPDGLDSAAASSITCAGVTTYKAVKISNIRPGQWIAIYGLGGLGNLALQYAKNVFNAKVIAIDVNEEQLRFASEMGADLVVNPLNEDAAKVIQAKTGGAHAAVVTAVAKGAFNSAVDALRAGGRLVAVGLPSESMDLNIPRLVLDGIEVVGSLVGTRQDLQEAFQFAAEGKVVPKVTLRPIEDINQIFDEMLEGKIKGRMVIQFEG

SEQ ID NO: 18808 - protein, 403 aa, Glycine max
MASATFSVAKPALQANGKGFSEFSGLRSSSGFLPFSRKSSEDFHSVIAFQTYAVGSSGGYKKGVTEAKLKVAINGFGRIGRNFLRCWHGRKDSPLDVIAINDTGGVKQASHLLKYDSILGTFDADVKPVGSNVISVDGKEIKVVSDRNPANLPWKDLGIDLVIEGTGVFVDREGAGKHIQAGAKKVLITAPGKGDIPTYVVGVNEYDYSPDEPIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNAAFRESADNELKGILSVCDEPLVSVDFRCTDVSSTVDSSLTMVMGDDMVKVIAWYDNEWGYSQRVVDLADIVANKWK

SEQ ID NO: 18809 - protein, 264 aa, Salmonella enterica subsp. enterica serovar Typhi str. CT18
MAISIKTSEDIEKMRVAGRLAAEVLEMIEPYIKPGVTTGELDRICNDYIVNEQHAISACLGYHGYPKSVCISINEVVCHGIPDDAKHLKDGDIVNIDVTVIKDEFHGDTSKMFIVGKPTILGERLCRVTQESLYLGIKMVKPGIRLRTIGAAIQKYAEGEGFSVVREYCGHGIGRGFHEEPQVLHYDADDGGVVLQPGMTFTIEPMLNAGDYRIRTMKDGWTVKTKDRSLSAQYEHTIVVTENGCEILTLRKDDTIPAIITHDE

SEQ ID NO: 18810 - protein, 248 aa, Chlamydophila abortus S26/3
MNGILSGKKAIVTGGSRGIGFAISKLFVEQGADVEIWGINDEGGKQAAQELSKIGRPATFAKVDVSKSQSVKDAVQNFITAHGNIDILVNNAGITRDNLLMRMSEEEWSAVINTNLNSLYYVCSSVIRPMIKARSGSIINISSVVGLMGSPGQTNYAAAKAGIIGFSRALAKEVAARNIRVNCIAPGCIDTDMTRVLNDNLKTEWLKNVPMGRMGFPEEIANAALFLASPLSSYITSQVLSVDGGMTY

SEQ ID NO: 18811 - protein, 451 aa, Glycine max
MATHAALASTRIPSNTRFPSKASHSFPTQCALKRLEVTEFSGLRSTSCVTYANSARESSFFDLVASQLTPKTNGSTPVRGETVAKLKVAINGFGRIGRNFLRCWHGRKDSPLEVVVVNDSGGVKNASHLLKYDSMLGTFKADVKILDNETITVDGKPIKVVSSRDPLKLPWAELGIDIVIEGTGVFVDGPGAGKHIQAGAKKVIITAPAKGADIPTYVVGVNEGDYTHQISNIISNASCTTNCLAPFVKILDEEFGIVKGTMTTTHSYTGDQRLLDASHRDLRRARAAALNIVPTSTGAAKAVSLVLPQLKGKLNGIALRVPTPNVSVVDLVVNVEKKGLTAEDVNAAFRKAAEGPLKGVLDVCDVPLVSIDFRCSDVSSTIDSSLTMVMGDDMVKVVAWYDNEWGYSQRVVDLAHLVASKWPGAAKAGSGDPLEEFCETNPADEECKVYE

SEQ ID NO: 18812 - protein, 367 aa, Yarrowia lipolytica CLIB122
MTTDFGGGTKKVRTEQEEDLASEFPTKLTIDAHSAPCTTAKISPNGKQIATCSADASIKLWDAATGDLIQTLRGHRAGINDISWSPDSKMLATASDDRTIRIWSTHRPSSQRILVGHTHYVTCVKFNYKGNLVVSGSADENVRVWDVLQGRCIMTLAAHSQPISAVDFSCEGTMIVSGSHDGLIRMWDTATGQCLKTIVGEESSPIMFARFTPNSKFILVSNMDSTARLWDYMNNKVVKTYKGHENGKYCCPTGFVYRQDRAVLLHASEDGRVYVYDIQDRTVRGSFDAHPGVIISLDVIDNKIVTCSLDGSVKLFELVEENSPSDDMDTDTEENGCRTNSSEERDNSREKEDGNGDGHGDVSMNND

SEQ ID NO: 18813 - protein, 612 aa, Candida glabrata CBS 138
MENKEHHHHHHHHHHHHSNGSYVSNKVSSLADGSRVGNYQIVKTLGEGSFGKVKLAYHVTTGQKVALKIINKKVLAKSDMQGRIEREISYLRLLRHPHIIKLYDVIKSKDEIIMVIEYAGNELFDYIVQRNKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGASDLIKRMLIVNPLNRISIHEIMQDEWFKVDLAEYLVPQDLKQQEQFNKKSGNEENVEEIDDEMVVTLSKTMGYDKDEIYEALESSEDTPAYNEIRNAYILIKDNKSLIKDMKQDNNVTQELDTFLSQSPPTFQQNGDGMKASEDQKKKHSGRRLASSVTQQRTFHQPPFMDQSKEEDSTISILPTSLPQIHRANMLAQGLPAASKISPLVTKKSKTRWHFGIRSRSYPLDVMGEIYIALKNLGAEWAKPSEEDLWTIRVRWKYDSDESRLIEDGVKKIPNLMKIVIQLFQIETNNYLVDFKFDGWESTYGDSTISTNMSEDEMSTFSAYPFLHLTTKLIMELAVNSQGN

SEQ ID NO: 18814 - protein, 477 aa, Pyrococcus furiosus DSM 3638
MRRVKLPSHKTKIVATIGPATNSRKMIKQLIKAGMNVARINFSHGSFEEHARVIEIIREEAQKLDRRVAILADLPGLKIRVGEIKGGYVELKRGEKVILTTKDVEGDETTIPVDYKGFPNLVSKGDIIYLNDGYIVLKVENVRENEVEAVVLSGGKLFSRKGVNIPKAYLPVEAITPKDFEIMKFAIEHGVDAIGLSFVGSVYDVLKAKSFLEKNNAEDVFVIAKIERPDAVRNFDEILNAADGIMIARGDLGVEMPIEQLPILQKKLIRKANMEGKPVITATQMLVSMTTEKVPTRAEVTDVANAILDGTDAVMLSEETAIGKFPIETVEMMGKIAKVTEEYRESFGLSRIREFMEIKKGTIKEAITRSIIDAICTIDIKFILTPTRTGRTARLISRFKPKQWILAFSTNERVCNNLMFSYGVYPFCLEEGFDENDIVRLIKGLGLVESDDMVLMTEGKPIEKTVGTNSIKIFQIA

SEQ ID NO: 18815 - protein, 109 aa, Picea sitchensis
MASANRLCVLYLVMIGIVVQTYVEAAEIGASKTAGQQRNGMKRRLLQTIDCNAACGERCTKASRHNMCLRACGTCCARCNCVPPGTSGNQDLCPCYASLKTHGNRPKCP

SEQ ID NO: 18816 - protein, 449 aa, Mycobacterium avium 104
MVIIALVAAISGMLYGYDTGVISWALLQLTQDFNITEGWQQVIAASILLGAVAGALTCSWLSDLRGRRGTLLMLAVVFIVGALWCADAADSVMLSLGRLVLGFAVGGATQTAPMYVAELAPPAYRGRLVLCFQIAIGVGILTATLVGAGGSISWRGPIGLACVPAAIMLWLLLRLPESPRWLVKKDNRDAARAVLEHVRPEGYDVAAELDEATELARVERTAATRGWRGLRDAWVRPALVLGCGIAVFTQLSGIEMIIYYSPTILTDDGVYRSVALQVSVCLGAAYLIAQLVGLAIIDRVGRRRLTLIMVPGAAISLFALGLLFITSDSGRDVIPYIMICLIAFMLFNGGGLQLMGWLTGSETYPLAVRPAATALQSATLWGTNLVITLTMLSLIKAIGVGPSMWLYALFNVAAWIFVFFRMPDLTGKTLEEIEYQLSEGKFRPSDFGR

SEQ ID NO: 18817 - protein, 210 aa, Idiomarina baltica OS145
MSKTTVIAIAGASASGKSLFASTVYQELVAELGSDGIAILAEDAYYRDQSHMTMEQRVLTNYDQPSAFEHDLLKQHIRDLRDGKAVEMPQYSHTTHTRLPESIPVAPAKVIMVEGILLLTDPSLREEFDISVFMDTPLDICLLRRIKRDIEERGRNLQSVTEQYEKYVRPAFFDHIFPSKQYADLVVTRGGRNEIAIDIIKTKIRQLLAE

SEQ ID NO: 18818 - protein, 246 aa, Oryza sativa
MKLNIAYPTTGRQKKLEIDDDQKLRAFYDRRLAAEVEGDVLGDEFKGYVFKIMGGQDKQGFPMKQGVLTNGRVQLLMSPGDQCFRGHGRRNGERRRKSVRGCIVSPDLSVLNLVIVKKGEKDLPGLTDEEKPRMRGPKRASKIRKLFNLSKDDDVRKYVNTYRRTFEANGKKHSKAPAIQRLVTPETLQRKRRKAAVKKAKHEKSRTEAAEYHKLLVQRLKEQRERRSESLAKKRAMRVASQASKE

SEQ ID NO: 18819 - protein, 457 aa, Haemophilus somnus 129PT
MSAGKIIQIIGAVIDVEFPQNAVPKVYDALKVESGLTLEVQQQLGGGVVRCIALGSSDGLKRGLKVENTGNPISVPVGTKTLGRIMNVLGEPIDEKGEIGAEETWAIHRAAPSYEEQSNSTELLETGIKVIDLICPFAKGGKVGLFGGAGVGKTVNMMELIRNIAIEHSGYSVFAGVGERTREGNDFYHEMTESNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRNIASLGIYPAVDPLDSTSRQLDPLVVGQEHYDVARGVQGILQRYKELKDIIAILGMDELSEDDKLVVARARKIERFLSQPFFVAEVFTGSPGKYVSLKDTIRGFKGILDGEYDHIPEQAFYMVGSIEEVLEKAKKM

SEQ ID NO: 18820 - protein, 472 aa, Arabidopsis thaliana
ITLCERNLRVYRDKASSIAMILETQRNVEFPHRIVDKRPRKRPRLTWDAAPPLLPPPPPPTVFQPPLYYGPEFASGLVPNFVYPNMFYNGLPRQGSPPWRPDDKDGHYVFVVGDTLTPRYQILSKMGEGTFGQVLECFDNKNKEVVAIKVIRSINKYREAAMIEIDVLQRLTRHDVGGSRCVQIRNWFDYRNHICIVFEKLGPSLYDFLRKNSYRSFPIDLVRELGRQLLESVAYMHDLRLIHTDLKPENILLVSSEYIKIPDYKFLSRPTKDGSYFKNLPKSSAIKLIDFGSTTFEHQDHNYIVSTRHYRAPEVILGVGWNYPCDLWSIGCILVELCSGEALFQTHENLEHLAMMERVLGPLPPHMVLRADRRSEKYFRRGAKLDWPEGATSRDSLKAVWKLPRLPNLIMQHVDHSAGDLIDLLQGLLRYDPTERFKAREALNHPFFTRSREQSIPPFNPNPHPFLYNQKN

SEQ ID NO: 18821 - protein, 478 aa, Erythrobacter sp. SD-21
MGKETGFLEYEREDRTYLDPAERLKNYKEFTVPHDKDALQKQAARCMNCGIPYCHNGCPVNNIIPDWNHLVYEDDWKNALEVLHSTNNFPEFTGRVCPAPCEAACTLNIVDAPVTIKSIECAIIDRGFKEGWVKPQVPEKQTGKSVAVIGSGPAGLAAAQQLARGGHAVTVFEKSDRLGGLLRYGIPDFKMEKHLINRRAVQMEAEGVQFRTSSEVGVEVSFEALKENFDAVVLAGGAEEARMLHIPGAELPGVRFAMEFLTQQNKRNAGDDEVRAAPRGSLTATDKHVIVIGGGDTGSDCVGTSNRQGAASVTQLEIMPKPPEHEDKALTWPDWPVKLRTSSSHEEGVDRDWAVLTKRVVEEGGQVAGLECVRVEWQGGKLVEVEGSEFTLKADLILLAMGFTGPKRRGLLDRAGVELDGRGNVKADTNRYATSEPHVYACGDMRRGQSLVVWAIREGRQCARAVDEALMGVSELPR

SEQ ID NO: 18822 - protein, 622 aa, Oryza sativa Japonica Group
MPPPTLLLLFITYLAWESQAFRTSADANPEEGCAASTVCGKVTISSPFAVVPEQATESKCGWLGFQVICRNDTPYLGYYKLGYRIQVLDIFYGNNSLLVSDVHKLGGFDVFSGASKEYSCHVPRTNTSSKVALPFSISTTNLNLFLYSCSKALVPRDGDGDLVETRCGNKTFARVGGNYSDSGDYPAFYMEGCNATVVPVLGTDARSYEQLIRDGFLLTWQGPPSSGAVFYRSFLISQTLHTSEGASRRSSCRRIPGRCRNSRRSKLKLIVIVSLSATTSLILTCLVWITCRQKEKGSLLTLQKYVANESKIEEALKEYDSLAPKRYNYSELKKITRSFKDKLGQGGYGMVFKGILQDGRIVAVKLLTGTKGNGEEFLNEVISIGRTSHVNIVSLLGFCLQGSKRALVYEYMANGSLDNYIYSEESKIVVGWGKLQQIAIGIARGLEYLHCRCNTRIIHFDIKPQNILLDEDFCPKVADFGLAKLCRLKDSALSMAEARGTVGFIAPEVFSRGFGVVSTKSDVYSYGMLLLELVGGRRHANELTTSHSTGNYFPNRIYDCLVKDLQTHAIITEEEEIAKLMTLVGLWCIQTNPGNRPSISRVIEMLEKNINEMEVPPKPFLS

SEQ ID NO: 18823 - protein, 598 aa, Oryza sativa Japonica Group
MLVLASFLLLLCHHAHADCEPATCGNLTINPPFWLDEPGRPPCGPPTFQLQCRGSEAFVAHSFFQTYQVVRIFTGNSSVVVVDRSLPLESGCPVPWFNISIGFVMGPFLISRANKELVFVHNCTTTKRRPPQGFRRMPCSPDESFVFLGDGRPRLLLPGCSMSVVPVLGLQDGDYVASMRRGLLLEWMLVPGDCQKCSASGGQCEYSSDGMGFSCKCPSGVHNPTSCVAGDSKSNGRKKTLIVLIPVAVSLLFPCAYVLIWHRKGQILCYLLCNKTRSRNESNIQKLIVSYGSLAPKRYKYSEVAKITSFLSNKLGEGGYGVVFKGKLQDGRLVAVKFLHDSKGNGEEFVNEVMSIGRTSHVNIVSLFGFCLEGSKRALIYDYMPNSSLDNYIYSEKPKETLGWEKLYDIAIGIARGLEYLHHGCNTRIVHFDIKPQNILLDQDFCPKIADFGLAKLCCTKESKLSMTGARGTIGFIAPEVLYRSFGVVSIKSDVYSYGMMLLEMIGGRKNVKSMVQNSSEKYFPDWIYDHFYQGDGLQACEVTSEVEEIAKKMTLIGLWCVQVLPMHRPTITQVLDMFEKALDELDMPPKQSFCESL

SEQ ID NO: 18824 - protein, 127 aa, Vitis vinifera
MKTIPGVSRVTIKKSKNILFVISKPDVFKSPTSDTYVIFGEAKIEDLSSQLQTQAAEQFKAPNVHPAAAQPETAAVVQDDEEVDETGVEPKDIDLVMTQAGVSRSKAVKALKAADGDIVSAIMELTN

SEQ ID NO: 18825 - protein, 347 aa, Sinorhizobium meliloti 1021
MKAVRLESVGNISVRNVGIPEPGPDDLLVKVEACGICGTDRHLLHGEFPSTPPVTLGHEFCGIVVEAGSAVRDIAPGARITGDPNISCGRCPQCQAGRVNLCRNLRAIGIHRDGGFAEYVLVPRKQAFEIPLTLDPVHGAFCEPLACCLHGVDLSGIKAGSTVAILGGGVIGLLTVQLARLAGATTVILSTRQATKRRLAEEVGATATVDPSAGDVVEAIAGPVGLVPGGVDVVIECAGVAETVKQSTRLAKAGGTVVILGVLPQGEKVEIEPFDILFRELRVLGSFINPFVHRRAADLVATGAIEIDRMISRRISLDEAPDVISNPAAAGEVKVLVIPSAERVAQQ

SEQ ID NO: 18826 - protein, 374 aa, Zea mays
MGYQDAPGGGGKLSLASVGFAGPGAGAGGGGYKELLVMALPQDDGLDGAKVAEAIGVRLPDVGGAVRTVLESREAREFASGALAGAMSKAILAPLETIRTRMVVGVGSRHIFGSLVEIIEQNGWQGLWAGNTINMLRIIPTQAVELGTFECAKRSMIEAQEKWKEDGYPKIQLGNMKIELPLHFLSPVAIAGAAAGIAGTLACHPLEVIKDRLTINREVYPSISLAFSKIYQTDGLGGLYAGLCPTLIGMLPYSTCYYFMYDSVKTSYCRFHKKSSLSRPELLLIGALSGLTASTISFPLEVARKRLMVGALQGKCPPNMIAALSEVIREEGFLGLYRGWGASCLKVMPNSGMTWVFYEAWKDILLSDRDRQHA

SEQ ID NO: 18827 - protein, 405 aa, Arabidopsis thaliana
  misc_feature (120)..(120): Xaa can be any naturally occurring amino acid
GLRVASPKPLSLVSSASSSSKSLSSPNPQKMSNDKDSFNVSDLTAALKDEDRAGLVNALKNKLQNLAGQRSDVLENLTPNVRKRVDALRDIQSQHDELEAKFREERAILEAKYQTLYQPXLYVKRYEIVNGTTEVELAPEDDTKVDQGEEKTAEEKGVPSFWLTALKNNDVISEEVTERDEGALKYLKDIKWCKIEEPKGFKLEFFFDTNPYFKNTVLTKSYHMIDEDEPLLEKAMGTEIDWYPGKCLTQKILKKKPKKGSKNTKPITKLEDCESFFNFFSPPEVPDEDEDIDEERAEDLQNLMEQDYDIGSTIREKIIPRAVSWFTGEAMEAEDFEIDDDEEDDIDEDEDEEDEEDEDEEDDDDEDEEESKTKKKPSIGNKKGGRSQIVGEGKQDERPPECKQQ

SEQ ID NO: 18828 - protein, 431 aa, Coprinopsis cinerea okayama7#130
MLASTIARRTATTLRAPAFRSISAWANVPAGPPDPILGITEAFKADKDPRKINLGVGAYRDEHGKPYILQTVKKVPPFTAEEIVASQNPDKEYLGITGLPEFTARATLLAYGAESTPLQQGTISSTQSISGTGALRIGGAFLARHYPHSKVIYLPTPTWGNHIPLFRDSGLEVRGYRYFDKTNVSLDFEGLKADLLAAPDHAIVLLHACAHNPTGIDPTPEQWAVISDIVKEKKLFPFFDMAYQGFASGNTARDAFALRHFVAQGHQVAVAQSFAKNMGLYGERTGNFSLTVADPEEKARVDSQLKIIIRPMYSNPPAHGARIANAILGDPTLYAQWEAEVKGMADRIISMREKVYNLLTHDLKTPGEWGHIKSQIGMFSYTGLQPAQTKALAEKAHVYMTADGRISMAGLNGGNVEYFAQSVDAAVRGNL

SEQ ID NO: 18829 - protein, 498 aa, Aspergillus oryzae
MASSFASILKDASLFVERSYVNGQWVSSNSNATFNVTNPANEAQVGVAPESTLDDLNVAIEAAADAFPTWRSVPGRQRGRILRRIADLLVENKEDIGKIITAENGKAKGDAEGEVMFAASFFEWFGEEASRIYGDIIPHSSAAGRTRVIKEPVGVCGLIVPWNFPLAMGARKVAAALAAGCTVVMKSDGLTPFASNAMAVVAERAGVPKGVFNVVTALNNTPQLGLAMCESDIIKKISFTGSTRVGKLLMKQSSSTLKKLSLELGGNAPFIVFNDADIETAITSALISKFKVTGQTCVCANRFYVQEGIYDRFAQRLVEEVSKFKVGNGLEDPSVTHGPLTNGVAKVEEHIKDAVSKGAKVLLGGNRLPALGKNYHELTILGDANDSMLVSKEETFGPVAALMKFKTEDEVVQRANNCEVGLASYLITSNLGTSHRVSERLEFGMVAINTGVISDAPAPFGGVKHSGMGREGSKYGVDDYMTIKMITTGGINTVYTRL

SEQ ID NO: 18830 - protein, 165 aa, Oryza sativa
MGSSDFSWTLPDHPKLPKGKPVAVVVLDGWGEADADQYNCIHVAETPTMDSLKKGAPEKWKLVKAHGTAVGLPSDDDMGNSEVGHNALGAGRIFAQGAKLVDTALASGKIFEGEGFKYIKESFDQGTLHLIGLLSDGGVHSRLDQLQLLLNGASANGAKNRVHFL

SEQ ID NO: 18831 - protein, 361 aa, Streptomyces avermitilis MA-4680
MTTDGRTGAVPRDAHDVVALGESMVTFLPTRPGRLADVPSFERGIGGAESNVACVLAAAGHSVRWAGRVGADGFGDHLVEAIAAYGVDTSAVRRDPARPTGVYFRTAGDRATDAHEVAYYRAGSAASAMTAENMDLDAVRAGRVLHLSGITAALSDGCLGLLRELTARRPARPLVSFDVNHRPGLWRDTDGPRVLLELARGADLVFVGDDEARAAWGLHGPRAIRDALPEPEVLVVKQGGGGATAFERRPGGPGTGDTSTDTVTFVRALQVDVVAAVGAGDAFAAGFLSATLRGLPVRDRLRHGHLMAAAALTVPGDLAVPPARDHADRLAALDDTAWETLRLGPGWTQAVDRAQEEVRTP

SEQ ID NO: 18832 - protein, 395 aa, Coprinopsis cinerea okayama7#130
MATLSPATSPKIVKRKGSVRRPRNVDALETHNAGVNGIRNFLKGHTCYEAFPVSFRLIVLDTELNVKKALQCLLLNGVVSAPLWNSSQSRFAGMLTVLDIIHLIQYYYRTTASYEYATTDVETFRLESLRGESANAIPQYNAQSHSLREIEKELGVATPPLLSDHPSSSLYDACKVLMQTHARRLPLLDYDTETGHEVIVSVLTQYRMLKFIAINCHKEISQLNQPLRKLRIGTYVASAPNEPKDGPNPYYPIATATLDTSVFNVVHMFSERAISAVPIIDDDGVVLNLYETVDVITLVKLGAYQSLDLKIRDALTQRSPDFPGVVVCTAGDSLGTLLQLIKIRRVHRLVVVEGEEEEKQGGKKGRLLGIITLSDVLRYLIGDVDIPEVQEPPES

SEQ ID NO: 18833 - protein, 472 aa, Candidatus Kuenenia stuttgartiensis
MNNYRKTKIVCTIGPASNSPAMIEQLICAGMNVARLNFSHGELSQHKECISHIRAISEKLMQPVAVLQDLSGPKIRIGMLSGDAVTLKTNDTFTLTTRNIVGNERVISINYSDLPMNVSIGDTLLLSDGEIEVEVIQKDDRNIHCKVIVGGVLTSRKGINIPARSLPVSSLTEKDKKDLEFGIEQGVDYVAMSFVKTAEDITELRDLIQKKGKTIPIIAKIEKHEAVDNIEKIVNTADAIMVARGDLGVEIPLERVPSVQKMIIRLANRYGKPVITATQMLASMVNNYRPTRAEVTDVANAILDGSDAVMLSEESAIGRYPADAVLMLTKIAKQIEPDLTQSNTFEKFRIPENRTTIPDAISIATCQVANELNMNTIITCTQSGSTARFISKYRPRQKILAVTPSVCTYRRLALVWGVIPILTESMENTDDMMKKGIEAAKQAGYIGENETIAITGGVPVGIPGSTNLLRVY

SEQ ID NO: 18834 - protein, 358 aa, Dehalococcoides sp. VS
MNLSDLRKQIDELDTELVKLMAKRLEVSDQIGKVKEETNSPVQDLSRESEVLNRVQSLAQSLGLDPQDIESLYQEILFISKKQQRFTVAFQGAAGAYSEETALKIFGPNTLTLPYEQLDATFEAVEKGMARFAVVPVENSLEGSISRTYDLLLDSNLMVAAEHELRVSHCLIANPETTLEGVKTIYSHPQALGQCQSFLKHLRAELIPAYDTAGSVKMIKEKHLLNGAAIASERAAVIYNMKVLEREIEDNINNYTRFFVLAKQDSAPSGNDKTSVVFAVKHEAGALYDFIKELASRKINMTKLESRPTRLKPWEYNFYLDIEGHRQDENIKQALAKAEDHVIFMKVLGSYPKMKKHI

SEQ ID NO: 18835 - protein, 403 aa, Streptomyces avermitilis MA-4680
MQVIQSTKLANVCYEIRGPVLEEAMRLEAAGHRILKLNTGNPAAFGFECPPEILEDILRNVSSAHGYGDAKGLLAARRAVVMHNQTLGIETDVEHVFVGNGVSELIVMAMQGLLDDGDEVLVPAPDYPLWTASVSLSGGTAVHYHCDEQSDWMPDLADVERKVTDRTKAIVIINPNNPTGAVYDEAMLRGLTDIARRHNLLVCSDEIYDKILYDGATHTPTAAVAPDLLTLTFNGMSKAYRVAGYRVGWMAISGPRAHADSYIEGLTILANMRLCANMPGQHGVVAALSGRQTINELVLPGGRLKEQRDVAHELLTQIPGVSCVKPKGALYLFPRLDPKVFKIKDDRQMVLDLLRREKIMVVQGTGFNWPDPDHFRVVTLPTVGDLTSAITRIGNFLDGYSQP

SEQ ID NO: 18836 - protein, 497 aa, Oryza sativa Japonica Group
MQGTWNARPHSGSRRRSSPSRNSPRQTGQSVAPSMPAPYVAVPREGNGFDRGLIELLLLVLVPTVDEAVDFLNDDEAVDGRVRGAATRRRRPCRCWPSHYASYGVINMSDISALSYLKVFMDAHCQLGDLVDAVVPFMGESITDGTLATFLKKPGDRVEADEPIAQIETDKVTMDVASPEAGIIEKFVASEGGIVTPGVKVAIISKSAAQSKTHTQSSEDTSQKHSTKPPSTKENKVEAKPPKVESSTTHESKLTSSSEPQLPPKERERRVPMPRLRKRIANRLKDSQNTFAMLITFNEVDMTNLMKLLSDYKDQFVEKHGVKLGLMSCFVKAAVSALQNQPIVNAVIDGDDIIYREYIDISVAVGTSKGLVVLVIHDIDAMNFADIEKGINNLAKKATEGAQSINNMAGGTFTISNGGVYGSLISTPIINSPQSSILGMHSIVQRLVVVNGSVLARPMMYLALMYDHRLIDGREAVLFLRRIKDVVEDPRRLLLDI

SEQ ID NO: 18837 - protein, 692 aa, Caulobacter crescentus CB15
MAAINAVTDFSVEGDIGVVTLNSPPVNALSAAVREGLQGAFDAAIADAAVKAIVLICDGKTFIAGADITEFGKAMTGPSLQDVQNVIENSPKPVIAAIHGTALGGGLEVALVANYRVAVPSAKAGLPEVNIGLLPGAGGTQRLPRIVGVEKALEMVTTGQHVPAKAAHAMGLFDELVEEGKLREGAIAFAKAVVAENRPLKKVRDLNEKVEAARGKPEIFEAFRKANAKKFRGFMAPENNIKCIEAAVNLPFDEGLKAERKLFMELMTGSQSAAQRYVFFAERQAAKIPDVPDDTPTIPVKKVGVIGAGTMGGGIAMNFLNAGIPVTIIEAKQENLERGVGIIRKNYENTAKKGRLTQDDVEKRMALLTPSMEMEALADCDMIIEAVFELMEIKKEVFTKLDKIAKPGAILATNTSYLDVDAIAAVTSRPESVIGTHFFSPANVMRLLELVRGDKTSKDVIATCMKLSKTIGKVPVLVGVCYGFVGNRMLAQRQREAQKLILEGAMPWDVDRVLYDFGLPMGPFAMSDLAGLDIGWDPAKTSSSTVREVLCEMDRRGQKNGKGFYDYDENRNAKPSPVVEEVIRDFAEKRQIQRREITDQEILERCLYPMVNEGAKILEEGKAIRASDIDIVWINGYGWPVYSGGPMFWGELVGLDKVLAKMKQFHAELGDDFKPSALLERLVAEGKGFKDA

SEQ ID NO: 18838 - protein, 370 aa, Photorhabdus luminescens subsp. laumondii TTO1
MNSQSPEQTNPDLLKSQVTKILATFTHLTLERDLTTLKALHHCTMLDGVLHIELLMPFVWQSGFKALKAATTEELQAVTGAKSVAWKLIHDISTLRRANDLPGINGVRNILAVSSGKGGVGKSSTAVNLALALAQEGAKVGILDADIYGPSVPSMLGTTKERPTSPDGQHMAPIMTHGLATNSIGYLVTDDNAMVWRGPMASKALMQMLQDTLWPDLDYLVIDMPPGTGDIQLTLSQNIPVTGALVVTTPQDIALIDAMKGIVMFQKVKVPVLGIIENMSTHICGNCGHLEPIFGTGGAEKLAAKYHCKLLGQIPLHISLREDLDRGEPTVISNPDSEFTDIYREIAANISAQMYWQGEKIPTEISFRAV

SEQ ID NO: 18839 - protein, 373 aa, Mycobacterium avium 104
MSGKAQLVLEDGRVFTGTPFGAIGQTLGEAVFSTGMSGYQETLTDPSYHRQIVVATAPQIGNTGWNGEDAESRGDKIWVAGYAVRDPSPRVSNWRATGSLEDELIRQRIVGIARIDTRAVVRHLRTRGSMKAGVFSGDALADPDELVQRVRGQQSMLGADLAGEVSTPDAYIVEPEGPPRFTVAALDLGIKTNTPRNFARRGIRSHVLPSSATFEQIADLRPDGVFLSNGPGDPATADHIVAVTREVLGAGIPLFGICFGNQILGRALGLSTYKMVFGHRGINIPVIDHATGRVAVTAQNHGFALQGEAGQAFDTPFGAAVVSHTCANDGVVEGVKLADGRAFSVQYHPEAAAGPHDANYLFDQFIELMEGDR

SEQ ID NO: 18840 - protein, 213 aa, Photorhabdus luminescens subsp. laumondii TTO1
MADEAYQCTIVGISGASASGKSLIANTLYRELRAQVGDHNIGIIPEDCYYKDQSDLSMEERYKTNYDHPSSMDHNLLFSHLQALKMGESIELPQYDYVAHTRKPEAIHFAPKRVIILEGILLLTDKRLRQEMDFSIFVDTPLDICLMRRIKRDVHERGRSLDSVIEQYHKTVRPMFLQFIEPSKQYADIIVPRGGKNRVAIDILKAKIGQFCE

SEQ ID NO: 18841 - protein, 468 aa, Photorhabdus luminescens subsp. laumondii TTO1
MSKQQIGVVGMAVMGRNLALNIESRGYSVSIFNRSSDKTDEVIAENPGKKLVPSYTVEEFVDSLEKPRRILLMVKAGEATDKTIASLTPHLDKGDILIDGGNTYFQDTIRRNRELSAQGFNFIGTGVSGGEEGALKGPSIMPGGQKEAYKLVAPILQEIAAKAEGEPCVAYIGPDGAGHYVKMVHNGIEYGDMQLIAEAYSLLKNALNLSNEELSEIFTDWNNGELSSYLIEITADIFHKKDEAGQYLVDVILDEAANKGTGKWTSQSSLDLGIPVTLITESVFARYISSLKDQRVAAAQVLSGPDVQPFKGDKAEFIEKVRRALYLGKIVSYAQGFQQLKAASDEYQWDLNYGEIAGIFRAGCIIRAQFLQKITDAYNENVDIANLLLAPYFKKIADEYQQALRDVVSYGVQNGIPTPTFSAAISYYDSYRSAVLPANLIQAQRDYFGAHTYKRTDKEGVFHTEWME

SEQ ID NO: 18842 - protein, 674 aa, Oryza sativa Japonica Group
MNPKLLFFPLLATLLLLCHHAHAVCEPATCGDLTIKYPFWLSGPDLNRSSLAIAACGHPSFELWCSRDGVASLRGSQILVLGIDYTNSSFVAGHKRVADGGDGVCRTDFNISSSLALSPFTISSSNRAICFLYSCNGTEPPEIDGLVNATISNCSKPIYAYLGGSYDRDKPPAIKAGNCTYSYLPVLWPESPVNLTAGTNYSPLFKKGFVLEWQKNGFGDCDACNASGGQCRYNNDSAAAFACLCSDGELRGTICAGSKKTGRRTILIVLTAAAAGLLLPCIYVLIWHGKGKQLRYFLYTKTSSTSERNIEALIISYGSIAPTRYKYSEVTKITSFLNYKLGEGGYGVVFKGRLQDGRLVAVKFLHDSKGNGEEFVNEVMSIGRTSHINIVSLFGFCLEGSKRALLYEYMPNGSLDDYIYSENPKEILGWEKLYGIAIGIARGLEYLHHSCNTRIIHFDIKPQNILLDQDFCPKIADFGLAKLCRTKESKLSMTGARGTIGFIAPEVIYRSFGIVSTKSDVYSYGMMLLEMVGGRKNAKSMVENSSEKYFPDWIYDHFALDDGLQACEVTSEVEQIAKKMTLIGLWCVQVLPMHRPTITQVLDMFERSLDELEMPPKQNFSELLEHPAQEINTESTSSTINTKAAQALSEVLRVEETSLVNSKDPTVTTNYAKR

SEQ ID NO: 18843 - protein, 278 aa, Zea mays
MNSRCRCVSMNTRKLSGHRLPSSSEPEDDVLETRDEHVVESRPEAEGEMVHFSHPEHRLARFDFPYLFMCMGCREYGAGKRFMCQTCGFQLHEFCALAPPSLHDHPLHPKHPHLLFFAKPASGGFLRCKCDVCGKPVRGFSFRCASCSFDMHPCCAAMARRMELPAVHEHPLLLAPAAQDGAETSFVCQVCRRTKRSSGQRVYQCLPCGYYLHARCAKDMVNGLYVHGVVPPEKRNALAAAARATVNALFGVIGGLIEGIGEGIGEAFVDNIGRSRRI

SEQ ID NO: 18844 - protein, 219 aa, Vitis vinifera
MASSDNLASVDPWVFRHTFADSWISEAFARDTETLTKALQKSISNHPDNVACDTISPFLNDLLKPETAQTPSVSGVSGSDHETAPKRRTAIPGAVGGKITKRKSRASKRSQTTFITADPANFRQMVQQVTGVRFGNSQLPVNPILKPEPKRPGNRLLGCLPTLDTSEFLLDHHHQQVMGPATATQGAMTFQPVVADGGATGLEFETFPSFPTLESWKVM

SEQ ID NO: 18845 - protein, 279 aa, Pseudomonas putida GB-1
MIKKCLFPAAGYGTRFLPATKAMPKEMLPVVNKPLIQYGVEEALDAGLNEISIVTGRGKRALEDHFDISYELENQIKGTDKEKYLVGIRRLLDECSFSYTRQTEMKGLGHAILTGRPLIGDEPFAVVLADDLCVNLEGDGVLAQMVALYKKYRCSIVAIQEVDPQETNKYGVIAGEEIKDGIFRVDSMVEKPKPEDAPSNLAIIGRYILTPDIFEKIEQTEPGKGGEIQITDALMKQAAEGNVIAYKFKGKRFDCGGAEGYIEATNFCFENFYKAGKAY

SEQ ID NO: 18846 - protein, 451 aa, Pseudomonas putida GB-1
MAYDFDLFVIGAGSGGVRAARFAAGFGAKVAVAESRYLGGTCVNVGCVPKKLLVYGAHVADELEQAAGFGWTLEEGHFDWGTLIANKNREIERLNGIYRNLLVNSGVTLLQGHARLTGANEVEVDGQRYSAEHILIATGGWPQVPDIPGKELAITSNEAFYLKDLPRRVLVVGGGYIAVEFAGIFQGLGANTTLLYRGDLFLRGFDGSVRTHLKEELEKRGLDLQFNADIQRIDKLEDGSLKATLKDGRELVADCVFYATGRRPMLDNLGLENTGVELDARGYIRVDEQFQTTAPSILAIGDVIGRVQLTPVALAEGMAVARRLFKPEQYRPVDYQNIPTAVFSQPPIGTVGLTEEQALAAGHKVQVFESRFRAMKLTLTDIQEETLMKLVVDAETDKVLGCHMVGPDAGEIIQGLGIALKAGATKQQFDETIGVHPTAAEEFVTMRTVTR

SEQ ID NO: 18847 - protein, 364 aa, Escherichia coli CFT073
MMSKNYHIAVLPGDGIGPEVMTQALKVLDAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDILCVRELTGGIYFGQPKGREGSGQYEKAFDTEVYHRFEIERIARIAFESARKRRHKVTSIDKANVLQSSILWREIVNEIATEYPDVELTHMYIDNATMQLIKDPSQFDVLLCSNLFGDILSDECAMITGSMGMLPSASLNEQGFGLYEPAGGSAPDIAGKNIANPIAQILSLALLLRYSLDADDAASAIERAINRALEEGIRTGDLARGAAAVSTDEMGDIIARYVAEGV

SEQ ID NO: 18848 - protein, 465 aa, Klebsiella pneumoniae
MHDKYDVLIIGGGPGGYVAAIRAGQLGLRTVLVEKQHLGGICLNWGCIPTKALLHGAEVAHTITHASQLGISVGEVNVDLQKLVQFSRTVSQQLTAGVAYLLKKNGVRVIDGTARLRGKGQITVEDARGEARDYRADHVILATGARPRALPGIAPDGEHIWTYFEALRPKLLPKSLLIIGSGAIGVEFASLYNDLGCKVTLVELASQILPVEDAEVSAAVRKSFEKRGIQIHTQTLVTQVQLTDTGVRCTLNNTGGEYSQDVERVLLAVGVQPNIEDLGLETLGVELDRGFIKTDAACRTNVFGLYAIGDVAGPPCLAHKASHEGVLCVETLAGVEGAHPLDRDYVPGCTYARPQVASLGLTESTALARGRPIRIGKFSYQSNGKALVSGETEGFVKTIFDAETGELLGAHMVGAQVTEQIQGFGIARHLEATDESLLSMIFAHPTLSEAMHESILAACDQPLHQ

SEQ ID NO: 18849 - protein, 733 aa, Coprinopsis cinerea okayama7#130
MKLDATDLRYVTSEEFRVLTAVEMGSKNHEIVPTHLIVQISGLRGGGVNKLIGSLAKRNLISKVQNAKYEGYRLTYGGYDYLAMRALSKRDSMTSVGNQIGVGKESDIYVVANAEGDEMVLKLHRLGRISFRSIKTKRDYMGKRKSASWMYLSRLSAQKEYAFMKVLYEHGFPIPKPIDQARHCVLMEFINAYPLRQISEVPSPGKLYSTLMDLIVRFAQAGLIHGDFNEFNILIREETGEPVVIDFPQMVSTSHENAEWYFNRDVECIRTFFRRRFRYESNLYPRFKRTMAEGSADGNDFRLDVIVEASGFSKNDMKVLEEYMEAADLEEEGTGDEEDESEESEEEEEEEEEEEEEGEESEEGGLSMPAQRTYDGPSEGESRQKTSESTQQEDGTPDISVLNISRESSRSASPEPDTVKDDIKARAAAEVSKRQNQQRRKYHSKKSVRNAGRPQGSKGKQDTRVKLDSFWASHAFLPVTLCFCFSLLKSNEMDKSDLEEYQLKLTQVEAALQADPDNAELAALHSELKELIELAQAAIAQAEAASSSSKSDNKKASSSTSTPAHVWSAGDDCLARYSADGQWYPARITFVGGAADNRVYSIVFKGYNTTELVKSTDLKPLPANYASTAPVTGKRKLTKAEEEERERKKKKNEKKLEMKAQKAKEQAAKQQSWQKFAKKSEKKGIHIAGVAGTSIFKTPDNPMGRVGVTGSGRGMTEVAAKTKHKFEGAGEEL

SEQ ID NO: 18850 - protein, 209 aa, Zea mays
MEKGKKSGSGRGYISWNDDMDKALLDTFVEYYNKGDRCQNGWKSHVYTAAIKNVREKCNVEITKDNIMSRNKTFDKHHTIINGMLQTSGFGWDWNKNKISVDSDSVWEAYVAKNKEANGYRHKTVLYWDSINLVFGKDHATGEAAKTPTDGARDMSKEEGTSKELTSSTTSGSLKRQRSSDSFTSMMAEKLDKFTEAIRDEAPKGPTSS

SEQ ID NO: 18851 - protein, 449 aa, Burkholderia xenovorans LB400
MAIKQTGDIAAQRLSPEQLSCEFSDIAPLLDASAAAAAASRCHYCYDAPCVNACPTQIDIPSFIRKISNGNLKGAAVDILSANPMGGMCARVCPTEILCEGACVRNHQDAKPVAIGALQRHATDWAMARGEVLFKRAAETGRHVAVVGAGPAGLACAHRLALAGHTVTIYDAHEKAGGLNEYGIAAYKTVDDFAQREVAWLCSVGGIEIKHGVALGRDIELDTLRKQHDAVFLAIGLGGVRALAMEGEDLGGVMNAVDFIEQVRSASDLGTVPVGRRVVVIGGGNTAVDAAVQSRKLGAASVTMVYRRGVEAMSATWAERDFAQTSGVTLITHATPMRLIGDNGVVTGVEFARASNDGGEERFVVEADMVLKAIGQTLVPVGIGRELLTLDGSRIAVDANGQTSLANVWAGGDCAATGGIDLTVQAVQDGKVAAAAIDAQFARTAAKAA

SEQ ID NO: 18852 - protein, 337 aa, Candidatus Kuenenia stuttgartiensis
MKKILVTGAAGFIGYYVSKKLLASGFNVTGIDNINDYYDTTLKHDRVKQLINNKQFSFHTLDIIDKDALLLIFKKEKFDGVINLAAQPGVRYSLINPHAYIDSNIVGFINILEGCRQNNVQHLVYASSSSVYGKNTKIPFSEHHNVDHPASLYAATKKANELMAHTYSGIYNIPCTGLRFFTVYGPWGRPDMAYFLFTKAIIEGKPINIFNHGKMKRDFTYIDDIVEGVVKVMMRIPCKNPDWDGENPDPATSNAPYRVYNIGNNKPVELLRFVAILEEYLGKKAVKKMLPMQPGDVPVTYANVDELIKDVGFKPATPIETGLKKFTDWYKWYFNVR

SEQ ID NO: 18853 - protein, 195 aa, Oryza sativa Japonica Group
MSKLCQSACKAAKSLLSATAAASSQRTSLLAVYMLQDQEAHAAEMERTFIAIKPDGVQRGLISEILSRFERKGFKLVAIKLVVPSKEFAQKHYHDLKDRPFFNGLCDFLSSGPVLAMVWEGEGVIKYGRKLIGATDPQKSEPGTIRGDLAVVVGRNIIHGSDGPETAKAEIGLWFEPRELVSYTSNEEKWIYGVN

SEQ ID NO: 18854 - protein, 337 aa, Shewanella sp. ANA-3
MAIKIGINGFGRMGRLALRAAWEWDDVEFVQINDPAGDAATLAHLLEFDSVHGRWRYPVTANQDGIQIQDKTIRTTRNKTIAETDWSGCDVVIEASGVMKTKALLQAYLDQGVKRVVVTAPVKEEGVLNVVMGVNHQLYDPAIHPIVTAASCTTNCLAPVVKVIHEQIGIKHGSMTTIHDITNTQTILDAPHKDLRRARACGLSLIPTTTGSATAITHIFPELKGKLNGHAVRVPLANASLTDCVFELERSVTEAEVNMLLQTAAEGELKGILGYEERPLVSVDYKTDPRSSIVDALSTMVVNGTQLKLYVWYDNEWGYANRTAELARLVGQLDLPR

SEQ ID NO: 18855 - protein, 311 aa, Arabidopsis thaliana
MVEPYETRNNGEASQMIRYQSYNHHNSRLPSSLSSPLLDLRVFYVRISNFKVDHSTPEVLTITHIPLDPDSLLEINGVRMSMYSEGVSSQLRRDRVDKKSEVATFISTDNIRLSGSVKFEVYDKDELVLSGTLEMSGSNGFTGESKHSVKRWNMNCEAEITAESGFLKEKHIGGSELSSPLPTIEVYVTGCFSGTPIILTKTLQLGFRKKHGRVTALDSIPEYETDEPHKGNSSELDYQVTEYGSYKQEYEGEHSDMYWNREYADGEDGEMSWFNAGVRVGVGIGLGVCKLQKEDYLVSFKLPQASSTLSL

SEQ ID NO: 18856 - protein, 1125 aa, Candida glabrata CBS 138
MDITNQNHSIDTPMPDTRPDIEFGFGYNAGTTRGGPSLASMQIQQGTNTHHQINNDISFNIGNNDTNSNDTNENIHVDSLRNNGNIQRFTAGDRLPNTIGNQSVAMARSIPGSIESRNGFPQDGEALMDMSNVESIDYNAPAKIFADMDINRLFYDPNLSSLQAEDIIKLHNFKEVVHRKIENFIEVIQKRRERILKEIELGNQRLEGVDLETSVSAMTYLNKLQRIRISALKSETMELQNLRIQIVSIVDEYKKAMAEYSKLNQEGRNAVNPTPYFQRWIKSLNPEDISGLNKELIELQMYSKQLSDIPELASIEYQVSTPQTSQFPLRSLPSEILHLVLDKITQKADIVNLLRVCKLWALIIVKILYYRPHINRKHQLDLFMRTMKLTKDETVFDYRSMIKRLNFSFVGDHLHDEELYNFVGCRNLERLTLVFCKHITSDPVAAVLKGCKYLQSVDITGIKEIYDNVFDTLAESCKRVQGFYVPQAKLVSYNALTNFVSNAPMLKRIKVTANANVNDEFLDLLAEKCPLLVEVDITLSANVHDSSLTKLFMKLTQLREFRITHNANVTDKFFLDLSKNVNQLPSLRLLDLSGCENITDKTIDRVVQLSPKLRNIFLGKCSRITDLSLFHLSTLGKNLQTVHFGHCFNITDRGVRALIKSCPRIQYVDFACCTNLTNHTLYELSYLSRLKRIGLVKCSQMTDDGLLNMIALRGRNDSLERVHFSYCSNLTIYPIYELLMACPRLSHLSLTAVPSFLRPDITAFCRPAPSDFSDNQRQIFCVFSGKGVHKLRHYLMSLTTPTDGPQIDVGDTLEQYVISKHLLRPGEYLNDGIRRITSELNQDSAAILAATGLNQMNGMNSDFPFQNIDFERLDEVFNWINMSMDGHSLNSDELNDLISEVDRDFCDDPFDEDYNSRDSIVAPGANTGLNSELCHIVKKFHRLDDQICDFEVNVSSLARVQFQFTGFLLHEMAQAYMNMVEINRQIWHIQKTTLEAGVESDIKALLVWRILFIDKFTALLHKYQISTVVLRLYLKDSITLLTRQRELFLAHQRTPWNPTIVEEAPDSNYWQLVGDRIQLLPEQMRVMPFGLRNPAIANNAQQNAAEAQNDDRSETPEDDVAIEDF

SEQ ID NO: 18857 - protein, 640 aa, Ralstonia metallidurans CH34
MIRIDQLVLQRGTKVLFDHTSVTLNPGERVGLVGANGSGKSTLFSMLRGELHADGGDVFLPAQWRIAHVAQETPAVARSAVDYVVDGDTRLREIEARIAAAQASGDGSAEGEAHAAYADADGYTAAARAEALLLGLGFTLPQVSQPVASFSGGWRMRLNLAQALMCPSDLLLLDEPTNHLDLDAIVWLEDWLARYPGTLVMISHDREFLDAICNVTVHIENQQLKRYGGNYTQFETMRLQQMAQQQSAYARQQKEIAHLESFINRFKAKATKARQAQSRVKALEKMERLAPVHVAAGFAFEFREPDSAPNPMMVLEGVDCGYAEADPPVTILHNLALSIQNGQRIGLLGANGQGKSTLVKTLAGTQAPLNGTVRLGKGLVIGYFAQHQLETLRDHDSPLQHLARLAPDVREQELRDFLGSFNFRGDMATSPIEPFSGGEKARLALSLIVWQKPNLLLLDEPTNHLDLDTREALTMALAQFEGTLILVSHDRHLLRATSDQFMLVAEGTIRPFDGDLDDYRDWLLQQAAAKRNAATAAHAAEAAPVVNRKDQRRAEADERQRLSVLRKPLTKELEKVEKRMSVLQADKTTIDTFMADASSYDDANKTKLKDMLKRQGEVTGELEQLEERWLELQEQIEQIA

SEQ ID NO: 18858 - protein, 78 aa, Arabidopsis thaliana
  misc_feature (17)..(17): Xaa can be any naturally occurring amino acid
  misc_feature (29)..(29): Xaa can be any naturally occurring amino acid
MASFMLFSAAVGTFPGXNTMGALYTGLKXTLFFPDHPRPNNIIFITRNGGRGICLKELPPLLKKKIETLFYLPDLTDD

SEQ ID NO: 18859 - protein, 789 aa, Shewanella sp. ANA-3
MQQYVLWYQELGMGDVNLVGGKNASLGEMISNLANAGVQVPGGFATTSYAFNEFLEQSGVNQKIYDILATLDVDDVNALAQVGAQIRQWVIDTPFQPALEQAIREAYDKLAAETSDASFAVRSSATAEDMPDASFAGQQETFLNVKGFDSVLVAIKHVFASLFNDRAISYRVHQGYEHHGVALSAGVQRMVRSDKAASGVMFTMDTESGNNDVVFITSSFGLGEMVVQGAVNPDEFYVHKPILTQGHKAVVRRNIGSKLIQMVYSDDASHGKQVKIEDVAAEKRRQFSINDAEVMELAKQAMVIEKHYGRPMDIEWAKDGNDGKLYIVQARPETVRSREDVQLIERYHLKSRGAVISEGRAIGHKVGSGVAKVLTSIADMDQIQPGDVLVTDMTDPDWEPIMKRASAIVTNRGGRTCHAAIIARELGVPAVVGCGDVTDRIKNGQLVTVSCAEGDTGYIYEGKQEFEVVSNRVDALPALPMKIMMNVGNPDRAFDFARLPNEGVGLARLEFIINRMIGIHPKALLEFNQQDAALQEEINEMIAGYDSPVEFYIARLVEGIASIGSAFYPKKVIVRMSDFKSNEYANLVGGDRYEPEEENPMLGFRGASRYISESFRDCFALECEAIKRVRNEMGLKNVEVMIPFVRTVKEAEQVIELLKEQGLERGKDGLRVIMMCEVPSNALLADQFLEHFDGFSIGSNDLTQLSLGLDRDSGIISHLFDERNEAVKILLSMAIKAAKAKGAYIGICGQGPSDHADFAAWLVEQGIDTVSLNPDTVIDTWLYLAEAHG

SEQ ID NO: 18860 - protein, 116 aa, Oryza sativa
  misc_feature (50)..(50): Xaa can be any naturally occurring amino acid
GDVTEANPLEVLRQVDEIFVQAIKDAGLYDIIWQAFAVFLPVPTVGVPGXTRVTPLPKPSSLEGQITSEDGMTADWYYFEREFLVDVVNKICNNVRGVNRVVQDITQKPPATVEWE

SEQ ID NO: 18861 - protein, 536 aa, Mycobacterium avium 104
MFGLVLIVALVSTVIVGTVIGRRYRVGPPVLLIVLGVLLGLVPQFGHVRIDGEIVLLLFLPAILYWEGLNISFREIRANARIIVFLSVALVIATAVAVSWTARALGMDPHAAGVLGAVLSPTDAAAVAGLAKKLPRRSLTVLKAESLINDGTALVLFAVSVHVAIGAPAISPPEVTLRFIGSYLGGIAAGLLVGGAVTLVRKRIDAPQEEGALSLVTPFAAFLLAQSVECSGVVAVVVSALVLAYSGPVVIRARSRLQSYAFWDIATFLLNGSLWVFVGVQIPGALRGIAGVDGGVRHALFVALVITGVVIVSRIFWGEFTTMLIRLIDRRAVQRERRVGWRQRFVTAWAGFRGAVSLAAAVAVPMTTLSGAPFPDRSLLIFIVTVVILVTVLVQGSTLPAVVRWARLPADVAHAEELQLARTRAARAALDALPAVADEVGVSDELRRRLHKEYEEKAALVLATENGSPDNRILKTREKVRQVRLGVLEHKRREVTALRNQNRIDDTVLRELQNEMDLEEVQLLAAAADEDDGDTE

SEQ ID NO: 18862 - protein, 153 aa, Streptococcus mitis
EHFIRGQYRSGKIDGMKYISYRSEPNVNPESTTETFASGAFFVDSDRFHGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 18863 - protein, 218 aa, Shigella flexneri
RVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 18864 - protein, 792 aa, Debaryomyces hansenii CBS767
MSSKTSSSASKKKATSTPASESSTKKVKIPKNYIVRPSPNNSARSSNKVFINSEILQALEISNGSIVYISKVSGGEAGVLGTIHSDNDIIDKNVIGISSSLRCLGGLLLGDRIQIDKYLSQPEYATSVDLRIENDQNESIKIEGKVSKALEKLFNEIGIVFPGLKLTKVSIPNNEGGNEEEDIKMSCTIKVIDVLGKESLEDSLNKLSINEEKESEICNSLTVSPAYIFSKGKTQINTSVIREPLRSKFPQLPQPVGYSQVGGLSRPIALLQSTIELPLHNPTLFSDFGISPPRGILLHGPPGTGKTMLLRCVANETNAHVLTVNGPSIVSKYLGETENAIRDIFEEARKFQPSIIFLDEIDSLAPNRNSDDSGETESRVVATLLTMMDGMGDTGRIVVVGATNRPNSIDPALRRPGRFDQEVEIGIPDVEARGDILIKQFDKMDKSKFDLTKEEINSIASKTHGYVGADLTALCRESVMKAINRSLKASIPQREIKLELRDVEEALPEIRPSAMREIFLEMPKVYWSDIGGQEELKQKLTEVVQLPLEAADTFNKLGVLAPKGVLLYGPPGCSKTLTAKALATESGLNFLAVKGPEIFNKYVGESERTIREIFRKARAASPSIIFFDEIDAISGDRESSGTSASQNVLTSLLNEIDGVEELKGVVIVGATNRPTEIDPALLRPGRLDRHIYVSPPDYDARLQILTKGCSKFNLDGREVNLSTLADLTNGCSGAEVALLCHEAGLSAVMEDKQATCVEQRHFDHALKGISKGITQDMLDYYKTFSSRSGLSI

SEQ ID NO: 18865 - protein, 506 aa, Brucella melitensis 16M
MVMSTIVKPQPLTGLEVREFSMLIDGKWVGSDSGKSIERVAPGHGVTVSRYPAGNKANVERAVSAARKAFDDGRWSSKTASQRSLVLLKAADLIEARAEELAYLDAIEAGKPISQVRGEISGSVDIWRYAAALARDLHGESYNTLGDGTLGVVLREAIGVVSIITPWNFPFLIVGQKLPFALAAGCTAVVKPSELTSGSTLLLGEILAEAGVPDGVVNIVTGTGADVGQHMSTHPHVDMVSFTGSTGVGKLTMANAAQTLKKVSLELGGKNPQILFPDADMDAFIDAAVFGAWFNAGECCNAGSRLIVHRSVVDAIVGRVADLSKKVIVGDPLDASTQVGAIITPQHLTKVGAYVDQARKAGAAIAHGGEVLDLGLGQYMGPTILAGVKADMAVAREEVFGPVLSVLSFDTVEEAISIANAVDYGLSAGVWSRDFDTCMTIGRKVRAGTVWMNTFMDGTPELPFGGYRQSGLGRELGRHAVEDYTETKTLNMHIGARTGWWMPQAK

SEQ ID NO: 18866 - protein, 201 aa, Salinibacter ruber DSM 13855
MYTSAALRYIPNLLTVGRILVTPLLLLLLSVPSKAGQMSAVVLFVLASLTDYYDGVLARRYGVRSRLGQYLDPLADKILILGTFIALALEAPDLVPWWAVVAIALRDVVVTVLRSWAEASGQTLHTYRVAKGKTMLQAAFLFGVLTLRAATHFSPPLRDAARWLLYDSGLPGLALTVVVGFTLATGALYVVAPVEEKVELE

SEQ ID NO: 18867 - protein, 297 aa, Escherichia coli
MTNLKAVIPVAGLGMHMLPATKAIPKEMLPIVDKPMIQYIVDEIVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFLKNIEQLLAK

SEQ ID NO: 18868 - protein, 333 aa, Staphylococcus epidermidis ATCC 12228
MKNLRNRSFLTLLDFSRQEVEFLLTLSEDLKRAKYIGTEKPMLKNKNIALLFEKDSTRTRCAFEVAAHDQGAHVTYLGPTGSQMGKKETAKDTARVLGGMYDGIEYRGFSQRTVETLAQYSGVPVWNGLTDEDHPTQVLADFLTAKEVLKKEYADINFTYVGDGRNNVANALMQGAAIMGMNFHLVCPKELNPTEELLNRCERIATENGGNILITDDIDKGVKDSDVIYTDVWVSMGEPDEVWQERLKLLKPYQVNQALLEKTGNPNVIFEHCLPSFHNAETKIGQQIYEKYGISEMEVTDDVFESKASVVFQEAENRMHTIKAVMVATLGEF

SEQ ID NO: 18869 - protein, 570 aa, Zea mays
MGSFLRKQPSYLFILIILHLVAHEARTLSSDGEALLAFKKAVTNSDGVFLNWREQDADPCNWKGVRCDSHSKRVINLILAYHRLVGPIPPEIGRLNQLQTLSLQGNSLYGSLPPELGNCTKLQQLYLQGNYLSGYIPSEFGELVELVALDLSSNTLSGSVPHSLDKLSKLTSFNVSMNFLTGAIPSSGSPLSFLKKNSRGGTPPRDDMINKRNGKNSTRLVISAVATVGALLLVALMCFWGCFLYKNFGKKDMRGFRVELCGGSSVVMFHGDLPYSSKDILKKLETMDEENIIGAGGFGTVYKLAMDDGNVFALKRIVKTNEGLDRFFDRELEILGSVKHRYLVNLRGYCNSPSSKLLIYDYLQGGSLDEVLHEKSEQLDWDARINIILGAAKGLSYLHHDCSPRIIHRDIKSSNILLDGSFEARVSDFGLAKLLEDEESHITTIVAGTFGYLAPEYMQFGRATEKTDVYSFGVLVLEILSGKRPTDASFIEKGLNIVGWLNFLAGENREREIVDLNCEGVHTETLDALLSLAKQCVSSLPEERPTMHRVVQMLESDVVTPCPSDFYDSE

SEQ ID NO: 18870 - protein, 466 aa, Yersinia pestis KIM
MMSDQQEGAELKRGLKNRHIQLIALGGAIGTGLFLGIAQTIKMAGPSVLLGYAIGGFIAFLIMRQLGEMVVEEPVAGSFSHFAYKYWGHFAGFASGWNYWVLYVLVAMAELTAVGIYVQYWWPEIPTWVSAAVFFLAINAINLANVKVYGEMEFWFAIIKVIAIIAMILFGGYLLISGRGGPEATVTNLWAQGGFFPNGIMGLVMAMAVIMFSFGGLELVGITAAEAEDPAKSIPKATNQVIYRILLFYIGSLAILLSLYPWGKVVEGGSPFVLIFDALDSNSVATVLNIVVLTAALSVYNSCVYCNSRMLFGLAKQGNGPKILLKVDGRGVPVIAIAVSAFATAFCVLINYLLPGRAFELLMALVVSALVINWAMISLAHLKFRAAKNRQGVIPKFKAFWYPFGNCLCLLFLTGILVIMFLTPSIRISVILIPVWVVVLAIGYILKNQSQRQNQQLSASSRKVTK

SEQ ID NO: 18871 - protein, 458 aa, Streptococcus pneumoniae
PSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATANKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVCASWKLIDRIEKLWAENGAPLHDYKAGSMGPQASFDLLEKFGAKW

SEQ ID NO: 18872 - protein, 470 aa, Streptococcus pneumoniae
DLAKRKLYPSLFRLYQSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATANKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWAENGAPLHDYKAGSMGPQASFDLLEKFGAKWTWQP

SEQ ID NO: 18873 - protein, 468 aa, Streptococcus pneumoniae
AKRKLYPSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATANKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVCASWKLIDRIEKLWAENGAPLHDYKAGSMGPQASFDLLEKFGAKWTWQP

SEQ ID NO: 18874 - protein, 470 aa, Streptococcus pneumoniae
DLAKRKLYPSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATANKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWAENGAPLHDYKAGSMGPQASFDLLEKFDAKWTWQP

SEQ ID NO: 18875 - protein, 624 aa, Coprinopsis cinerea okayama7#130
MAAPSMAAALAASLPAAPVAPVQVAPTYEALPSSMAKVIDIEAEIPLNVVQLDGMAVTKIIKHAREAPSTTAHGLLLGLDLDGVLEISNSFPLPHAGDEAEKASKSIARHQAAMLRSLKEVQADDSVVGFYQATTLGAFFNQTLLDTQAIHQDKLRHGGIVIVHDLSQTARGNASFRAFRLTVAFLDAYKRSNFSTPSLISHRLTFSSILEEVPLKIRTNPLLSSFLGTLTETRKEPVQDATLPSGSALAPSFSVLDLGTAGTTRNLEQIVEALESYRTEEGNLSYLSRQIARERAKAEAYIAKRKEENQVRIAQGLAPLPEEDVSRMFKIPPEPSRLESLLLLGQIDGYAKNLESTASMGLVKMYGAKAGTMPSFVNAVVVFLAAVASVNGLVTPHIARHNAHHRSIAARVAEPQVQPALVPRAPTATLRKRCRPRLVFVTPSPSPSTAPAPSPEVPPVNVAPSPSPEPQPEPEQPAPVPSPEAPPAPVEPAPQPAPQQPAPQPGNGGGNQPGFMSGTQTGQGTFYDAGLGACGIVNTNADYIAAVSHLLFDNYPGYNRVNPNTNPLCGRTVTATYQGRSVTVAITDRCEGCAVTDLDFTPSAFAQLADHSLGRISGVTWHWN

SEQ ID NO: 18876 - protein, 457 aa, Streptococcus pneumoniae
PSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATANKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVCASWKLIDRIEKLWAENGAPLHDYKAGSMGPQASFDLLEKFGAK

SEQ ID NO: 18877 - protein, 331 aa, Ustilago maydis 521
MTSDSVKMWTNMTEAEVQEMYVFAIELARKAGRAIVEGSSRRFASSAGYDQKKNTADLVTETDEAVEALVKREIAGRYGTHAFIGEESWAAGEENAIGDQVTWIVDPIDGTTNFVHGFAFTCISIGVVVDRKPTIGVVYAPFMDTLYHGCVGKGSFVSSAHYPTPQRLPLASPQPLTSLNQALVAFEWGSDRRSEILARKLSSFAKITGDAQAGVVGGKFAQGVRSIGSAALNFCNVASGSLDLYWEIGCWAWDVCAGIVIAQEAGAAVVGSHAHTMSVIETDAFNQVTPDVLTGRKYVVVRAIATDQQSNIQAQKHILTEFYSCIDEWDP

SEQ ID NO: 18878 - protein, 464 aa, Dehalococcoides sp. VS
MANGKVIQVIGSVVDVEFSADSMPALFNALEIPRDNGKMVLEVQSHVGNNRVKCLSFTPTDGLERGAEVIDTKRPLSVPVGRNTLGRIFNVLGEPLDNRGDVKSEKTMPIHRSAPAMDELESSAQVLETGLKVIDLIAPFARGGKIGALGGAGVGKTVLIQELIRNIATEHEGFSVFAGVGERSREGNDLWHEMEDSGVLPKTTMVFGQMNELPAVRLRIALTGLTMAEYFRDEERQDVLLFIDNIYRYTLAGMEVSALLGRMPSAVGYQPTLATEMGALQERIASTKQGSITSFQAVYVPADDYTDPGVVATFGHLDAMIALERSLAEQALYPAVDPLASNSRILDPQVVGEEHYKVARDVQKVLQRYKDLQDVIAILGMEELSEEDKLTVARARRIQRFLTQPMFVSEVFTGRPGQYVSLAETIRGFKEILEGKHDSLPEQAFYMVGTIDDAVAEAKKLSAV

SEQ ID NO: 18879 - protein, 409 aa, Streptomyces avermitilis MA-4680
MSYSTADSLPAVTLDDVRGAQKMLAGVARMTGMEGSRHLSQLVGAPVHFKCENLQRTGSFKLRGAYVRIAGLLPEERAAGVVAASAGNHAQGVALASSLLGVRSTVFMPKAAPLPKISATREYGAEVRLHGTVVDETLAAAQEYAAETGAVFIHPFDHPDIIAGQGTVGLEILEQCPEVRTIVVGIGGGGLAAGIATAVKALRPDVRIVGVQAAGAAAYPPSLAAGRPVSVENPATMADGIKVGRPGDVPFRIIGDLVDEVRTVSEGNLSSALLLCLERAKLVVEPAGASPVAALLREPGAFEGPVVAVLSGGNVDPLLMQRILRHGMAAAGRYLAVRLRLTDRPGALATLLGVLPTVDANVLDVSHVRTDPRLGLTEVEVELHLETKGPEHCAEVEQALREAGYTVID

SEQ ID NO: 18880 - protein, 413 aa, Magnaporthe grisea 70-15
MSTKKFSIVAFGGDYAGPEVMAEGLKVMNQVLSRYPDVECDIKSYELGGTSFDLHGEALLPEALEAAKKADAVLVGAVGGPKWNGRVPSVEFQSLGALRRELQLYGNLRPINFAAPSLVDDSPLKAEVVRGTDILMIRELTGGIYFGEKSQGDRAASDTDRYTYEEVERVARLAGSLARQQRDPPLPVVSLDKANVLMACGAFWRRVVAEVFAAEFPDVPLTHQLADSAAMILACSPTKLNGVVLASNLFGDILSDQASVIAGSIGLLPSASLCGIPTAGSGMIKGLYEPIHGSAPDIAGKQVVNPIGMILSVAMMFRYSLGMPEAAGLIETAVRDTIEAGTMLLPERFQVGQFVQAASCKGVQRDTPATIDDLGTGKWQTHLWDRPTPCYIMRIMKSLLEQSDNGSAYAHLC

SEQ ID NO: 18881 - protein, 620 aa, Oryza sativa Japonica Group
MWRHAARRSSAQIRRSGVMSSSSSPAAPAAAAGAAVPGPCIVHKRGTDILHDPWFNKDTAFPMTERDRLGLRGLLPPRVMSFEQQYDRFINSFRSLEHNTRGEPDTIVALAKWRILNRLHDRNETLYYRVLIDNIKDFAPIIYTPTVGLVCENYSGLFRRPRGMYFSAKDKGEMMSMIYNWPAEKVDMIVVTDGSRILGLGDLGVQGIGIPIGKLDVYVAAAGINPQKVLPIMLDVGTNNTKLLEDKLYLGLRQPRLEGEEYLSVVDEFMEAVHARWPKAVVQFEDFQMKWAFETLQRYRNRFCMFNDDVQGTAGVALAGLLGAVRAQGRPLSDFTKQKIVVVGAGSAGIGVLNMAKQAMLRMPGINRSGEGHNQFWVLDKDGLITKSRKGLDPAVARYARGFGPEEVQDLHEGASLVEVVRKVKPHVLLGLSGVGGIFNEEVLKAMKESDSPRPAIFAMSNPTTKAECTPEDVFKYVGDNAVFASGSPFSNVTLGNGRQGYANQANNMYLFPGIGLGALLSGARHITDGMLQSAAECLASYITDDEIRKGILFPSISSIRHITARVGAAVVRAAVDEDLAEGRCDVDARDLKSMTEADTVDFVARKMWYPIYSPLVNDK

SEQ ID NO: 18882 - protein, 255 aa, Mycobacterium avium 104
MTDFVKQHPRPPEGFFGWEAAGLRWLSSVDGGVPCARVVAVDATSLTLRRLQSVPAGRDAAHEFGRRLAVTHDAGAAAFGAGPDGWDGPGYFGPLSQPLPMSLRRHRHWGSFYAEERLVPMAERAAPRLAASTRDAIGAVAARCRAGDFDDDDGPARLHGDLWSGNVMWTPDGVVLIDPAAHGGHRETDLAMLALFGCPHYDAVLAGYQQVRALKPGWRNRIGLHQLYPLLAHVVLFGGGYAGQTDAAARAALAA

SEQ ID NO: 18883 - protein, 308 aa, Escherichia coli O157:H7 EDL933
MAVAMDNAILENILRQVRPLIGQGKVADYIPALATVDGSRLGIAICTVDGQLFQAGDAQERFSIQSISKVLSLVVAMRHYSEEEIWQRVGKDPSGSPFNSLVQLEMEQGIPRNPFINAGALVVCDMLQGRLSAPRQRMLEVVRGLSGVSDISYDTVVARSEFEHSARNAAIAWLMKSFGNFHHDVTTVLQNYFHYCALKMSCVELARTFVFLANQGKAIHIDEPVVTPMQARQINALMATSGMYQNAGEFAWRVGLPAKSGVGGGIVAIVPHEMAIAVWSPELDDAGNSLAGIAVLEQLTKQLGRSVY

SEQ ID NO: 18884 - protein, 133 aa, Zea mays
PLPGVGKDALEDPQNLLVEGIIDRAEANDAAQRKQKMMILEQQYRDDLKKELQGITCTSAGSIETSTEVVQTGESTTSVHENVDHDDMGKLMLSRKRRGLVKAIEKSRERNKAQTDLIKQRKKKIDEEQRQRS

SEQ ID NO: 18885 - protein, 399 aa, Glycine max
  misc_feature (187)..(187): Xaa can be any naturally occurring amino acid
MASASASLLKSSLVLDKSEWVKGQTLRQPSASVVRCNPTTPSGLTIRAGSYADELVKTAKTVASPGRGILAMDESNATCGKRLASIGLENTEANRQAYRTLLVTVPGLGQYISGAILFEETLYQSTTDGRKIVDVLLEQNIVPGIKVDKGLVPLAGSNDESWCQGLDGLASRSAAYYEQGARFAKWXRTVVSIPNGPSALAVKEAAWGLARYAAIAQDNGLVPIVEPEILLDGEHGIDRTFEVAQKVWAEVFFYLAENNVLFEGILLKPSMVTPGAESKDKASPQTVADYTLKLLHRRIPPAVPGIMFLSGGQSEVEATLNLNAMNQSPNPWHVSFSYARALQNTALKTWGGRPENVKAAQDALAFRAKSNSLAQLGKYTGEGESEEAKKELFVKSYSY

SEQ ID NO: 18886 - protein, 481 aa, Pseudomonas fluorescens PfO-1
MRPVQTPQKTTARQRQKTSINREAKTVIETLNHLPHPQESAAALAGHFTDLAPPLNDRQAHLEASRCLYCYDAPCVNACPSEIDIPSFIRNIHQDNVPGAAQKILSANILGGSCARVCPTEILCQQACVRNNAHECAPVLIGLLQRYAVDNANFTEHPFQRAAATGKRIAVVGAGPAGLSCAHRSAMHGHEVVIFEAREKAGGLNEYGIAKYKLVDDYAQKELDFLLQIGGIEIRHGQKLGENLTLSELHQQFDAVFLGLGLNASKQLGLPHEDAPGLLAATDYIRELRQADDLSQLPLAERCIVLGAGNTAIDMAVQMARLGARDVNLVYRRGAADMGATGHEQDIAKANQVRLLTWAQPDEVLLDAQGKVRGMRFARTHLVDGRLQTTGETFELAADAIFKAIGQAFDGSALADPLARELKRQGERIQVDENLRTSIPGVYAGGDCTSLDQDLTVQAVQHGKRAAEAINAQLMLNVEAA

SEQ ID NO: 18887 - protein, 297 aa, Shigella flexneri 2a str. 2457T
MTNLKAVIPVAGLGMHMLPATKAIPKEMLPIVDKPMIQYIVDEIVAAGIKEILLVTHASKNAVENHFDTSYELESLLEQRVKRQLLAEVQSICPPGVIIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 18888 - protein, 398 aa, Alteromonadales bacterium TW-7
MTYLVIAFIGALFLIYSLTLRQLEKTEVTGPMFFVIGGITLANLVPNNGGELKAGVDLLLPFIELTLSIFLFSDAAKSKLSVLRHSFQYPGLLLFVALPLTLLLGIAVGLFLFAELSLIQAALIAIILTPTDAALSKGLLSSSEVPEKIREGINTESGLNDGLCVPVFLIFILLAKNPESAITTSHVVSVFSRELGIALLVAITSISIFIPSLNFAMKRHYFAQNTSPFLLLGFAMAVFSVTQYLHGSGFIAVFVAGLLFDKFSTKTVRTELIEDSEHIADFTSLMIWCLFGYACAYLVLPKLNFEIVTYAFLSTTLIRIIPVMLSLLFTSLNLKERFTFAWFGPRGLASIVFTLMVIDEQIENKFQIASIAMTTILFSVFIHGISTKPIADSFKSAK

SEQ ID NO: 18889 - protein, 495 aa, Pseudomonas putida GB-1
MSDITLLPAVTAFLAREHGVFIHGQHLASQSSSTIAVVNPANGQTIAHIADANQADVDHAVSSSRQGFATWSHTSPAARAAVLFKLADLLEAHREELAQLETVQSGKLIGISRAFEVEQAAHFLRYYAGWATKITGQTITPSLPSFAGERYSAFTLREPIGVVVGIVPWNFATMIAIWKLASALTTGCSIILKPSEFTPLTLLRIAELATQAGLPAGALNVLTGGGLVGKALIEHAGTDKVSFTGSVPTGIAVGQAAMGAKLTRATLELGGKNAVAFLPDVATDKAVDGIIEAGFLHSGQICAAGERFYVHRSRIDPLLDALSQRLGQLKIGSPLDESTQFGPVANKPHQQKLAELFATARAEGSQIIHGGKLGDGPGCFVEPTVILARSANDTLLNQETFGPVATFLPYDDEDELLQLMNASPYGLSASLWTNDLGKAMRMIPQIQAGTLWVNMHTLLDPAVPFGGIKASGVGREFGSAFIDDFTELKSVMIRY

SEQ ID NO: 18890 - protein, 267 aa, Salmonella enterica subsp. enterica serovar Typhi str. CT18
MTIPAFGLGTFRLKDDVVIASVKTALELGYRAVDTAQIYDNEAAVGQAIAESGVPRNELYITTKIWIENLSKDKLIPSLKESLKKLRTDYVDLTLIHWPSPGDAVSVEEFMQALLEAKKQGLTREIGISNFTIPLMEKAIAAVGADHIATNQIELSPYLQNRKVVDWAKAHGIHITSYMTLAYGKALKDEVIARIAVKHNATPVQVILAWAMGEGYSVIPSSTRRENLASNLLAQDLHLDAEDKNAIAALDCNDRLVSPEGLAPAWD

SEQ ID NO: 18891 - protein, 235 aa, Triticum aestivum
  misc_feature (224)..(224): Xaa can be any naturally occurring amino acid
TRPRAEFGTRPISRPRPAPIPCEVRTPASLRGSAPRGGRPARSGVFYKFTQQDLPAWKPAMTPGYVIAIFLIIGIIFVPLGLICLQASNRVAEIVHRYDIDCVPDAYRSNKQAYIKDSSISKECIQKVKVQYHMKAPIYVYYELDNFYQNHRRYIKSRSDKQLRHGLQYTDSSCSPIERSDGLPVVPCGLIAWSWFNDTYDFTRGSMGLVVIGKHSWRSDRNIXWKDVNLQLQNG

SEQ ID NO: 18892 - protein, 431 aa, Burkholderia cepacia
LNDDATFWRNARHHLVRYGGTFEPMIIERAKGSFVYDADGRAILDFTSGAMSAVLGHCHPEIVSVIGEYAGKLDHLFSEMLSRPVVDLATRLANITPPGLDRALLLSTGAESNEAAIRMAKLVTGKYEIVGFAQSWHGMTGAAASATYSAGRKGVGPAAVGSFAIPAPFTYRPRFERNGAYDYLAELDYAFDLIDRQSSGNLAAFIAEPILSSGGIIELPDGYMAALKRKCEARGMLLILDEAQTGVGRTGTMFACQRDGVTPDILTLSKTLGAGLPLAAIVTSAAIEERAHELGYLFYTTHVSDPLPAAVGLRVLDVVQRDGLVARANVMGDRLRRGLLDLMERFDCIGDVRGRGLLLGVEIVKDRRTKEPADGLGAKITRECMNLGLSMNIVQLPGMGGVFRIAPPLTVSEDEIDLGLSLLGQAIERAL

SEQ ID NO: 18893 - protein, 281 aa, Spinacia oleracea
MSKEVSEEAQAHQHGKDYVDPPPAPFFDLGELKLWSFWRAAIAEFIATLLFLYITVATVIGHSKETVVCGSVGLLGIAWAFGGMIFVLVYCTAGISGGHINPAVTFGLFLARKVSLLRALVYMIAQCLGAICGVGLVKAFMKGPYNQFGGGANSVALGYNKGTALGAEIIGTFVLVYTVFSATDPKRSARDSHVPILAPLPIGFAVFMVHLATIPITGTGINPARSFGAAVIFNSNKVWDDQWIFWVGPFIGAAVAAAYHQYVLRAAAIKALGSFRSNPTN

SEQ ID NO: 18894 - protein, 539 aa, Arabidopsis thaliana
MASRIINHSKKLKHVSALLRRDHAVAVRCFSNSTHPSLVGREDIFKARLNYSSVERISKCGTGNVTMLSGISTTSTKLSSPMAGPKLFKEFISSQMRSVRGFSSSSDLPPHQEIGMPSLSPTMAEGNIARWLKKEGDKVAPGEVLCEVETDKATVEMECMEEGFLAKIVKEEGAKEIQVGEVIAITVEDEDDIQKFKDYTPSSDTGPAAPEAKPAPSLPKEEKVEKPASAPEAKISKPSSAPSEDRIFASPLARKLAEDNNVPLSSIKGTGPEGRIVKADVEDFLASGSKETTAKPSKQVDSKVPALDYVDIPHTQIRKVTASRLAFSKQTIPHYYLTVDTCVDKMMGLRSQLNSFQEASGGKRISVNDLVIKAAALALRKVPQCNSSWTDEYIRQFKNVNINVAVQTENGLYVPVVKDADKKGLSTIGEEVRFLAQKAKENSLKPEDYEGGTFTVSNLGGPFGIKQFCAVINPPQAAILAIGSAEKRVVPGTGPDQYNVASYMSVTLSCDHRVIDGAIGAEWLKAFKGYIETPESMLL

SEQ ID NO: 18895 - protein, 321 aa, Candida tenuis
SASIPDIKLSSGHLMPSIGFGCWKLANATAGEQVYQAIKAGYRLFDGAEDYGNEKEVGDGVKRAIDEGLVKREEIFLTSKLWNNYHDPKNVETALNKTLADLKVDYVDLFLIHFPIAFKFVPIEEKYPPGFYCGDGNNFVYEDVPILETWKALEKLVAAGKIKSIGVSNFPGALLLDLLRGATIKPAVLQVEHHPYLQQPKLIEFAQKAGVTITAYSSFGPQSFVEMNQGRALNTPTLFAHDTIKAIAAKYNKTPAEVLLRWAAQRGIAVIPKSNLPERLVQNRSFNTFDLTKEDFEEIAKLDIGLRFDDPWDWDNIPIFV

SEQ ID NO: 18896 - protein, 350 aa, Vitis vinifera
  misc_feature (192)..(192): Xaa can be any naturally occurring amino acid
MAGRYVSKIFCGERIMGLVVGYDNETAQFKIVYEDRNNEVVDKETLIRTLAPPDLIDRLFLSHRMPRLIELKNLFSRQLPDVPREYIVRLVLDINHKSIMIIRRNQVVGGITYCPYLSQQFVEIAFCAIMADEQIKGCGARLMNHLKQHARNMDGVTHLLTCADNNAVDYFIKQGFKKITLEKERWQGYIKXYDGGILMECELHPKFPYSYLTTMISHQRQAINERIREVSNCEIVYPGIDFQKGDDGVPARPIKLEDIPGLKDAGWTPDQYGHSRFKTSNASADTQIYDHPDAWPFKEPVDSDNAPGYYDIIKDPMGVVETSFVYLALMPKLEPTRRPEWLSQDSNSRP

SEQ ID NO: 18897 - protein, 620 aa, Candidatus Kuenenia stuttgartiensis
MMIKKRFLGLPLVSVLLFTMTFLCINDHIAYGQLPQPTRTQPQPGFSPRPQPTGTQPQPGFSPRPRPTGTQPQPGFSPRPQPTGTQPQPGFSPRPQPTGTQPQPGFSPRPQPTGTQPQPGFSPRPRPTGTQPQPGFSPRPRPTGTQPQPAPTPGVVTPQISGGWSHSLALDSEGKLWAWGLNEDGQLGDGTNDSQTTPVAVQINALTTITAVDCGGDHSMALDSLGRVWAWGYNGDGELGGGTTENNSNVPVPVPVPNLTDIIAISAGGEYSIALSSDGSVLTWGANSDGQLGNGNTDQNSVPTKISSLPLMKGISAGEAHSLAVTEDGFVYAWGLNDEGQIGNGEKSADNPVLNPVQVQGLTDIDAVCAGATFSLALGIDGRVWAWGLNDEGQLGDGTNTNSTTPVEVTNLAKISAVACGSDHSLAIRNGKVKSWGLNDEGQLGDGSTRSSSAPLDVTGLSDIVYVAAGESHSLAITSKGNIYVWGLNGDGQLGDGTNRSSRTPKTIDLNLGVTAVEGPGECETDDIEADPKKLKLKVGKSTEVTLTLTGEDGCLVEGESITVKLNSSGKRRVSISPSKLTSDENGNASFTATANAKGKAKITAKAGSSKVKIKVKVKE

SEQ ID NO: 18898 - protein, 297 aa, Anabaena variabilis ATCC 29413
MMVNDIEYIRQAEATRVQVLSEALPYIQQFAGRTVVVKYGGAAMKDSHLKDQVIRDIVFLSCVGLRPILVHGGGPEINSWLDKLGIEAQFKNGLRVTDAPTMDVVEMVLVGRVNKEIVSLINQAGGLAVGLCGKDGNLITARPQGQEGIGFVGEVSNVNIKILETLASNGYIPVVSSVAADDSGQAYNINADTVAGEIAAALGAEKLILLTDTRGILKDYKDPGTLIPKVDIREARELINGGVVSGGMIPKVTCCVRSLAQGVRAAHIIDGRIPHALLLEIFTDVGIGTMILGSQYS

SEQ ID NO: 18899 - protein, 1078 aa, Caulobacter crescentus CB15
MSLSRVLIANRGEIAVRIARTAAEAGLESVAIYAADDAQSPHVSAADHAVALPGAGARAYLDIAAVVAAAKAQGCDALHPGYGFLSENPHLARACAEAGIVFIGPSPEHLTTFGDKAAARALAAERGLPLIPGTGAITLEAARAFQAEHGAIMLKARAGGGGRGMRMVLDPGELDAAFAACEREALAAFGDGGLYAEKLIERARHIEVQIVGDGDQVLALGDRDCSLQRRNQKLVEIAPAALPDNLRAALAGWSERLCAGYRGLATVEFLVDADPHSPSGGEAFFIEVNPRLQVEHTVTEEVTGLDLVRLQFDLAAGKRLGELELTNTPPPFGVAIQARINAETLTPEGQVRPSTGTLSAWTPPGGPGVRVDAGVAAGLTIGAAYDSLLAKVIVRGRTPSEAASRLDRALTELKVAGVATTAPLVRAILAHPTAVTGEATTTFIAQHAETLAAEAQRLTPETTASVTRFEVLAGAEPVVAPLAATVGAITIREGDLVRPGQALAVLEAMKMEHLVSASAGGRVVKIVVQGGATVAEGQPLVFLEPAEVESALDGETVEQDLDALRPDLAEVVARHRHTLDEARPEAVAKRRKTGHRTARENIDDLVDPGSFLEYGALAIAAQKRRRSTEDLIANTPADGLITGIGTVNGALFPPDKARTAALAYDFTVLAGTQGAMNHRKSDRLMALIADQKLPVVWFAEGGGGRPGDTDTTAVAGLDVPTFRSFAQLSGLVPKIAIVAGRCFAGNAAIAGLSEIIIATRDSNLGMGGPAMIEGGGLGVFRPEEIGPSAHQWKNGVIDILADDEAHATRLAKQALSYFQGTLSTWTAPDQRRLRHAIPENRLRVYDVRGLINHLVDEGSFLELRGGFAAGMVTGLIRIEGRPMGLIANDPRHLGGAIDCEGAEKAARFLQLCDAFALPVLSLCDTPGFMVGPDSEDAAAVRRVSRQFIAGAKLRSPLFTIVTRKGYGLGAQAMAGGSFHSPAFIAAWPTGEFGGMGLEGAVKLGYRKELEAETDPVKQKALYDQLVARLYAAGKATSMAAALEIDAVIDPADTRRWVIGGLDAAAGVSRPWEVRVDSF

SEQ ID NO: 18900 - protein, 410 aa, Ralstonia metallidurans CH34
MLGFNRPAAATVNPRLDLLQTYPFEKLRALVADVKPAAVPPISFGIGEPKHPTPAFIKEAMTASLGGLANYPSTAGSDALRACIAGWLERRYNLPKVDAATEVLPVTGSREALFAFAQTVIDSSKPNPLVLCPNPFYQIYEGAALLAGARPVFANSDPARNFAPAFDQIGADVWPHVQLLYVCSPGNPTGAVLSLEDWKQLFELSDRYGFVIASDECYSEIYFDEAKPPLGALEAAHKLGRGLERLVMFSSLSKRSNVPGLRSGFVAGDPEILKKFLLYRTYHGAAMNPAVQAASAAAWGDEAHVRENRAAYVRKFAEVTPMLAGVLDVALPDAAFYLWADVSRTGLSDTEFAVRLLAEQNLTVLPGSYLARDAHGVNPGANRVRMALVATPDECLEGARRIVEFCKSLG

SEQ ID NO: 18901 - protein, 382 aa, Silicibacter sp. TM1040
MTLAVLIVAAGKGTRAGGGLAKQWRPLAGRLVIDWTIEAFQRAGCGTIMVVRDPDNEHAIEALAPYPELLLADGGPSRSESVRNGLIALQEIGVERVLIHDAARPCVCPQVIQQVLDALDDTPAAAPGLAVTDALWTGADGHVTGTQDRSALFAAQTPQGFHFDAILAAHMRHDGTAADDVEVARQAGLAVRITPGDVNNIKITRPEDFSRAEHILRSTMDNIPDIRLGNGYDVHRFGPGDHVMLCGVQVPHERGLQGHSDADVGMHAVTDALYGAMAEGDIGRHFPPSDPQWKGAASDIFLRHAVELARSKGFTINNVDCTLVCEYPKVGPHAEAMRARMAEIMGMDMGRLSIKATTSERLGFTGRKEGIAALATATLVRA

SEQ ID NO: 18902 - protein, 762 aa, Oryza sativa Japonica Group
MAILSDVATEVLIPIAAIIGIGFSIAQWVLVARVKLAPSQPGASRSKDGYGDSLIEEEEGLNDHNVVAKCAEIQNAIAEGATSFLFTEYQYVGVFMSIFAVVIFLFLGSVEGFSTKTHPCTYSKDKECKPALFNALFSTVSFLLGAITSVVSGFLGMKIATYANARTTLEARKGVGKAFITAFRSGAVMGFLLASNGLLVLYIAINLFKMYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSMGIIVCLITTLFATDFFEIKAVKEIEPSLKKQLIISTALMTVGIALVSWLALPYKFTIFNFGEQKEVTNWGLFLCVSIGLWAGLIIGYVTEYYTSNAYSPVQDVADACRTGAATNVIFGLALGYKSVIIPIFAIALGIYVSFTIAAMYGIAVAALGMLSTIATGLSIDAYGPISDNAGGIAEMAGMSHRIRERTDALDAAGNTTAAIGKGFAIGSAALVSLALFGAFVSRAGVKVVDVLSPKVIIGLIVGAMLPYWFSAMTMKSVGSAALKMVEEVRRQFNTIPGLMEGTGKPDYANCVKISTDASIKQMIPPGALVMLTPLIVGTLFGVQTLSGVLAGALVSGVQVAISASNTGGAWDNAKKYIEAGASEHARSLGPKGSDCHKAAVIGDTIGDPLKDTSGPSLNILIKLMAVESLVFAPFFATHGGILFKLF

SEQ ID NO: 18903 - protein, 351 aa, Arabidopsis thaliana
LKALILVGGFGTRLRPLTLSMPKPLVDFGNKPMILHQIEALKGAGVTEVVLAINHQQPEVMLNFVKEYEKKLEIKITFSQETEPLGTAGPLALARDKLVDESGQPFFVLNSDVICEYPLLEMIEFHKTNRAEASIMVTEVDDPSKYGVVVTEEGTARVESFVEKPKHFVGNKINAGIYLLSPSVLDRIELRRTSIEKEIFPKIASEKKLYAMVLPGFWMDIGQPKDYITGQRMYLNSLREKTPQELATGDNIIGNVLVHESAVIGEGCLIGPDVVIGPGCVIDSGVRLFGCTVMRGVWIKEHACISNSIVGWDSTVGRWARVFNITVLGKDVNVADAEVYNSGVVIEEQGL

SEQ ID NO: 18904 - protein, 249 aa, Phaseolus vulgaris
MVKITLGTFDDSFSVASLKAYFSELHATLIFVFAGVGSAIAYNELTKDAALDPTGLVAVAVAHAFALFVGVSVAANISGGHLNPAVTFGLAVGGNITLLTGFLYWIAQLLGSILACLLLNLVTAKSIPTHGPAYGVNAFQGVVCEIIITFGLVYTVYATAADPKKGSLGTIAPIAIGFIVGANILAAGPFSGGSMNPARSFGPAVVSGNFADNWIYWVGPLIGGGLAGLIYGDVFIGSYAAVPASETYP

SEQ ID NO: 18905 - protein, 325 aa, Streptomyces griseus subsp. griseus
MTRGTSGSAFGVTSWGRGGHRNHTGPCDTENSERHEVTDLMADIARVGVVGCGQMGAGIAEVCARSGLEVKVAETTGEALEIGRTRLHNSLSKAAERGKISAAERDETLGRLSFTTDLGEFADRDLVIEAVVENEQVKTEIFQVLDQVVTRQDAILASNTSSIPLVKLAVATSRPDQVIGIHFFNPAPVQKLVELIPALTTSDETIARAEAVVQDVLGKHPIRAQDRSGFVVNALLIPYLLSAIRMFESGIASREDIDNGMEMGCAHPMGPLKLADLIGLDTVASVADSMYAEYKEPLYAAPPLLQRMVDAGRLGRKTGSGFYAY

SEQ ID NO: 18906 - protein, 728 aa, Staphylococcus epidermidis ATCC 12228
MKNKKNSYSIRKLSVGASSIIVASMLFIGGGSVHAAESNHLENQEQSEVSASHSIEMQHKNQETQQTENKDNKTNHSETIDKTPTIHNNGYSYHETPSTDVKSNEDKQIDSQSNQPQTSMPNNDQQNPKKVAEHTTKSINAKKEETRKNENAKSLVQPQQDDKTTSEQTKMKESREQEITNEQKQLQSKDVKNAQQENQNIDQEKSQEKIKVQQSNIEKAQKSSRIDGKLDNQYNKDATQSDEGTASENVSEQHITAKDGGVTRNNRGDKHLNQEKPTTSSDKELKVDDIDKDLSTKESPENEKDDSRKGIKALTKNSQATTRNTATTEASKELKDQTNKVASQKEYKNHDPIILVHGFNGYASGTGPVTGKGNYWGGNRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLAQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 18907 - protein, 467 aa, Staphylococcus epidermidis ATCC 12228
MLKRFHKGIIISLAIEKGMIRMKANKYLIFILGALGGLLYGYDNGVISGALLFIHKDIPLNSTTEGIVVSSMLIGAIVGAGSSGPLADKLGRRRLVMLIAIVFIIGALILAASTNLALLIIGRLIIGLAVGGSMSTVPVYLSEMAPTEYRGSLGSLNQLMITIGILAAYLVNYAFADIEGWRWMLGLAVVPSVILLVGIYFMPESPRWLLENRNEEAARQVMKITYDDSEIDKELKEMKEINAISESTWTVIKSPWLGRILIVGCIFAIFQQFIGINAVIFYSSSIFAKAGLGEAASILGSVGIGTINVLVTIVAIFVVDKIDRKKLLVGGNIGMIASLLIMAILIWTIGIASSAWIIIVCLSLFIVFFGISWGPVLWVMLPELFPMRARGAATGISALVLNIGTLIVSLFFPILSDALSTEWVFLIFAFIGVLAMIFVIKFLPETRGRSLEEIEYELRERTGARTE

SEQ ID NO: 18908 - protein, 279 aa, Nicotiana benthamiana
MGSSQAAVSFLTNVARAAFGLGISATVLNSSLYTVDGGQRAVLFDRFRGVIDDTVGEGTHFLVPWLQKPFIFDIRTRPHTFSSVSGTKDLQMVHLTLRVLSRPEVSRLPAIFKTLGLEYDEKVLPSIGNEVLKAVVAQFNADQLLTERPQVSALVRESLIRRAKDFNIVLDDVAITHLSYGAEFSKAVEQKQVAQQEAERSKFVVMKAEQERRAAIIRAEGESESAKLISDATAAAGMGLIELRRIEASREVAATMAKTPNVAYLPKQGNMLLGLNASR

SEQ ID NO: 18909 - protein, 361 aa, Sinorhizobium meliloti 1021
MANAGIRSVQREVFNMPVLPSVLEAIGNTPLIRLKAVSEATGCNILGKAEFLNPGQSVKDRAALWIIRQAEKSGQLRPGGVIVEGTAGNTGIGLAVVGSALGYRTVIVIPETQSQEKKDALRLLGAELVEVPAVPYRNPNNYVKISGRLAAQLAETEPNGAIWANQFDNVANRQAHVDTTAPEIWRDTDGKVDGFICAVGSGGTLAGVAEGLRARNAAIKIGIADPEGAALYNFYAHGELKSSGSSITEGIGQGRITANLEDFTPDFAYQIPDAEAVPYVFDLIEKEGICVGGSTGINIAGAVRLARDLGPGHTIVTILCDYGNRYQSKLFNPDFLTSKGLPVPDWLKTASNIAVPYEPAG

SEQ ID NO: 18910 - protein, 350 aa, Listeria monocytogenes str. 1/2a F6854
MTYKITSLAGDGIGPEIMTSGLQVLEAVAKKYNHTFEIESHTFGGAGIDVAQDPIPSSTLKACQDADAILLGAIGGPKWDNASKRPEDGLLALRKALGLFANIRPIQVPSSITHLSPLKKEIVENTDFVVVRELTGGLYFGEPKHWDESAAVDSLTYTRAEIERIIEKAFEIAATRNKKVTSVDKANVLASSKLWRKIAEEVASRHPDITLEHLYIDAAAMLMIQRPTTFDVIVTENLFGDILSDEASVITGSLGMLPSASHAENGPSLYEPIHGSAPDIANQNIANPMSMISSVSMMLRQSFSLFKEADAIDAAATRTMQAGFLTADLGGNTTTTDFTDEVLKQIEGGE

SEQ ID NO: 18911 - protein, 521 aa, Chlamydophila abortus S26/3
MSRGLKSTMEMTSNENQDSGRTLPPCPPCVMVIFGATGDLTARKLFPALYHLIKEGRLSNNFVCVGFARRKKSHEEFREEMKQAIQNFSRAQELDIRIWEEFESRIFYHESNFSSSEGYASLKERLEEIDKQDGTQGNRLFYLSTPPDYFPEIIENINKHKLFYHDQGEGKPWSRVIIEKPFGVDLQSAKELQKYIDDNLDEGSVYRIDHYLGKETVQNILTIRFANTLFESCWNSQYIDHVQISVSESIGIGTRGNFFEKSGMLRDMVQNHMMQLLCLLTMEPPSVFNSEEIKKEKIHVLKKIRPFSQDDVVRGQYGTGEVQGVSVLGYREEENVNPHSMVETYVALKMFIDNPRWLGVPFYLRAGKRLAKRSTDISIIFKKSYATLFEPESCRICPIENDLLIIRIQPDEGVALQFNCKVPGMNNVVRPVKMDFRYDTYFKTTAPEAYERLLCDCILGDRILFTSSDEVMASWELFTPILQQWEQDSSDVCFPNYVAGSVGPKEADQLLQADGRSWRPL

SEQ ID NO: 18912 - protein, 422 aa, Listeria monocytogenes str. 1/2a F6854
MELVDLLVTEEDVEKAYEVLKSVVKHTPLEYDFYLSEKYHCNVYLKREDLQRVRSFKLRGAFYAISRLSAEQLEKGVVCASAGNHAQGVAYTCKRMTVPATIFMPTTTPQQKVSQVKFFGGSNVEVVLVGDTFDASATAAKEFAAAHGQTFIPPFDDPDIIAGQGSLAVEMVKDLNKAHEQADYVFAGIGGGGLISGVATYLKAKSPITKIIGVEPDGAPSMTAALKQNQVVTLDKIDKFVDGAAVKEVGSLTFQHAKVLVDEVTTISEGAVCSTILDMYTKQAIVAEPAGALSVAALETYREEIKDKTVVCIVSGGNNDINRMQEIEERSLLHEGLKHYFIVNFSQRPGALKEFVNDVLGPHDDITKFEYTKKVNRGNGPVIIGVLLQDKNDYEGLLDRVAAFDPSYIPINDNQTLYTLLV

SEQ ID NO: 18913 - protein, 483 aa, Glycine max
  misc_feature (163)..(163): Xaa can be any naturally occurring amino acid
MASAAAPTTFSLLHSTTPASSSSATSASPSRVQLSSSLRSRPLARRLGFAAADPLLAANVAARVAAVRGGKGARGVVSMAKKSVGELSAADLKGKKVFVRADLNVPLDDNQNITDDTRIRAAIPTIKHLIQNGAKVILSRHLGRPKGVTPKYRLAPCIPQLVXLMGIQVVKAEDSIGPEVEKLVASLPDGGVLLLENVRFYKEEEKNDPEHAKKLASLADLFVNDAFGTAHRAHASTEGVTKYLKPSVAGFLLQKELDYLVGAVSSPKRPFAAIVGGSKVSSKIGVIESLLEKVDILLLGGGMIFTFYKAQGLSVGSSLVEEDKLDLATSLLAKAKEKGVSLLLPSDVVIADKFAPDANSKVVPASAIPDGWMGLDIGPDSVKSFSEALDTTQTIIWNGPMGVFEFDKFAVGTEAIAKKLADLSGKGVTTIIGGGDSVAAVEKVGVASVMSHISTGGGASLELLEGKELPGVLALDEAVPVAV

SEQ ID NO: 18914 - protein, 336 aa, Yersinia kristensenii
MTILVTGGAGYIGSHTVLTLLENGEDVVVLDNLSNASAESLLRVSQITGRMATFYQGDVLDSDCLKQIFSEHKIDAVIHFAGLKSVGESVVKPIEYYQNNVTGSIVLLEEMVIADVKKLIFSSSATVYGDPEFVPLTEDARIGGTTNPYGSSKVMVEQILKDFSFAHPDFSIRALRYFNPVGAHASGLIGEDPNGKPNNLLPFITQVAIGKLPKLAVYGNDYPTVDGSGVRDYIHVMDLAEGHICALNKLTAGFKVYNLGSGVGYSVLQMIAEFERISGKKVPYEIVARRSGDIAECWASAELALKELEWKAKRSLTDMLKDAWNWQQSNPNGYVR

SEQ ID NO: 18915 - protein, 275 aa, Caulobacter crescentus CB15
MRQWTIDAFATGPFRGNPACVLEPFDVWPADAWMQALAAENNQAETAYLLKTADPDRFGLRWFTPTLEAPLCGHATLAAAHVLFEELGVDVAMLSFETLSGVLTVRRADDQLEMDFPADPPRRTEIPEGLAEALGVRPREVWAGAYLVAVVDDETTVRQLRPDLGALKVIGGEATGGAGQTVVVAQADAGADYAVVSRFFAPGFGIPEDPATGSAHCILMPLFGDKLGAGRLKFHQAYPGRGGDLECENRGARVLLRGRGFTVMESQLRLEPARN

SEQ ID NO: 18916 - protein, 438 aa, Azospirillum brasilense
MTMINAYAPDSAGSLPERERALIARREKLLGPAYRLFYADPIHVVRGEGSSLYDAEGNRYLDAYNNVASVGHSRPEVVEAMAKQAAVLNTHTRYLTDGILDFAEAFLAEFPAELSHLMLTCTGSEANDLALRVARVHTGGTGVVIAHNAYHGVTSALAEMSPSLGAAVKLGDHVRVVPAPDGYRMPEAEVGAAFARSVEEAIADLREKGITPAALLVDTIFSSSGVFTDPAGFLAPAVEVMRKAGGVFIADEVQPGFGRLGTHMWGFARHGLVPDIVTVGKPMGNGHPVAGAVFRPEVIEAFGKSQRYFNTFGGNPVSCAVALAVLRVIKADRLQENALTVGTEMIDGLRALAAKHELIGDVRGSGLFIGVEMVRDRKLKTPASEETARVVNGMRQRRVLISATGQEGHILKIRPPLVFSSEDATLFLATLDEVLTAL

SEQ ID NO: 18917 - protein, 636 aa, Microcystis aeruginosa PCC 7806
MHLSEITHPNQLHGLSLRQLEDIARQIREKHLQTIAATGGHLGPGLGVVELTIALYQTLDLDRDKVLWDVGHQAYPHKLLTGRYNDFHTLRQKNGVAGYLKRCESKFDHFGAGHASTSISAGLGMALARDAKGEDFKVVSIIGDGALTGGMALEAINHAGHLPNTNIMVILNDNEMSISPNVGAISRYLNKVRLSEPVQFIADNLEEQLKHLPFFGDSLTPEMERVKEGMKRLAVPKVGAVIEELGFKYFGPIDGHNIPELIATFKQAHKVHGPVFVHVATVKGKGYEWAEKDQVGYHAQNPFNLATGKPIPSSKPKPPAYSKVFGHTLTKLAENDPRIIGITAAMATGTGLDKFQAKLPKQYIDVGIAEQHAVTLAGGLACEGMRPVVTIYSTFLQRAFDQIIHDICIQNLPVFFCMDRAGIVGADGPTHQGMYDIAYLRCIPNMTIMAPKDEAELQRMVVTGINHTSGPIAMRYPRGNGLGVPLMEEGWEALPIGKGEILRSGDDILLLGYGTMVNTSLQVAEILSEHGIEATVVNARFVKPLDTELIFPLAQRLGKVVTLEEGCLMGGFGSAVLEALQDANILVPVKRFGVPDKLVDHATPEQSFADLGLTSPQIAQQVLAAFFSQKQTANVG

SEQ ID NO: 18918 - protein, 272 aa, Ralstonia metallidurans CH34
MSIHINTAEDIAQMRVACRLASEVLDYITPHVKPGVTTGELDRLCHAYMRDVQGTVPAPLNYAPPGYPPFPGAICTSVNDVICHGIPGDRVLKSGDVVNLDITVITKEGYYGDTSRMFVVGEASILAKRLSQITYECMWKGIQQVRNGARLGDIGHAIQTHAEAAGYSVVREYCGHGIGKVFHSDPQVLHYGRPATGMEIKAGMIFTVEPMINAGKRDIRTMPDQWTVKTRDRSLSAQWEHTVLVTETGYEVLTLSEGSPLPPAFITETVAA

SEQ ID NO: 18919 - protein, 572 aa, Xanthomonas oryzae pv. oryzae KACC10331
MRSPCLRSCGPYPQLRSVCGDITATIAIVARLRAANKTTALTAKRARPVVGIGMYHAYAPVPQRRSRSSDDSSRRFVSRSWPLLLQAGVKRRGRRRDAVSWRDSRHSSLSMPLPTDPVAETAASAAPVLRHALKPRQLMMMGLGTAIGAGLFLGSGVGIHAAGPAALVSYLIAGGLVIIVMNALGEMAAAKPTSGAFSVYAADAMGPTAGATVGWLWWLQIVVVIAAEAVGAAGLLATVWPALPVPLLALLFMATFTAINLLGVRNFGEFEFWFAILKVLAIVVFLLIGIALLAGWLPGVTSPGLSNFTQNGGFAPKGLAGIGSALLVVVFAFGGTEIVAVAAAETADPGRSLARTIRTVAGRILVFYIGSISVIVAVVPWTSTALSSPFAAVLQVARIPGAATAITLVAVVALLSALNANLYGASRMIFSLAQRGEAPRVLARTSSEQVPLVAVIASVLFGFAAAALELLYPNKVLPMLLNIVGATCLLVWTISLVSQLILRARADRAGLALPFRMRGFPFLTVLALAILAVIFGLLAYSADTRAQFLSMVTLTAVIAVVSEVARRFRSRM

SEQ ID NO: 18920 - protein, 425 aa, Mycobacterium avium 104
MTRLDSVERAVADIAAGKAVIVIDDEDRENEGDLIFAAEKATPEMVAFMVRYTSGYLCVPLDGAICDRLGLLPMYAVNQDKHGTAYTVTVDARNGVGTGISASDRATTMRLLADPTSIAEDFTRPGHVVPLRAKDGGVLRRPGHTEAAVDLARMAGLQPAGAICEIVSQKDEGSMAQTDELRVFADEHDLAMITIADLIEWRRKHEKHIERIAEARIPTRHGEFRAIGYTSIYEEVEHVALVRGEIAGPNSDGDDVLVRVHSECLTGDVFGSRRCDCGPQLDAAMAMVAREGRGIVLYMRGHEGRGIGLMHKLQAYQLQDAGEDTVDANLKLGFPADARDYGIGAQILVDLGVRSMRLLTNNPAKRVGLDGYGLHIIERVPLPVRANAENIRYLMTKRDKMGHDLAGLDDFHESVHLPGEFGGAL

SEQ ID NO: 18921 - protein, 398 aa, Streptomyces avermitilis MA-4680
MAAMTSSARPLLNRRLAEFGTTIFAEMSALAMSTGAINLGQGFPDTDGPEEIREAAVRALRDGRGNQYPPGPGVPELRTAIAAHQQRRYGLTYDPDTEVLVTAGATEAIAATLLALLEPGDEVIAFEPYYDSYAACIAMAGGTRVPVTLRPHPEDGRFRLDLDELRDAVTDRTRLLLVNTPHNPTGTVLTREELTAIAELAVERDLLVVTDEVYEHLVFDDAEHLPLATFPGMRERTVSISSAGKTFSFTGWKVGWVTGAPGLVTAVRSAKQFLTYVASGPFQYAVAEALALPDTYFEAFRADMLAKRDLLAAGLTAAGFEVFRPAGTYFITTDIRPLGERDGFAFCRALPERAGVVAIPNAVFYDHREAGAPFVRFAFCKRTDVLEEAAKRLGTLRG

SEQ ID NO: 18922 - protein, 520 aa, Silicibacter sp. TM1040
MTETAHDRLLIIDFGSQVTQLIARRLRELNVYCEIHPYQNVTMDFVREFAPKAVIFSGGPDSVTREGSPRAPQEIFDYGVPILGICYGQQVMMHQLGGTVQSGHGTAEFGRAYVTPTEERIDMLSGWFLDQTEQVWMSHGDHVSEIAPGFKVYGTSPNAPFAITADLERNFYAVQFHPEVHHTPNGKTLYENFVRLAGFSGDWTMGAYREQMVETIREQVGDKKVICALSGGVDSSVAAALIHEAIGDQLTCVFVDHGLLRKNEAEEVVGMFRDHMNLQVIHADETELFLGELEGQSDPETKRKIIGKLFIDVFQKYADQIEGAEFLAQGTLYPDVIESVSFSGGPSVTIKSHHNVGGLPEKMGLKLVEPLRELFKDEVRALGRELGLPDSFIGRHPFPGPGLAIRCPGEITRDKLDILREADAIYIDQIRKHGLYDEIWQAFVAILPVRTVGVMGDGRTYDYACALRAVTSVDGMTADYYPFSHEFLGETATRIINEVKGINRCTYDITSKPPGTIEWE

SEQ ID NO: 18923 - protein, 407 aa, Nicotiana tabacum
FAWSTLIANKNAELQRLTGIYKNILKNAGVTLIEGRGKVVDPHTVDVDGKLYSAKNILISVGGRPFIPDIPGSEYAIDSDAALDLPTKPNKIAIVGGGYIALEFAGIFNGLKSEVHVFIRQKKVLRGFDEEIRDFVGEQMSLRGIEFHTEESPQAIIKSADGSLSLKTSRGTVEGFSHIMFATGRRPNTKNLGLETVGVKMTKNGAIEVDEYSRTSVPSIWAVGDVTDRINLTPVALMEGGALAKTIFADEPTKPDYRNVPAAVFSQPPIGQVGLMEEQAIKEFGDVDVYTANFRPLKATISGLPDRVFMKLIVCAKTSKVLGLHMCGDDAPEIVQGFAIAVKAGLTKADFDSTVGIHPTSAEEFVTMRTPTRKVRSSPSEVSNSPEIAVHSSLGKAEHDIKAAAGV

SEQ ID NO: 18924 - protein, 472 aa, Staphylococcus epidermidis ATCC 12228
MGSTVKYRKFILPIVVGLIIWALTPIKPDALNDQAWFMFAIFVSTIIACITQPMTIGAVSIIGFTIMILVGIVDTKTAVQGFGNSSIWLIAMAFFISRGFVKTGLGRRIALQFVKLFGKKTLGLAYSLVGVDLILSPATPSNTARAGGIMFPIIKSLSESFGSSPRDGSERKMGAFLIFTEFQGNLITSAMFLTAMAGNPIAQSLAEKTAHVQITWMNWFVAAIIPGLISLIVVPFIIYKLYPPTVKETPNAKKWATEQLEEMGHMSIAEKLMVGIFIIALALWVLGSFINVDATLTAFIALALLLLTGVLAWSDILNETGAWNTLVWFSVLVLMAEQLNKLGFIPWLSKLIAQGLNGFSWPIVLVLLILFYFYSHYLFASATAHVSAMYAALLGVAVASGAPPLFSALMLGFFGNLLASTTHYSSGPAPILYAAGYVTQKRWWTMNIVLGIVYFIIWIGVGSLWMKLIGMM

SEQ ID NO: 18925 - protein, 469 aa, Staphylococcus epidermidis ATCC 12228
MQMKLGWHNVLLVKGGIYYMSKSYDLIVIGAGPGGYVAAIRGAQLGKNVAVIEKNNAGGTCLNVGCIPSKTLLEHGEKAHSIRVANDWGITTKDLKIDFTQFVQRKKKVVQTLTGGVKQLLKKNKVTYIEGEARISKNLKVDVNNETYQAKDIILATGSQPFIPPIDGLDQVNYETTDTFFDLEKLPKQLAVIGGGVIATELASSMADLGVRVTIIEVADDILLTEINETREMLKAHLDNQGIKILTKAKIKQVKESKIILDGQDDVSFDTLLVATGRQPNTQVAKDLNLEMDGKFFKVNEHYETSQKHVYAIGDLIKGYQLAHAASAHGIHVVETIMNKQPSLVRQEDITRCIYTRLEAASVGLSEAQAKEAGYDVKVTQSAFQGNAKALIKGENEGFIKLVVDKKYGEVLGAFIVGPHATDIIGELLSVKASEGTIHELSQIIQPHPALLEAIGESADAFFDSAIHM

SEQ ID NO: 18926 - protein, 165 aa, Streptomyces griseus subsp. griseus
MTTKVYFDITIDDAPAGRITFNLFDDVVPKTTENFRALATGEKGFGYAGSSFHRVITDFMLQGGDFTRGDGTGGKSIYGEKFADENFKLKHDRVGLLSMANAGPNTNGSQFFVTTVLTPWLDGKHVVFGEVADEDSMKLVRKIEALGSPSGKTRAKVTIAASGVL

SEQ ID NO: 18927 - protein, 489 aa, Pseudomonas putida GB-1
MSSMIKHWINGREVESKDTFVNYNPATGDAICEVASGGAEEVAQAVAAAKEAFPKWANTPAKERARLMRKLGELIDQNVPKLAELETLDTGLPIHQTKNVLIPRASHNFDFFAEVCTRMDGHTYPVDDQMLNYTLYQPVGVCGLVSPWNVPFMTATWKTAPCLALGNTAVLKMSELSPLTANELGRLAVEAGIPNGVLNVIQGYGATAGDALVRHPDVRAISFTGGTATGKKIMQTAGLKKYSMELGGKSPVLIFEDADLERALDAALFTIFSLNGERCTAGSRIFIQESVYPQFVAEFAARAKRLIVGDPTDPKTQVGSMITQQHYDKVTGYIRIGMEEGARLVAGGLERPANLPAHLAKGQFIQPTVFADVNNKMRIAQEEIFGPVVCLIPFKDEAEALQLANDTEYGLASYIWTQDIGKAHRLARGIEAGMVFINSQNVRDLRQPFGGVKGSGTGREGGQYSFEVFAEIKNVCISMGSHHIPRWGV

SEQ ID NO: 18928 - protein, 423 aa, Pseudomonas fluorescens PfO-1
MGTHVIKMPDIGEGIAEVELSQWHVKVGDLVVEDQVLADVMTDKAMVDIPSPVHGKVIALGGQPGEVMAVGSILISIEVEGAGNLKESDKPAPVAAKETPVAPKVEAVVESKPAAPRTAPVCQGPMVARQADERPLASPAVRKHALDLGIQLRLVRGSGPAGRVLHEDLDAYLAQGQSNASAPVAAAYAQRNDEEQIQVIGMRRKIAQRMQDATQRAAHFSYVEEIDVTAIEELRAHLNEKHGASRGKLTLLPFLVRALVVALRDFPQMNARYDDEAQVITRLGAVHVGVATQSDVGLMVPVVRHAEARSLWDSAAEISRLANAARNGKASRDELSGSTITLTSLGALGGIVSTPVLNLPEVAIVGVNKIVERPMVVKGQVVIRKMMNLSSSFDHRVVDGMDAALFIQAIRGLLEQPATLFVE

SEQ ID NO: 18929 - protein, 425 aa, Staphylococcus epidermidis ATCC 12228
MSENIIMPKLGMTMKEGTVEEWFKSEGDTVKQGESIVTISSEKLTNDVEAPASGTLLEIKVQAGEDAEVKAVLGIIGEEGEAIDKDEDDLASEKVKEDNEHEKETQEVKDTSQQSSDNKDNSPKSAARERIFISPLARNMAEDKGLDINKIKGTGGNHRITKLDIQRVEANGYDYASDTTSNEDTSHVPTQTVDTSAIGEGLNPMRQRIAQNMRQSLNSTAQLTLHRKVDADRLLDFKDRLATELKQADQDVKLTVTTLLAKAVVLALKEYGAMNARYEQGELTEYEDVHLGIATSLDEGLMVPVINHADTKSIGTLAHEIKSSAEAVREGNTGAVQLEGATFTITNMGASGIEYFTPILNLGETGILGVGALTKEVVLEADNIKQVSKIPLSLTFDHQILDGAGAADFLKVLAKYIENPYLLML

SEQ ID NO: 18930 - protein, 473 aa, Physcomitrella patens subsp. patens
MEATAAAHFSGLHFDDEYPVPKYKGADKVPFVIGVAGGTASGKTTVCDMIIQQLHDHRVVLVNQDSFYRGLKPEEMANVGEYNFDHPDAFDTEQLLECLGSLKANQPVQIPVYDFKKHQRCNDRYRKVNASDVIIMEGILVFHDARVRELMNMKIFVDTDADVRLARRIKRDTLERGRDVNGVIEQYAKFVKPAFDDFILPTKKYADVILPRGGDNHVAIDLIVQHIRMKLGQHDLRKIYPNVFVIQSTFQIRGMHTLIRDQETTKHDFVFYADRLIRLIVEHGLGHLPFTEKQVITPTGSIYVGVDFCKQLCGVSIIRSGESMENALRACCKGIKIGKILIHREGDDGKQLIYEKLPINIADRHVLLMDPILGTGNSAVQAIELLIRKGVPESHIIFLNLISAPEGIHTVCKRFPLLKIVTSEIDAGLNDEFRVVPGMGEFGDRYFGTDDDGPDQMFKAPIEPKLQQSIHRP

SEQ ID NO: 18931 - protein, 457 aa, Pseudomonas fluorescens PfO-1
MQSLNTTLLIIGGGPGGYVTAIRAGQLGISTILVEGESLGGTCLNIGCIPSKALIHVAEQFHQTQHHNQHSALGISVSAPTLDITKSVEWKDGIVDRLTTGVAALLKKNKVQVINGWAKVIDGKTVEVGDTRIQCEHLVLATGSKSVNLPILPIGGPIISSTEALAPKSVPKRLIVVGGGYIGLELGIAYRKLGAEVSVVEAQDRILPAYDAELTQPVHDALKQLGVKLYLKHSVLGFDGTLQVRDPNGDTLNLETDQVLVAVGRKPNTQGWNLEALNLDMNGSAIKIDSRCQTSMRNVYAIGDLSGEPMLAHRAMAQGEMVAELISGKTREFNPTAIAAVCFTDPELVVVGKTPDEAKAAGLDCIVSNFPFAANGRAMTLESKTGFVRVVARRDNHVIVGWQAVGVGVSELSTAFAQSLEMGARLEDIGGTIHAHPTLGEAVQEAALRALGHALHL

SEQ ID NO: 18932 - protein, 362 aa, Pseudomonas putida GB-1
MNAALKTFAPSALALLLILPATASAKEAETQQKLANVVILATGGTIAGAGASAANSATYQAAKLGVDKLIAGVPELADIANVRGEQVMQIASESISNDDLLKLGKRVAELAESKDVDGIVITHGTDTLEETAYFLTLVEKTDKPIVVVGSMRPGTAMSADGMLNLYNAVAVASDKQSRGKGVLVTMNDEIQSGRDVSKSVNIKTEAFKSAWGPMGMVVEGKSYWFRLPAKRHTVNSEFDIKQISSLPQVDIAYGYGNVTDTAYKALAQNGAKALIHAGTGNGSVSSRVVPALQELRKNGVQIIRSSHVNQGGFVLRNAEQPDDKNDWVVAHDLNPQKARILAMVAMTKTQDSKELQRIFWEY

SEQ ID NO: 18933 - protein, 415 aa, Sinorhizobium meliloti 1021
MKQDVEKAAAAMREIFPPTPLQLNEHLSARCGATVFLKREDLSPVRSYKIRGAFNFFRKSLGSGAAGKTFVCASAGNHAQGFAFVCRHFGVPGVVFMPVTTPQQKIDKTRMFGAEFITIRLVGDIFDQCYKAAREHVEAIGGVMVPPFDHDDIIEGQATVAAEIAEQLPAGPVADLVVLPVGGGGLAAGVTGYLGDSLSADRFLFCEPEGAPSFRRSLELGGVVTLDQVDNFVDGAAVARIGDLNFAALRRFSPEQVMLLPENAICLTITEMLNVEGVVLEPAGALAITALEALGRDSLEGKIVVAVVSGGNFDFERLPDVKERAMRHAGLKKYFILRMAQRPGALRDFLGLLGEEDDIARFEYLKKSARNFGSVLIGIETKHAENFPVLKQRFDAAGLRYQDITENEMLANFVI

SEQ ID NO: 18934 - protein, 297 aa, Streptomyces caeruleus
MRGILLAGGTGSRLWPVTRAISKQLIPVFDKPMIYYPLTTLMMAGVREILVITRPDDQRQFRHLLGDGSQLGLRLEYAVQERPEGIAQAFVLGAEFIGDQSVALVLGDNIFHGAGLGTRLRQYNDPAGARIFAYVVADPKAYGVVEFDEAGRAVSIEEKPARPKSRYAVPGLYFYDNRVLDVVHGLVPSRRGELEITAVNETYLKWGQLRVTTLDRGTAWLDTGTFASLVQASEYVRVVEERQGLKIGCVEEVAWRCGFIGNDQLRDLSRPLLKSGYGRYLLDLLADHEELKEVKPS

SEQ ID NO: 18935 - protein, 231 aa, Chlamydophila abortus S26/3
MNNKQRPKTLIAPSIMGGDLACIGAEAKRIEESGADLIHIDVMDGHFVPNLTFGPGVIAAINRSTDIFLEVHAMIYTPFDFVEEFVKSGADRIIVHFEASEDLKELLSYIKKCGIQAGLAFSPETSIEFIPPFLPFCDVILLMSVHPGFCGQGFIPDIPDKIRFTKQAIKTMGLEGSCLIEVDGGINETSAKICREAGADILVAASYIFEKNEQTMEEKVLLLRGENHGIK

SEQ ID NO: 18936 - protein, 233 aa, Microcystis aeruginosa PCC 7806
MLESRSPDYPITSNYRPAIYANTGRNSLANVLPVVIEQSGMGERAFDIYSRLLRERIVFLGTPVDDQVADSIVAQLLYLEAEDPEKDIQLYINSPGGSVYAGLAIYDTMQQIRPDVATICFGLAASMGAFLLCGGAAGKRMSLPSSRIMIHQPLGGAQGQASDIAIQAKEILYIKQRLNTMLAHHTGQPYDRIANDTERDFFMSAVEAKEYGLIDLVISRPELPDPTVPVTSL

SEQ ID NO: 18937 - protein, 532 aa, Streptomyces avermitilis MA-4680
MSEPEELHHPDIHTTAGKLADLQRRIQEATHAGSERAVEKQHAKGKLTARERIALLLDEDSFVELDEFAQHRSTDFGMENNRPYGDGVVTGYGTVDGRPVAVFSQDFTVFGGALGEVFGQKIMKAMDFALKTGCPVIGINDSGGARIQEGVSALGMYGEIFRRNTHASGVIPQISLVVGPCAGGAVYSPAITDFTVMVDQTSHMFITGPDVIKTVTGEDVGFEELGGARTHNAVSGVAHHMAGEEKDAIEYVKQLLSYLPSNNLSEPPAFPEEADLALTDEDRELDTLVPDSANQPYDMHTVIEHILDDAEFLETQPLFAPNILTGFGRVEGHPVGIVANQPMQFAGCLDIDASEKAARFVRTCDAFNVPVITFVDVPGFLPGVGQEHDGIIRRGAKLIYAYAEATVPLITVITRKAFGGAYDVMGSKHLGADLNLAWPTAQIAVMGAQGAVNILHRRTIAATPEEEREEVRRRLIQEYEDTLLNPYTAAERGYIDGVIMPSDTRAHVVRGLRQLRTKRESLPPKKHGNIPL

SEQ ID NO: 18938 - protein, 473 aa, Triticum aestivum
MELGAAGMRRSASHNSLSGSDDFDLTHLLNKPRINVERQRSFDDRSLSDVSYSGGHARGGGGFDGMYSPGGGLRSLVGTPASSALHSFEPHPIVGDAWEALRRSLVFFRGQPLGTIAAFDHASEEVLNYDQVFVRDFVPSAMAFLMNGEPEIVKNFLLKTVLLQGWEKKVDRFKLGEGAMPASFKVLHDDKKGVDTLHADFGESAIGRVAPVDSGFWWIILLRAYTKSTGDLTLAERPECQKAMRLILSLCLSEGFDTFPTLLCADGCCMIDRRMGVYGYPIEIQSLFFMALRCALLMLKHDAEGKDFVERIATRLHALSYHMRSYFWLDFQQLNDIYRYKTEEYSHTAVNKFNVIPDSIPDWLFDFMPCEGGFFVGNVSPARMDFRWFALGNMIAIVSSLATPEQSMAIMDLIEERWEELIGEMPLKICYPAIENHEWRIVTGCDPKNTRWSYHNGGSWPGYCTLCYLDLFM

SEQ ID NO: 18939 - protein, 299 aa, Coccidioides immitis RS
MTTSTSISPNLQEIHDCFIELAKQAGEMITGAKPLVNTVGSKKNSSDLVTETDRAVEQMVSKALRSKYPDYEFMGEETYQPGMRLTNAPTFIVDPIDGTVNFVHNFPNACISLGFAIEKKPVVGVVFNPFTKTLYSAIRGKGAFLNRTTKLPLKGDNIEPLKGLSSALVGVEWGSDRHGTNWETKIRTFETLGKAREEGGAMVHSMRSMGSAALNLCAVASGYMDLYWEGGCWAWDVCAGWVILTEAGGIMVDGNPGGWNAAVDGRRYLAIRASKNGEGQKEIVEEFWGQIKGKFDYGQ

SEQ ID NO: 18940 - protein, 596 aa, Oryza sativa Japonica Group
MATAAAAGEGGSGRRYWRWSKADFFPEPSFASWRSYGGALAATVPRLVDRVGSRSSEAAEAGTLRAVSENPLRRCLSWLDLAFLGFGSVVGSGVFVLTGQEARFDAGPAIPLAYAAAGFSALLSSFCYAELATEIPSAGGSFSYLRVELGDIAAFLAAGNILLEAVVGAAGLGRSWTSYLAALLGRDTDSLRIHVPALAEGFNLLDPIAVVVLVSTSAVAMSGARLTSTLNSLASVVGIAIIAFVLAAGFSHFDAGNLAPSFFPFGAAGVFRAAGVVYWSYTGFDMVATMAEETKNPGRDVPLGLISSMSSITVVYCLMSLALVGMQRYTEIDANAAYSVAFAAAGMRWARYVVALGALKGMTSGLLVGALGQARYTTQIARTHMIPPYFALVHPTTGTPIYATVAVTLGAACVALFSSLDVLASVSSISTLFIFALVAVALLVRRYHVAGATTPGQLRTFLAFLALVVLSSIGVSAYYNSRYARRWPGYAAFGCGWAAGAAGLAACAEKQRAPRVYGAPLVPWLPAMSIATNLFLMGSLGTAAYARFGICTAAMLVYYVLFGVHATYDVAHADDAAADNLEHGKIAAAPAPTTPA

SEQ ID NO: 18941 - protein, 516 aa, Oryza sativa
MAACVDDVGKPRASRKVCVIGAGMAGLAAARELRREGHAVTVLEQAGDVGGQWLYDDPRADDDDEDPLAAAAAAAKPVRVHSSMYASLRLLGPREVMGFSDFQFVPARKSRCGGGDNPGGRDPRRFPGHREVYLYLRDFYRAAGLTDSVRFNTRVVRVAVAPPPCRGGPGDALRWVVRSMDAGLWKRCTDDQMAEAHCVEEVFDAVVVATGHYSQPKLPSIQGMGDWKRRQMHSHWYRVPDSFRDEVVVLVGCGDSGMDIALDLLAVAREVHLSAKSVEAAATPAMSKMLARHANLHLHPQIERLCDDGRVVFADGGGGVVAADTVMYCTGYRYSFPFLDTEGKVAVDDDDNRIGPLFEHTFPPSLAPSLSFVGIPRKVMVPWFFEAQGRWIAGVLSGRRALPSEEEMTRSVEEFYRARELAGVPKAHTHDVEPHKMYELGEKYCDFPRTEEWKRELMAIISRNTSDDMETFRDRDDDSDNVRRCLQEWYALAEHQAQDEEDPAAAAAQAPVHSSL

SEQ ID NO: 18942 - protein, 466 aa, Escherichia coli O157:H7 EDL933
MDKKQVTDLRSELLDSRFGAKSISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 18943 - protein, 215 aa, Brassica napus
MAETTQMEVEVPTEAASPLPAKPIFKPLKAHEMSDGKVQFRKIPVPPNRYTPLKKAWLDIYTPVYDQMKVDIRMNLKSRKVELKTRADTPDVSNLQKSADFVHAFMLGFDIPDAVALLRMDELYVESFEIKDVKTLKGEHLSRAIGRLSGKGGKTKFAIENSTKTRIVIADTRIHILGAFTNIKVARSSLCSLIMGSPAGKVYSKLRNVSARLAD

SEQ ID NO: 18944 - protein, 306 aa, Glycine max
  misc_feature (233)..(233): Xaa can be any naturally occurring amino acid
MSKEVIATQSPAPFEYEILDSDAEVLRTVRASSNHTNPWIEPERLKLRHRIGRGPFGDVWLATHHQSTEDYDEYHEVAAKMLHPIKEDHVKIVLEKFNELYFKCQGVASISWLHGISVLNGRICIIMNLYEGSIGDKMAGLKEGRISLHDVLRYGINLAQGVQELHSKGIFILNLKPFNVLLNGNDQAILGDVGIPSLLLGSSFLSSDMAKRLGTPNYMAPEQWEPEHYIERXCDRIYQSVVEKHEKPNIPSGLPSSVENILSGCFEYDLRNRPLMVDILSVFQRFVNIYIFIYFLKILLKISVAV

SEQ ID NO: 18945 - protein, 302 aa, Pseudomonas putida GB-1
MNAKVVVVGSLNMDLVARAQRLPRAGETLPGESFFTVPGGKGANQAVAVARLGGSVAMIGNVGDDDYGRQLHRALYVEGIDCQGVSTCPGVSSGVALITVDAASQNCIVIIPGANGLLTPRSVQRFDALLQAAEVIICQLEVPAETVAWTLARGHELGKQVILNPAPATGPLPADWFAHIDYLTPNESEAEALTGMAVTDQESARRAGERLLQLGAGKVIITLGAQGALRITAQGHQHYPASVVQPLDTTAAGDTFVGGFAAGLVRGLEEGEAIVFGQRAAALSVTRAGAQPSIPYLAELTP

SEQ ID NO: 18946 - protein, 312 aa, Streptomyces griseus subsp. griseus
MSTARKHTALPKAQILIEALPWLTRHHGRTVVIKFGGNAMIDEELKAAFAQDVVFLRHAGLKPVVVHGGGPQISAQLDKQGLVSEFKAGLRVTTPEAMDVVRMVLAGQVQRELVGLLNQHGPLAVGLTGEDAHTITAVQHRPTIDGELVDIGRVGEITAIDTGAIQALLDDGRIPVVSSIARSADDHHVYNVNADTAAAALAAALNAETLMVLTDVEGLYEDWPNSDDVISRLTASQLEKLLPELSSGMVPKMQGCLHAVRNGVETARVIDGRVQHSILLEIFTDEGIGTMVVPDAPIDVHAARTAHEQGAS

SEQ ID NO: 18947 - protein, 400 aa, Streptomyces griseus subsp. griseus
MTGTGTGLTSRWQGALMDNYGTPRLPLVRGEGAHVWDEEGTRYLDFVGGIAVNALGHAHPAVVEAVSTQIASLGHVSNLFIAEPPVALAERLLQLFGRAGRVFFANSGAEANEAAFKIGRLTGRPHMVATDGGFHGRTMGALALTGQPGKQEPFRPLPGDVTHVPYGDADALRAAVTTDTALVIIEPTQGENGVVVPPKGYLEAAREITRATGTLLVLDEVQTGIGRCGQWFEHQAHQGVEPDIVTLAKGLGGGLPIGATVAFGPAADLLKPGHHGTTFGGNPVACAAGLAVIDTLAADGVLADVKRLGERIRDGVEALGHPLVSHVRGAGLLLGIVLTGPLAPQVQQAAQGAGLLVNAPAPDVVRLMPPLIIGDAEVDAFLEILPSALDAAHGDGRSGA

SEQ ID NO: 18948 - protein, 488 aa, Shigella flexneri 2a str. 301
MKKVNHWINGKNVAGNDYFQTTNPATGEVLADVASGGEAEINQAVAAAKEAFPKWADLPMKERARLMRRLGDLIDQNVPEIAAMETADTGLPIHQTKNVLIPRASHNFEFFAEVCQQMNGKTYPVDDKMLNYTLVQPVGVCALASPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPNDPNTQVRALISQQHWEKVSGYIRLGIEEGATLLAGGPDKPSDLPAHLKGGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 18949 - protein, 342 aa, Glycine max
  misc_feature (204)..(204): Xaa can be any naturally occurring amino acid
MKMKPSSPNEEHHDLENAKSDKDKVRTPRNGRGVKVYNQALLSGLAYCFSSCGMILVNKLVLSSYDFNAGISLMLYQNLISVAIVSVLSLLGLVSTEPLTWRLIKVWLPVNFIFVGMLVTSMFSLKYINVAMVTVLKNVTNVITALGEMYLFKKHHDGKVWASLFLMIISAITGGITDLSFNAVGYAWQTLNCFLTASYSLMLXRVMDTAKQVTKSGNLNEFSMVLLNNTLSVPLGIFLIIVFNEMDYLLSTPLLRLPSFWLVMTFSGFLGLAISFTSMWFLHQTGATTYSLVGSLNKIPLSIAGILLFKVPTSLENSASILFGLLAGVFFARAKIRERSQS

SEQ ID NO: 18950 - protein, 454 aa, Coprinopsis cinerea okayama7#130
MPVSLVRVLSRGLHVSARRHALSQFNMPAMSPTMTEGGIASWKKKEGEAFSAGDVLLEIETDKATIDVEAQDDGILAKILAQDGSKAVPVGSVIAIIGEEGDDLSGAAALAEEAASKPQASPPKAEEKAPEQPKPQPTPAPEPVKVESKESLPKGDRIFASPIAKKIALERGIPLAKVKGTGPSGRIIREDVEKWKAPEAAAPAASATTAAAAAQPSVPSTDYVDTPVSNMRRTIGARLTQSKQELPHYYLTAEINMDKVLKLREVFNKTLGEKDKSAKLSVNDFIVKATACALSDVPEANSAWLGEVIRTYKKADISVAVATPTGLITPIVKDAGAKGLASISAETKALAKKARDGKLAPAEYQGGTFTISNLGMYGIDHFTAIINPPQSCILAVGATQARLVPAPEEERGFKTVQVMKVTLSCDHRTVDGAVGARWLNAFKGYLENPLTFML

SEQ ID NO: 18951 - protein, 126 aa, Glycine max
  misc_feature (23)..(23): Xaa can be any naturally occurring amino acid
FLPFRFQKMSEEQQRPAPRLNEXILSSLSRRSVAAHPWHDLEIGPGAPQIFNVVVEITKGSKVKYELDKKTGLIKVDRILYSSVVYPHNYGFVPRTLCEDNDPIDVLVIMQEPVLPGCFLRARAIG

SEQ ID NO: 18952 - protein, 321 aa, Oryza sativa Japonica Group
MSYHKLAIDLKPGSTILCADGTITLTVLSCDCEQGLVRCRCENSAMLGERKNVNLPGVIVDLPTLTEKDKVDILQWGVPNKIDMIALSFVRKGSDLMLVRSVLGEHAKSILLMSKVENQEGVANVDEIIANSDAFMVARGDLGMEIPIEKIFYAQKMLESMIKSPCPTRAEATDVANAVLDGTDCVMFSGETAAGAYPELAVQTMANICSRAELYLDYPFIFKKLSSEAPVPLSPLESLASSAVQTANISKASLILVLTRGGTTARLIAKYRPAMPVLFVVVPELKADDSFNWTCSDEAPARQSHCQGFDPNAEHRYTKGI

SEQ ID NO: 18953 - protein, 495 aa, Escherichia coli CFT073
MDNGRHKKNVRPAGDKYIEVMMSTEIKTQVVVLGAGPAGYSAAFRCADLGLETVIVERYNTLGGVCLNVGCIPSKALLHVAKVIEEAKALAEHGIVFGEPKTDIDKIRTWKEKVINQLTGGLAGMAKGRKVKVVNGLGKFTGANTLEVEGENGKTVINFDNAIIAAGSRPIQLPFIPHEDPRIWDSTDALELKEVPERLLVMGGGIIGLEMGTVYHALGSQIDVVEMFDQVIPAADKDIVKVFTKRISKKFNLMLETKVTAVEAKEDGIYVTMEGKKAPAEPQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTEPEVAWVGLTEKEAKEKGISYETATFPWAASGRAIASDCADGMTKLIFDKESHRVIGGAIVGTNGGELLGEIGLAIEMGCDAEDIALTIHAHPTLHESVGLAAEVFEGSITDLPNPKAKKK

SEQ ID NO: 18954 - protein, 544 aa, Zea mays
  misc_feature (503)..(503): Xaa can be any naturally occurring amino acid
MEEQQPRPRPSIMFVLSSLAKNNPESVLALIAVLTVVALRHLISSWRQQARLPPSPTSLPVIGHLHLLRPPVHRTFQELASRIGPLMHIRLGSTHCVVASTPEVASELIRGHEGSISERPLTAVARQFAYDSAGFAFAPYNTHWRFMKRLCMSELLGPRTVEQLRPVRRAGTVSLLADLLASSARGETVDLTRHLIRLSNTSIIRMVASTVPGSVTDEAQEVVKDVAELVGAFNVDDYISLVRGWDLQGLRRRAAGVHRRFDALLEDILRHKEEARAARRLDQDDDGRGSSKQDKKQATHSKDLLDILMDKADDPAAEIKLTRENIKAFIIDVVTAGSDTSAAMVEWMLAELMNHPETLRKVAEEIDAVVGGDRIASEADLPQLPYLMAAYKETLRLHPAAPIAHRQSSEEMVVRGFTVPPQTAVFINVWAIGRDPAYWEEPLAFRPERFMPGGAAESLEPRGQHFQYMPFGSGRRGCPGMGLALQSVPAVLAALVQCFHWAXVDGDGGVNKIDMSESDGLVCARKKPLLLRPTPRLTPFPAVV

SEQ ID NO: 18955 - protein, 184 aa, Triticum aestivum
PGIYLHSTTLAPPRDGLSATSVVPFPGLSPTAALPVSPAPNGASFGSVSNGGRIRCMQVWPIEGIKKFETLSYLPPLSTEALLKQVDYLIRSKWVPCLEFSKVGFIFREHNASLGYYDGRYWTMWKLPMFGCTDATQVINEVEEVKKEYPDAYVRIIGFDNMRQVQCVSFIAFKPPGCEESGKA

SEQ ID NO: 18956 - protein, 475 aa, Streptomyces avermitilis MA-4680
MIIGGGPGGYEAALVAAQLGAEVTVVDCDGLGGASVLTDCVPSKTLIATAEVMTTFDSSYEELGIIVADDTPPMEQAARVVGVDLGKVNRRVKRLALAQSHDITASVTRAGARVMRGRGRLDGMQSIDGSRKVVVRAADGAEETLVADAVLIATGGHPRELPDAQPDGERILNWTQVYDLDELPDELIVVGSGVTGAEFAGAYQALGSKVTLVSSRDRVLPGEDPDAAAVLEDVFRRRGMNVMARSRAESAKRIGDRVEVTLSDGRVISGSHCLMAVGAIPNSSGMGLEEAGVKLRDSGHIWTDKVSRTTAPGVYAAGDVTGVFALASVAAMQGRIAMYHFLGDAVAPLNLKTVSSNVFTDPEIATVGYSQADVDAGKIDARVVKLPLLRNPRAKMQGIRDGFVKIFCRPGTGIVVGGVVVAPRASELIHPISIAVDNNLTVEQIANAFTVYPSLSGSIAEVARQLHTRKTAGDA

SEQ ID NO: 18957 - protein, 586 aa, Saccharomyces cerevisiae
MSRKSSTEYVHNQEDADIEVFESEYRTYRESEAAENRDGLHNGDEENWKVNSSKQKFGVTKNELSDVLYDSIPAYEESTVTLKEYYHHSIKNNLTAKSAGSYLVSLFPIIKWFPHYNFTWGYADLVAGITVGCVLVPQSMSYAQIASLSPEYGLYSSFIGAFIYSLFATSKDVCIGPVAVMSLQTAKVIAEVLKKYPEDQTEVTAPIIATTLCLLCGIVATGLGILRLGFLVELISLNAVAGFMTGSAFNIIWGQIPALMGYNSLVNTREATYKVVINTLKHLPNTKLDAVFGLIPLVILYVWKWWCGTFGITLADRYYRNQPKVANRLKSFYFYAQAMRNAVVIVVFTAISWSITRNKSSKDRPISILGTVPSGLNEVGVMKIPDGLLSNMSSEIPASIIVLVLEHIAISKSFGRINDYKVVPDQELIAIGVTNLIGTFFHSYPATGSFSRSALKTKCNVRTPFSGVFTGGCVLLALYCLTDAFFFIPKATLSAVIIHAVSDLLTSYKTTWTFWKTNPLDCISFIVTVFITVFSSIENGIYFAMCWSCAMLLLKQAFPAGKFLGRVEVAEVLNPTVQEDIDAVIS

SEQ ID NO: 18958 - protein, 252 aa, Ustilago maydis 521
MFVNGGGKGEIPRKVDIDPYFDNTKLVFGEAGTKVPYTPQNTWKDPNGDRKDYLDRTKGLTTMQKHVAFFDGDCDGVIWPTDTFFAFLSLGFGFLLSAMAVAIIHGPFSYPTLPRKDNKLLDWLPDPFMRIYVANIHRCKHGSDSESYDRRGHFRQSQFETILDDYSTRHGKDALSFSDAMAMIRERRDLMDLFGCFAFMFEWGSTYMLLWPADGYMRKDDILGIFDGSIFVVLAHRHRNGQGGGAFKPKRA

SEQ ID NO: 18959 - protein, 794 aa, Ralstonia metallidurans CH34
MTNQVDTGAYVLPFEQLRMQDVEVVGGKNSSLGEMISQLAGAGVRVPGGFATTALAFRDFLAHNNLTSRISERLKTLNVDDVKALAEAGAEIRGWVAAAPFQPRLEAEIREHYARVSAREGAEASFAVRSSATAEDLPDASFAGQQESYLNVSGIDDVLDKIKHVFASLYNDRAISYRVHKGFAHDVVALSAGVQRMVRSDLASSGVMFTIDTESGFPDVVFITSSYGLGETVVQGAVNPDEFYVFKPMLQAGKYPIIRRSIGSKLIKMEFTKPGEAGRVKTVDVPPELRNRYSITDDDVAELARYAMIIEKHYGRPMDIEWGKDGKDGKIYILQARPETVKSQSAGKAEQRFKLKGTAPVLTSGRAIGQKIGTGPVRVINDPSEMERVQPGDVLVADMTDPNWEPVMKRAAAIVTNRGGRTCHAAIIARELGVPAVVGCGDATDLLKDGTLVTVSCAEGDEGRIYDGLLETEVTEVQRGEMPEIATKIMMNVGNPQLAFDFAQIPNHGVGLARLEFIINNNIGVHPKAILDYPQVDADLKKAVESVARGHASPRAFYVDKLAEGIATIGAAFYPKPVIVRLSDFKSNEYKKLIGGSRYEPDEENPMLGFRGASRYISDDFAEAFEMECKAMKRVRDEMGLTNVEIMVPFVRTLGQAERVIELLAKHGLKRGENGLRIIMMCEVPSNAILAEEFLQFFDGFSIGSNDLTQLTLGLDRDSGMELLAKDFDERDPAVRFMLQRAISTALRLNKYVGICGQGPSDHPDFAVWLAKEGIKSISLNPDSVVETWQQLAS

SEQ ID NO: 18960 - protein, 652 aa, Magnaporthe grisea 70-15
MNRTSSKRAPGPDTAATAAPTRQCTPDGSDANDDRVSALVAPLGGSIHSPEQQSVGYMLCQGHNSEYLANYISEIALWLDMFDSQRAFGVQVPLLARSTPALILELYQEAIRLVGSLLEIRDPSVVPICTILCVMEMMSVDLCGALISDGTQSTLVPLCQLAPSVAIDNPQGVATLFCTSKDPDMYANYAVYLCSKPLSPPCKHNTPLAMPYMSSQPKVLIAGGGIGGLSTALALHASGLTDIHIFEAAGKLTSLGVGINVQPSAVLILRNLGLLPELERTGVVTQELNFYNRHGDEILSEPRGTKAGYACPQLSIHRGNFQMVLLDAVRKRIGEDRIHLGHALVNFQQDDKSITGFFKHAENTKDPVPSMTGDVLIAADGINSATRKILYPNEGPPRFSGRILWRGCIEREPYLTGGSMVWAGFADQKFIAYPISGESARNGKSLVNWIAELRVRDDSDPDKTPPKVDWTKTVPKERFAGPFKGWTCGGLRMIEDLIAPTERVFEFPMCDRDPLERWSFGRLTLTGDAAHCMYPIGSNGATQAIIDAETIAQCLTGTETEKIPEALKKYEEIRLPPTAKIVYANRANGPDHVLQLAEERAPEGFKNVYDVIPKEELESIGAKYKAIAGFELEAVNKKAKETEELAARFAQK

SEQ ID NO: 18961 - protein, 511 aa, Triticum aestivum
  misc_feature (160)..(160): Xaa can be any naturally occurring amino acid
  misc_feature (168)..(168): Xaa can be any naturally occurring amino acid
  misc_feature (188)..(188): Xaa can be any naturally occurring amino acid
MAFVSFLELSLSLLCFVVFYYFHARSKRKNPVIPLEWPLVGMLPALLANLPRLHDWVTSLLTASPLNFRFVGPPRSGMELFLTSDPANVRHVFTSNFANYPKGPEFAEIMDILGGGIFNADGDSWRRQRAKAQLLMSGPRFRAFVTRCSRRKVERDLLPXLLAHVARXGTGVCDLQDVFLRLTFDTTXTTLVFGVDPGCLAIGFPEVPFARAMDDAMDVLLVRNVLPPSWWKLVRWLGVGYERKMAVAWRDIDRFIGETIAKRREAVKARGGIEDSADLLSSYIDDDDEASTVVDAFLRDTTMNLMLAGRDTTGSGLSWFFYLLTRNPGVVSKILAELDTVSSSTTTPDGMVTYDPDELGRLTYLHAALCESLRLYPPVPMEHKGVVAAEALPSGHEVRPGDKVMVSLYAMGRMEAVWGKDCREFRPERWIGEDGKARYVPSYKFVSFNSGPRTCLGKDMAFVQLKAVAAAVVRNFEVEAVPGHAVEPKISIILHIKNGFKARIKRRHADA

SEQ ID NO: 18962 - protein, 478 aa, Streptomyces avermitilis MA-4680
MASAFEYAPAPESRSVVDIAPSYGLFIDGEFTEAADGKVFKTVSPSTEEVLSEIAQAGEADVDRAVKAARKAFEKWSALPGSERAKYLFRIARIIQERSRELAVLETLDNGKPIKETRDADLPLVAAHFFYYAGWADKLDHAGFGANPRPLGVAGQVIPWNFPLLMLAWKIAPALATGNTVVLKPAETTPLSALFFADICRQAGLPKGVVNIIPGYGDAGAALVEHPDVNKVAFTGSTAVGKAIARQVAGTEKKVTLELGGKGANIVFDDAPIDQAVEGIVTGIFFNQGQVCCAGSRLLVQESVQDELLDSLKRRLSTLRLGDPLDKNTDIGAINSAEQLSRITSLVDQGEAEGAERWSPACELPSSGYWFAPTLFTNVTQAHTIARDEIFGPVLSVLSFRTPDEAVAKANNSQYGLSAGIWTEKGSRILAVASKLRAGVIWANTFNKFDPTSPFGGYKESGFGREGGRHGLEAYLDV

SEQ ID NO: 18963 - protein, 335 aa, Caulobacter crescentus CB15
MAVRVAINGFGRIGRLVLRSIAEHGRRDIEVVAINDLGPVETNAHLLRYDSVHGRFPGVVTSGEDWIDVGMGKIKVTAIRNPAELPHKDLGVDIAFECTGIFTSKEKAAAHLEAGAKRVLVSAPCDGADKTIVFKVNDDTLSADDLVVSNGSCTTNCLAPIAKVIHDLVGIERGYMTTIHSYTGDQPTLDTMHKDLYRGRAAALSMIPTSTGAAKALGLVLPALKGKLDGSSIRVPTPNVSVVDLKFVPGRETTVAELNDALKAAAAGPLKGVLGVTDEALVSTDFNHIAESSTAALAQTQVIEGKLGRVLSWYDNEWGFATRMSDTALVMAKFL

SEQ ID NO: 18964 - protein, 347 aa, Photorhabdus luminescens subsp. laumondii TTO1
MKKMKHTALASLLALISGSAFALPNITLLATGGTIAGGGKSAIQSNYVAGRVAIDELVNAVPEIKNIANLKGEQVVSIGSQDMNDQVWLTLAKRINADCDKTDGFVITHGTDTMEETAYFLDLTTHCQKPIVMVGAMRPSTALGADGPLNLYNAVVVAGDTASAKRGVLMAMNDAVISGRTVVKMSTTEVQAFQPVNAGAEGFVHNGKVNYYADAKPRANKAIFDVSKLDKLPKVGIVYNYANASDLPAKALLKDGYQGIVSAGVGNGNMYKAIFDTLALAAKDGVVVVRSSRVPVGYVTQDAEVDDSKHGFVASERLNPQKARVLLQLALTETRNPVKIHEMFVKY

SEQ ID NO: 18965 - protein, 396 aa, Caulobacter crescentus CB15
MTFRTLDTADLAGKRALVRVDFNVPVDGGKVADDTRLKAALPTIRFLADKGAKVVLLAHFDRPKGKVVPEMSLAFVAEPLAALLGAPVAFVGDCVGPAAAEVVNGLADGGVALLENVRFHAGEEKNDAEFAKALAANGDVYVNDAFSAAHRAHASTEGLAKLLPAYPGVSMQRELEALDAALGNPKKPVIGIVGGSKVSTKLDLLNNLVAKLDRLAIGGGMANTFLFAQGHDVGGSLCEKDLADTAREIMEKAKAAGCELLLPVDVVVAKKVAPGVETAVRSLSEVQADDLILDAGPESAKRLLAAMDQSLTLIWNGPLGVFEVPPFDEATVSAAKHAASLAKSGKIVAVAGGGDTVAALNHAGVSADFTFVSTAGGAFLEWMEGKTLPGVAALES

SEQ ID NO: 18966 - protein, 574 aa, Escherichia coli O157:H7 EDL933
MDIQKRVSDMEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIIAQTQREGLSEEAARQKVFMVDRFGLLTDKMPNLLPFQTKLVQKRENLSDRDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASETLAQYSPLVLNGEGLVLPELKDIQKVSRAIAFAVGKMAQQQGVAVKTSAEALQQAIDDNFWQAEYRDYRRTSI

SEQ ID NO: 18967 - protein, 170 aa, Oryza sativa
LNLNYLQVNNVGFFFLKPAVNVTPEELSSVMAGNLESCFHLSQLVHPLLKASGKGNIVNISGISTVTNINRQIMLLLISGAMNQITKSLAVEWASDKIRVNCIAPGIIDTPLGDDGVSGTDFIQDDIARTPMRRVGKPEEVSSLVAFLCMPAAAYITGQIICVDGGRTLS

SEQ ID NO: 18968 - protein, 113 aa, Glycine max
MPGLFFVLLNMGGERKEAWTSWLKAYIHEVSTSGIPDDERKISMDSVNPKYILRNYLCQTAIDAAEIGDFGEVRSLLKLVEHPYDEQPGMEKYARLPPAWAYRPGVCMLACSS

SEQ ID NO: 18969 - protein, 108 aa, Oryza sativa
MAAIIVSVKARQIFDSRGNPTVEVDVVLATYGSFARAAVPSGASTGVYEALELRDGGSDYLGKGVSKAVDDVNSVIAPALIGKDPTSQAGYTGKVVIGMDVASFGILQ

SEQ ID NO: 18970 - protein, 444 aa, Arabidopsis thaliana
MATITVVKARQIFDSRGNPTVEVDIHTSNGIKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINDGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 18971 - protein, 61 aa, Zea mays
  misc_feature (20)..(20): Xaa can be any naturally occurring amino acid
NPDPKVLQAMQLMTKNRVKXFPVIDGPGILGMVSIGNFVGGVVAKHREELNRLNDYIQGGF

SEQ ID NO: 18972 - protein, 87 aa, Solanum lycopersicum
MKNLDHIAASVDWEKESLPEYQDLIFLLFFALFFPVLRFILDRFVFEALAKRMIFGKKTVVNINGREEEEDQQIQRVSMEICIFSIC

SEQ ID NO: 18973 - protein, 688 aa, Staphylococcus epidermidis ATCC 12228
MKTRQNKYSIRKFSVGASSILIAALLFMGGGSAQAAEQQQDKGTVENSTTQSIGDGNEKLSEQQSTQNKNVNEKSNVNSITENESLHNETPKNEDWIQQQKDSQNDNKSESVVEQNKENEAFVQNHSEEKPQQEQVELEKHASENNQTLHSKAAQSNEDVKTKPSQLDNTAAKQEDSQKENLSKQDTQSSKTTDLLRATAQNQSKDSQSTEEINKEVNNDTQQVTAKNDDAKVESFNLNSKEEPLKVDKQANPTTDKDKSSKNDKGSQDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLYQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLAEDLVQSEQLTSTNK

SEQ ID NO: 18974 - protein, 288 aa, Trichodesmium erythraeum IMS101
MTTLLTDNIRTLPNTTHNSTLQKYQGNLRSQNKPTVETEVSQENLISESNRELSSSSCFHRFWYKYFIFPEIETILTDFQIIFERDPAARNWIEVLCCYPGLHALLLYRLAHKLHYHKIPLIPRLISHFGRFFTGIEIHPGAQIGQGVFIDHGMGVVIGETAIVGDYSLIYQGVTLGGTGKEIGKRHPTIGTNVVVGAGAKVLGNINIGNNVRIGAGSIVLRHVPSDCTVVGIPGRVVSKSSERTEVLDHGKFPDTEATATRALVEKIQQLEEKLQTLIGETRKNNNV

SEQ ID NO: 18975 - protein, 291 aa, Trichodesmium erythraeum IMS101
MWEYTEKVMDLFYNPQNQGTITDKKEGEKIVSGEVGSIACGDALSLHLKVNEASGEILDAKFQTFGCASAIASSSALTAMLKGKTIDEAMNIKNQDIAGYLGGLPEEKMHCSVMGEEALEAAIFKYKGIEVEVHEEDDEGSLVCSCFAITENKIKRVILENNLKTAEEVTNYVKAGGGCGSCLADIDDLVASVYEAPDTTTQQIPTTTKPATNLTNLQKITLIQQVLQQEVRPVLAEDGGDVELFDVDGDRVLVKLKGACGSCSNVLVTLKGAIEATLKERVSESLVVEAV

SEQ ID NO: 18976 - protein, 192 aa, Oryza sativa Japonica Group
ELISLLSRAPTTETSSPPSAAMQQRRPASGRPSGTDGSDFSYRMVVDSRYQRVADGKSRLGRLILVQALHQVAGGALLLLALSKGAEMNKFAVMSVAAGLLAIVLGEIGRRRTMAVLLRMYTSLSSIAVAFSVACIIRSELFFKITKQNTESITSHELLEVVRVALGVLLQLVVIATTTRLLQNMSPPRRAS

SEQ ID NO: 18977 - protein, 334 aa, Prochlorococcus marinus str. MIT 9303
MIVPFTPQVDGAYRFSVAPMLDCTDRHFRVLMRQISRRALLYTEMLVAQALHHSNRLDHLLDFDIIEHPLSLQVGGDDPKMLAEAARLADAWGYDEINLNVGCPSSRAKAGNFGACLMAKPDQVARCVEAMAMASPLPVTVKHRLGIDDFDSDALLMTFVDRVSLAGATRFTVHARKAWLEGLDPKQNRTIPPLQHQRVTHLKQQRPQLTIEINGGLEHPADCLTALQTCDGAMVGRAAYAHPLRWKSMDELVYGEEPRSINASQVIGGLLPHAETHLSRGGRLWDLCRHLLQLVEGVPGAKSWRRDLGIKAQKADADLTVLQKAAQQLEDAGL

SEQ ID NO: 18978 - protein, 365 aa, Dehalococcoides sp. CBDB1
MDFKLTVLPGDGIGPEVMDEGLKVLNAVAKKYKHTFKYQYGLIGGCCIDKEGVALSPAALAMCKKSDAVLLAAVGDPRFDDPKLPVHPEDGLLALRKGLGLFANIRPVKVAPSLVNSTPIKAEIVKGTDFIFIRELTGGVYFAKPKKRWTTPAGIRKATDSMTYSENEIERIVRVGFELAKNRKKKLVSVDKANVLLSSRLWRQIVIEVAKDYPEVKVEHVLVDACAMKLILAPTYFDVIVTENLFGDILTDEASMLAGSMGMLPSASLAGIPAKGTKIFGLYEPIHGSAPTIAKQNIANPIATILSIAMMLRYSCGLETEAVEIESAVDKVLAAGYATIDIFKEGNTKLGTAEMGNQITKMIGG

SEQ ID NO: 18979 - protein, 176 aa, Brucella melitensis 16M
MNIDAISIGSNPPEDVNVIIEVPVGGQPIKYEMDKKAGALIVDRFLYTPMTYPGNYGFVPHTLSEDGDPIDVLVCNTRPLIPGCVINVRPIGVLVMEDNSGKDEKIIAVPSPHLTRRYEKIHDYTDMPEITLKQIAHFFEHYKDLEPGKWVKIGDWGDEDYARKFIVEAIERAKGK

SEQ ID NO: 18980 - protein, 211 aa, Methanosarcina barkeri str. Fusaro
MKFPYSQKVLEHFKNPHNVGKIENPDGKGLEGSPACGDMVAVYIKVNPDTKIIEDIKFESYGCASNIATGSVITDIAKGKTLDEAKKITWKQASEELGGLPPIKAHCSVLAVEGLRAAIKDYEEKHGLITEREPTTEKVIRNRLKHVMNPLTGLDIIRTNLILKTSVEEGVVRVVVDLPANHQFAPAIKEDIMEKLGSLWDVERVDVVFTA

SEQ ID NO: 18981 - protein, 215 aa, Fusobacterium nucleatum subsp. nucleatum ATCC 25586
MTNGIKIAPSILSSDFSKLGEEVAAIDKAGADYVHIDVMDGQFVPNLTFGPPVIKCIRKCTGLIFDVHLMIDKPERYIEDFVKAGADIVVVHAESTIHLHRVIQQIKSFGIKAGISLNPSTPEEVLKYVINDIDMVLVMSVNPGFGGQKFIPAVVEKIKAIKKMRVDIDIEVDGGITDETIKVCVDAGANIFVAGSYVFSGNYKERIDLLKLKAK

SEQ ID NO: 18982 - protein, 451 aa, Streptomyces avermitilis MA-4680
MTPQPNPQVGAAVKAADRAHVFHSWSAQELIDPLAVAGAEGSYFWDYDGRRYLDFTSGLVFTNIGYQHPKVVAAIQEQAASLTTFAPAFAVEARSEAARLIAERTPGDLDKIFFTNGGADAIEHAVRMARIHTGRPKVLSAYRSYHGGTQQAVNITGDPRRWASDSASAGVVHFWAPYLYRSRFYAETEQQECERALEHLETTIAFEGPGTIAAIVLETVPGTAGIMVPPPGYLAGVRELCDKYGIVFVLDEVMAGFGRTGEWFAADLFDVTPDLMTFAKGVNSGYVPLGGVAISGKIAETFGKRAYPGGLTYSGHPLACAAAVATINVMAEEGVVENAANLGARVIEPGLRELAERHPSVGEVRGVGMFWALELVKDRETREPLVPYNAAGEANAPMAAFGAAAKANGLWPFINMNRTHVVPPCNVTEAEAKEGLAALDAALSVADEYTV

SEQ ID NO: 18983 - protein, 178 aa, Dehalococcoides sp. CBDB1
MSPTKHTIVALVEDRPGVLNRMASLFRRRGFNIDSIAVGRSETPGFSRMTIVVDGANTMVEQVRKQLDKVIDVVKVSDITGQDIICRELALIKVKSTPANRSEIMQIVDIFRAKIVDVASDSLTVEVTGDEEKVNSLYNLLRAFGIKEITRTGRIAMTRGGLATATELQSSKELKTKE

SEQ ID NO: 18984 - protein, 968 aa, Vibrio angustum S14
MSTLFNFGDTDLSTTVPVVNGLYDLTLDELLLSQEHYESDVRSYPRRLPLAIAKAAGVLVEDTRGQLFVDCLAGAGTLALGYNHPEINKAIVDQLESGLPYQTLDITTVAKDKFIKQLLSFLPESFANNACVQFCGPTGADAVEAAIKLAKQTTGRNTMAAFHGAYHGMTNGTMAMMGNLNTKSRRQGLMADVHFLPFPYSLRCPYGLSGDDGAKQSLRYIERMLSDDESGVQKPAAIIVEPVQGEGGVIPAPAFWLRELRRITQEQGILLIFDEIQCGIGKTGHNFAFEESGITPDILCLSKAVGGGLPMSVLVFNKEIDSWNPGEHTGTFRGNQLAMATGAKTLEIIERDGLIEHAQKAGMYLRRGLEKVAAQTSCIAEVRGKGLMLGIEIVQSDGSKNKFGEPVADPELTAAIQRSALERGLIIEKGGRQGSVLRFLPPLIISFEQLDFVINTIKEAIEVHVEPIEQGLVLESDNKANWKDHFIQTGKGGSESFETALNQTTQVLKKVFEQTNQPYSGMDPQLLKTLINGIDLNQPQSSLDAVIDQTGDLIAKHSIMVQHPHCIAHLHTPPLVPAIAAEAFIAALNQSMDSWDQASAATFVEQKIVDWLCDVYQLGQQADGVFTSGGTQSNLMGLLLARDWAADTISGHNIQQQGLPSYADKLRILCSKKSHFTVQKSASLMGLGEQSVVCVDTNPDGTIQLASLITTIEALKVDDLIPFAVVGTAGTTDHGAIDDLTGLADISARHNLWFHVDGAYGGALILSRHQSRLHGIEKADSLSVDFHKLFFQPISCGAVLVKDKAHFKYLLHHADYLNREDDLLPNLVDKSIATTKRFDALKVLMTMQSVGADALGEMYDHLINQTQHVADLVNQQPQFELLADPALSTVLFRFVGEGANLNEQQLNQLNKQLRIDALVQGQAVLGETVVDDKVALKFTILNPCLTINDFKTLLNKVSQLGQSLLSST

SEQ ID NO: 18985 - protein, 436 aa, Glycine max
MPTFTAIAFDRLIEPGASKPAYKSAPVPMPVPKKIERRTSEPTIRKKPRPRPQLKPALYATPEVTPLPDAPSSFPPSPYIINHKRRGPRLLKSYSEANVQAKQENLENENANVKSNDGVITSLDGDLQVTFTNIEPVKEEQVNGVHDTDLSSSSNNKGDLGEAHRESESSGILNGSHLDKVVALNLEREGESEDFFDPHDSMSLKSCTDGEDNTGTDQALKFSAAGGEFFDAWEELSSDGGTQNSHRDIEAELREIRLSLLMEIEKRKQVEETLNSMQSHWERLGQRLSHIGIVLPSDLTAEGGQLSSDPMEDVCQQLYITRFISNTIGRGIARAEAEIEMEAQLQSKNFEIARLLERLHCYETMNREMSQRNQEAVEMARRERQRRSRRQRWIWGSITTAIAVGTAAIAWSYLPVGRGSTSAVHDQVSEHDDAAN

SEQ ID NO: 18986 - protein, 258 aa, Bacillus subtilis subsp. subtilis str. 168
MKKTIVFKCGGSVIRELSEEFYQNLKELRASGWKLAIVHGGGPEITNMLKRLNIKTEFSGGQRKTTKPVLEVAEMVLSGSVNKFFVAELAKHGLRAAGISGKDGGLLEADYLDPETYGEVGEIKKVDASMVNALMENGIIPVIAPLSMTSDCKTLNVNADLAASAVAGALEADKLMFVTDVDGIMKEKQRLDVLTPKEIQMLIKQEVITGGMIPKVNSALSALSDQVSEVMIVNGKGSFFAEQTFQGTKIVKAKEAVS

SEQ ID NO: 18987 - protein, 385 aa, Bacillus subtilis subsp. subtilis str. 168
MSSLFQTYGRWDIDIKKAKGTYVEDQNGKTYLDFIQGIAVSNLGHCHEAVTEAVKKQLDSVWHVSNLFQNSLQEQAAQKLAGHSAGDLVFFCNSGGQANEGAYKLARKATGKTKIITFLQSFHGRTYAGMAATGQDKIKTGFGPMLGGFHYLPYNDPSAFKALGEEGDIAAVMLETVQGEGGVNPASAEFLSAVQSFCKEKQALLIIDEIQTGIGRTGKGFAYEHFGLSPDIITVAKGLGNGFPVGAVIGKKQLGEAFTPGSHGTTFGGNMLAMAAVNATLQIVFQPDFLQEAADKGAFLKEQLEAELKSPFVKQIRGKGLMLGIECDGPVADIIAELQTLGLLVLPAGPERDSAAAPLTVTKDEIAEAVSKLKQAIAHHSAVNQ

SEQ ID NO: 18988 - protein, 275 aa, Brassica napus
KALFFMALRSALSMLKHDEEGREFIEKIVKRLHALSFHMRNYFWLDFQQLNDIYRYKTEEYSHTAVNKFNVMPDSIPDWVFDFMPLRGGYFVGNVSPARMDFRWFSLGNCVAILSSLATPDQSMAIMDLLEHRWEELVGEMPLKICYPCIESHEWRIVTGCDPKNTRWSYHNGGSWPVLLWMLTAACIKTGRPQIARRAIDLIESRLHRDCWPEYYDGKLGRYVGKQARKYQTWSIAGYLVAKMMLEDPSHIGMISLEEDKQMKPVLKRSASWTC

SEQ ID NO: 18989 - protein, 567 aa, Cryptococcus neoformans var. neoformans JEC21
MSAGPAQPNIYAPIRTSHSGYPSPTHSGSSTPASLEFSDGRLPESNVERDMSKVAERVALLGEVDDGAVIVEGEDKITKFVWTLVLAAAISGLLFGYDTAAISGMLVIIKDDLGTILSSWQKEAITSATTLGALLGGLAAGCISDFTGRRLVIVFANVAFIGGSICQAACHTVAVMIAGRFIVGLGVGLASCIVPLYIGELAPTMIRGRLVTINCVAITLGQVVAYAIGASFQNAHNGWRWIVGLGAMPSFVQLASIGFLPESPRILLLRSDVAGARAITAKIYPLAKVEQVDRKVEIMKAAVDQSIEYNANSTWFERLKSLVMVGTNRRALIIGCGLQAAQQLCGFNTLMYYSATIFAMLGFKNATAVGLIVATVNVLFTLVALKIVDPVGRRRTMLFTLPIMTLALVLAAIFFYYLTLSTNGILIEDHDYPRSLSIPVLLSMLLYVAGYATGLGNIPWQQGELFRLEVRGIGTSICTAVNWSCNMLIASTFLSLMDAATPSGAFGIYAGFCVIGWLFCWMLYPETSGLSLEEVYFVFEEGFGIEKSQQLRKQKLEESAKLKAIFE

SEQ ID NO: 18990 - protein, 353 aa, Bacillus subtilis subsp. subtilis str. 168
MEGYLVLEDGTSFSGELDGHENCTGEAVFFTGMTGYQEVLTDPSYKGQIIVFTYPLIGNYGINEKDFESKKPQVKAAVVYEACDHFSHYEAVYSLKEYLQKWNIPLLTHVDTRAVVKKIRANGTMGATVTASKEGAEIALQPENVAEQASAQEISTFGDGNKHIALIDFGYKKSIASSLVKRGCKVTVVPYQQMEAVYNIKPDGIVLSNGPGDPKAIQPYLGKIKSIISRFPTLGICLGHQLIALAFGGNTFKLPFGHRGANHPVIDRKTKRVFMTSQNHSYVVDEQSINEEELTIRFHHVNDTSVEGLAHKKLPVMSVQFHPEAHPGAAESEWIFDDYLKNVIPARREIAHA

SEQ ID NO: 18991 - protein, 104 aa, Trichodesmium erythraeum IMS101
MTTYKVRLIKGKKNKPPEMDVTIDVDEDTYILDAADEAGIDLPVSCRAGACSSCTGRLVEGEIDQEDQNFLDDEVMEKGFLLMCVTYPRSDCTIKTHQEAYLPV

SEQ ID NO: 18992 - protein, 470 aa, Chlamydophila abortus S26/3
MKKQKRFLSLLFLTFVLLGIWFCPHPEAINPNAWHLFAVFTTTILGIILQPVPMGAIVIIGISTLLLTQTLTLEQGLSGFHDPIAWLVFLSFSIAKGIIKTGLGERVAYFFVSILGKNPLGLSYGLVITDFLLAPAIPSVTARSGGILYPVVMGLSESFGSSAEKGTESLIGSFLIKVAYQSSVITSAMFLTAMAGNPLLAALASNAGIALTWATWAKAAVFPGLLSLVLMPIVLYKLYPPTITSCEEAIRTAKLRLKEMGPLKKGEKIILMIFTLLVVLWTFGDLLRISATTAALIGLSLLILTNILDWHKDVMANTTAWETFIWFGALIMMASFLNQLGFIPLIGDSVAAGVAGLSWKIGFPILFLMYFYSHYLFASNTAHIGAMFPVFLAVSIALGTNPIFACLVLAFSSNLFGGLTHYGSGPAPLYFGSQLVSIKDWWQSGFILSIVNIAIWVGIGSLWWKILGLI

SEQ ID NO: 18993 - protein, 489 aa, Bacillus clausii KSM-K16
MAKFTQTVEVFQNYINGEWKDSTSGQVMDSVNPANKTETIGQLQSSTTEEVDEAIQSATEAKIGWRKTGAYQRGQLLASVANELEKNVDDIAETLTKEMGKTLPEAIGETQRGIAILRYYAAEGMRKEGEVIPASDKEALMFTKRTPLGVVGIITPWNFPVAIPIWKIAPALVYGNTVVFKPASESAVTAAKVVKCFEHAGLPKGVLNFITGKGSIVGEALINSKKLNGITFTGSESTGKRVAKAASANGIKYQLEMGGKNPVIVLDDADVQSAVQGILSGAFKSTGQKCTATSRVIVQEGIYEELKAALLAETKKITIGDGMNSSIWMGPCASESQLNTVLEYIQIGQEEGATLLYGGQRLTENEYAHGFYVEPAIFEQVTSTMRIAQEEIFGPVIALLKVKTVEEAIDIANDTEFGLSASLYTSNIGSALSFIDDIEAGLVRVNSESAGVELQAPFGGMKASSTGTREQGEAAKEFYTAIKTVLIRS

SEQ ID NO: 18994 - protein, 388 aa, Vibrio vulnificus CMCP6
MNLHEYQAKQLFAEFGLPVPEGYACDTPQEAFEAAGRISTAKKVVKCQVHAGGRGKAGGVELHDTKEGVKEFAQKWLGKNLVTYQTDANGQPVTKILVEEASNIANELYLGAVVDRATRKVVFMASTEGGVEIEKVAEETPELIHKAAIDPLVGPQAYQGRELAFKLGLQGDQIKQFVKIFMGLGEMFTQYDLALLEINPLVITGEGNLLCLDGKINIDSNALYRQPKLREMHDPSQEDKREAHAAQWELNYVALDGNVGCMVNGAGLAMGTMDIVNLHGGKPANFLDVGGGATKERVAEAFKIILSDDNVKAVLVNIFGGIVRCDMIAEGIIGAVKEVGVSVPVVVRLEGTNADLGRKVLAESGLDIIAAESLTDAAQKVVAAAEGK

SEQ ID NO: 18995 - protein, 254 aa, Listeria monocytogenes str. 1/2a F6854
MRKPLVGINMKNYINTRAQTSEWLEATIPLLGNFSDVDTFIFPSMGTLETTANLLSGTSFGFGPQNMAPEKSGPLTGEFSVESIIDLSANYVEIGHAERKNLFHEKTSEIAKKIKLALDEKITPVVCVGEGIRANDTNELKNALKKQIEALFDTIQVTQFKNVVLAYEPEWAIGKANSADTNYIESAHQALREIIRELGGDETLVRIIYGGSVSKENAAEIVRQKNVDGLFVGRFGHKPQNFADIVSIVSKTKG

SEQ ID NO: 18996 - protein, 167 aa, Candida boidinii
MAPIKRGDRFPTTDDVYYIPPEGGEPGPLELSKFVKTKKFVVVSVPGAFTPPCTEQHLPGYIKNLPRILSKGVDFVLVISQNDPFVLKGWKKELGAADAKKLVFVSDPNLKLTKKLGSTIDLSAIGLGTRSGRLALIVNRSGIVEYAAIENGGEVDVSTAQKIIAKL

SEQ ID NO: 18997 - protein, 402 aa, Vibrio vulnificus CMCP6
MTIEILVPDLPESVADATVATWHKKPGDRVERDEVLVDIETDKVVLEVPASEAGILEAIVEEEGATVLSKQLIGRIKLAAVAGEPTADTTEESEPSPDKRHTASLSEESNDALSPAVRRLLAEHSLEASQVKGTGVGGRITREDIEAHLAAAKQAPAVAEAPAAVAPVAARSEKRVPMTRLRKTVANRLLEAKNSTAMLTTFNEVNMKPIMDLRKQYGDQFEARHGIRLGFMSFYVKAVTEALKRYPEINASIDGDDIVYHNYFDISMAVSTPRGLVTPVLKDCDTLGFADVEKGIKELAIKGRDGKLTVDELIGGNFTITNGGVFGSLMSTPIINPPQSAILGMHKIQDRPMAVDGKVEILPMMYLALSYDHRLIDGRESVGFLVTVKELLEDPARLLLDV

SEQ ID NO: 18998 - protein, 167 aa, Candida boidinii
MAPIKRGDRFPTTDDVYYIPPEGGEPGAFELSKFVKTKKFVVVSVPGAFTPPCTEQHLPGYIKNLPRILSKGVDFVLVITQNDPFVLKGWKKELGAADAKKLIFVSDPNLKLTKKLGSTIDLSSIGLGTRSGRLALIVNRSGIVEYAAIENGGEVDVSTAQKIIAKL

SEQ ID NO: 18999 - protein, 143 aa, Glycine max
  misc_feature (23)..(23): Xaa can be any naturally occurring amino acid
  misc_feature (25)..(25): Xaa can be any naturally occurring amino acid
ALNLALGSLPQFTICNRAGAGGXVXFTVPLFTAGLPTRKTNNDITNIVSNGGRVRCMQVWAPVGKKKHETLSYLPDLDDAQLAKEVEYLPRKGWIPCLESEREHGLVYREHIRLPGYYDGRYWTMWKLLMIGCTDASQVLKEL

SEQ ID NO: 19000 - protein, 297 aa, Escherichia coli O157:H7 EDL933
MKPQVYHVDAFTSQPFRGNSAGVVFPADNLSEAQMQLIARELGHSETAFLLHSDDSDVRIRYFTPTVEVPICGHATVAAHYVRAKVLGLGNCTVWQTSLAGKHRVTIEKHHDGYRISLEQGTPGFEPPLEGETRAAIINALHLTEDDILPGLPIQVATTGHSKVMIPLKPEVDIDALSPDLNALTAISKQIGCNGFFPFQIRPGKNETDGRMFSPAIGIVEDPVTGNANGPMGAWLVHHNVLPHDGNVLRVKGHQGRALGRDGMIEVTVTIRDNQPEKVTISGAAVILFHAEWAIKL

SEQ ID NO: 19001 - protein, 533 aa, Dehalococcoides sp. CBDB1
MEIAREKSGAKSECIDSGEETLRESIVIFDFGSQYSLLIARRIREMHVYCELVSHDTPWEKIAHLNPRGFILSGGPSSVYEPEAPLAPAYIFESKLPVLGICYGMQAITQQLGGVVEHSDKREYGHALLHSNVINTELLADMPEPSPVWMSHGDRIEKLPAGFKSLAYTENCPVAVMGNESDIYGLQFHPEVVHSPHGKIILKNFVFNICKCHANWTMGNYIQESIQNIREQVGDGQVICALSGGVDSAVVASLIHKAIGDQLTCIYVNNGLLRREEADRTLHVFKNHMGMKIIYVDAIDRFLESLGGITDPEQKRKVIGSEFIKVFEDEACKLGQIDFLAQGTLYPDVIESVSSVSKASAKIKSHHNVGGLPAHMKLKLIEPLRYLFKDEVRLLGKELGLPDEMIWRQPFPGPGLAIRIIGEVTREKLEILRSADWIVMSEIKKAKMYHQVWQSFAILTDVKSVGVMGDFRTYGYLVAIRAVTSEDAMTADWAKLPYDLLSIISNRIVNEVKEVNRVVYDISSKPPSTIEWE

SEQ ID NO: 19002 - protein, 256 aa, Caulobacter crescentus CB15
MIEAARKAARGLARDFGEVTELQVSKKGAADFVTNADIKAEQTLFELLTKARPGYGFLGEERGMVEGTDKTHTWIVDPLDGTTNFMHAIPHFAVNIALQREGEGIVAGVTYNPITNDLFWVEKGKGAFLGAEKRLRVAARRHLDEAILATGVPFAGKPGHGQFLKELHQVSQKVAGVRRFGAASLDLAWVAAGRFDAFWERNLNSWDVAAGVLMIQESGGKITTIDESDHDVVQGKSILASNQDLHPQILERLRAA

SEQ ID NO: 19003 - protein, 107 aa, Rhodovulum sulfidophilum
MTVKPPTPTSTPILDRVAGPADLKGMSQADLALLARDLREEVISVVARTGGHLGSSLGVVELTVALHAVFNTPFDKLVWDVSHQCYPHKILTGRRDRMHTLRQGGGL

SEQ ID NO: 19004 - protein, 319 aa, Bacillus subtilis subsp. subtilis str. 168
MHTVTQTSLYGKDLLTLKDLSEEDINALLAEAGELKQNKIQPIFHGKTLAMIFEKSSTRTRVSFEAGMAQLGGSALFLSQKDLQLGRGETVADTAKVLSGYVDAIMIRTFEHEKVEELAKEADIPVINGLTDKYHPCQALADLLTIKEIKGKLKGVKVAYIGDGNNVAHSLMIGCAKMGCDISIASPKGYEVLDEAAEAAKTYALQSGSSVTLTDDPIEAVKDADVIYSDVFTSMGQEAEEQERLAVFAPYQVNAALVSHAKPDYTFLHCLPAHREEEVTAEIIDGPNSAVFQQAENRLHVQKALLKAILYKGESSKNC

SEQ ID NO: 19005 - protein, 185 aa, Vibrio angustum S14
MRLSIPNILSFVRLMLIPFFVIAFYVPYEWSAFATALIFWVAGVTDWFDGYLARKLNQTTRFGAFIDPVADKLMVATALVLVVEHYHSVWVTIPAVTMIGREIIISALREWMAEIGKRASVAVSWVGKVKTASQMFALLLLLWHPHEYVVWLGYVSLYVAMVLTYWSMVQYLKAAKGDLLNAENH

SEQ ID NO: 19006 - protein, 119 aa, Glycine max
MAKGEGRIELKFRIYDGTDIAHSTYSSSTTVGTLKQKLVAEWPQGKPVTPMSVSDLKLIHAGKVLENNKTLADSRITFGDIPGDVVTMHVVVQPRVTKKKTEKNKENNQKMNSCSCTIL

SEQ ID NO: 19007 - protein, 454 aa, Aspergillus nidulans FGSC A4
MTSNGTNGSATAYHASSTQEAIQAENDFAAHNYHPLPVVFARAQGTSVWDPEGRHYLDFLSAYSAVNQGHCHPKLVAALVDQASRLTLSSRAFYNDVFPKFAEMVTKYFGFDMVLPMNTGAEAVETGIKIARKWGYKVKGIPENEAIILSAENNFHGRTMAAISLSSDPESRENYGPYVPNIGCTIPGTEKPITYNDKAALREAFEKAGSNLAAFLVEPIQGEAGIIVPDDDYLQLARSLCDQHNVLLICDEIQTGIARTGKLLCHEWSGIKPDMVLLGKAISGGMYPVSCVLGRKDVMLTVEPGTHGSTYGGNPLACAVAIRALEVVQEENMVERAEKLGQAFRSGLEAIQNPIIQTVRGKGLLNAIVIDESKTNGHTAWDLCMLMKEKGLLAKPTHQNIIRLAPPLVITEEEIAKALEIIKAAVAELPNLKGAAEDKVVPPPEKKVKITLEN

SEQ ID NO: 19008 - protein, 289 aa, Lactobacillus acidophilus NCFM
MTAFTYFKDEWTPVIDNYLAKHLASEIDDQKISQIMSYSVMAGGKRLRPLLFLATLNALGKKIEESEIRLACGIELIHTYSLIHDDLPAMDNDDYRRGKLTSHKKWGEAEAILAGDALLPLGVQWIAEGSNSSELVIMITKAIGANGMVGGQYLDIDSTNNASVADDEKFINKMEWLKTGCLIQASVEMAAVYAKASDIEQVKLVDFAKTFGRSYQIYDDLVDVVETSEEAGKATHKDEEEGKNNTLTLLGIEKSRKELKDLISQAKADLHGINNEVLLGFLDLYHKVL

SEQ ID NO: 19009 - protein, 540 aa, Rhodopseudomonas palustris CGA009
MAIIESTVAPGSEGFRANRDSMLALIERMRMLEARARTLSAGSAERFHKRGQLLPRERVALVLDPGTPFLELSTLAGYMFDTANADKSVPGGGVIGGIGYVAGIRCMISANDSGIDAGALQPFGLDKTLRIQELALENKLPFVQLVESAGANLLRYRVEDFVRGGNIFRNLARMSAAGLPVVTVTHGSSTAGGAYQTGLSDYIVMVRGRTRAFLAGPPLLKAATGEIATEEELGGAEMHTSISGLGDYLAEDDRDALRIARDIMAGLPWDRSGPGPDPASYHPPLYDPEELLGIMPMDHKRPVDMRQVIARIVDESDFTEMSPNYGPATVVGQARIAGMAIGIITNNGPLDPAGANKATHFIQACCQSRTPILYLNNTTGYIVGRAYEEAGMIKHGSKMIQAVTSATVPQITIYCGASFGAGNYGMCGRGFHPRFCFSWPNAKTAVMGGEQAAETMAIVSEAGAARKGVPVDREKLDQMKAGITAVFNGQMDVFATSARMLDDGVIDPRDTRAVLAEVLAICRESEAREPQRMQFAVSRP

SEQ ID NO: 19010 - protein, 384 aa, Arabidopsis thaliana
MALQATTTTFCFSGPTFRSTPHSLTSKRPISIKATTSSPSRLSNSRSNLKGRALSSDGSTQESPYVVCFGEMLIDFVPTTSGLSLADAPAFKKAPGGAPANVAVGIARLGGSSAFIGKVGEDEFGYMLANILKDNNVNNDGMRFDPGARTALAFVTLTNEGEREFMFYRNPSADMLLEESELDFDLIKKAKIFHYGSISLITEPCKSAHISAAKAAKEAGVILSYDPNLRLPLWPSADNAREEILSIWETADIIKISEEEIVFLTKGEDPYDDNVVRKLFHPKLKLLLVTEGPEGCRYYTKDFSGRVHGLKVDVVDTTGAGDAFVAGILSQLANDLSLLQDEERLREALMFANACGALTVKVRGAIPALPTKEAVHEALLKAVV

SEQ ID NO: 19011 - protein, 247 aa, Zea mays
TARPRTHSPRTFFSLLPLRLKPRFSARRLMHWHPSPGATLNSQILAEACGCAESLGGSKDGRWKTSIFFYRAMTRDGAGGPAVQQHPDLPRELLGVALHERPGLYFSIVRAQRLVLQADAAFPQVMEKLQSYRIRVALNFEGFQYQLGDFCLRIGKCVPNNSEALRGIMMEVEYYPLTSIEKSKAVMEDFFDIWQETVAKKSLPGQFIHVDSNFSEYGLSDQYSFQHTAGQYATCLQQLMAAVTVRG

SEQ ID NO: 19012 - protein, 376 aa, Prochlorococcus marinus str. MIT 9303
MTLCQVWAASSSGTAESATYFCMIGGHFPCGFPVFVMTLRVAINGFGRIGRNFMRCWLSRGVNTGIEVVGVNVTSDPKTNAHLLKYDSILGQIKDAEIDYTDDTFVINGKPIKCFSDRNPLNLPWKEWGIDLVIESTGVFNTDVGASKHIEAGAKKVILTAPGKGDGVGTYVVGVNADQYRHGDFNVLSNASCTTNCLAPIVKVLDQNFGMEWGLMTTIHSYTGDQRILDNSHRDLRRARAAALNMVPTTTGAAQAVALVYPEVKGKLTGFAMRVPTPNVSAVDLTFGTSKGPSVDDVKAVMKSASENGMKGIIKYSDLPLVSTDYAGTNESSIFDADLTYAMGDKAVKILAWYDNEWGYSQRVVDLAEIVAKNWK

SEQ ID NO: 19013 - protein, 2195 aa, Zea mays
MSTAQGTALKSAPIGAGHRARRGRPVVPPYRSGWQAYGGVSLEGSGFLGGLQRTEERVATLAPRAAARDAEVVRPLSKLPNSSIGLYDPSFERDACGVGFVAELSGDYKRETVNDAIEMLERMAHRGACGCEKNTGDGAGIMVALPHDFFKEVTKDAGFELPPPGDYAVGMFFMPTDEKRREKGKAEFKKVAESLGHVILGWRPVPTDNSDLGESALETEPVIEQVFVTKSSRSEAEFEQQLYILRRLSIISVRASLNIKRGGERDFYMCSLSSRTIVYKGQLKPCQLKGYYYADLGQENFMSYMALSQAAVLLWPTAMPDSSGCDLRLGGGKEMCLVHSRFSTNTFPSWDRAQPMRVLGHNGEINTLRGNKNWMTAREGLLEAEKLGLSKEQLARILPIVDATSSDSGAFDNVLELLVRGGRSLLEAVMMMIPEAWQNDGNMDPEKKALYEFLSALMEPWDGPALISFTDGRYLGATLDRNGLRPGRFYVTHSGRVIMGSEVGVVDVPPEDVLRKGRLNPGMMLLVDFENHTVVDDEALKAQYSKAHPYGEWLKRQKIYLKDIVESVPETDRVAPSISSSLPAKNENKDHVGINGILTPLKAFGYTVEALDMLLLPMAKDGVEALGSMGNDTPLAVMSNREKLTFEYFKQMFAQVTNPPIDPIREKIVTSMECMIGPEGDLLETTEKQCNRLSLKGPLVSIDEMEAIKKMNYRGWRSKVLDITYPKKSGRKGLEETLNRMCAEAREAIREGYTILVLSDRGFSSDRVAASSLLAVGAVHQHLVANLERTRIGLLVESAEPREVHHFCTLLGFGADAICPYLAIEAIWCLQNDGKIPPNGDGQPNSKEELVKKYFYASNYGMMKVLAKMGISTLASYKGAQIFEALGLSSEVIGKCFEGTPSRIEGATFEMLARDALRLHELAFPSRTPPAGSADAKALPNPGDYHWRKNGEVHLNDPLAMGKLQEAARVNSRAAYKEYSKRIQELNKACNLRGMLKFKDISDKISLDDVEPASEIVKRFCTGAMSYGSISLEAHTALAIAMNKLGGKSNTGEGGEQPSRMEPLPDGSMNPRRSAIKQVASGRFGVSSYYLTNADELQIKMAQGAKPGEGGELPGHKVIGDIAVTRHSTAGVGLISPPPHHDIYSIEDLAQLIHDLKNSNPGARISVKLVSEAGVGVVASGVVKGHADHVLISGHDGGTGASRWTGIKNAGLPWELGLAETHQTLVANGLRGRAVLQTDGQLKTGRDVAVACLLGAEEFGFSTAPLITLGCIMMRKCHMNTCPVGIATQDPVLREKFAGEPEHVINFFFMLAEELREIMANLGFRTITEMVGRSDMLEVDPEVVKTNEKLENIDLSLILKPASEIRPGVAQYCVEKQDHGLDMALDNKLIDLSRTAIEKQVRVFIETPIQNTNRAVGTMLSHEVTKRYHINGLPAGTIHVKFTGSAGQSFGAFLCPGITLELEGDSNDYLGKGLSGGKIVVYPPRNSSFSPEDNIVIGNVALYGATMGEAYFNGMAAERFCVRNSGAQAVVEGIGDHGCEYMTGGTVVILGKTGRNFAAGMSGGIAYVYDVDGKFSARCNNELVDLYHVEEEDDIITLKMMIEQHRRNTESVLARDILSDFDNLLPKFVKVYPRDYKRVLESMKVEKAVAKHAKEPKMANGISVTTKKVQPDQSASRPTHVANAKKYRGFITYERESISYRDPKERVRDWKEVAIESTPGPLLNTQSARCMDCGTPFCHQESSGAGCPLGNKIPEFNELVHQNRWREALDRLLETNNFPEFTGRVCPAPCEGSCVLGIIENPVSIKSIECAIIDKGFEEGWMIPRPPLQRTGRKVAIVGSGPSGLAAADQLNKMGHFVTVFERADRIGGLMMYGVPNMKTDKIGVVQRRVNLMAEEGVTFVVNANVGSDPLYSIERLRSENDAVILACGATKPRDLTIPGRELSGVHFAMEFLHANTKSLLDSNLEDGKYISARGKKVVVIGGGDTGTDCIGTSIRHGCTSLVNLELLSKPPSTRAADNPWPQWPRIFRVDYGHQEAATKFGKDPRTYEVLTKRFIGDGNGKVKALEVVRVKWEKVDGRFQLKEMEGSEEIIEADLVLLAMGFLGPEATIAEKLGLEKDNRSNFKAQFGDFATSVDGVFAAGDCRRGQSLVVWAITEGRQAAAAVDKYLSRYDQNAAATGDSTPSGTGLVQPVAA

SEQ ID NO: 19014 - protein, 306 aa, Prochlorococcus marinus str. MIT 9303
MLTELVKQSPPLPTGSKLLVLGGGFSGQHVVALARALGSTAICSRRDINSPGADMAFDSATKLLPTTKVLEGVTHLLSCIPPAADGKDPVLTCLGDQLKALPLQWVGYLSTTGVYGDRQGRWVTEIDHPQPQQARSKRRLACEEAWQASGLPLQILRLPGIYGPGRSVLKSVNTGQSRMIHKPNQVFSRIHVDDIAGAILHLIQCAADGQRPIVINVTDDMPTAYTDVLGFAAQLLGKSLPEIEPFAVAAAQMNPMALSFWQENRRVSNQLLCRELGYSLMHPNYHSGLRDCYLAEGFKVSQTNFP

SEQ ID NO: 19015 - protein, 466 aa, Frankia sp. EAN1pec
MAAHFDLVVLGGGPGGYVAAIRAAQLGLSVAVVEEKYWGGVCLNVGCIPSKALLRNAELAHLFAHEAKTFGISGEVSFDFGAAFDRSRQVAEGRVKGVHFLMKKNKITEFTGRGTFRDPNTLDVALSAGGTDQVSFDHAIIATGSRVRLLPGVELSDNIVTYETQILTRELPRSMAIVGAGAIGMEFAYVLRNYGVDVTIIEFLDRALPNEDADVSKEIVRQYKKLGVPILTSTKVETVTDNGSSVTVEYTGKDGARGSLEVDKVLMSIGFAPNVEGFGLENTGVALTDRGAIAIDDHMRTNVEHIYAIGDVTAKLMLAHVAEAQGVVASETIAGAETVMLGDYRMMPRATFCQPQVASFGLTEAQAREEGHDIKVAKFPFTANGKAHGLGDPNGFVKLISDTKYGELLGGHLIGPDVSELLPELTLAQKWDLTALELARNVHTHPTLSEALQEAIHGLAGHMINL

SEQ ID NO: 19016 - protein, 1773 aa, Arabidopsis thaliana
MASLSGLYSSSPSLKPAKNHSFKALPAQSRDSFSFPHTSKPTNLPLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKIKPPSSPEGRFTQILSVGIGGSALGPQFVAEALAPDNPPLKIRFIDNTDPAGIDHQIAQLGPELASTLVVVISKSGGTPETRNGLLEVQKAFREAGLNFAKQLQLLPHCSSSAAISRCMLMQGVAITQENSLLDNTARIEGWLARFPMYDWVGGRTSIMSAVGLLPAALQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHAYIQQLRDGVHNFFATFIEVLRDRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEVTSKSLKLVFSLVFFCCINKQKLKLISRLEMLNNFLPCEKDFISSILATSSTSFYSHCASISTSHFTMIPNGELRLPALKVREDRVSPSAPIPVTRTLVADTDVTSDDDMSTNSEDVSLDSSPENSRVSSAVGRSYGRNSSYYTYSEVSSSRETLVGAREQTGPRFDGDTEEDESTDSASSTQFSPPPAAGRINDGVSQVEQTHFPKTDRRATVEKEFDETFSSEEVSDIPSAPPFSGAAEESEEIKPATSSVQVSEVKTGDCVESRKTGHFTRPSAASESSGPPDQHPARLPTFHARLQQLLLQSEEELLAKRSSQAPHEGVAPKPKKNIGKMKVQVRRVKTVMDGPTGCSISSLKPSLIKFEKIRIHFSNMSTRLFSGWRALRKIHVRVPANGSSLPRQSLAYVHASTQYLKQVSGLLKTGVTSLRNNSTSYDIVQETYSCKLRLKSLAEDNAIMMQPGSGESHVFFPDSHGDDLIVEILDPMGKDFGRVLVQLANISEDSYVSSDSNEETIQAEKLRWWSVFREPEHQHVGKLQLYIDYSASFDDNSHLKCASVAETVAYDLVLEVALKMQRFQQRNLLLYGSWKWLLEEFATYYGISDVYTKLRYLSYVMDVATPTSDCLHLVHDLLTPVIMKGNGKSALSHQENRILNEIKDQIEQILKLVFENYKSLDESSFSGMIDVVNSASGVPAPALIPAVKLYTLLHDVLSPEDQTHLCHYFQAAAKKRSRRHMGETDEFVANNSEPNFWDMSAMSAAYQKMTMACKNVKNEIYTDIEIQNEDILPSFLDLPNLSASIYSTDLCNRLRAFLVACPPSGPSPTVAELVIATADFQRDLSSWNISPIQGGVDAKELFHLYIMIWIQDKRLSLLESCKLDKVKWSGVRTQHSTTPFVDEMYKRLNETIQDYQVIISRWPEYIFVLESAIADVEKATVEALEKQYADVLSPLKENLAPKKLSFKYVQKLTKRSVIPYVVPDELGILLNSMKRMLDVLRPNIEAKFKAWSSCIPDGGNAAPGDRLSEVTVMLRAKFRSYLQAVVEKLVENSKLQKTTMLKKILQDSKESVGESDIRSKMNNLKEQLTNTVNHLHSVCETHVFIALSRGYWDRMGQIVLSFLENRKENRAWYKGSRVAVSILDDTFAAQMQQLLGNSLREQDLEPPRSIMEVRSILCKDPADNKAKSFYY

SEQ ID NO: 19017 - protein, 336 aa, Brucella melitensis 16M
MRDSNGEYAMNKPLGSKDAEAAGRGRIYDSILDTIGNTPLVRIDKFARENGVKANLLVKLEFFNPLASVKDRIGLAMIEALEKQGKAVPGKTVFVEPTSGNTGIALAFAAAAKGYRLILTMPETMSMERRKLLRLLGAELVLTEGAKGMKGAIAEAEAIAEGNPNAIIPQQFENPANPEIHRLTTAEEIWNDTNGEADILISGIGTGGTITGVGQVIKARKPSFKVVAVEPKDSPVLSGGAPGPHKIQGLGAGFAPKTLDTGIYDEIVQISNEDAFTNARLVARLEGIPVGISSGAALAAAIEVGKRSENAGKNIVVVIPSFAERYLSTALFEGLE

SEQ ID NO: 19018 - protein, 576 aa, Oryza sativa Japonica Group
MGNNCVGPSAAGQNGFFANVALWRPRPADAAPPALPPPSSAPSDQAPEPVTIPPSEHSSHHSSRSTDPSTPTSAAEQPANKAAPKVKRVQSAGLLADSVLKRDVNTARLKDLYTIGKKLGQGQFGTTYLCVEKATGREFACKSIAKRKLLTQEDVEDVRREIQIMHHLAGHANVVSIVGAYEDAVAVQLVMELCAGGELFDRIIQRGHYSEKAAAQLARVIVGVIEACHSLGVMHRDLKPENFLFIHQKEDSPLKAIDFGLSIFFKPGETFTDVVGSPYYVAPEVLMKHYGREVDVWSAGVIIYILLSGVPPFWDESEQGIFEQVLKGDLDFSSEPWPNISESAKDLVRKMLIRDPKKRLTAHEALCHPWVCVDGVAPDKPLDSAVLSRLKQFSAMNKLKKMALRVIAESLSEEEIAGLKEMFKMLDTDNSGHITLEELKTGLQRVGANLMDSEIDALMEAADIDNSGTIDYGEFIAATLHINKVEKEDKLFAAFSYFDKDGSGYITQDELQKACEEFGIGDTRIEDIIGDIDQDNDGRIDYNEFVEMMQKGNNAMGKMGQHSTGNFGLGEALKLR

SEQ ID NO: 19019 - protein, 321 aa, Triticum aestivum
  misc_feature (232)..(232): Xaa can be any naturally occurring amino acid
  misc_feature (265)..(265): Xaa can be any naturally occurring amino acid
MSDNSIQRALLPENPDANVLQRKPSQGAKRFRRCRSAPRSETDEKPQENGSSLPAKELFSVVRPSFRLVGFLLFLYLLVGVVVFYLVMDQLSGKRTNRVLDALYFCIVTMTSVGYGDLVPNSDTTKLLACVFVFTGMAIIALFVSKSADYLVEKQEVLFFKALHMNMKCGEAKMLRQIETNKTKYKFYTAALLLVTAIVVGTVFLWKVEKLSLVDSFYGVCATITTLGLWGXRLSSQLGRTFAGFWIITSPIFLALFFMVPCWNXTERREKKVAKMGPHRRVKTRILKRVDWDMNQKGGLGNCPGQTRKRGEIRHRHNFLF

SEQ ID NO: 19020 - protein, 428 aa, Oryza sativa Japonica Group
MASKRFLSLSLLILLLGFSSSLAAGQVLFQGFNWESWKENGGWYNMLMGKVDDIAAAGITHVWLPPPSQSVAEQGYMPGRLYDLDASKYGNEAQLKSLIEAFHGKGVQVIADIVINHRTAEHKDGRGIYCLFEGGTPDSRLDWGPHMICRGDPYGDGTGNPDTGADFGAAPDIDHLNKRVQRELIGWLDWLKMDIGFDAWRLDFAKGYSADVAKIYIDATEPSFAVAEIWTSLAYGGDGKPDYDQNAHRQELVNWVDRVGGANSNATTFDFTTKGILNVAVEGELWRLRGEDGKAPGMIGWWPAKATTFIDNHDTGSTQHMWPFPSDKVMQGYAYILTHPGNPCIFYDHFFDWGHKEEIERLVSIRNRQGIHPASELRIMEADSDLYLAEIDGKVITKVGPRYDVEHLIPEGFQVVAHGDGYAVWEKI

SEQ ID NO: 19021 - protein, 322 aa, Brucella melitensis 16M
MHNFRELEMSLISIGTLGGTIAMVEGGSGGGVVPTLTADALIAAVPQIRNYAQIKAQSLFQLPSPSLKFRHGLEVIGWAENEVKSGADGIVLTQGTDTLEEMAFLLDLLWEHPQPLVLTGAMRSPRAPGADGPANLVAAVLTAASRLSRERGVLVAMNDTIHAARWITKSHALSVQTFVSSDSGPLGYVYEETPVYINTLSRLPKIDRTQFNADVKIGFYESLLDGDAQMLRSMFESGRYDGIVVAGFGAGHVSGDEADIIERYASRIPVVVASRTYGGRTATKTYGFHGSEIDLQTKGAMLAGWLSPPQGAVIAMGTTGSG

SEQ ID NO: 19022 - protein, 572 aa, Methylobacillus flagellatus KT
MSYQVLARKWRPKSFDELVGQEHVVRALTNALQQQRLHHAYLFTGTRGVGKTTLSRILAKSLNCERGVSANPCGQCTACVAIDKGSFLDYVEMDAASNRGVDDMTSLLEKAIYAPTQGRYKVYMLDEVHQLTGHAFNAMLKTLEEPPAHVKFILATTDPQKVPVTILSRCLQFNLRQMSSSGIAAHLQHVLTQENITFEPVALQLIGRSANGSMRDALSLLDQAIAYGGDSVNEKEVRTMLGAIDQAYLFELLNALLAQDGNALLAQARAMEERAISFDAALSDLANLLHEIAIAQAVPDSIAIDHPDRQTLLDIAARMRPEEIQLYYQIALLARRDLGLAPDEFAGFTMALLRMLAFRPGEQTSSTKAAPPPAASSTVAESTRPRASAALAVSEPAVRIPAPNMREASPEPTPESATSRDSQALSPGAFSAAASSTQEAPASAVTRSFDGNWRALVDRLKLGLARALAQNCEVASFDEDHIAFSVPPTQKHLLGMGYEEKLQSAVEQHFGRKIKLTFALGGSGNTPAQLMSQEKAALQAHAENAIHNDGFVQALIKDFGAQIIPSSIKPLQ

SEQ ID NO: 19023 - protein, 1423 aa, Nostoc punctiforme PCC 73102
MTNREELMKNESTSASNADVNFLIGGGEMGARMREWDWSKSSLGPTQQWPQSLKTAVRIMLTCRQPMFVWWGEELINLYNDPYKAIIGGKHPEALGQPASCVWREIWDQIGPRAESAMLKNEGTYDEALLLIMERNGYPEETYYTFSYSPVPNDQGDTGGIICANTDDTQRIIGERQLALLRELAARTADARTFDQACTLSANCLESNPYDLPFAMIYLVDPDEQQVFLTGTCRIGQNHVAAPETVDLDSDCVWPFAEVIETHQAKLISDLEVSFSSLPCGIWERSPHQAIAVPIAPSGQTGKAGILIAGLNPFRLFDDNYKRFIDLVAAQIAASIANAQAYEEERKRAEALAELDRAKTVFFSNVSHEFRTPLTLMLGPLEETLANCATLLPAHEREQLEMVQRNGLRLLKLVNSLLDFSRIEAGRVQASYEPTNLATFTAELASVFRSAVERAGMELSVNCPSLPAPVYVDREMWEKIVLNLLSNAFKFTMTGKIAVSLQWANDHIEFAVKDTGIGIPAEEIPHLFKRFHRVKGAQGRTFEGSGIGLSLVQELVQMHGGTVKVTSVLGAGSCFTISIPTGYAHLPPARISAPRTLASTALGATPYLEEALRWLPEEERETRGGGDKGSVAKEFSLSPYTLIPLSSSSARILLADDNSDMRDYVKRLLSQQYEVESVADGLAALDSARGRVPDLVLTDVMMPGLDGFGLLQELRANPQTKKVPIILLSARAGEEARVEGLEAGADDYLIKPFSARELLARVEAALKMAHLREEAMQREQGLRIEAEVAKAHLETVLAGIQDQFFVLDREWHYTFVNDRVAEVVGIQKEELLDRIIWELFPDVAKSEFYTQVHRAMAEQTVVQFEYFYPAWQRWFENRVYPFGEGVSIFVTEISDRKQAEKALRESEEQFRNMADNAPFMVWVTDTNNYCTYLSRSWYDFTGHNEETSLGFGWLNAVHPEDCDEVRNIFLEASKRCEAFRMEYRLHRKDGEYRWTINAANPWFGVDGQFKGYIGSVIDITERKTAEAERDRLLELEQVARTEAETANRIKDEFLAVLSHELRSPLNPILGWARLLQTREFQPAEIKKAIATIERNAKLQAQLIEDLLDVSRILQGKLNLKMFPVNLVLVIEAGLETVRLAAEAKDIQIQTMLDASLGQVLGDSDRLQQVIWNLLSNAVKFTPEEGKINIQLERIDSQAQITVSDTGKGISPEFLPHVFEYFRQADGTTTRRFGGLGLGLAIVRHLIELHGGTIWAESLGEGQGAIFRVRLPLIKKELTPKQQINIDPINASSTTEILTGIQILVVDDDDDTREFHTFVLEQAGAKVMAVASAKEALQALAESEPDILLSDIGMPETDGYMLMRQIRALQLKQAKQIPAIALTAYAGEINQQQAIASGFQRHLSKPVEPDELVKAIATLIGRNG

SEQ ID NO: 19024 - protein, 543 aa, Gossypium hirsutum
MVAPQLAAVFTKLQTLSTSDHASVVSMNIFVALLCACIVIGHLLEENRWMNESITALIIGVFTGVIILLTSGGKSSHLLVFSEDLFFIYLLPPIIFNAGFQVKKKQFFRNFITIMLFGAVGTLISCTIISLGVINFFKEMDIGSLDIGDFLAIGAIFAATDSVCTLQVLNQDETPLLYSLVFGEGVVNDATSVVLFNAIQSFDLVNTSPRILLEFIGSFLYLFLASTMLGVIVGLVSAYIIKKLYFGRHSTDREFALMMLMAYLSYIMAELFYLSGILTVFFCGIVMSHYTWHNVTESSRVTTKHAFATLSFVAETFLFLYVGMDALDMEKWRFVSDSPGTSVAVSAVLMGLVMVGRAAFVFPLSFLSNLAKKSTSEKISFREQIIIWWAGLMRGAVSMALAYNQFTRGGHTQLRGNAIMITSTITIVLFSTVVFGLMTKPLIRFLLPHPKPTASMLSDQSTPKSMEAPFLGSGQDSFDDSLIGVHRPNSIRALLTTPAHTVHYYWRKFDNAFMRPMFGGRGFVPFVPGSPTERSEPNLPQWQ

SEQ ID NO: 19025 - protein, 426 aa, Vibrio angustum S14
MSVYSTLCFLAAAAMFIAFVNSKIGKMQTTIAITAGSLILSLLIIIAGHNGWFHLEDVAATQISKINFEDFLLKGILGFLLFAGGLGIKLPHLEDQKWEITVLALGATLFSTFFIGFSLWGICQVIGIQLDLIYCLLFGALISPTDPIAVLAIVKKMNAPRRISTQIEGESLFNDGFGLVIFVTMFTIAFGDTAPTVMGVTQLFLQEAIGGIAYGFVLGLIFHYLISSTNDHSMELLLTIGIPTAGYALAEVLHVSGPLAMVVSGIMIGNWTRYIGFSKESEEHLDHFWELVDEFLNGVLFLLIGMTMLDFSFHQEDWILMIIAVPLVLLSRYISVKLPYVGFNRYRQYNPMSVKILTWGGLRGGLALAMAMAIPAGVMVIPEKGIDVREIILVMTYSVVVFSILIQGSTITPLIEKAKLWELKNK

SEQ ID NO: 19026 - protein, 442 aa, Zea mays
  misc_feature (26)..(26): Xaa can be any naturally occurring amino acid
AHLPEQKSTKKIMGSELGEAMGSKTXRRSSSSSSNSMGSENWNIEVDEGDGIDSSVGCSLDTHSRSNMRRSGSPEVVRTPRMCFNMLQGCRSIDDFERINTINEGTYGVVFRVRDKKTGEIVALKKVKVDKENGREGFPLTSLREINILLSFDHPSIVDVKEVVVGGHDDDTFMVMEYMEHDLKGVMEAMKQPYSQSEVKCLMLQLLEGVEYLHDNWVLHRDLKTSNLLLNNRGELKICDFGLSRQYGSLLKPYTQPVVTLWYRAPELLLGAKEYSTAIDMWSLGCIMAELLSKEPLFTGKSEIDQLDKIFRILGTPNEERWHGCSKLPGFKGNFVKRPYNRLRDKFPAVSFTGGLTLSEAGFDLLNRLLAYDPEKRISAADALNHEWFREVPLPKMKEFMPTFPALNEQDRRIKRYMKSPDPLVEQQMKEQGSIGDHGLFD

SEQ ID NO: 19027 - protein, 409 aa, Bordetella petrii
MTVTSTQQDPAAFLARRMSAIKPSPSMAAKRKVDSLRAEGKTIIDFTIGEPDVPTPAHIARAGIAAIESGSVKYTSSSGIRELLVAAQQKFSRENGLSFSLDQLVVGTGAKQLIFSALQATLDAGDEVIIPTPYWVSYPDMVLLNDGKPVIVPTVEAQGFKLTPQALEAAITPRTKWLLLNAPNNPSGAIYTEAELAALLAVLERHPHVLLMVDEIYEHFCYDGRYVSPLAVKPGLGPRVLLVNGVSKAYAMTGWRVGYAAGPAWMAKAISTLISQSTSCASQICQVAAATALSADQQCVADIIALYKARRDIIVDLLNDIESMSCPMPAGAFYVFPNIQGFIGKRTPDGKTIGNDLDFVHYLLDAAGVAVLDGTAYGNPGYMRMSFATDLDTIRTGCEKLSWACSQLK

SEQ ID NO: 19028 - protein, 456 aa, Vibrio angustum S14
MDKATTHSESLTVAKFGGTSVADYAAMSRSAAIVTANPETKIVLISACSGVTNILVELANGVSDSTTRQQRIQTLTQTHQDVLDQLQHPENVQDAIYGLLDNIATLAEHAAFATSAQLTDQIVSHGELLSTHLFSQILVELNAPAVRVDIRPIMRTDDQFGKAIPQPDTIKQLATEQLLPLLDNNIVVSQGFIGSNSQGVTTTLGRGGSDYSAALIAEAVNASTLEIWTDVPGLYTTDPRITSAAKPIKEISFSEASEMANFGAKILHPSTLVPAVRQQIPVFVGSSKAPEQGGTWIRQSVEEAPLFRALALRANQTMVTLTSLNMFHAYGFLAEVFRILAEHKISVDLITTSEVSVSLTLDQTDTGGGAPTLPLQVVEELSQLCVVDVEQGLSLVALIGNQMSDTKGSAKDIFGALEDHNLRMICYGASPHNLCFLINEDEAKDVVRTLHASLLE

SEQ ID NO: 19029 - protein, 372 aa, Vibrio angustum S14
MTINSFIPPHRTLMGPGPSDIYPQVLQALSRPTVGHLDPLFISMMDELKQLLQYAFQTKNAFTIAVSAPGSAGMEACFVNLVEPGDKVLVCRNGVFGERMRENVERCGGVAVVVDNEWGTAVDPDLVEQALQNDPDIKIVAFVHAETSTGALSDAKTLAEIARKYDCLTIVDAVTSLGGVPLLVDEWQLDAVYSGSQKCLSCTPGLSPLTFSQKAIDKIQQRKTKVQSWFLDQSLVLGYWSGEGKRSYHHTAPVNSLYALHEALVLLQNEGLENAWQRHRNAHEELKAGLEKLGIKFVVEETSRLPQLNAVYIPEGVDDAEVRNELLQRYNLEIGAGLGALAGKAWRIGLMGYGARSENVALCLKALETTLK

SEQ ID NO: 19030 - protein, 543 aa, Malus x domestica
MGCYSSKENAPKPGSKGFGSSQPYQQPQTAAQPQKVSSQQPHNPPPPPRPQPQQRAQPAPQPRAQYQQPSPPPAKPAPQPNSILGKPFDDIKQYYTLGKELGRGQFGITYLCTENSTGHSYACKSILKRKLVSKNDRDDIKREIQIMQHLSGQPNIVEIKGAYEDRYSVHLVMELCAGGELFDRIIAQGQYSERAAAAILRDIVNVVHICHFMGVLHRDLKPENFLLSSKDEKAMLKATDFGLSVFIEEGKVYRDIVGSAYYVAPEVLRRSYGKEIDIWSAGVILYILLSGVPPFWAETERGIFDAILEGVIDFDSQPWPSISDSAKDLVRKMLTQDPRKRITSAEVLEHPWLRVGGVASDKPLDSAVLSRMKQSRAMNKLKQLALKVIAENLSEEEIKGLKTMFTNMDTDKSGTITYEELKTGLARIGSRLSEAEVRQLMDAADVDGNGSIDYIEFISATMHRQRLERDEHLYKAFQYFDKDSSGYITRDELEAAMKEHGMGDDNTIREIISEVDADNDGRINYSEFCAMMRSGAQQPAKLF

SEQ ID NO: 19031 - protein, 463 aa, Oryza sativa Japonica Group
MHTRSRRLGFPPLNPSHLLLTPHLPPLSSDRARMAMSRAAAAAAGTPVARRRLMGAVAARSMASWFGHVEPAAKDPILGVTEAFLADPSPDKVNVGVGAYRDDSGKPVVLECVREAERRIAGSMNMEYLPMGGSIKMIEESLKLAYGENCEFIKDKRIAAVQALSGTGACRLFADFQKRFLPDSQIYIPTPTWANHHNIWRDAQVPQKTFTYYHPESRGLDFAGLMDDIKNAPDGSFFLLHACAHNPTGVDPSEEQWREISHQFKVKKHFPFFDMAYQGFASGDPERDAKAIRIFLEDGHQIGCAQSYAKNMGLYGQRAGCLSILCDDEMQAVAVKSQLQQIARPLYSNPPVHGALIVSTILGDPELKSLWLKEVKGMADRIIGMRTALKENLEKLGSPMSWEHITNQIGMFCYSGMTPEQVDRLTKEFHIYMTRNGRISMAGVTTGNVAYLANAIHEVTKTK

SEQ ID NO: 19032 - protein, 480 aa, Vibrio parahaemolyticus RIMD 2210633
MTSKLRRTKIVTTLGPSTDKDNVLEEIIKAGANVVRMNFSHGTSEDHIQRAKKVRAIAARLGRQVAILGDLQGPKIRVSTFKDGKITLKVGDKFTLDSDLPKGEGNQESVGLDYKELPQDVSPNDILLLDDGRVQLQVTSVEGNKVHTRVTVGGPLSNNKGINKKGGGLSADALTEKDKADIITAAEIKVDYLAISFPRNGEDMHYARRLARDAGLEAKLVAKVERAETVATSESIDDIILASDVVMVARGDLGVEIGDPELIGVQKKLIRRARSLNRVVITATQMMESMINSPMPTRAEVMDVANAVLDGTDAVMLSGETAAGQYPVETVKSMADVCIGAEKMSEASLSTYRLDRTFETAEETIAMATMYSANHMEGIKAMIALTESGRTALMMSRLSSGLPIFALSRNESTLNRAALYRGVTPVYFDAKCDAGLPTAQAAISSLKDQGYLHEGDLVIITQGDVMDVVGSTNCMRILPV

SEQ ID NO: 19033 - protein, 394 aa, Vibrio vulnificus CMCP6
MGGFEEGKACLRAKIDMASSFMVMRDPVLYRVRFASHHQTGDKWCIYPMYDFTHCISDALEGITHSICTLEFMDNRRLYDWVLDNITIDCRPHQYEFSRLNLEYTVMSKRKLNQLVTEKLVNGWDDPRMPTISGLRRRGFTPASIREFCKRIGVTKQENMIEFSSLESCIRDDLNENAPRAMAVLDPVKLVIENFPAGEVENLTVANHPNKPEMGEREVPFSREIWIEREDFREEANKKYKRLVLGSEVRLRGAYVIKAERVEKDDEGNITTIFCTYDSETLGVNPADGRKVRGVIHWVSADKGVPAEIRLYDRLFTVPNPAAADDFASTINPESLTVMNGFVEPSLVEAEAEKGYQFERMGYFCADSKDSSKEHLVFNRTVGLRDTWAKIEAK

SEQ ID NO: 19034 - protein, 516 aa, Escherichia coli O157:H7 EDL933
MFMATYMTFSLKQSGRAMSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFFSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETAS

SEQ ID NO: 19035 - protein, 633 aa, Gibberella zeae PH-1
MAQELKAGGGASEVTRSIPKLDPVVTGHLVKLFGSLADRADNTWSKERVSSFIKDTQKDGPSPAVDDLLARDSLDLDGFITWMTSSHAAATTPPKPQDLTYPLASYFISSSHNTYLTGNQLSSDSSTKPYTETLLRGGRCIEIDVWDGDESEPEGTSSPSSSDEERGVKKVVRKKRSTFGKLKDKLKKTSISDKKDSASASTTDPVSREPGAVTNAEPESTEPEAAIVEPRVLHGYTLTKEISFRAVCEAIRDSAFVVSDLPVIVSLEVHCNAEQQLAMVRIMKQVWEGLLVAEPENDPENLPSPDELRHKLIVKVKYAPPDTDSTQEESEEDDRAPHPGAESGDPPKKKPSKVIQELSKMGFHCRGVSFKSLSQPEAGMPTHIFSLSEKKVIDVHEEQADALFNHNRHFLMRTYPWGLRIGSSNLDPSVFWRKGIQVVALNWQRWDEGMMLNEGMFAGTGGYVLKPLGYRPNRNDEVVSNTIPRQTLHLTITVIAAQNIPLPPGDKSARGFEPYVKVELHVEGPDEFHGGPIPNDGHEREGEYKARTRTQKGDVVDFGSEPLEFPPIPHVVDELSWVRFTIRDDEIGRDDMAAWACMRVDRLGHGYRFVHLMDCEGCLTDGAILIKVDKRLE

SEQ ID NO: 19036 - protein, 382 aa, Prochlorococcus marinus str. MIT 9303
MQDKLTLMIPGPTPVPETVLKAMGRHPIGHRSGEFQAVVRHTTEQLRWLHQTKSDVLVITGSGTAAMEAGIINTLSYGDKVLCGDNGKFGQRWVKLAKAYGLDVQVIKADWGQPLDPEAFKRALEADNGKTIKAVILTHSETSTGVINDLETISKYVRTHGKALTIADCVTSLGACNVPMDSWGLDVVASGSQKGYMMPPGLSFVAMSERAWQAHQQSDLPKFYLDLGPYRKTAAQDSNPFTPAVNLYFALESALGMMQSEGLEAIFDRHARHRAAAQAGMKAICLPLYAAEGHGSPAITAVAPEGVDAEQLRKTVKEKFDILLAGGQDHLKGKVFRIGHLGFVCDRDILTAIAAIESTLQSLGLHKGNMGDGLAAAAAILR

SEQ ID NO: 19037 - protein, 332 aa, Brucella melitensis 16M
MKTGRTDRPRILIVSTGGTIASRYDPQTDSLLSVSTGKELLSSLGALAPAVDVVLDEFCNLGSNRIDLDTSFRLAHHIDERLRDRTVDGCVVTHGTDTLEESAFLAQLTISSRKPVVFTGAQRSADEPDADGPRNLADAISVAASPEARDLGTLVVFAGKVLSSIDATKIHTSKLEAYDAPGYGPLGVVDHGAVFITRKPLGYPMIAAHSIETRVDLITLAMGADGRLIEAAINSGTHGFILETFGRGNATPAVVDAIARATERGIVTIITSRCPDGRVLPVYGDGGGSDLEKAGAIFAGRLNGPKARILLCLSLPTIPVEELGRLFEQFGR

SEQ ID NO: 19038 - protein, 256 aa, Streptococcus pyogenes MGAS315
MKIGIIGVGKMASAIIKGLKQTPHELIISGSSLERSKEIAEQLTLPYAMSHQDLIDQVDLVILGIKPQLFETVLKSLHFKQPIISMAAGISLQRLATFVGQDLPLLRIMPNMNAQILQSSTALTGNALVSQELQARVRDLTDSFGSTFDISEKDFDTFTALAGSSPAYIYLFIEALAKAGVKNGMPKAKALEIVTQTVLASASNLKTSSQSPHDFIDAICSPGGTTIAGLMELERLGLTTTVSSAIDKTIDKAKSL

SEQ ID NO: 19039 - protein, 474 aa, Escherichia coli O157:H7 EDL933
MQHKLLINGELVSGEGEKQPVYNPATGDVLLEIAEASAEQVDAAVRAADAAFAEWGQTTPKVRAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINVLFGRGKTVGDPLTGHPKVRMVSLTGSIATGEHIISHTAPSIKRTHMELGGKAPVIVFDDADIEAVVEGVRTFGYYNAGQDCTVACRIYAQKGIYDTLVEKLGAAVATLKSGAPDDESTELGPLSSLAHLERVSKAVEEAKATGHIKVITGGEKRKGNGYYYAPTLLAGALQDDAIVQKEVFGPVVSVTLFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 19040 - protein, 347 aa, Agrobacterium tumefaciens str. C58
MKTHRIALIPGDGIGQSVTDAAWQVLNAVAKTSGFVLEGTEFPWSCAFYKETGAMMPKDGIETLRGFDAIMLGAVGWPAEVPDSVSLHGLLLPIRKAFVQYANIRPHRLLSGVQGPLKADGFDILCIRENTEGEYSGAGGRVHQGTEDEVAVETSIFTRKGVERILRFGFEQAQKRRGKLASITKSNAQKYSMVFWDEVTHKLAAEYPDVEVSSYHIDAMAARMVMAPESLDVVVASNLFGDILTDLGAAIQGGLGFAASANINPDRSAPSMFEPVHGSAPDIAHLGIANPIAAIWSGAMMFEHLGEKDAAAKIMAALETATGRGIGTVPGKDKTDTITAAVLAALA

SEQ ID NO: 19041 - protein, 485 aa, Agrobacterium tumefaciens str. C58
MQGLKDKELFRQTGLIGGAWKAAASGKVVDVIDPATQAVIGTVPDMGGAETRAAIEAANAAFGPWKKKTHAERAALLEKWFALMIENIDDLRLILTIEQGKPLDEAKGEIRYGASFVKWFAEEARRIGGGTIPSPTPDRRIVVLKEPVGVCGIITPWNFPNAMITRKVAPALATGCTVVIKPSEFTPYSALALGVLAERAGIPAGVINIVTGMPTEIGNEIMANETVRKISFTGSTRVGSLLMRGAADSVKRLSLELGGNAPFIVFDDADLDLAIEGAIVSKFRNGGQTCVCANRILVQSSVYDAFAKKLADRVDAMRVGPGTEAGVSIGPMINKPAIAKIRAHIDDAVAKGATIITRPRDLPEGPQYTAPVVLTGATTAMQLASEETFGPVAPLFRFETEEEALAIANGTPFGLAAYFYTESLKRAWRVGEALEFGMVGLNTGAISTEVAPFGGVKQSGLGREGAQVGIEEYLETKTFHIGGLA

SEQ ID NO: 19042 - protein, 281 aa, Frankia sp. CcI3
MVLSPVPTVPLAHGARMPRLGLGTWPLNDREVQGVVEQALGLGYRLIDTAHNYGNEKGVGAGLRAAGVPREELFVTTKFNKRSHSVRGVRRAAVESTRRMGLDYLDLLLIHWPNPWRDRYVEAWKGLVELLKDGQVRAIGVSNFKTTHLDRLLAQTGVAPDVNQIQLDPRLGRSAIRAYHAEQGIVTEAWSPLGAGTGLLDEPVITRIAAAHERTPAQVALRWHIELGIVVVPKSASPRRMAENIDVFDFTLSAEEIAAISGLDRGAAGEADALDSDVFGH

SEQ ID NO: 19043 - protein, 224 aa, Medicago truncatula
MDQRSGREKDIEVDLESGLPLIEDNSRRISIISGGFVGGSVNGEARPSSYLNESNLSEVSVNMMKVVNKAPAKEKRKKASGKKAAKPPRPPQGPSLDAADHKLIKEMSELAMLKRARIERMKALKKMRTAKSSTPSSNSSSIVAMVFTVIFFIVIICQGMSSTGKSSVSSFQGSPVSAGGTEEGLISVQYQLNPSSDSNAPGSESINFVQRVSGSDLHEKLRRD

SEQ ID NO: 19044 - protein, 461 aa, Dehalococcoides sp. CBDB1
MLENAEYIKAGELLDHTQKLYDEGAIFCTASCVDLGNEFEVIYHYNLEKGLRMKHLRLKIDKNETVPSISNIYLCASLIENEMQELYQLKLSKIAIDFSGGFLVTKETPTSYMIKAPDYKLIPVERLTAPCQKTCPAGIDVSCYVRLCGEGNYDAALAVIKQAMPFPGILGRVCLAPCESACRQGKCGESISIKQLKRAAYEYGHYTDSITAKPTGKKVAIVGSGPSGLATAYFLAKKGHKVTVFEALPKAGGYMRVGIPEYTLPRQILDAEIENVSKLGVEFKLGTTVNSLGSLKEMGFDATLLALGANQGVRRSNIIAAFSGGTDVFKRFGLAVENINGNNVLKIDDDTLTTSQQGVFACGDAVNGPTSVIHAVASGKKAAASIDKYLGSDGKWVFENIVAHEPVSRDTFLERILPKSKPLSVKYDIKQAKERNEETAGYNREVASTEGKRCWRCDLEE

SEQ ID NO: 19045 - protein, 276 aa, Pseudomonas syringae pv. tomato str. DC3000
MSTDDPRFAGIARLYGIEGLARLRAAHVAIVGIGGVGSWAAEAMARSGVGEISLFDMDDVCVSNSNRQLHALDTTVGRPKVEVMAERIRAINPDCVVHAVSDFVTRDTMAECITPDMDFVIDCIDSVNAKAALISWCKRRKIQMVTTGAAGGQIDPTLIQIADLNRTFNDPLASKVRSTLRRDYGFSRTPNRHYSVPCVFSTEQLRYPKPDGSICLEKKFIGDGVKLDCAGGFGAVMMVTATFGMIAATRAVDKLVAGTRRPSERAKPAAVTANQA

SEQ ID NO: 19046 - protein, 352 aa, Cryptococcus neoformans var. neoformans JEC21
MGCTQSTEDAAAKARSAEIDEQLKRDRANLRNEIKMLLLGAGESGKSTVLKQMRLIYNKPYDAEERDSYREIVYSNTVQSMRVLLEGVQFMDIPIDTSNQSRWELIMAAPPQIEGDVFPPKLTDAVAGLWKDYGVQQAFFRRNELQLNDSAPYYFDAIARIAQPNYMPTDQDILRARVKTIGITETHFKIGELTYKLFDVGGQRSERRKWLNIFDSVTALVFLIAISEYDQKLYEDETVNRMQEAMTLFESVANSRWFTKTSIILFLNKIDIFREKLLVSPLSNTFPDFRGGNDYDMACSFLLEKFVGLNNNPSKSIYAHYTDATDTKALKFVISAINDVIIQVNLRDCGLL

SEQ ID NO: 19047 - protein, 376 aa, Vibrio angustum S14
MTDKFIKSKAAIAWGPKQPLSIEEVDVMLPRAGEVLVRIVATGVCHTDAFTLSGDDPEGIFPAILGHEGGGIVEMIGAGVTDLQVGDHVIPLYTAECGKCKYCLSGKTNLCQAVRETQGKGLMPDGTTRFYKDGQPIFHYMGCSTFSEYTVLPEISLAKISKEAPLEEVCLLGCGVTTGMGAVLNTAKVEEGSTVAVFGLGGIGLAAIIGATMAKASRIIAVDINEEKFELARKLGATDCINPMKFDKPIQEVIVELTDGGVDYSFECIGNVNVMRSALECCHKGWGESVIIGVAGAGQEISTRPFQLVTGRVWRGSAFGGVKGRSELPGIVDRYMAGEFQLDDFISFNMGLDKINEAFDLLHEGKSIRTIIHFDK

SEQ ID NO: 19048 - protein, 401 aa, Pseudomonas syringae pv. tomato str. DC3000
MPLLSPWRADFPAIAALQRQGQTYLDNAATTQKPQALIDALTHYYTNGAANVHRAQHLPGAHATQAFEASRLKAAHWLNAGESGQIIFTHGATSALNLLAYGLEHEFTAGDEIALSALEHHANLLPWQQLAQRRDLKLVILPLDRDGVIDLDAATSLIGPRTRLLAVSQLSNVLGTWQPLARLIALAKAQGALTVVDGSQGVVHGRHDVQALGCDFYVFSSHKLYGPEGLGVLYGRNDALPSLTHWQFGGEMVLTADYQHAKFRPAPLGFEAGTPPIASVIGLGATLDYLDSLDHQAVAEHEARLHRRLLEGLQQRDGIQVLGAPDLALVSFVVDGVHNADLAHLLTEQGVAVRAGHHCAMPLLKTLGLPGAIRVSLALYNDSDDLLRFFSALDQALELLR

SEQ ID NO: 19049 - protein, 397 aa, Pseudomonas syringae pv. tomato str. DC3000
MNNAMQLLQPYPFKKLRALLGSVTPNPEKRPVALSIGEPKHRSPDFVAKALADNLDQMAVYPTTLGIPALREAIAGWCNRRFGVPQGWIDPARNVLPVNGTREALFAFTQTVVNRSDDGLVVSPNPFYQIYEGAAFLAGAQPHYLPCLSDNGFNPDFDAVDADIWKRCQILFLCSPGNPTGALIPVETLKKLIALADEHDFVIAADECYSELYFDEQTPPPGLLSACVELGRQDFKRCVVFHSLSKRSNLPGLRSGFVAGDAEILKAFLLYRTYHGCAMPVQTQLASIAAWNDEEHVRANRDLYREKFDAVLDILAPVLDVQRPDGGFYLWPNVGTDDAAFCRDLFVDQHVTAVPGSYLSREVDGVNPGAGRVRLALVAPLAECIEAAERIRAFVLK

SEQ ID NO: 19050 - protein, 290 aa, Vibrio angustum S14
MIKKCLFPAAGYGTRFLPATKSMPKEMMPVVNKPLIEYGVDEAIQAGMNRICIVTGRGKNTLMDHFDKNYELEHQISGTNKEELLVDIRDIIDSAYFTYIRQREMKGLGHAILTGRELVGNEPFAVVLADDLCVTDEEQQGVLAQMAELYKQFRCSIVAVEEVPEEETHKYGVISGQMLRDDLFRVDNMVEKPEPGTAPSNLAIIGRYILTPDIFDIIEQTEPGKGGEIQITDALMQQAQTGCVLAYKFKGKRFDCGSVEGYIDATNYCFEHVYKKGKHKELAQQQTGKK

SEQ ID NO: 19051 - protein, 505 aa, Cryptococcus neoformans var. neoformans JEC21
MAPAYPANPLLLEEPLIRTSYELLRRSHRSAQRQVEKDFNAINSGLQAILKSMEKGSITDEGRMEIVKKVDQVTERANGLKRKLDDLQPSASRPNTLRARLDYLEQNFPGSTTPSKKTKPKGESNRAAASKADKADAASNDMQIDEEDATPLPSNEADKSEPTPDSSTLDRYIVDYLIRKGRLNSATALATSQGIEELVDIKLFAELAKIENALVEKHSCTEGLAWCGENRGTLKKTKNNLEFTLRLQEFIELCRKRDITTAIAYARKYLSGWASAHMSEFQKGMSLLAFGEKTGVAPYRKLYDQSRWEAVRDQFRETFLDLYAQPSQSLLALALSAGLASLRLPSCVQNVRPNKSTGGDNTSVNPVVPLLPAVPPLHNLETTLFSPASSTHLTAPLGGIPSSPTTDLHAHPEAVTGNIDCPTCDENMRVLASEVPMSHHVNSTIVCRISGQVMDSENEPLAFPNGYVYSSKALAEMAKNNFDVVTCPRTRESCAFGRLRKVYIS

SEQ ID NO: 19052 - protein, 260 aa, Pseudomonas syringae pv. tomato str. DC3000
MTITLKTPEDIEKMRIAGRLAAEVLEMIAPHVKPGVTTEELDRICHDYIVNEQQAIPAPLNYKGFPKSICTSINQVVCHGIPGDRKLKDGDSLNIDVTVIKDGYHGDTSKMFHVGTVPVWAERLSKVTQECLYKAIEIVKPGTHLGDIGAVIQKHAEKNGFSVVREFCGHGIGKVFHEEPQVMHFGEAGTGLQLKEGMTFTIEPMINQGRAETKILGDGWTAITKDRKLSAQWEHTLLVTADGYEIFTLRSDDTIAQKAP

SEQ ID NO: 19053 - protein, 147 aa, Vibrio vulnificus CMCP6
MSEADARPSNFIRQIIDKDLADGKHTSVHTRFPPEPNGYLHIGHAKSICLNFGIAQDYQGKCNLRFDDTNPEKEDIEYVESIKNDVSWLGFEWDDEICYSSNYFDKLYEYAVELINKGLAYVDELSPEQIREYRGTLTAPGKPSPYR

SEQ ID NO: 19054 - protein, 316 aa, Trichodesmium erythraeum IMS101
MMLMPNTGNLINPMLPQFQIDTTFDLSNYLVERKALVEKALDNSIKIVYPEKIYEAMRYSLLAGGKRLRPILCLATCELSGGNIEMAMPTACALEMIHTMSLIHDDLPSMDNDDYRRGQLTNHKVYGEDIAILAGDGLLSYAFEFVVTQTKNVLPKQVLQVIARLGKASGAAGLVGGQVVDLASEGISQVSEKTLHFIHTHKTGALLEASVVCGAILADVSQANLYRLERYAQNIGLAFQIVDDILDITATTEELGKTAGKDIEAKKATYPVIWGLEKSRFQAQKLVEKAKAELEVFGDKVMPLIALADFIISRSN

SEQ ID NO: 19055 - protein, 388 aa, Candida glycerinogenes
MVSPAERLSTIASTIKPNRKDSTSLQPEDYPEHPFKVTVVGSGNWGCTIAKVIAENTVERPRQFQRDVNMWVYEELIEGEKLTEIINTRHENVKYLPGIKLPVNVVAVPDIVEACAGSDLIVFNIPHQFLPRILSQLKGKVNPKARAISCLKGLDVNPNGCKLLFTVITEELGIYCGALSGANLAPEVAQCKWSETTVAYTIPDDFRGKGKDIDHQILKSLFHRPYFRVRVISDVAGISIAGALKNVVAMAAGFVEGLGWGDNAKAAVMRIGLVETIQFAKTFFDGCHAATFTHESAGVADLITTCAGGRNVRVGRYMAQHSVSATEAEEKLLNGQSCQGIHTTREVYEFLSNMGRTDEFPLFTTTYRIIYENFPIEKLPECLEPVED

SEQ ID NO: 19056 - protein, 762 aa, Zymomonas mobilis
  misc_feature (305)..(305): Xaa can be any naturally occurring amino acid
  misc_feature (360)..(360): Xaa can be any naturally occurring amino acid
MPPSQQIATIAAREILTRLHDVMASRSNAQSKLDQVVQIISTALLSDVCSIYLLRDGVLELFATYGLKQEAVHVTRLSLGQGLVGTIARDMAILNLSEATSHPDFVHNPETGEEFFHSFAGVPIVRREQAVGVLAVQSAESRRFADIEVEALQTVAMVLAELIFSAGLIDENSLASSGSKDQGSLRYNGLKLVEGMGRGYAVFHQPRVTIEFTVAEDVEVERQRLNAAFARMREQIEHMAQEAEFFGNSNDHREVLATYRMFAYDEGWRRRIDEAIDSGLTAEAAIERVQQHNRMRMREIGDPIXADRLHDLEDLSNRLLRLVSGQLGTAARLGLHDDAILIARNMGPAELLEYERGRLXGIVLEEGSLTSHVTIVAKAIGIPVLGRVKEIHQGVREGDLLLVDSNQGAVFIRPTPEIEEAFATRFALSRKRRAEFAAMRDLPAITRDNHRIELMINAGLRDDVAALEATGADGIGLFRTQFEFLVYSTLPRRERQLRLYSDILEAAGDRPVILRTVDIGNDKTLPYINNSDETVEENPALGWRAIRLALEKKALLKVQARALIEGAAGKTLYVMFPMIAEPWEYEQARAVFEKQNAWLAKHDKPRAKRIYYGSMLEVPSLAETLDILLPKLDFLSIGTNDLIQFFFAADRAYPKLAERYDWLSPALLRFLSRIIDQANAAGCKVGICGEMGGRTLTAMALIGLGLKRLSITPVAIGPIKAMIRSLDRDAFAPFIRELVASGASNIGDQLELWAKKHGVVIN

SEQ ID NO: 19057 - protein, 528 aa, Prochlorococcus marinus str. MIT 9303
MSNSQSEGQRQPAIVILDFGSQYSELIARRVRETEVYSLVMSYSTSADELRQLAPKGIILSGGPSSVYAERAPLCDPNIWDLGIPVLGVCYGMQLMVQQLGGRVEMATGKAEYGKAPLEIDDPTDLLTNVENGSTMWMSHGDSVRALPEGFVRLAHTANTPDAAVAYHTRSLYGVQFHPEVVHSTDGMSLIRNFVYHICGCEPDWTTTAFIEEAVSQVRSQVGDKRVLLALSGGVDSSTLAFLLKKAIGDQLTCMFIDQGFMRKGEPEFLMDFFDRKFNINVEYINARQRFISKLNGIVDPEEKRKIIGTEFIRVFEEESNRLGPFDYLAQGTLYPDVIESAGTNIDPKTGERVAVKIKSHHNVGGLPKDLQFKLVEPLRRLFKDEVRKVGRSLGLPEEIVRRHPFPGPGLAIRILGEVTDEKLNCLRDADLIVREEIREAGLYHEIWQAFAVLLPVRSVGVMGDQRTYAWPIVLRCVSSEDGMTADWSRLPDELLERISNRIVNEVRGVNRVVLDITSKPPGTIEWE

SEQ ID NO: 19058 - protein, 312 aa, Hyphomonas neptunium ATCC 15444
MKLISCNANRPLSDAIADYLDMRLTRSEVKTFADQEIFVRIDENVRGEDVFVIQSTSYPANDNLMQLLIMMDALRRASARRITAVIPYFGYARQDRKTDGRTPISAKLVANLISTAGADRVLTVDLHAGQIQGFFDIPTDNLFGGPVMVDDIKERYGKEKIIVVSPDVGGVVRARSLAKRLDDADLAIVDKRRPEAGKSEVMNIIGDVRGARCIMLDDMCDSGGTLANAAAALKEHGASSVSAYVTHGVLSGSAVERIEKSVLDELVMTDTIQPSEHALKSKNIRVLPISPLLGEAIRRIANEESVSKLFDR

SEQ ID NO: 19059 - protein, 533 aa, Ricinus communis
MQSSTSKENKQPPSSQPHPPPLMVAGAAEPNSSPLRKVVMVASIAAGIQFGWALQLSLLTPYVQLLGIPHTWAAFIWLCGPISGMLVQPIVGYHSDRCTSRFGRRRPFIASGAAFVAIAVFLIGYAADLGHLSGDSLDKSPKTRAIAIFVVGFWILDVANNMLQGPCRALLADLSGTSQKKTRTANALFSFFMAVGNVLGYAAGAYTHLYKLFPFTKTTACDVYCANLKSCFFISIVLLLSLTVLALSYVKEKPWSPDQAVDNAEDDTASQASSSAQPMPFFGEILGAFKNLKRPMWILLLVTCLNWIAWFPFLLFDTDWMGREVYGGDSSGSAEQLKLYDRGVRAGALGLMLNSVVLGFTSLGVEVLARGVGGVKRLWGIVNFVLAVCLAMTVLVTKQAESTRRFATVSGGAKVPLPPPSGVKAGALALFAVMGVPQAITYSIPFALASIFSNTSGAGQGLSLGVLNLSIVIPQMIVSVAAGPWDALFGGGNLPAFVVGAVAALASGIFALTMLPSPQPDMPSAKALTAAFH

SEQ ID NO: 19060 - protein, 77 aa, Vibrio parahaemolyticus RIMD 2210633
MSNIEERVKKIIVEQLGVDEAEVKNEASFVDDLGADSLDTVELVMALEEEFDTEIPDEEAEKITTVQAAIDYVNSAQ

SEQ ID NO: 19061 - protein, 410 aa, Kineococcus radiotolerans SRS30216
MTTTTSSGNRAVAYLGPGKVEVQNIDYPTFELKDGPGVNPANVGRKVEHGVVLKLVATNICGSDQHMVRGRTTAPPNLVLGHEITGEIVEKGRDVEFLEVGDLVSVPFNIACGRCRNCKERKTGICLNVNPDRPGSAYGYVDMGGWVGGQAEYVLVPYADFNCLRFPDKDQAMEKILDLTMLSDIFPTGFHGCVSAGVGVGSTVYVAGAGPVGLAAAVGAQLLGAAVVIVGDLNAERLERARSFGCETVDVSKGDPKDQIEQILGVPEVDCGVDAVGFEARGHGSGASGEAPATVLNSLMEITAAGGALGIPGLYVTGDPGGVDEAAKKGSLSLDLGTGWAKSLAFTTGQCPVMKYHRGLMMAILHDKVQIAKAVGATAISLDEAPEAYAKFDAGAPQKFVIDPHGMIPR

SEQ ID NO: 19062 - protein, 409 aa, Silicibacter sp. TM1040
MKRAMDIEFVRKQFPAFEQPSLQGQAFFENAGGSYTCRQVIDRLFRFYTEHKVQPYAPYAASEAAGAEMDEARSRLAAMLGVSAQDLSFGPSTTQNTYVLAQAFRGFLKPGEKIIVTNQDHEANSGPWRRLADEGIEVLEWQIDPATGHLEPSALEDLLDESVRLVCFPHCSNVVGEINPVTEITALAHAAGAFVCVDGVSYAPHGLPNVGELGPDIYLFSAYKTYGPHQGIMVINPALAELLPNQAHYFNGDVPYKRFTPAGPDHAQVAACAGMVDYFEALAEHHNAPEITGTGAGAFVHDLMREQEISLLQPLLDAVKGRNDVRLLGPANAKERAPTVALALGRAAEPVAKQLAELGIMAGGSDFYAVRALRAMGVDPAQGVLRLSFTHYTDQLEVTALIEALDRVL

SEQ ID NO: 19063 - protein, 247 aa, Gibberella zeae PH-1
MARKFFVGGNFKMNGSKSSIKEIVENLNNADLDKNAEVVVSPPALYLPLVRETLRKEIEVAAQNVYDKPNGAFTGEISVSQLKDSDINWAILGHSERRTIIGESDEVISSKTKYATENGLKVIWCCGESLETREAGKTIEFVSAQIESLKSQISDWSNIVIAYEPIWAIGTGKVATTEQAQEVHKAIRDLLRSISDKVADETRILYGGSVNEKNCGELSKQADIDGFLVGGASLKPAFVDIINATKQ

SEQ ID NO: 19064 - protein, 316 aa, Rickettsia prowazekii str. Madrid E
MNKFKNIAVYGGGSFGTSLASLVARNCNNVTLFLRDEIILKEILYKKTNAQYLGDIELPTNLQATTNLSVIKDFELIIIAVPSYAFDDSIKLLKTYGISKEHTILVATKGLADNPTELFSDRLNTLLPDNPIGFLSGPNLAKELAKNLPASASIASLDIDIANKIAYNFSSKTFSTNTTIDIVTLQIAGALKNIFAIKSGIDLAREQGANSRATLIVGALKEITTLSKVLGGMQKNSDILLEAGVLGDLVLTCYSLGSRNTKFGYEFEISRDKKKFLCEYKELVEGREALKLVLDLIKKYNLHMPIVAEVASLILI

SEQ ID NO: 19065 - protein, 449 aa, Magnaporthe grisea 70-15
MTSSVASGLPLSTSTNPQAKPPTDATTTAASIPNLKDRLPKLEPRRRRPAPSNPVPVPETPNLPPPTGTSPETQFRVPTRRILSKKDHDLFVAAPAYKLILAFVFGLSDAVVDKPISAIKDSDLSPAVQTINALLDEASELVKQSPPDEQGGSRFGNKRFRDFLDNVKERAPSWHKKLGIKDEGDAIAEAVTYLGQSFGNRMRIDYGSGHELNFLMWLLCLYQLGVVTKSDFAALVLRVFVKYLQVMRLVQSTYYLEPAGSHGVWGLDDYQFLPFLFGASQLLHHPFITPLAIHQQLTIEEFGHDYLYLDQVNFVNSTKTVQGLRWHSPMLDDISAAKSWSKVEGGMRRMFVAEVLNKLPVMQHFLFGSLIPAAEGMTEQDLAGLQPEDEETEGGQVEVFNDEGGVRHMHQQNGWGECCGIKVPSSVAAAAEMRKRGIGGDSLRRIPFD

SEQ ID NO: 19066 - protein, 471 aa, Medicago truncatula
MERRVGNKFRVGRKIGSGSFGEIYLGTNIVTNEDVAIKLENVRTKNPQLLYESKLYRMLQGEPGIPNIKWFGVEGDYNVLVMDLLGPSLEEMFNFCSRKLSLKTVLMLAEQMIKRVEFVHSKSLLHRDIKPDNFLMGLGKRENQVYCIDFGLAKKYRDSTTHQHIPYRENKNLTGTARYASMNTHLGIEQSRRDDLESVGYVLMYFLRGSLPWQGLQARTKREKYEKISEKKVSTSIEALCRGYPTEFASYFHYCRSLRFDDRPDYAYLKRIFRDLFIREGFQSDYIFDWTILKYQQAQLITPPARAIGLNAGTSSGIPPAMASANRHTGREEGRHSGMVSVNSSRRRMSGPILNSVNISNQRNPGPGDAAISRDVMLSSANVLGESSGSRRLHGSSSRNAYGGADSNFRARATEDINGKAINSSGQRISQSGPLDPRRVTSSRNSSHINNYETALKSMEGLKLKNVDSHQ

SEQ ID NO: 19067 - protein, 482 aa, Vibrio angustum S14
MKGDIGVIGLAVMGQNLILNMNDHGFNVVAYNRTVAKVEEFLEGPAKGTNIVGATSLEDLVAKLEAPRKVMLMVRAGDVVDAFIDQLIPLLDEGDIIIDGGNTNYPDTNRRVAHCREKGIYFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFADWNKTELDSYLVEITADILGYKDEDGEALVEKILDTAGQKGTGKWTGINALDLGIPLTLISESVFSRCLSALKDQRVEAATLFGKTITPVEGDKQEWVDALRQALLASKIISYAQGFMLMREASNENGWDLNYGNVALMWRGGCIIRSAFLGNIRDAYEANPDIAFLGSDEYFKNILQGSLAAWRKVAAKSLESGIPMPCTISALSFLDGYTTARLPANLLQAQRDYFGAHTYERTDRPRGEFFHTNWTGTGGNTASTTYDV

SEQ ID NO: 19068 - protein, 379 aa, Coprinopsis cinerea okayama7#130
MSDTAGKTIKCKAAVCWGAGEPLKIEEVEVAPPRAHEVRIRILYTGICHTDEYTRSGKDPEGLFPVILGHEGGGIVESVGEGVTSVAVGDHVIPLYTAECRECKFCKSGKTNLCGKVRATQGKGLMPDNTSRFSINGKPIHHFMGTSTFSQYTVVADVSVVAVNKKAPLDKVCLLGCGITTAWGAVVKQPGIKDSTVAVFGCGAIGLGCISTASVVGASRIIAIDTNPKKESWAKQFGATEFINPLDLPEGKKIQDHLVEITDGGLDFTFDCTGNVQVMRAALEACHKGWGVSTVIGVAAAGQEISTRPFQLVTGRVWRGSAFGGVKGRTEIPGLVEDYLNGKLKVDEYVTHHRKLEELNEGFHDMHSGECIRCVVDMQ

SEQ ID NO: 19069 - protein, 499 aa, Vibrio angustum S14
MVQPENNSIVIFGASGDLTHRKLIPAFYHLYANGLLPEDFAILGVSRTSYSDEEFRDKLKQSLTENEKIDEETLINFCQHLYYQALNTSDKDEYAVLKERLDTFKETHNTQGNAVFYLATPPSLYGVIPECLAAHGLNDETEGWKNLIVEKPFGYDLESAISLDKQIHACFQEHQIYRIDHYLGKETVQNLLVFRFANGMFEPLWNRNFIDYVEITASESLGVEDRGGYYDGAGAVRDMFQNHLLQVLAMVGMESPAAINADSIRDEVVKVMQSFKPLSDDDLKNNLVLGQYTESDARGKHFLGYRQEPGVAEDSRTETYVGMKMFIQNWRWNGVPFYVRTGKRLPTRVTEVVIHFKKTPHPVFGENAPENKLIIRIQPDEGILMSFGLKKPGAGFESQEVSMDFHYDKLEETNMLTAYERLLLDCMKQDATLFARTDAVRACWKFVQPILEYKENPEHLFGYAAGTWGPKQADDLLASSNREWRFPCKNLANTDYCEL

SEQ ID NO: 19070 - protein, 78 aa, Zea mays
MTEADVNPKAYPLADAHLTKKLLDLVQQSCNYKQLRKGANEATKTLNRGISEFIVMAADAEPLEIILHLPLLCEDKNV

SEQ ID NO: 19071 - protein, 216 aa, Zea mays
MSAYCGKYKDELIKNAAYIGTPGKGILAADESTGTIGKRLSSINVEILVDGPHDIDRCAYVTETVLAACYKALNEHHVLLEGTLLKPNMVTPGSDSKKVTPEVIAEYTVRTLQRTVPAAVPAVVFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 19072 - protein, 399 aa, Triticum aestivum
  misc_feature (314)..(314): Xaa can be any naturally occurring amino acid
TSSLLSDCYRYGDETTGKRNYTYMDAVNANLSGIKVQLCGFLQYANIVGVAIGYTIAASISMLAIKRANCFHVKGHVNPCHISSTPYMVIFGVAQIFFSQIPDFDQISWLSILAAIMSFTYSTIGLGLGIVQVVANKGVKGSLTGISIGAVTPIDKVWRSLQAFGDIAFAYSYSLILIEIQDTIRAPPPSEAKVMRRATLVSVATTTLFYMLCGCMGYAAFGDDAPGNLLTGFGFYEPFWLLDIANAAIVVHLVGAYQVYCQPLFAFVEKWAQQRWPKSGFITGEIQVPLVSSGFKLNLFRLTWRSAFVVATTXVVSMLLPFFNDVVGFLGAIGFWPLTVYFPVEMYIVQKKIPRWSSQWVCLQLLSLACLIITIAAAAGSIAGIMSDLKVYKPFSTTD

SEQ ID NO: 19073 - protein, 519 aa, Vibrio parahaemolyticus RIMD 2210633
MFEFPQFSKHSIKNDVLSGLTVALALVPEAVAFAFVAGVDPMVGLYAAFIVGLITSIFGGRPGMISGATGAMAVVMVSLVASHGVQYLFAAIMLAGILQIAAGLFKLGKFIRIVPHPVMIGFVNGLAIVIFLAQLGQFKAPDINGVLTWLPQDQMMLMLGLVALTMAIIYFLPKITTAVPSSLVAIVTVTALVVGLDLETRTVVDFLRSMSGNEAATLAGSLPTFSIPSVPFTLETLQIILPYAVILAAIGLIESLLTLTVLDEMTNTRGQSNRECIGQGMANMTCSVFGAMGGCAMIGQSMINVNSGGRGRLSGIVAAVALLMFILFASSLIEMIPLAALVGVMFMVVIGTFEWATFKLARRVPKQDFFVIVLVTVVTVLTDLAVAVAVGVIASALMFAWQHAKHIYADTCLNAEGSKEYKIHGPIFFGSAANFLELFNAPEDPKDVIVDFADSRVTDHSAIEAIETLAERYASIGKTLHLRHLSPDCRKLLDKAGSLVEINVKEDPSYKVATDILAG

SEQ ID NO: 19074 - protein, 604 aa, Prochlorococcus marinus str. MIT 9303
MSQAYQPLHHKYRPQRFDALVGQDAIAATLSHALRSSRIAPAYLFSGPRGTGKTSSARILARSLNCLNCDQPTPEPCGNCELCKSIAAGTALDVIEIDAASNTGVDNIRELIERSRFAPVQARWKVYVVDECHMLSTAAFNALLKTLEEPPPRVVFVLATTDPQRVLPTILSRCQRFDFRRIPLEALEKHLEMIATREAIPINPEALHVVAQRAQGGLRDAESLLDQLSLLPGPIKAEAVWELMGAVPEQELLKLAAALAQADPLCLLETCRNLLNRGRDPGALLQGLAAVLRDLVLMTAAPDRPELTSVSPQFRNQLPPLASQIGRHQLLQWQVQLKGSESQLRHSVQPRLWLEVLLLGLLAEPPSSEAVTAVPITKTAQPINPAAQAITANALTPTTQIQQPPSRSTTTHDPVSAITPNAEPDPPPAQRTPNNNLQELWQQILGSLELPSTRMLLSQQAQLVRLDDHRAVVQVAGNWMGMVQSRATLLEQAIAKALGNSRQLVLESQSGSATPMPSPHKTGAAPTPNTSASTAEPSPPQQVQSSSTGAYPPDPATSAAITDQQKPLEEDSPPTQPTSSLEPIDSKAKRLADFFNGKVLDVDL

SEQ ID NO: 19075 - protein, 327 aa, Leifsonia xyli subsp. xyli str. CTCB07
MSSAAPEPSAELPASIDEVYSFLGPSGTFTEAALAQVPEARGKRWRAVGNVGEALADVVARRSVAAMIAIENSIEGGVSVAQDALATVPGLRIVGEYLVPVDFILVARPGTTLGDVRTINAHPVAYAQCHRWLDANLPEHGHLPAASNVAAAAALFGGGAGGSADAAIAPPGIVDHHDVVVLAESIGDDPNAVTRFVLVSTSHSVPAPTGADKTSLIAELPDDRPGALLELLEQFSTRGINLSLIESRPIGDALGRYRFVIDADGHIRDERVAEALLGLRRFSPGVLFLGSYPRADGVGVDFDQRYRNGVFTEAREWLASLVDDAGR

SEQ ID NO: 19076 - protein, 711 aa, Haemophilus influenzae
MKQLFATTSRGFEELLKVELTELGAQEAKVVQGGVHYQADDETLYRTLLWSRLASRILFPLIETKIYSDLDLYAAVSGFNWLAQFDERVTFFVDFNGTNQEIRHTQFGAMRVKDGIVDYFERQGKTRPDVDKIQPDVRIHAYLNRENLVISLDLSGEALHLRGYREDAGQAPLRETLAAAIVMRSGWQVGSPLVDPMCGSGTLLIEAAQMEAKIAPQLYRLHWGFDFWKAHNQSAWEKVKNEAIELAEEKQREIQPHFYGFDLDHRVLKKAQKNAQNAGVSHLIKWQQADVAALKNPRLNEVGTVICNPPYGERLGTTPALIALYSVFGQRLKKEFCGWNVSVFSSESTLLDCLRMRASRQFKAKNGPLDCVQKNYQVSERKSDAITDEKELEFNRTSEVAPDFANRLQKNIKKISKWAKQQELDAYRLYDADLPEYNLAVDRYADYIVVQEYAAPKNIDENKARQRLLDAVTATLQVTGVETNKLILKVRQKQKGTNQYEKLANKGEYFYVNEYGTQLWVNLTDYLDTGLFLDHRLTRKMIGELAKGKDFLNLFAYTGSATVHAALGGAKSTTTVDMSNTYLNWAEQNLILNDIEGKQHKLIQADCLQWLEKCDRQFDLIFADPPTFSNSKRMEESWDVQRDHVKLMRNLKRVLSNNGTIVFSNNKRGFKMNLVALEELGLSAIEISHKTLPLDFERNKQIHNCWMIQHI

SEQ ID NO: 19077 - protein, 234 aa, Fusobacterium nucleatum subsp. nucleatum ATCC 25586
MFLQRTELLIGSDNIEKLKNSNVIVFGLGGVGGATVEALVRAGIGNLSIVDFDTIDKTNLNRQIITTQSVIGKPKVDVAKDRILSINPNINLTIYNEKFLKEKIDLFFKDKKYDYIVDAIDLVTAKLDLIEFATNSKIPIISCMGTGNKLNPAQFKVVDINKTSVCPLAKIIRKELKKRRINKLKVVYSDETPRKPLNLDGDREKAKNVGSISFVPPVAGMLLASEVVKDICEL

SEQ ID NO: 19078 - protein, 279 aa, Colwellia psychrerythraea 34H
MNKNLNTFTSMRNDRQLHLYLAWGCPFCHRILASLAITKLDDNISITWMENIKGEAGWKMYFIEDPLFNSDSLKAVYQQLEPTVEHRYSVPLLVDKKNNLLLSTSSPEIVRYVAKGFDDAFSVAYDLIPNKLIKDIDEMNQWLHDKINRAVYLVGFATQQSDYEYKLYELFKALDELEERLKKQLFLFGNQLTESDLYLLATLERFDNIYFCLFKCSLKRIADYPALFRYHNQLRGMESLASTYQPVLTKEHYFMSTMHVLGEARELNPSKIIPIDYYP

SEQ ID NO: 19079 - protein, 538 aa, Gibberella zeae PH-1
MASNGNFAQQDQYKEPADQQQTAPATSAADGSTTAAASANSNLSKDEVGWYFVEQYYTTLSKSPEKLHLFYGKRSQFVYGREAELSTVSVGRQLIQERIKELDFQDCKVRVSNVDSQASFENIVIQVIGETSNKGAEPRKFVQTFVLAQQPSGYFVLNDILRYIDEETEAEATTATEEAPEKAAEEIAVPATEEAAPPAEPEAPQSVEETQEEAPAQPLDPEVVDHKLEEVSTDKDSVTLNGSAAETSADEVKAPEVKPEAPAETADQAAKELAEEDVKEAEKPKDPSPTPVSKPVAAPPAAPEKPAGPPKPMTWASRAAAALPRPVVPLSKTPTPPVNQSRAPAPAAAAPTSQPAAAPASTANAPAAEAAPKEAAGWQTAGSDSKRQNRPQSVSGPPPTEKEGTLGYVKYVTDKVQDADLKNALAAFGELTYFDINRQKNCAFVEYKTPEGYQAAAAANPHTVNGESIVVEARRPKANAYGGTSYGGGRGPAPGRGRGGAEGGRSGGQGSRGNFSGQNRGRGGAARGRGAAAQPQNA

SEQ ID NO: 19080 - protein, 333 aa, Rickettsia prowazekii str. Madrid E
MNLLLQPPQNVAIAHNRIKQYINLTPIIHSESLNAMLGHEIFFKVESLQKTGAFKIRGVLNNLLKLKEQEKLPDKIVCYSSGNHGIGLAYSSKLFGIKTRIYLPLNTSKVKQQAALYYGGEVIYTNTRQEAESRAKADEEQGFYYMHPSDSDSIIAGAGTLCYEALQQLGFSPDAIFASCGGGGLISGSYLAKELISPTSLLIGSEPVAANDAYLSIKNNNIYRFNDSPITIADGLKTLSVSARTFEYLKKLDHFYLAEEYEIYYWTAWLTHLLKVICEPSSSINMASVVSWLKTQTKTQKLLVLISGGNIDPTLYNELWKNDYLTVPPSISN

SEQ ID NO: 19081 - protein, 538 aa, Pseudomonas citronellolis
MPLIQSEIDTQGEDFARNREAMLAAVASFREVEQKVLDKAAEAKPKFDKRGQLLPRERLNLLLDPGAPFLELCSLAGYKLHDDKDGTQAGGGIISGIGYVAGVRCLVSASNSAIKGGTISPTGLKKTLRLQQVALENKLPLVALTESGGANLNYAAEIFVEGARGFANQARLSAAGIPQVTVVHGSSTAGGAYQPGLSDYVVVVRGKAKMFLAGPPLLKAATGEVATDEELGGAELHAQVAGTAEYLAENDADGVRLVREILAALPWNAQLPARPARQWDEPLYPAEELLGVVPADARKPYDVREIIARIADGSRFLAFKNEFDAQTVCGHLHIEGHACGLIGNNGPITPQGAAKAAQFIQLCEQSNTPILFLHNTTGFMVGTESERLGVIKHGSKMIQAVANATVPKLTLVVGGSYGAGNYAMCGRGLDPRFIFAWPNSRTAVMGGAQAGKVLRIVTEEKHAKEGKEADAKMLDMLEQMTAQKLDAQSTALYGTASLWDDGLIDPRDSRRLLGYLLDICAEAAVRPLKGNSFGVARF

SEQ ID NO: 19082 - protein, 228 aa, Fusobacterium nucleatum subsp. nucleatum ATCC 25586
MKLVLIRHGESAWNLENRFTGWKDVDLSPKGMEEAKSAGKILKEMNLVFDVAYTSYLKRAIKTLNIVLEEMDELYIPVYKSWRLNERHYGALQGLNKAETAKKYGDEQVHIWRRSFDVAPPSIDKNSEYYPKSDRRYADLADSDIPLGESLKDTIARVLPYWHSDISKSLQEEKNVIVAAHGNSLRALIKYLLNISNEDILNLNLVTGKPMVFEIDKDLKVLSSPELF

SEQ ID NO: 19083 - protein, 452 aa, Silicibacter sp. TM1040
MTLRPPKPPVRPDRVSLWRYLKLFRADILSAQPQRLYRAWMAEFRTPFFRSFLVNQPALLDVILKERPDDFPKSNRVGEGLRPLLGNSVFLTNGETWKRQRRIIDPAFEGGRLKESFPAMRAAAEAGVARLRPHADGSELEIEAEASHIAADVIFRTLFSIPIEHEVAAEVFSRFRAYQQAQPILNLAAFVPVPRWMPRFYPKGTRQNARHIRRLIADLTKARMAEIAAGTAPDDLATKIMTTLDPETGKGFGAEEMVDQVAIFFLAGHETSASALGWALYLLALYPEWQEKLAAEVAEHGAEEFADLSKLRLTRDVFRETLRLYPPVPMMVREAVQTERFRDREVLRGSQMVLSPWHLHRHERLWERPDEFDPGRWQSENGKACARNAYMPFSAGSRVCTGAGFAMVEGVLILAQILRHYRITPVEGRSPEPVAHLTVRSRTGIWLRFSHR

SEQ ID NO: 19084 - protein, 794 aa, Oryza sativa
MGGKNLVVLFLVSVVMAMVPGSTQLQASQTWSLLKIQQMLGYPAELGHWHNYTDFCYGGDYKTTSAFVECYGDSVTQLHIIGGGGGSPTPPPLPKTFSIDSFFTTLSRLPDLRVLTLTGLGLWGPLPGKVSRLAALEIVNVSGNYLYGELPLALSRLGNLQTFIADDNMLSGELPAWLGRLPVLAVLSLRNNSLEGTLPGSGSDMASLRSLSLASNNLSGNLPDMSGAKNLQVIDLANNSLGPEFPRLGRKVASVVLAGNRFSDGLPPELASFYLLERLDVSRNRFVGPFMPALLSLPSIEYLSVAGNRFTGMLSGNMSCGNNLKFVDVSSNLLTGSLPTCLAAGAVGKAADSDSDSSKTVLFSANCLATGDDTQHPSPFCKNQAIAVGIVPDQARRKPSGARSGLVAGVVAAAIAAAVLAGVAVFLAVRKASMRRAQARPPRRLVEHASSAYPSKLFADAYISQTVKLGALGIPAYRSFSLVELEAATNDFEVSNMMGQDSHGQMYRGRLSNGTPVTIRSLKVKRSQTSQSFNHHIEMISKLRHRHLVSALGHCFEYNLDDSTITQLYLVFEYVQNGNLRGRISGTEGRKLTWVQRISTAIGVAKGIQFLHGGIIPGLFANNLKITNILLDQNLVAKIGSYNLPILSETMKSEGGSGNKYPSDVPNGDKLDIFDFGVILLEVISGRPITSIYEVEIMKEQLQSALTAEGTAKRRSFVDPAVSKGCSDESVKTVMEICLRCLAKEAVQRPSVEDVLWNLQFAAQVQDDWRGDSRSSEESPLSPSQIPRDLEDDQ

SEQ ID NO: 19085 - protein, 338 aa, Arabidopsis thaliana
VADKKIRIGINGFGRIGRLVARVVLQRDDVELVAVNDPFITTEYMTYMFKYDSVHGQWKHNELKIKDEKTLLFGEKPVTVFGIRNPEDIPWAEAGADYVVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPALNGKLTGMSFRVPTVDVSVVDLTVRLEKAATYDEIKKAIKEESEGKLKGILGYTEDDVVSTDFVGDNRSSIFDAKAGIALSDKFVKLVSWYDNEWGYSSRVVDLIVHMSKA

SEQ ID NO: 19086 - protein, 313 aa, Desulfitobacterium hafniense Y51
MSVKELKIFCGNANRALAEEIVDYLGVPLGEAKVKRFKDGEITIAIDESVRGADVFVVQPTCNPTNDNIMELLIMIDALKRASARRITPVIPYYGYARQERKSKARDPITAKLMANLITTAGADRVVTMDLHAPAIQGFFDIPVDHLPGVPILAEYFKSKELENVVVVSPDHGGVQRARNLAERIGAPLAIIDKRRPEPNVSEIMNVIGDIQGKQVIMIDDIIDTAGTITQGAQALKDRGAQDVYACCTHPVLSGPAFERLENSVIKEVVITNTIPVHPEKMISKIKVLSVAPLLGAAIVRIHEDLSVSKLFS

SEQ ID NO: 19087 - protein, 229 aa, Triticum aestivum
  misc_feature (149)..(149): Xaa can be any naturally occurring amino acid
  misc_feature (186)..(186): Xaa can be any naturally occurring amino acid
MASRIASRLLRRSSPTLGLLRSYTHVRNYSSQLSGLIPVGPQSSKLTRRNNYFPNASPYQLWSRSFASDNGDKFEAVVPFMGESVTDGTLANFLKKPGDRVEADEAIAQIETDKVTIDVSSPEAGVIEKFIASEGDTVTPGTIVAIVSXSAAPAETHVAPSEEAPQKESPPVKAEEKSPKAEEKQXKVEPPKKQAPKPTPSKTSPTEPQLPPKERERRVAMPRARKRIA

SEQ ID NO: 19088 - protein, 145 aa, Lactobacillus acidophilus NCFM
MVLDESKKKQALKKLTQEEYDVTQNAATEYPFTGKYDNFYEKGIYVDVVSGEPLFSSQDKYDAGCGWPSFTKPIEKLQYHRDQSHGMERTEVVSPEAQSHLGHVFTDGPVDRGGLRYCINSAALKFIPYDQLNEAGYGEYKKLFK

SEQ ID NO: 19089 - protein, 526 aa, Chlamydophila pneumoniae AR39
MERKRFIDCDSTKILQELALNPLDLTAPGVLSAERIKKFSWLGGGFTFSFATERLDDAILAALISLAEERGLHESMLAMQQGQVVNYIEGFPSEMRPALHTATRAWVTDSSFTGEAEDIAVRSRVEAQRLKDFLTKVRSQFTTIVQIGIGGSELGPKALYRALRAYCPTDKHVHFISNIDPDNGAEVLDTIDCAKALVVVVSKSGTTIETAVNEAFFADYFAKKGLSFKDHFIAVTCEGSPMDDTGKYLEVFHLWESIGGRFSSTSMVGGVVLGFAYGFEVFLQLLQGASAMDQIALQPNARENLPMLSALISIWNRNFLGYPTEAVIPYSSGLEFFPAHLQQCCMESNGKSIVQDGRRVGFSTSPVIWGEPGTNGQHSFFQCLHQGTDIIPVEFIGFEKSQKGEDISFQGTTSSQKLFANMIAQAIALACGSENTNPNKNFDGNRPSSVLVSSQLNPYSLGELLSYYENKIVFQGFCWGINSFDQEGVSLGKALANRVLELLEGADASNFPEAASLLTLFNIKFR

SEQ ID NO: 19090 - protein, 2367 aa, Cytophaga hutchinsonii ATCC 33406
MFKFRKLYYTWIIAVISLLATVQVKAQDLLISGGYAYSTAICANGNVYSWGQNNAGTPSIKGTLGIGSATDPILSPTRVLFPTNDPYFSGVLGLPNITIRAVDAGSTLTLMALDCHTGVWTVGMNNDANGVLGQGPGKGGASTVPARVLKGEYTGTAYHPSLSTYLTNVKSISGGDNMNYVIMNGSGEVMSWGLNANGQLGNGTTTSSTTPVYVRTNATTTLKNAIQIEAGDKTGYALIDPDGDGIGTVYSWGANTNGELGRSNAGGTNNGTENGPNSNYASPVVFKTGLPLDNIVSISAGDVMCFAIDVDGFVWAWGNNGWFGLCGTGPGGVHSDPKRVLAGEWATTPGGAGQTFLKARAIGGGQGFGMAVSIDGIPLAWGGNGGNNGYLGNGSTTPSDVAVIIRTSAAAYDTDVIGISDGDGWGFYTRRDGSLRTWGFNAQGQLGIGNTTSQVYAVTFALPGGCAIPDPKPFAKITPRDQNICPGSWTGTLLNSQFNVSGALAPNYTIRWYKDGSATPITGATTSTYNATAIGTYKVVVKYIGASVPCATYPDAIDEITIAEAVAPYTANAGTYCGTTGTFSVTGYTGNLTNFQWFKDAVGGTAIPITPATTPPNTSNTITTALTNATMVNATTYRLWAEDIYGLDNYAAKTPPCATTSRMAINGGSFAVAFTLAQTNGVIINSIDVTAWDYNNKTVSYQVRILSDNGSNSPDFASNIWTSPTKTMDFTASAVQQSIPLNFNASILTPGTKYWMQIISTDQFTVADYTDCSANPLPLVDDSGKGVLTIGNSYKNSSVNTKFPNIYNFNIKRGIAYPCKRIPVDITKDCPPCTKPSSVTITTPSTGTVTLCQGTAQNLIGSATVTAAAQNTNFTYSWIKVLPTPVTTPVAATVIALPANTPTSTPAFALTGALTDAGTYTLRVEDGNTGNASCYTEASVVVVVNATTVAGSIAAAQTICTGGDPVAFTSVAATGGNGTTYSYVWEKSINGAAYADITPAVTTATFDEGVLTNAGTTAMTVDYRRKVTSGACPQVTTAAIRITVNPAIVAGIVAADQTICSGGDPAAFTVTAAPTGGTGTYTYQWQSASALAGTYTNISSATGATYDVPSGLTATTYYRRVDASGTCTTVNTNVITVTVQPALVAGSIASAQTICTGGDPVAFTSVAATGGNGTTYSYVWEKSINGAAYADITPAVSTATFDEGVLTNTGTTAMTVDYRRKVTSGMCSQVTTAAVRITVTPAIVAGAIATDQAICSGGDPAAFTVPTAASGGTGTFTYQWESSVSPFTTWTAISTSGTGSTYDAPSGLTATTHYRRVVSSGTCTAANTNEVIVTVTPTVAPGVTISTPSTTICAGTSVTFTATPTNAGTPPTYQWYKGAVGSGTAIGSATGSTYTTSSVANNDSYYVVVTSTATCPSPATASSTAIVMTVTTVVTPAVSITAAPAGTICAGTSVTFTASPGNGGTAPTYEWFIKKTTDAAPVSQGAASSAAGSDEFTRSNLGNGDEVSVRMVSNSGCVVAPGIANSNVITMTVTPIPAPSVSLSANKSTLCPSETIIYTAVPTAGGAAPTYVWKNNGTVITGQSGSTLTTTGTAIGTPNSITVEMVSNAPCAPATPAVSTPVAVTVTPVPTLSVSIAADKTTICSGNAVQFTASATGSGSTPAPTYEWFIGAAGSETSQGAGSTTANPYSTTSLTTTAALSPQTYSIYVRATSNATCASTTPAQSAAVTVTVNAGVGAGTITTTLLTICNNTVPGAITEASAASGGTSPTYTWEESIDNGAWGPATGTVSGTGFTPSGAKTGTKVSYRRIVTYTSIPAPCNTAMSNIIDITVNPALVAGVIQDDQIICSGLVPAALTQVSAPTGGTGSYTYQWQSSTTGTAGSFSNIGGATTSGYAPGALTATTYYQRVETSGTCGSVTGNMVTITVSTPEVVTAQINDPGQVCEGSVPMVFTATTTGSGTLTYAWTLDGAPVGTNSSTYSYNPTTASDAGKKVKVVVTTSIGCNAGPGISNEVALNIVVSSMPSVSITGAPAVQCSGLPVRFTVSNTTAGGNNPTYQWFIESQAGVATAVSGATNTSFTSTGLTAGDKVYVELTSNLGCALGTNPHASNKIAPAILATPAPVINETPLPICSPEGFEFTATVGSATPPNTLQWYKDGVAISGATTSIYKAFESGLYSIEESNAACGTISTEVPLTVIQTPVANAGSDITVKEGEQVTLNGSGGVIYSWSPDTGLDDASSANPKLTADKTIMYILTVRDATGQCHDDDEVMVFVERPIKVPNVITVNGDGVNDTWEIENIESFPNAEFLIYNRWGNLVWKSTGYPKEWDATNFRNGEVLPDGTYFYIIDLHSTIYTEAYTGYIQVVK

SEQ ID NO: 19091 - protein, 363 aa, Bordetella petrii
MKTYRIATIPGDGIGKEVIPAGRQAMQVLAETDGSFTFEFQDFDWGGDYYRRHGVMMPADGLEPLRDKDAILFGSAGDPDIADHITLWGLRLKICQGLDQYANVRPTRLLPGIDGPLKRCTAEQLDWVIVRENSEGEYSGVGGRVHQGLPIEAATDVSMMTRAGVERILRYAFRLAQSRPRKQLTVVTKSNAQRHAMVMWDEIALEISREFPDVRWDKELVDAATARMVNRPASLDTIVATNLHADILSDLAAALAGSLGIAPTGNIDPERRGPSMFEPIHGSAFDIMGKGLANPIGTFWSVVMLLEHLGEHQAAARMMRAVESVTADQALHTRDLGGTATTEQVTQAVCQHLRQTAGQARAA

SEQ ID NO: 19092 - protein, 537 aa, Corynebacterium glutamicum ATCC 13032
MRDLLPSRDDYQLLRFSWKMDIAAGVTVGIVALPLALAFGVSSGVGAEAGLVTAIIAGLVAAIFGGSNVQVSGPTGAMVVVLAPIVAQYGVGAVALLSLMAGVIVLVAGVLRLGRTVSFIPWPVIEGFTAGIGVIIFLQQVPAAFGYSGHLPTNALLAAIHTVSHATKDAILPLLIIIVTAAIMIVLGKIAPKLPASFIAILVVSIGVALLKLPVELIGELPNSLPAPHLPDVNLEMFTSLLGPAFAVAALAAIESLLSARVAASMADTGPYNADRELVGQGLASISAGFFGGMPATGAIARTAVNVRSGGRTRIASIIHALVLLGVVYVAANIVAVIPLAALSGVLMVTASRMVSIEVISRVMRSTRSDAIVFVITAIVTISVDLVIAVGIGIAVATFFMLRRMSMNAGVFRETLPEPATLNDEKIGLFRIEGALFFGAAERLSQQILDYEDLEVVILRLSHIQMIDATGAHQLTELVNALERKNVTVLIKGVRKEHIHVLGVLGAIRSLRHENHLFDDLAPAVEHARKHVKIDNS

SEQ ID NO: 19093 - protein, 213 aa, Vibrio parahaemolyticus RIMD 2210633
MSDNNQCVIVGIAGASASGKSLIASTIYNELRAKVGDHQIGVITEDCYYNDQSHLSMEERVKTNYDHPSALDHDLLCEHLEKLVRGEAVEVPEYSYTEHTRTSNTTTMTPKKVIILEGILLLTDPRLRDLMHATVFMDTPLDICLLRRVKRDVEERGRTMESVLKQYQQTVRPMFMQFIEPSKQYADIIVPRGGKNRIAIDVLKAHIAKLLKA

SEQ ID NO: 19094 - protein, 224 aa, Prochlorococcus marinus str. MIT 9303
MIDSCCYHPIHNRWPGIRPVSSPGILPTVVEQSGRGERAFDIYSRLLRERIIFLGTGVDDQVADALVAQMLFLEAEDPEKDIQIYINSPGGSVTAGLAIYDTMQQVAPDVVTICYGLAASMGAFLLCGGTKGKRLALPNARIMIHQPLGGAQGQAVDIEIQAKEILFLKETLNGLLAEHTGQPLNKIAEDTDRDHFLSPAKAVEYGLIDRVVDSLTGGGIVTEG

SEQ ID NO: 19095 - protein, 595 aa, Medicago truncatula
MAFWWSILVLAFAFAICKFLLLLIPPKVPSIDVDASDVLEVGNQSQENNFIYVPPRGTAQQSGKKVQCYEPATMKYLGFLPALAPDEVKERIEKVRKAQKMWAKTSFKQRRQFLRILLKYIIKHQALICEISSRDTGKTMVDASLGEIMTTCEKINWLLSEGEKCLKPEYRSSGRSMLHKRARVEFHPLGVIGAIVSWNYPFHNIFNPMLAAVFSGNGIVIKISEHASWSGCFYFRIIQSALAAIGAPEDLVEVITGFGETGEALVSSVDKVIFVGSPGVGKMIMKNASETLIPVTLELGGKDAFIVCEDVDVDHVAQIAVRAVLQSGGQNCAGAERFYVHRNIYPSFVSKVTKIIKSVTAGPPLAGKYDMGALCMHEHSEKLLGLVNDALDKGAEIVARGSFGHIGEDAVDQYFPPTVIVNVNHSMKLMQEEAFGPIMPIMKFSSDEEVIKLANDSKYGLSCAVFSGSQSHAREIASHIHCGVAAVNDFASNYMCQSLPFGGVKHSGFGRFGGVEGLRACCLVKSVVEDRWWPFIKTKIPKPIQYPVAENGFEFQESLVEALYGLSIWDRLQALVNVLKMLTEQNSTGGNKKEK

SEQ ID NO: 19096 - protein, 181 aa, Colwellia psychrerythraea 34H
MNKTQQQLLINAIHTIPDYPVEGIMFRDVTSLLEDAEAFKLVMELLENKYKGRGFTKIVGTEARGFLFGAPLALALNIGFIPVRKPGKLPRPTYSQAYQLEYGEDILEIHQDALTPEDNVLIIDDLLATGGTIEATTKLIRRLGAQVQEAGFVISLPDLGGEERLAELNITPYSLIQYQGE

SEQ ID NO: 19097 - protein, 327 aa, Colwellia psychrerythraea 34H
MRGIISPKLVPLLEQANIAIAAAKATGQGFSAELVRQGLDNLSALMGAGPNIAIVKDSFLATSSHNIPVRIYNPAPNDMLPVLLHFHGGGHMCGSADLYDPISRKLALATQAIVICVDYRLAPEYPYPAGLDDCQQVLERYQSLLTEMKYSDELYIAGDSAGGAICTSLVMNNLINEKTSNSIKIDKQILVYPSVDYTMASASIDENGQGFLLEKDKMHWYFQQYFQVSSLEQDEITQAKIVKASPLLGKFSANMPTTLVITAGCDPLRDEGVAYAKSLDEVGVNVEHHSFDGMTHAYMLLNDLVSDECQQTYQLIGQFVKAGINDQ

SEQ ID NO: 19098 - protein, 453 aa, Rickettsia prowazekii str. Madrid E
MVIGSGPAGYTGSIRAAQLGLKVACIEKNDTLGGTCLNIGCIPSKALLNTSKKYEEAIRHFDSIGIIADIKLDLQKMLSNKDKIVLDLTKGIESLFIKNKITKIKGEAKIISNNIVEVNKEQIKAKNILITTGSSVIEIPNITIDEEFIVSSTGALKLSKVPKHLIVVGGGYIGLELGSVWRRLGAKVTVVEYASSIVPMLDKEIAKQFMTIQQKQGIEFKLNTKVIASEVKSGKVNLTIEEWDKRSIITSDVVLIAVGRKAYTKNLGFESVGITTDNKGRIEINERFQTAVSNIYAVGDVVKGAMLAHKAEEEAIAAVEIMVGQAGHVNYNLIPSVIYTYPEVASVGATEEQLQEQGINYKVGKFPFLANSRARAIGSTEGMVKILADSKTDRVLGAHIIGSDAGTLIAELIAYMEFGASSEDIARTCHAHPTLSEAIKEAALNVDKRTINI

SEQ ID NO: 19099 - protein, 425 aa, Agrobacterium tumefaciens str. C58
MAEFVITMPDVGEGVAEAELVEWNVKPGDIVHEDMVLAAVMTDKATVEIPSPVAGIITWLAVTVGNTVPVKAPLVRIETDVAAAAPNGSAPEAEAPSRMTEEEAPADMTEAPPPVETQPAARQTEEAPSAPVAEPHHKPLASPAVRQRADDLDIDLIKVKGTGPDGHITHADLDGFLTVRARPERPEPMTPHDSAVEEVKVTGLRRKIAEKMVLSVSRIPHITYVEEIDVTELEDLRATMNGNRRSGQPKLTILPFLMRALVKAVADHPGMNAIFDDEKGVVSHYEAVHIGIATQTPAGLTVPVVRHAETLGLWDCAEEVARVAEAARTGTAHREELMGSTITISSLGALGGVVSTPIINHPEVAIIGVNKIMTRPVWDGNRFVPRKMMNLSSSFDHRVVDGWDAAVFIQAVKALLEKPALIFIE

SEQ ID NO: 19100 - protein, 458 aa, Aspergillus nidulans FGSC A4
MRILLPVLATASLAHAVSITGCHKHGDDVYCLTDDGGEVQVLLDNPPAGDPPSEYTDCHEHGSTWYCVDAGGNDVEILGEITDSSTSTNSTNEETTTTESTEESTEGENCHFHAGVEHCLAPGESESGGSTSESSCGIQTRDYDMPLRIGTLFVVLVTSSIGVFLPMGLVKLPSATINVWASTIIKQFGTGVILSTAFVHLYTHADLMFGNECLGELDYEATTSAVVMAGIFLSFLTEYMGHRFILARAARSAERSQPAENGSNISSKSAAEQEPQPHHHATLAGLGHHHGGDPTNPNTKLSVLVMEAGVIFHSILIGVTLVVAGDSFYKTLLVVIVFHQFFEGLALGARIALLPGRTFPSKAIMGGVFALITPIGMAIGMGVIHSFNGQDRQTLVALGTLDALSAGILVWVGVVDMWARDWVIEGGDMFSAPLGHVAAGGISLVAGMILMGVLGKWA

SEQ ID NO: 19101 - protein, 320 aa, Deinococcus radiodurans
MNSRRSPLLVFSGQSNRPLAQAICDNLGVPLGRSRTEKFTNDNLIVHYEESLREGDVFIVQTFSTPVSDAIMELMLMIDAAKSASAGRVTAVIPYYSYARSDKKDSPRISIAGRLVADLLQEAGADRVLTMTLHSPQVHGFFKVPVDHLSADVVLSQHFKKCVPDAHNGVVLAPDAGSIKRASQIARRLDSGLAMIDKERLSDTEVRPRALIGDVDGKTVFIVDDEISTAGSLVETVSIARSMGAKDVYVAVTHGVYSGPAIERIAALDVTQVASCNTVLVPQDKLDRAGGKLAVLDVAPLFASAIANIHTGASVSTLFT

SEQ ID NO: 19102 - protein, 533 aa, Agrobacterium tumefaciens str. C58
MKLTSSLNRDPAFTANAAFMSGLVEDLRGHVEKISKGGGDKARERHLSRGKLLARDRIEALLDPGSPFLEFSQFAAYEVYDEPVPAAGIVTGIGRVAGRECVIVANDATVKGGTYYPLTVKKHLRAQEIATENRLPCIYLVDSGGANLPNQDEVFPDRDHFGRIFYNQANMSAAGIAQIAVVMGSCTAGGAYVPAMSDQSVIVKNQGTIFLGGPPLVKAATGELVSAEDLGGADVHSRQSGVTDHYANDDRHALSLTRRIVSTLNRRKQVELDIREPVEPLYPADELYGIVPSDTRKPFEVREIIARLVDGSQFDEFKALYGTTLVCGFAHIHGYPVGIIANNGILFSESALKGAHFIELCCQRGIPLVFLQNITGFMVGKAYEAGGIAKDGAKLVTAVASAKVPKFTVIIGGSFGAGNYGMCGRAYSPRFLWMWPNARISVMGGEQAASVLAQIRRDGIEADGRHWSKEGEEAFKQPIREKYEREGHPYYASARLWDDGIIDPKDTRLVLGLGLSAALNAPIEPTRFGIFRM

SEQ ID NO: 19103 - protein, 428 aa, Pseudomonas syringae pv. tomato str. DC3000 [sequence omitted]

SEQ ID NO: 19104 - protein, 181 aa, Coprinopsis cinerea okayama7#130
MGLSFSKLFASLLGKREMRILMVGLDAAGKTTILYKLKLGEIVTTIPTIGFNVETVEYKNISFTVWDVGGQDKIRPLWRHYFQNTQGIIFVVDSNDRERVSEAREELQRMLNEDELRDALLLVFANKQDLPNAMNAAEITDKLGLHGLRQRTWYIQSTCATSGDGLYEGLEWLSTNLKRRT

SEQ ID NO: 19105 - protein, 361 aa, Lactobacillus acidophilus NCFM
MRYLILEDGSIYAGEGFGSDRETSGEVVFTTGMTGYQEAITDQSYADQILVFTNPLIGNYGITLADYESLEPRIKGVICHQVARRPDSWRMQTTLPKFLKQLNIPGIQGIDTRELVRKLRVHGTLRGKIANSKNDAEKIAKILQTKKITQGVISRVSTKSPYPVPGSKRNIVVIDFGIKHSILRELAERDCNCIVLPYTATTEEVLELHPDGVLLSNGPGDPEEMKDAVKMVQEVEKYVPLFGICMGHQVFALANGAKTYKMKFGHRGFNHPVREIATGNIGFTSQNHGYAVDGDSIDKDNLMITHVEVNDGTVEGLRHKKYPAFSVQFHPDATPGPHDEDSLFDDFMSMIDQRKEEERHA

SEQ ID NO: 19106 - protein, 370 aa, Pseudomonas syringae pv. tomato str. DC3000
MIKSRAAVAFEAKKPLEIVEVDVAMPKAGEVLLKVVASGVCHTDAYTLSGADPEGIFPSILGHEGGAIVEAIGEGVTSVAVGDHVIPLYTPECRQCKFCRSGKTNLCQAIRSTQGKGLMPDGTTRFSYKGEPIFHYMGTSTFSEYTVLPEISVAKIDKKAPLEKVCLLGCGVTTGIGAVLNTAKVKPGDTVAVFGLGGIGLSAVIGAVKAKAARIIAIDINPAKFEIAKQLGATDCVNPKDFDRPIQEVIVDMTDGGVDFSFECIGNVQLMRSALESCHKGWGESVIIGVAGAGQEISTRPFQLVTGRVWRGSAFGGVRGRTELPSYVDMAQTGEIPLDTFITHTMGLEDINKAFDLMHEGKSIRTVIHF

SEQ ID NO: 19107 - protein, 237 aa, Absidia glauca
YHQKDHVRPAFDRSLKEMDLEYIDLYLIHFPVPIEYVDPAVKYPGGWIQDGQTSIAYERSPIHVCWAEMEKLVDDKVARNIGVSNFNVMALLDLFTYCRYKPATLQVELHPYLQQKRLVEWVQKQGVAVTAYSSFGPASYVTLNEEGKTAKPLLSHELVQDIATKYEKSTAQVLLRWSIQRNVAVIPKSMNEGRMKSNLDIFSWSLEQKDVDALNKLEMGARFNDTVSYGFDLPLFD

SEQ ID NO: 19108 - protein, 413 aa, Vitis vinifera
MGSLGAILTHPDDIYPLLKLKMAVRHAEKQIPPEPHWAFCYTLLHKVSRSFGLVIQQLGTELRNAICIFYLVLRALDTVEDDTSIRTDVKVPILIAFHRHIYDRDWHFACGTKDYKVLMDQFHHVSTAFLELERGYQEAIEDITKRMGAGMAKFICKEVETIDDYDEYCHYVAGLVGLGLSKLFHASKLEDLASDELSNSMGLFLQKTNIIRDYLEDINEIPKSRMFWPREIWSKYVNKLEDLKEEENSIKAVQCLNDMVTNALIHMEDCLTYMSALQSPAIFRFCAIPQIMAIGTLALCYNNIEVFRGVVKMRRGLTAKVIDRTKAMSDVYGAFFDFSCMLKSKVDKNDPNATKALSRLEAVQKICRESGALTKRKSYVIRSEPRYNSALIVAFFIILSIIFAYLSANRQNN

SEQ ID NO: 19109 - protein, 157 aa, Pseudomonas syringae pv. tomato str. DC3000
MRIGHGYDVHRFAEGDFITLGGVRIAHGFGLLAHSDGDVLLHALSDALLGAAALGDIGKHFPDTDPQFKGADSRVLLRHVLKQIHGKGWKVGNVDATIVAQAPKMAPHIDAMRALIAEDLLVELDQVNVKATTTEKLGFTGREEGIAVHAVALLLRA

SEQ ID NO: 19110 - protein, 377 aa, Zea mays
MSAPSDAAAASAAPAPAPTTAAASSSGGFTFKLHPLVIVNVSDHHTRVKAQAACSADSSSPSSGPGAGQPPRVFGCVIGVQRGRTVEIFNSFELVLDPVSGTLDRAFLEKKQELYKLLRESAGSLLRFHLSRRLKSYGMLGFRGRFGDAVLCYDCGYADKKVFPDFYVLGWYSTGSDVHDTDMQIHKALMDVNESPVYLLLNPTINLSQKDLPVTIYESELHVIDGCPQLIFVRSNYTIETVEAERISVDHVAHLKPSDGGSAATQLAAHLTGIHSAIKMLNSRVRVIHQYLVAMQKGDIPMDNSLLRQVSSLVRRLPATESQKFQDDFLMEYNDTLLMTYLAMFTNCSSTMNELVEKINTSYERPTTRRGGRGAFM

SEQ ID NO: 19111 - protein, 604 aa, Onion yellows phytoplasma OY-M
METKTKIPKQIFSQTKPPKKPKPQINQIKRKRTYKMQKQSNFIKTIIQKDLQSGKCSQIITRFPPEPNGFLHLGHARAIIINFELAHFFEGKTLLRYDDTNPSKEKQIYVNAILNDIKWLGYTPYKITFASDYFPQMYQMALFLIKQGKAYVDDQTAEQIAQSRGNLTQKGTNSPYRNRSIEENILLFEQMKKGKFVEGSKVLRAKIDMQSPNLNLRDPILYRILSAFTLKQKHWHIFPTYDYAHPLEDSFENITHSLCSLEFEDHRPLYDWIIKETKAKHTPRQIEFGRLNLTQTLMSKRHLNNLVEKNLVTGWDDPRMPTLSGIRKKGYTPEAIKNFVLETGLSKVNSQVKQEMLESFVRDDLKGKSLPRMAVINPLKLTITNFPENQIENLKAPWTNNFHTCKCCNTSQTQGKTPEQNQEQTKGKEQTQEREIYFSRHLYIEKDDFALQKPDKNYKRLTLGEEVRLFHAYFVKAYDVVKNNKGEITEILATYDPQTKSGSGFKDRKPNGTIHFVEAKTACKATFNFFAPLLCTNGNFNYKSWHIKKGFVESSLQKSCCCKNHLQFLRQGYFAADKITKDTNGKTQELNFNEVVSLKSNPQK

SEQ ID NO: 19112 - protein, 300 aa, Vibrio vulnificus CMCP6
MSNGKVLAKIEARNPSFSVKCRIGANMIWEAEKEGKLKPGVELVEPTSGNTGIALAFVAAARGYKLTLTMLESMSLERRKLLKALGANLELTEAAKGMKGAIAKAEEIVASNPEKYLLLQQFNNPANPEIHEKTTGPEIWEATDGAIDVFVAGVGTGGTITGTSRYIKGEKGKQILSVAVEPTESPVISQALAGEEIKPAPHKIQGIGAGFIPGNLDLSLIDRVEKVTSEEAIEMARRLMEEEGILAGISSGAAVVAANRLAELPEFEGKTIVTVLPSSGERYLSTALFAGIFTEKENQQ

SEQ ID NO: 19113 - protein, 601 aa, Hyphomonas neptunium ATCC 15444
MAAESHASHAVDLAPVVILLGSAVLAVPLFKKIGFGSVLGYLAAGLVIGPFGFRVFTEPTAILHVAELGVVMFLFIIGLEMQPSRLWSMRKDIFGLGLAQVGICILLLSWVGVALGYSPQTSLVAGTGFVLTSTAIVMQMLQERGDLAKPRGQKMVSILLFEDLAIVPLLALVAFLAPGGGEVTLMERLQGVAIGLGCILGLVLAGRYLLNPVFRILAAARAREVMTAASLLLVLGAAWWMQLGGLSTAMGAFLAGVLLSESSYRHELEADIEPFRGILLGLFFLAVGMSLDLNVVLGNWEIIALSVIAFTLLKAAGVYGVARAFRANHREAVERTVLMTQGGEFAFVLYAAALAVGIIDPEGSAMLTAIIIVSMLMTPLFVLIHDRLMPEVEVDASGVETPADVRGTALLIGFGRFGQVVSQPLLARGYTITTIDNDPEMIRVAGQFGFKVWYGDGARLDILHAAGAHHASLVLVCVDDQAAATKIVELVRHEFPNALLLARAYDRDHGLELVKAGVDYPVRETFESALKFAHAALDRLGEPEDAITDALDEVRRRDEERFALQLTGGSFAGRELMFGNGGGAVPLNARKAEPDAEPGGG

SEQ ID NO: 19114 - protein, 99 aa, Chlamydomonas incerta
MSQQTTPAPGVTKVTFKVTLTSDPKLPFRVFSVPEEAPFTAVLKFAAEEFKVPAQTSAIITNDGVGINPQQTAGNVFLKHGSELRLIPRDRVGGSSLAR

SEQ ID NO: 19115 - protein, 574 aa, Vibrio vulnificus CMCP6
MISGILASPGIAIGKALLLQEDEIVLNTNTITKAQVEAEVQRFYDARSKSSAQLETIKQKALETFGEEKEAIFEGHIMLLEDEELEEEILALIKKEKMTADNAIYTVIEEQATALESLDDEYLKERATDIRDIGSRFVKNALGINIVSLSDINEQVILVAYDLTPSETAQINLDYVLGFACDIGGRTSHTSIMARSLELPAIVGTNDITKKVKNGDMLILDAMNNKIIVNPSEAQIEEAKAVKASFLAEKEELAKLKDLHAETLDGHRVEVCGNIGTVKDCDGIIRNGGEGVGLYRTEFLFMDRDALPTEEEQYQAYKEVAEAMEGQAVIIRTMDIGGDKDLPYMDLPKEMNPFLGWRAVRISLDRREILRDQLRGILRASAHGKLRIMFPMIISVEEIRALKEAIEEYKAELRAEGLAFDENIEIGVMVETPAAAAIAHHLAKEVSFFSIGTNDLTQYTLAVDRGNEMISHLYNPLSPAVLTVIKQVIDASHAEGKWTGMCGELAGDERATLLLLGMGLDEFSMSGISIPKVKKVIRNANFAAVKAMAEEALSLPTAAEIEACVEKFIAEHSK

SEQ ID NO: 19116 - protein, 476 aa, Burkholderia pseudomallei K96243
MSSERQFQAIAQREGGLRRTLSARQMTMIAIGGAIGTGLFLGSGFAIGFAGPSVLISYAIGALISLLLMGCLAEMTVAHPTSGSFGAHAEHYLGPWAGFLVRYAYWACIVLAVGTEVTAVALYMKYWLPAVPGWVWIAGFSAVLVFVNALSVDVFGSVEYGFSVVKIAAIVAFIAIGGYVVFVDPSLVADPNAGAPGLRHYFGHGGFFPKGLWGTWVAVIVSIFSYLSIEMIAVAAGEAQDPERAVTRAFRSTVIRLVLFYLVTLALMLAIVPWTAAGRDESPFVKVMIAIHLPGAAGVINFVVLIAALSAMNSQLYITTRMMFSLACAGHAPRGLGRLTRRGVPLNALLLSTAGIAIATLVSVAYPDASFTIMMAISMFGAMFTWTMIFVTHYFFRRKRAAQGLPPPRFRMPGFPLATLAGAALMLAIMATTYFTPEFHMTLVFGAPFLAALSVLYFARYRRRPHALARAESQPR

SEQ ID NO: 19117 - protein, 479 aa, Bacillus cereus G9241
MTTSNTYKFYLNGEWRESSSGETIEIPSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGINMVSFTGGTNTGKHLAKKASMIPLVLELGGKDPGIVREDADLQDAANHIVSGAFSYSGQRCTAIKRVLVHENVADELVGLLKAQVAELSVGSPEQDSTIVPLIDDKSADFVQGLVDDAVEKGATIVIGNKRERNLIYPTLIDHVTEEMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNLV

SEQ ID NO: 19118 - protein, 551 aa, Bordetella bronchiseptica RB50
MSNIVEIKVPDIGDFKEVEVIEVLVSAGDTIKAEQSLITVESDKASMEIPASAAGVVKSVKVKVGDKIAEGTVILEVEAAGEAAAAPKAEQAPEAAEAPKADAAKAEAPQAEAPAAAGPIEVKVPDIGDFKEVEVIEVLVAEGDTIKAEQSLITVESDKASMEIPASAGGVVQSLKVKVGDKVAMGTVIAVVQGQGAAAPAAKAEAPAAAPAAAEPAAPASPAAPAPAPAQRPAPAAALQDEDLKPGQLPHASPSVRKFARELGVNLSRVTGSAAKGRITADDVRAYVKQALSAGAPAGASGGGDGAALGLLPWPKIDFTKFGPIEAKPLSRIKKISGANLHRNWVMIPHVTNNDEADITDLEALRVALNKENEKSGVKVTMLAFLIKAVVAALKKFPEFNASLDGDNLVLKQYYHIGFAADTPNGLVVPVVRDADKKGILELARETSELARKAREGKVSPAEMQGGCFSISSLGGIGGTHFTPIINAPEVAILGVSRSAHKPVWDGKQFVPRLTLPLSLSYDHRVIDGASAARFNAYLGQLLADFRRIAL

SEQ ID NO: 19119 - protein, 591 aa, Bordetella bronchiseptica RB50
MSNIVEIKVPDIGDFKEVEVIEVLVAAGDTIKAEQSLITVESDKASMEIPASSAGVVKSVKVKVGDKVAEGTVILDVEAAGEAAAAPKAEAPKTEAPKAEAPKAPAAKASAPAAAAYSGSADLECDMLVLGAGPGGYSAAFRAADLGMDTVMVERYATLGGVCLNVGCIPSKALLHNAAVIDEARALAAHGISFGEPKVDLDKLRGYKDSVVAKLTGGLAGMARARKVRVVTGTGEFADPHHLTVTDGEGKKQTIRFKQAIIAAGSQSVKLPFLPDDERIVDSTGALQLRAIPKKMLIIGGGIIGLEMGTVYSTLGARLDVVEMLDGLMQGADRDLVKVWQKMNAPRFDNIMLKTKTVGAEARKDGIYVSFEGEGAPKEPQRYDLVLQAVGRSPNGKKIGAERAGVAVTERGFIEVDRQMRTNVPHIYAIGDVVGQPMLAHKAVHEGHVAAEAAHGEKSFFDARVIPSVAYTDPEVAWVGLTEDEAKKQGVKVEKGLFPWAASGRAIANGRDEGFTKLLFDAETHRIVGGGIVGTHAGDLISEIALAIEMGADMVDIGKTIHPHPTLGESVGMAAEVAEGVCTDLPPMRKK

SEQ ID NO: 19120 - protein, 439 aa, Burkholderia pseudomallei K96243
MHETLWYLIVGGVLMLMGIVTSTLKHLPCSAAMIYLLLGYLLGPPGIGLLRIDIERDAPLLRMVTEIALLVSLFAIGLRLRVPLRDRLWAVPWRLGVVAMALTVPLLAAFGALALGLAWGPALLLAAMLAPTDPVLAHDVQVRDPNDVDLTRFALSGEGGLNDGIALPFALAGLALCGNRDVLGGASPASLAALGASAWGVAGGLAIGGLLGWCTMHTVAWLRTRHAQALGLEGFLALGLIELSYGAARLAHTFGFLAVFAAGVAMRRAEHRASGGRRPREVIGTIDSEDVVATEKHPDKARAYMAESVLGFTIELERIAEAIVMTMVGNVLADFHPAAFGWRAFAAVVALFCFARPLAVALSLAGSGATRTQRRLMGWFGIRGIGSFYYLVFALERGPIDAVRPIAPLVLAAVAASVIVHGMSATPLMNWYHRLRASR

SEQ ID NO: 19121 - protein, 595 aa, Prochlorococcus marinus str. MIT 9303
MALLVQKFGGSSVGNVERIQAVAERIATSKDLGHDLVIVVSAMGQTTDELTALAKVISSNPPQREMDMLLATGEQVSISLLAMALHELGIPAISMTGAQVGIVTESAYGRARILDVRTERLQSLLSTGKVVVVAGFQGTSLSSVGTAEITTLGRGGSDTSAVAIAAALGADACEIYTDVPGVLTSDPRQVSDAQLMQEVSCDEMLELASLGASVLHPRAVEIARNFGVALVVRSSWSNEAGTKLTSKSKRPLGREGLELGRPVDGVELAEGQAVIALSHVPDQPGVAATLFENLSSDGVNVDLIIQSTHDGNSNDIAFTVAEADLAKAHSLCEGLLKTVGGQLSAEAGMSKLSISGAGIMGRPGIAASLFDTISRAGINLRLIATSEVKVSCVIDATLGSKALRAVSTAFELSDSQVRINPLVNGKGEPEVRGVALDQGQAQLSVRGVPNRPGTAAALCSAMAEAGISLDAIVQSERQHDDGSRDISFTLKRDEREQANKTLAPLLAQWPGANLEDGPAIARVSAVGAGMPATAGTAGRMFRALADAKINIAMIATSEIRTSCVVAEPDGVKALQSVHKGFGLGEETGHPVQSNS

SEQ ID NO: 19122 - protein, 552 aa, Zea mays
MALAPSHAHASLAVAPFTVLCTFLALVALLFLHRYRRSNARPSKKTRQLPPGPAGLPIIGSLHCLVSKKPVFRWVHGLLKDMNTKILCLRFGAVHVVVVACPEIAREVLRTNDAALASRPETDACELFSLGYKGAILSPYGEQWRKMRRVLTSEILSASMEQRQQRRRAQEADYLVASLYSQCCSSASASAAASSAASSAVVDIRHVARHFSCNMIRSLVFGKRHFGAGAGPGPEEVAHVDTLFALLNYIYIFSVSDYVPAAWRWMVAGLDLGGDREAGRSVMRTLSRLHDPIIRERVHEWDGLRERGEKREVRDFLDALVSLVDSQGRPFLSFDEIKAQTAEMMFATIDNPSNAVEWALAEMMNRPEVMQKAMEELDAVVGKDRLVQESDIPGLNYLKACVREAFRLHPYHALNLPHVAMEDTVVSGYLVPKGSHVLLSRLALGRNPDVWDEPLQFRPERHLVNDGDVVLTEPDLRFISFSAGRRGCPGVSLGSSITMMLFARLLQGFAWSKPPGVRAIRLEESSASLALAEPLLLQAQPRLPAHLYAASG

SEQ ID NO: 19123 - protein, 714 aa, Vibrio parahaemolyticus RIMD 2210633
MSRTIMLIPASAGVGLTSVSMGVLRAMERKGVKVSFYKPISQPRSGGDQPDLTSTIVGHNSDMKIGEPMAMSVAESLIGNDNMDELLETVVERYNQINKDADVTLIEGLVPTRKHPFANQVNAEIAATLGAEIVLVATPGTDNPAQLKERIEVACSNFGGTKNKNISGVIINKLNAPVDEAGRTRPDLSEIFDDADSAKQNEMKVMEIFNTSPIRVLGCVPWSIDLIATRAIDMAKHLKADIINEGDINTRRIKSITFCARSLPNMIEHFKPGSLLVTSADRPDVIVAASLAAMNGVDIGAVLLTGGYDIPREIEGLCKPAFETGLPIFKAQGNTWQTSLNLQSFSIEVPADDKERIEFINEHVAGHIDGNWIESMTEGTQKSRRLSPPAFRYQLTELARKAGKRIVLPEGDEPRTVKAAAICAERGIAECVLLGNPAEIKRVAAQQGVELGAGVQIIDADAIRENYVARLVELRGAKGMTEVVAREKLQDSVFLGTMMLENNEVDGLVSGAVHTTANTIVPPFQIIKTAPNASIVSSVFFMLLPDQVLVYGDCAINPDPTAEQLAEIAIQSADSAAAFGIEPRVAMISYSTGESGKGADVDKVREATKLAQEKRPDLIIDGPLQYDAAIMENVAASKAPNSPVAGKATVFVFPDLNTGNTTYKAVQRSADLVSIGPMLQGMRKPVNDLSRGALVDDIVYTIALTAIQATQEQK

SEQ ID NO: 19124 - protein, 534 aa, Kineococcus radiotolerans SRS30216
MSSLETPHDLRTTAGQVAALHDRTRAAVQAADERAAAKQHPRGKKTARERIAALVDEGSFVERGGFVRSRATAFGMAAKHVDGDGVVTGYATVEGRPVCVYAQDFTAFGGSLGEEHGAKIAELQDFAATTGCPVVGINDGGGARIQEGVASLVQYARIFRRNVHASGVVPQVSLILGPSAGGAVYSPALTDITVMVEETSHMFVTGPDVIRTVTGEDVGFEELGGGRTHATRSGVAHHLAESEDEAIAYVRELLGYLPSNNLSEPPLLAPEHPRDLHVDEHDLVLDSIVPDSPNQPYDMTAVIAEVLDDQEFLQVHELFAPNVLTGFGRVEGRPVGVVANQPSQLAGTLDIDASEKAARFVRLCDAFNVPVLTFVDVPGFLPGTDQEWNGIIRRGAKLLYAYAEATVPLVTVITRKAYGGAYIVMGSKEMGADVCLAWPSAQIAVMGAQGAVNILHRSTLKAAADAGEDVEATRRGLVEDYELQLANPYVAAERGYVDAVIAPSETRVQVVRALRALAAKRATLPAKKHGNIPL

SEQ ID NO: 19125 - protein, 105 aa, Pinus taeda
LGAICGAGLVKAFQKPYYDRYGGGANVVAHGYTKGVGLAAEIIGTFVLVYTVFSATDPKRSARDSHVPVLAPLPIGFAVFMVHLATIPITGTGINPARSFGAAVI

SEQ ID NO: 19126 - protein, 122 aa, Triticum aestivum
  misc_feature (7)..(7): Xaa can be any naturally occurring amino acid
  misc_feature (11)..(11): Xaa can be any naturally occurring amino acid
  misc_feature (13)..(13): Xaa can be any naturally occurring amino acid
  misc_feature (16)..(16): Xaa can be any naturally occurring amino acid
  misc_feature (24)..(24): Xaa can be any naturally occurring amino acid
  misc_feature (37)..(38): Xaa can be any naturally occurring amino acid
  misc_feature (42)..(42): Xaa can be any naturally occurring amino acid
  misc_feature (56)..(56): Xaa can be any naturally occurring amino acid
  misc_feature (64)..(65): Xaa can be any naturally occurring amino acid
  misc_feature (72)..(73): Xaa can be any naturally occurring amino acid
  misc_feature (80)..(80): Xaa can be any naturally occurring amino acid
  misc_feature (86)..(88): Xaa can be any naturally occurring amino acid
  misc_feature (90)..(91): Xaa can be any naturally occurring amino acid
  misc_feature (93)..(93): Xaa can be any naturally occurring amino acid
  misc_feature (97)..(98): Xaa can be any naturally occurring amino acid
  misc_feature (101)..(101): Xaa can be any naturally occurring amino acid
  misc_feature (103)..(103): Xaa can be any naturally occurring amino acid
  misc_feature (109)..(109): Xaa can be any naturally occurring amino acid
  misc_feature (115)..(115): Xaa can be any naturally occurring amino acid
  misc_feature (117)..(117): Xaa can be any naturally occurring amino acid
MKMNIAXPTTXCXKKXEIDDDQKXRNLYDKRISQEVXXDLLXEEFKGYIFKIMGGXDKQGFPMXXGGLTSGXXRLLLHRXTPWFPXXXRXXGXRRRXXARXWXVSQNPXGINLGXGXKGGKI

SEQ ID NO: 19127 - protein, 236 aa, Glycine max
MASQVCKSASRAARSLLSSRFHSQGRALGAAAAVSLSSKVPLFYGKNGSGNGSASSSSSSSWISGALALPAAAYMFQDQEVQAAELERTFIAIKPDGVQRGLISEIISRFERKGYKLVGIKVVIPKKEFAQRHYHDLKERPFFDGLCDFLSSGPVIAMVWEGQGVISYGRKLIGATDPQKSEPGTIRGDLAVVVGRNIIHGSDGPETAKDEIKLWFKPEELVSFTSNAEKWIYGAN

SEQ ID NO: 19128 - protein, 478 aa, Agrobacterium tumefaciens str. C58
MHTYPDIKLLIDGEWRDAVSGKTIAVSDPATDEIIGAIAHAEKEDLDLALAAAERGFKLWRDTSPYERSKIMRKAADILRERKDKIAYIMTREQGKPLAQSATEIMGAADTIDWFAEEARRTYGQVIPARATGVSQLAIKVPVGPVAAFTPWNFPLNQIVRKLSAALATGCSIIVKAPEETPASPAELIRAFVDAGVPAGVIGLVYGVPSEISEYLIPHPVIRKISFTGSTPIGKHLAALAGKHMKRATMELGGHAPVMIFDDADIEKAIEVTSLAKFRNAGQVCVAPTRFLVQDGVADRFLEGFVEATKAIKVGNGLEEGVIMGPLANERRIPALEGLINDAVSHGAELKTGGRRIGNKGNFFEPTVLANVPVTAKIMNDEPFGPVAIINRFSSFDDAITEANRLPFGLASYAFTGSVKTAHALGQQVEAGMLTINHNGLALPEVPFGGIKDSGYGTEGGSEAVQAYLETKFVSQMS

SEQ ID NO: 19129 - protein, 591 aa, Oryza sativa Japonica Group
MRGNLREQKVYHMEGADEERPLIHHLPPQEQCSQYTCDGTVDIDRRPALKHSTGNWRACFFILGAEFTQCLCFSAVVKNLVRYLTSVLQESNVNAARSVSTWIGTCFFTPLIGAFLADTFWGRYRTIVICLSVYSIGMLILTTSASLPFLLHDSYNNGDDIRRVVAYLGLYLIALGAGGIKPCMSALGADQFDGADPVERVTKGSFFNYYYFSNNMGTLLSTTVLVWVQDNIGWGIGFATPMLLMGFGLSMFVAGRRVYRYRKLGRSPLTRVSQVVVAAARNHRLKLPDDSSLLHELPSLTEGGYRIQHTTRFRFLDKAAIPSDSDDNSPVQPDPWRLCTVSQVEELKMLLRVFPVWASLLVFFVVTAQMSSTLIEQSAAMDGRVGPFTVPPASLATFNVVAVLIWVPVYDAVLVPLARRATGNDRGLSHLQRIGVGLALSAVAMAYSAQVERRRRRPAAEEEAMSIMWQAPCYLVLGMAEVFTSIGMLEFFYERSPGSMKSLGTSLAHLAVATANYLNSGVLGVVVAATTRGGGAGWIPDNLDEGHLDYFFWMMALVRSDWASAAGQTGGDLMPQESIAGDGSGVNLEIR

SEQ ID NO: 19130 - protein, 213 aa, Triticum aestivum
  misc_feature (201)..(201): Xaa can be any naturally occurring amino acid
MAATAAASPSSSLLLSRRHGASSSSSSASRAGASRLRAPRCVLGTAEQLRVVEAGKPAGGADPWAAAWTPKTPAQEARLAALPQEARDSRLKIFSGTANRPLAQEIASYLGVDLGKILIKRFADGEIYVQLQDSVRGCHVFLEQPTCSRVNEKLMEHIIMIDACRRGAARSITVVIPDVGGAPADRKGQGRRAITGKWAAXVLTKVGGGGVII

SEQ ID NO: 19131 - protein, 442 aa, Rhizobium leguminosarum bv. trifolii
MRITMIGSGYVGLVSGVCFADLGHDVICVDKDLSKIEALREGRIPIYEPGLEQLVAENTSTGRLSFSTDVGESVRSADVVFIAVGTPSRRGDGHADLSYVYAAAREIATYVEGFTVIVTKSTVPVGTGDEVERIMRETNPAADVAVVSNPEFLREGAAIEDFKRPDRIVVGLNDDRARETMTEVYRPLYLNQAPLVFTTRRTSELIKYAANAFLAMKITFINEIADLCERVDANVQDVSRGIGLDGRIGSKFLHAGPGYGGSCFPKDTLALAKTAQDYDAPMRLIETTISINDNRKRAMGRKVISAVGGDIRGKKIAILGLTFKPNTDDMRDSPAIAVIQTLQDNGAQVVGYDPEGMETTRKVIENIEYASGLYEAAAGADALVIVTEWNQFRALDFNRLKQSMRAPILVDLRNIYRSDEVRKYGFTYTGIGTNLYQDVTNT

SEQ ID NO: 19132 - protein, 308 aa, Escherichia coli
INGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 19133 - protein, 246 aa, Vitis vinifera
MSSGSQSRSRSPQDRKIRTDRLSYRNAPYRRDSRRGFSQGNLCKNCKRPGHYARECPNVAVCHNCSLPGHIASECTTRSLCWNCQEPGHTASNCPNEGICHTCGKTGHLARDCSAPPVPPGDLRLCNNCYKQGHIAADCTNDKACNNCRKTGHLARDCRNDPVCNLCNVSGHVARQCPKANVLGDRGGGPRSSGFRDIVCRNCQQLGHMSRDCAAPLMICRNCGGRGHMAFECPSGRFMDRFPRRY

SEQ ID NO: 19134 - protein, 141 aa, Methylobacillus flagellatus KT
MAVERTLSIIKPDAVAKNVIGKIYTRFEDAGLKIIASKMVQLSQADAEGFYAVHKERPFFNDLVKFMISGPVVVQVLEGENAVLKHRELMGATDPKKAEPGTIRADFADSIDANAVHGSDSLENAAVEIAYFFAQSNIYSR

SEQ ID NO: 19135 - protein, 181 aa, Rickettsia conorii str. Malish 7
MRIDKNLPNYLTIARIMVIPVIILVFYINNSLARTLGALLFVLASITDFFDGYIARKYNLVTSFGKMFDPIADKLLVGCVIIMLLKKDNVDEIPCLLILAREFLVSGLREFLALVKVSVPVSRLAKVKTFLQMFALSILILGSKGSGIIYLDIVGEIILWIAAFLTIITGYSYFKACKKYF

SEQ ID NO: 19136 - protein, 729 aa, Oryza sativa Indica Group
MGKGGELWDDSALVDAFDHAVATFKAMHSKNTQATTSENEEPGDPAVAAPAGEENISAEVADELIEKDGSQTEPCEASETPYQTHEERKSTEQAPLQEKDLDKEAHFSEPKIHASDVADAEQKDTSNQQTWDYNELVKKYYELEEQSRKVLEQLHQTNYWNYQVPGQSSVYQQPQVPAYSATAPDPHSSTIQSPCCCANVPLVSVSCCSTGQTSGVSSCMQPSGGCSISLTCDQCPGTSATDSTGATCVQQAEKVSTDSDQVAKAAMMTAEGAMNFMRSTISGDLGSFPRTDAASGKESMPMGMNPNFDTMGADSDLAVVLNAWYAAGFYTGSLPVKMSDNLMDKVSAFGERLKITGSEVSKKMTAGMSSMSFKMKEIFQGQTPADKIVEEATSENLDGPDWSANLEICDLINTEKVNSVELIRGIKKRIMLKDARVQYLSLVLLETIVKNCEKAFSEVAAERVLDEMVRLIDDPQTVVNNRNKALMLIEAWGESGDELRYLPVYEETYKSLKSRGVRFPGRDNESLAPIFTPARSVAEAEVDANFSQQTFEDVQVHTYTAEETKEAFDVARNSIELLSTVLSSSPQQDALQDDLTSTLVQQCYQSQHTIQRMIETAGDNEAMLFEALSVNDEIQKVLSKYEQMKKPAASENAEQRPVVIPIATEHEDSATVGNEDALVRKPAGSRARSGGDDDILDDLDEMIFGKKGGSSSQEGPKKQDPKKDDLISF

SEQ ID NO: 19137 - protein, 564 aa, Aspergillus nidulans FGSC A4
MAAAWENKGAQEASTAAPEPPPGYTEANRATHLPQSDLDAREMSPGVRRIELINTQLGRYGRIAMFFGIWLIAYVYGLDGGVRNTYQVHTSAFPSKARPAPRNGELCHSQPAFDGTGAAECDCGCGAAMTTLTWIGRTFCAGAVIYQIGYTGIMFLVEVLIGDTTSTRSRLLFSYIPATPFIINTWIGGNVTDAVLKVTSWRWGIGMFAIIFPVCSIPLFLILLYGHSKAKKITAYPSLIETHGLKHFLLDVFWRMDVLGIILLIAVFALILVPFTLAGGNAEQWKQAKIIAPLVIGVLCVPLWIVWESKCRYPMVPFKLLKDRAVYGAIGIAIMLNTGNYLYTVLMVSFDESNLSATRISSLYSFASVITGCILGAIVIKIRRLKPFIVAGTFLFTVAFGILYRFRGGPSGDSYAGIVAGEVVLGIAGGMFPYPAQASIQTATKHEHLAIVTALFLSSYNIGSALGGSISGAIWSQTLLPNLTRQLGGNSTLASQVYADPFAFALSNPVGTPDRDAVIAAYMDTQRLLCITGLCLTVPLIGFALCIRNPRLNEKQSLEDAEKD

SEQ ID NO: 19138 - protein, 429 aa, Zymomonas mobilis subsp. mobilis ZM4
MTAIVSIHGRQVVDSRGNPTVEVDVTLEDGSFGRAAVPSGASTGVHEAVELRDGDKTRWGGKGVTKAVHAVNNEIANAIIGLEAEDQELIDQTMIKLDGTPNKGKFGANAILGVSLAVAKAAAEARGLPLYRYVGGTAAHVLPVPMMNIVNGGMHADNPIDFQEFMIAPVGASSINEAVRIGTEVFHTLKKELSAKGMNTNVGDEGGFAPSLDSASSALDFIVDSISKAGYKPGEDVFIALDAASSEFYNKDQNIYDLKGEGRKLTSAQLVDYYVELCGKYPIYSIEDGLAEDDFEGWKILTEKLGDKVQLVGDDLFVTNVKRLSDGIERGIANSLLVKFNQIGSLSETLAAVNMANDASYTAVMSHRSGETEDTTIADLAVATNCGQIKTGSLCRSERIAKYNQLMRIEEELGSVAKYAGRSVLRKAK

SEQ ID NO: 19139 - protein, 540 aa, Rhodopseudomonas palustris CGA009
MTAPSTSSASSVVPSGADTSPHVAAIHEKILIVDFGSQVTQLIARRVREEGVYSEIVPFQKAEAAFAEMKPKAVILSGGPASVLDDNAPSAPMTILEAGVPVLGICYGEQTLAKQLGGTVEGGHHREFGRAQIEITDDCALFDGIWQKGGKYDVWMSHGDRVTKLPAGFRAVAQAPGSPISVIADDTRKFYAMQFHPEVVHTPDGAKLLSNFVRKVAGLTGDWTMRAFREEAIEKIRAQVGTGKVICGLSGGVDSAVAAVLIHEAIGDQLTCVFVDHGLLRKDEGKSVVDLFRHHYNIPLVHVDVSETFLGALKGVTDPEQKRKTIGKLFIDVFEAEARRVGGADFLAQGTLYPDVIESVSFTGGPSVTIKSHHNVGGLPERMNMKLVEPLRELFKDEVRALGRELGLPDVFVGRHPFPGPGLAIRCPGEITEEKLEILRNADAVYIDQIRKAGLYDVIWQAFAVLLPVRSVGVMGDGRTYDYVVGLRAVTSTDGMTADFYPFEMSFLGATATRIINEVKGVNRVVYDVTSKPPGTIEWE

SEQ ID NO: 19140 - protein, 538 aa, Cytophaga hutchinsonii ATCC 33406
MLSCSNISLKYGKRTLFEEVTIRFASGNCYGLIGANGAGKSTFLKILSGEIDPTTGKVEMSPGERMAILKQNHYEFDEFPILETVMMGHKRLYQIMKEREAIYANPDFSEEDGIKASELESEFADLNGWNAEAEAAELLSGLGVKEENHYTLMQDVDGKVKVRVLLAQAIFGNPDVLLLDEPTNDLDVDSVLWLENFLADFKNTVIVISHDRHFLDTVCTHVADIDYAKIKLYTGNYTFWYESSQLAAKQKADQNRKVEDKRKELQDFVERFSANASKSKQATSRKKLLEKLVIDEIQASSRKYPGIQFRSDREAGDQLLTVEGLSKKGADGNYLFKDLTFTINKADKVSILSKEPLSISALFDVLMGVEKPDAGAFKWGITTSQSYFPRDNSEFFSDGNLNLVDWLRQYSKDKDESYIRGFLGRMLFTGEESLKKCTVLSGGEKVRCMLSKMMMESANVLIMDDPTNHLDLESITALNNALMEFKGTMLFYSHDYQFINTIATRIIELGPNGFIDKTMTYEEYLEDDKVKLQKEAVY

SEQ ID NO: 19141 - protein, 315 aa, Vibrio parahaemolyticus RIMD 2210633
MGKLVEGVWHDVWYDTKANGGKFVREDAGFRDWIKNDSEAVFQPESGRYHLYVSLACPWAHRTLIFRKLKGLEPHIDVTVVCPDMLSQGWQMGLPEPLFGHTRMHQIYTQAKPDYTGRVTVPVLWDKKTNTIVSNESSEIIRMFNSAFNDLTGNHDDYYPEPLRGVIDEWNDYIYPNVNNGVYRCGFATSQEAYEEAFESLFSALDKIDAHLATHRYLAGNKITEADWRLFTTLVRFDAVYVGHFKCNKQRIADYVNIQGYLKELYQIDGIADTTDFYHVKRHYYFSHTGINPTQVVPKGPDLDFSSPHQREMIG

SEQ ID NO: 19142 - protein, 342 aa, Zea mays
MAIVGEFLFQRIAASHLANPLELPPLDGVSIVVTGATSGIGLEIARQLALAGAHVVMAVRRPKVAQELIQKWQNENSETGRPLNAEVMELDLLSLDSVVKFADAWNARMAPLHVLINNAGIFAIGEPQHFSKDGHEEHMQVNHLAPALLAMLLIPSLLRGSPSRIVNVNSIMHSVGFVDAEDFNLRKHKYRSWLAYSNSKLAQVKFSSMLHKRIPAEAGISIICASPGIVDTNVTRDLPKIVVAAYRFLPYFIFDGQEGSRSALFAACDPQVPEYCEMLKSEDWPVCACINYDCNPMNASEEAHSLETSQLVWEKTLEMIGLPPDALDKLIAGETVPCRYGQ

SEQ ID NO: 19143 - protein, 192 aa, Hyphomonas neptunium ATCC 15444
MFIQTEATPNPDTIKFLPGQPVVGDRGPFDFPDAASARTSLLARALFQVEGVERVFLGSDFVSINKAQDKDWRHVKPMVLAAIMDHYMSGLPVIEEGTSSASSGADETEYEGETAEIVNEIKELIETRVRPAVAQDGGDITFHRFDADTGIVHLSMRGACAGCPSSTMTLKQGIENMLRTYVPEVTAVEAAL

SEQ ID NO: 19144 - protein, 277 aa, Brassica napus
  misc_feature (19)..(19): Xaa can be any naturally occurring amino acid
  misc_feature (29)..(29): Xaa can be any naturally occurring amino acid
  misc_feature (31)..(31): Xaa can be any naturally occurring amino acid
  misc_feature (43)..(43): Xaa can be any naturally occurring amino acid
  misc_feature (48)..(48): Xaa can be any naturally occurring amino acid
  misc_feature (56)..(56): Xaa can be any naturally occurring amino acid
  misc_feature (58)..(59): Xaa can be any naturally occurring amino acid
  misc_feature (63)..(64): Xaa can be any naturally occurring amino acid
  misc_feature (77)..(78): Xaa can be any naturally occurring amino acid
  misc_feature (80)..(80): Xaa can be any naturally occurring amino acid
  misc_feature (97)..(97): Xaa can be any naturally occurring amino acid
  misc_feature (105)..(105): Xaa can be any naturally occurring amino acid
TTHIGEGDRPPRSRTLYQXTVDAKKRSTXLXQQNIVPGIKVDXGVGPXVGLTTSQXCXXLDGXXSRTAAYYQQRCSXXAXWRTVESIPNGPSALAVXEAAWGLAXYAAISQDSGRVPIVEPEIMLDGEHCIDRTYEVAEKVWSEVFFYLSQNNVMFEGILLKPSMVTPGAESKDRATPEQVASYTLKLLRNRVPPAVPGIMFLSGGQSELEATLNLQRNEPRTEPMARVLLLCTCLAEHLLEDMGRQRREREGGSGHSLDPSQSELAGSAREIHRGR

SEQ ID NO: 19145 - protein, 303 aa, Medicago truncatula
MEIIPIPADSYTLGFIGAGKMAESIAKGAVRSGVLSPSRIKTAIHSNPARRTAFESIGITVLSSNDDVVRDSNVVVFSVKPQLCISLFQNFSVVYERSVVVLLMSFVVVVVAVKDVVLKLKPLLTKDKLLVSVAAGIKMKDLQEWAGHERFIRVMPNTAATVGEAASVMSLGGAATEEDANLISQLFGSIGKIWKADDKYFDAITGLSGSGPAYIYLAIEALADGGVAAGLPRDLALSLASQTVLGAASMATQSGKHPGQLKDDVTSPGGTTIAGVHELEKAGFRGILMNAVVAAAKRSQELS

SEQ ID NO: 19146 - protein, 176 aa, Oryza sativa
  misc_feature (162)..(162): Xaa can be any naturally occurring amino acid
MAAEAETKAMITLRSCEGQVFEVAEAVAMESQTIRHMIEDKCADTGIPLPNVSAKILSKVIEYCSKHVEARGGAAAAADGDAPAPAAVEANKAVEDELKTFDAEFVKVDQSTLFDLILAANYLNIKGLLDLTCQTVADMIKGKTPEEIRKTFNIKNDFTPEXEEEEVRRENQWAFE

SEQ ID NO: 19147 - protein, 295 aa, Halobacterium sp. NRC-1
MEHLVDINDVESEEIEQLLDLAASMKENPGEFSGVMDNKSLVMLFAKPSTRTRLSFETGMTQLGGHGIFFEMGSSQLSRGEPISDVSQVMSRYEDAIMARLFEHDEMMELAENADVPVVNGLTDFLHPCQALTDMFTMQEKDRLDTLAFVGDGNNVAHSLMQASAKMGVDCRIATPEGMEPDEEIQDRVSDANVTVTNDPYEAVDGATAVYGDVFVSMGEEEQREEKLAEFDGFQIDQDLMDAARDDAIFMHCLPAHRGEEVTAEVADGPQSVIFDQAENRMHVQKAIVHTLVNQ

SEQ ID NO: 19148 - protein, 362 aa, Desulfovibrio desulfuricans G20
MTAQHNDTCGAACPPPLRRAEAPVKVLLDIDNAMGLPVRDADDGVALALALWSPEFELTACTTCSGNCRASASAQNTLRMLELAGADAVPVAAGTDTPLGGEDRARHHAFLDAKASGAGASLWDDVSLPAPSARQASAPACRLIIETVRRHPHEVVLVMEGALTNLALALRHASDIAPLIGAVVHMGGVFAPRCPEEMAPQWKTPDIPEYVWRHALRFNTWYDPQATEEVVRAGLPLCFVPVNVTSRTCLSSHQIAQMRTADDPLRCFVRRTLLPWARWSEQVRGLDGAHMHDALALAVAAMPHLCSWKPFCFDVQAFRDGRDFLLPFGDKPYHRVWVATAVDAAAFHAWLLATMGIDVSAL

SEQ ID NO: 19149 - protein, 160 aa, Methanosarcina mazei Go1
MPVSSNTEGVHMEQTYVMVKPDGVQRGLVGEVISRIEKRGLKIVALRMNVIAEATAKEHYGEHAARPFFPSLIEFITSGPSVSMVVAGKDAIKVMRAINGATNPVDAAPGTIRGDFALDVGRNVVHASDSPEAAAREIAIHFKDSEIANYSRVDEVCLYE

SEQ ID NO: 19150 - protein, 261 aa, Medicago truncatula
MAELFVNQGKEYADARPSYPPQLFQFIASKTPSHNLVWDVATGSGQAAKSLAALYKNVIATDVSEQQLEFATKLPNVQYKHTPSTMSIPELEQIVTPQGTIDLVTIAQGLHWFDLPNFYQQVKWVLKKPHGVIAAWCYFLPRISDEVDTVFDQFYYTDSQPYWDSARKLVEKNYRSIDFPFQAVDGVDHTGPFEFVTETFMSFDGLLTYIKSWSAYQTAKKKGVELLGEDVVEKFKLAWGEDGHKTAKFPVYLRIGRVGNV

SEQ ID NO: 19151 - protein, 105 aa, Pinus nelsonii
LGAICGAGLIKAFQKPYYDRYGGGANVVAHGYTKGVGLAAEIIGTFVLVYTVFSATDPKRSARDSHVPVLAPLPIGFAVFMVHLATIPITGTGINPARSFGAAVI

SEQ ID NO: 19152 - protein, 104 aa, Medicago truncatula
MWKARNDKVFNNRNPYVGEMVDDVKVLSWRWALDRISMPPLQRSDWRNQRVIEMAELFVNQGKEYADARPSYPPQLFQFIASKTPSHNLVWDVATGSGQAAKSD

SEQ ID NO: 19153 - protein, 181 aa, Daucus carota
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 19154 - protein, 501 aa, Rickettsia prowazekii str. Madrid E
MLPPKIFFEKVKEIIWPIERKELKLFIPMALMMLCILFNFGALRSIKDSLVVPSMGAEIISFLKLWLVLPSCVIFTILYVKLSNKLNFEYIFYSIVGTFLLFFLLFAYIIYPNQDIYHPNDAMINNLIASYPNLKWFIKIGSKWSYALMYIFSELWSAVVINLMFWQFANHIFDTAKAKRFYPVLGMVGNIGLIIAGSVLVFFSSGQYIIDSELLTDSYNSSSNNSIMLQPIISIIVTAGIIAMFLFRIINKFILTNSINVLDVKKVAAKTKTKLALIESIKLIIHSKYIGRIALLIICYGLLINIVEGPWKAKIKELHPNTVDYVNFMGMFNIWMGISCVTFMIIGSNILRRLGWLISALLTPIMLSITGFMFFIFIIFIEEIGTCFGDFNLLYVAIIVGAIQNILSKSSKYSLFDSTKEMAYIPLSLELRTKGKAAVEVIGTKFGKSLGAFIQSLIFIIIPTATFDSIIIYLLVIFIVMMNLWIWNIIKLNKEYIKLCQ

SEQ ID NO: 19155 - protein, 176 aa, Medicago truncatula
MSIPELEQIVTPQGTIDLVTIAQGLHWFDFPNFYQQVKWVLKKPHGVIAAWCYSLPRISDEVDTVVDQFYFIDSKPYWDSACKLVEDNYRSIDFPFEAVDGVDHRGPFEFVTEILMSFDGLLTYIKSWSAYQTAKEKGVELLGEDVVEKFKLAWGEDGHKTAKFPVYLRIGRVGNV

SEQ ID NO: 19156 - protein, 120 aa, Methanosarcina mazei Go1
MAQLAKFDVPEELTNKALEALELARDTGKIKKGTNEATKAIERGNAKLVLIAEDIEPAEIVAHIGPLSEEKKAPYIYIKNQKDLGAASGLGVSCATVAIVDAGKAAEMIQDIAQKLDALK

SEQ ID NO: 19157 - protein, 411 aa, Kineococcus radiotolerans SRS30216
MPVRHVSSTSDRRRGRRRTLVDLFEYQARDLFAAHGVPVLDGRVATTPEEARAAAEAMGGGTVVVKAQVKTGGRGKAGGVKLAHSPEEAGERAREILGMDIKGHTVHQVMIAEGARIAEEFYFSVLLDRSNRTYLAMCSVEGGMEIEQLAVERPEALARVPVDALTGIDAAKAAEIVEAAGFAPELREKVADVVVKLWGVFTAEDATLVEVNPLVRTEDGSIVALDGKVTLDENADFRHPAHAELVDAAAADPLEAKAKELGLNYVKLDGEVGIIGNGAGLVMSTLDVVAYAGEAHGGVKPANFLDIGGGASAQVMANGLDVILNDAQVKSVFVNVFGGITACDEVAKGIVAALGILGDEATKPLVVRLDGNNVEEGRRILAEAAHPLVTVVDTMDGAADRAAELASAGKA

SEQ ID NO: 19158 - protein, 201 aa, Colwellia psychrerythraea 34H
MSVLVGRQAPDFTAAAVLGSGEIVDSFTLSEAINGKKAVVFFYPLDFTFVCPSELLAFDHRMEEFKSRGVEVIGVSIDSQFSHNAWRNTPVNDGGIGPVQYTLVADTKHEICKAYDVEHPEAGVAFRGSFLIDEEGNVRHQVINDLPLGRDVDEMIRMVDALQFHQDHGEVCPAGWNKGDKGMTASPEGVASYLTDNADKL

SEQ ID NO: 19159 - protein, 248 aa, Medicago truncatula
MATENGGGQNGTTETAITTMEIENGDITTQPQLQEQPQCLFTKKDNGSIESHRYYLSRRTVLEMLKDRGYSIPSDEIQLSLDDFRQIHGQSPDVDRLRLTATHATNPSKRILVVFSGPGIVKVNGVRDIAGQIVNRESLTGLILIVQNQITSQALKAVNLLSFKVEIFQITDLLVNATKHVLKPKHQVLTDKQKKNLLKKYDIQEKQLPRMLQTDAIARYYGLQRGQVVKVTYTGEITQMHVTYRCVW

SEQ ID NO: 19160 - protein, 223 aa, Neptuniibacter caesariensis
MTQDEMKKAVAEAAVEYIKPKLTEDSIVGVGTGSTANFFIDALAEIKHMFEGAVASSEATAERLKGHGIEVFDMNSVSEMEVYVDGADEFDSGLNLVKGGGGALTREKIVAAVAKEFVCIVDSSKKVDVLGEFPLPVEVIPMARSQVARELVKLDGMPEWRQGFVTDNGNLILDVHDLEIMRPKELEKQLNNIVGVVTNGLFANRGADVVLMGTESGVETIKL

SEQ ID NO: 19161 - protein, 131 aa, Rickettsia prowazekii str. Madrid E
MAYSKKVIDHYENPRNVGSLDKKKKNVGTGLVGAPACGDVMKLQIEVGDDEIITDAKFKTFGCGSAIASSSLVTEWIKGKSVEDAKEIKNTEIAKELSLPPVKLHCSLLAEDAIKAAIADYKQKRENKKDS

SEQ ID NO: 19162 - protein, 505 aa, Neptuniibacter caesariensis
MPDRYIKKILSARVYDVAVETPLDEAKGLSERLNNRIMLKREDEQPVFSFKLRGAYNKLSQLSEEERACGVVAASAGNHAQGLAMSAKKLGVKATIVMPKTTPDVKVNNVKRLGGKVVLHGDAYDDAAAHAQKLVAEKGMTFVHPFDDPDVIAGQGTVAMEILRQESGPIEAIFVPVGGGGLVAGIATYVKYLRKDTKIIGVESEDSACLKAAMDAGKRVTLEQVGIFADGVAVATIGENTFELAQRYVDDVITVSTDEICAAIKDIYDDTRSICEPAGALGVAGMKKYVEREACSDKTLIAIDSGANVNFDRLRHIAERSELGEKREAIIAARIPEKPGSFKRFCSALGSRNITEFNYRYSDESNAIVFAGVQLKAGGGGREELVNELRSSDYEVEDLSDNEIAKIHVRYMVGGHAPANLENEVIYRFEFPERPGALMKFLSKLGSKWNISMFHYRNHGAAYGRVLVGMQIPQAERAQVEGFLEEIGYNFWEETDNKAYQLFLG

SEQ ID NO: 19163 - protein, 410 aa, Rickettsia prowazekii str. Madrid E
MNQQLKNLTLPIYMDYQSTTPIDPRVMEAMLPYFTTKFGNPHSRSHSFGWEAENAVENARSMVAKVIGADSKEIIFTSGATESNNLVIKGIAKFYGNKKKHIITLVSEHKCVLNACRHLEQEGIKITYLPIKSNGIIDLETLKNAITDQTLLVSVMAVNNEIGVIQPLKEIGKICRERNVFFHSDIAQGFGKIPINVNECNIDLASISGHKIYGPKGIGALYIRKKPRVRVTPLINGGGQERGMRSGTLPTPLIVGLGIASEIAYNEMEKDTQHVNYLFDRFLNNIHSKISEVYLNGDKDQRYKGNLNLSFAGVEGESIILAIKDLAVSSGSACTSASLEPSYVLRSIGISEELAHTSIRFGIGRFTTEQEIDYAVNLVCSKIDKLRRLSPLWEMMQEGVDLKKIRWTAH

SEQ ID NO: 19164 - protein, 528 aa, Glycine max
  misc_feature (388)..(388): Xaa can be any naturally occurring amino acid
MADSTPLLSQPNPSSSSSPDTQEAPPSNQHHPSLGSTVELCIGEFNWSQFLQSILVSLAWIFDAQQTFISVFTDALPEWHCTERGANACKTATTVCSLPKGSWAWDVPTQASIVSEWGLECANSAITGLPASMFFLGCLIGGFVLASLADSSLGRKNMLFFSCLVMAITSLLVTLSPNVWIYSALKFLCGFARATIGTSALVLASELVGKRWRGQISVIGFFCFTIGFLSLPAMAYINRSSSWRNLYLWTSISTMFYCILVKLFVTESPRWLLVRGKTEEAVETLKCITSITQSNLNLAINNMSHKEETWNVDIFSALKILLQKKWSSRRLSLIMAMGIGIGLVYYGMPLGLQNLSFNLYLSVTFNALSELPSALIVLFFVDKFNRRXALLLFTILSGVFSVMSIMEMKTSSWTNNIQIVFELVSFFSACSSFNVYLIYTTELFPTCVRNSALSMARLAVVLGGTFSPLLVSAARGNKFMCYGVFGLVIGFSGVFGIFLPETKGRALCDTMDEEENKEKNMTCDMFLA

SEQ ID NO: 19165 - protein, 152 aa, Exiguobacterium sibiricum 255-15
MVFEGFLTGEGLRVAIVAARFNELITSKLVGGANDAFRRHGVAADAVDTAWVPGAFEIPLVAEKLAKSGNYDAVITLGAVIRGATSHYDYVCNEVAKGVAGASRETGVPIIFGVLTTDSIEQAVERAGTKAGNKGYEAAVSAIEMANLLRTI

SEQ ID NO: 19166 - protein, 394 aa, Exiguobacterium sibiricum 255-15
MNGFDLVEEAVEDLKHGRPIIVCDDENRENEGDLILLAEHATPEQINFMITYGKGLVCVPVSPQLAARLELNPMTDVNTDPHGTAFTISIDHEDAMTGISAAERALTIQRMLTDGPKQFKRPGHIFPLIAKEGGVRERRGHTEAGVDLARLAGSAEATVICEIILEDGTMARVDDLLTYKEVHGLKMITIDALVAYLERPVRREADVLLPAVHGAFRMLGYTTPDQKEHVTVLSGEPEDGMLVRLHSECLTGDVFGSKRCDCGPQLDAALERIGQEGGAVLYLRQEGRGIGLMAKLKAYELQEQGLDTVEANHALGYATDLRNYSVAAAMLHDLGVTKIRLMTNNPEKQQALENEGITVLERVPLEIAAVPENKQYLQTKQTKLGHLLDIQGGN

SEQ ID NO: 19167 - protein, 135 aa, Triticum aestivum
MAAPIPQTKLHELLGKLKEENVSTLTILVMGKGGVGKSSTVNSIVGERVANVSAFQSEGLRPMMCSRTRAGFTLNIIDTPGLIEGGYINEQAVEIIKRFLLEKTIDVLLYVDRLDTYRMDTLDEQVIRAITNSFR

SEQ ID NO: 19168 - protein, 496 aa, Cytophaga hutchinsonii ATCC 33406
MKYDVCIIGAGPAGYAAAMRALDLNKSVILIEKDKIGGAGLYNGAISSKTFWELAKDIQTARKRLAQYSPDQHFSVTYQQVLRQVREGIANRRFHLEGQIESLAKQQTSRFRYIKGSAKLVSHNTVEVSTGTEEEIIEAENVVIATGSKPRKLPNIPIDEKIIVTSDGVENFENFPKSLVILGAGVIGCEWATIFSNFGYTSVNIIDKAERILPFEDDDVTDVVEANMKKQGITVHKKSNLLSMRIVDGEVEYILEYTDGRKEMHRVEKVLVSVGRIPNTQNLGLERVGVNILANGQIENTDGQTNIPNIYVAGDISSDVALVNVAELEGRHVIEKMFGLSDSVITYNNVSTIMFVQPEVAGVGMNEKKALQNKMSYKVVKIRYDMIPRAIAMRNNDGFFKILVTNDADMKIIGMRAVGVHASSAIQAVALLISMDKGVEELADMIHPHPSIIEGIQECIRMLLGKSVLKPEFFKGMLSCKSCDENGCVNDIIYLR

SEQ ID NO: 19169 - protein, 390 aa, Zymomonas mobilis subsp. mobilis ZM4
MADPISARPPEGATGVLVLADGQMIWGRGFGATGAKVGEVCFHTAMTGYEEIMTDPSFASQIINFTFPHIGNVGANREDVEAKTLHALGCIVREDVTAPSNFRSLWRFDSWLKDHDRIGLAGVDTRALTGLLRKKGAQNAVIAHDPKGQFDIPALIETARSWAGLQGMDLARSVSTHQSYNWQEGIWSLQNGYSVVDNQKGPHVVAIDYGLKHNILRNLVEAGARVTVVKATASFDEVMAHKPDGVFLSNGPGDPAATAEYAVPVIRQLLDIKMPIFGICLGHQLLALAVGATTYKMHQGHRGANHPVKRLDDSKVEITSMNHGFAVATDSLPEQARPTHLSLFDGSLAGLELTDRPAFSVQYHPEASPGPQDSYYLFTKFIDLIAKERP

SEQ ID NO: 19170 - protein, 1095 aa, Pseudomonas aeruginosa UCBPP-PA14
MTAPFNALLIANRGEIAIRIARACADLGIRSVAVFAEDDAASLHVRKADVALPLAGRGVAAYLDMDRLVALALEQGCEAIHPGYGFLAENGEFARRCQRAGIHFVGPQAEVLDLFGDKAAARALAERLEVPLVAGVNRAVSVEEAEAFLEGLGDGAAVMLKALAGGGGRGMRAVEEVAQLADAYRRCRAEAQAAFGRDELYVEQRVARARHIEVQVLGDGSGAVSHLWERDCSLQRRQQKLLEIAPSPDLPEATREALIDCALRMAGAVRYRGIGTFEFLVDEERPGHFYFMEANPRIQVEHTVTEEVTGVDLLHAQLRLAAGMELAALGLERPPAIGGCAVQLRINLETLAADGSARPAVGTIGAYEPPSGPGLRVDGYGYAGYRVSPSYDSLLAKLVVRGADYPAALRRAYRALCEFRLEGVASNLDLLRNLLLHPAVQANRVDTRFVESHLETLLAPIPASHPRLRAECPLAKDAAPARVEAPLGSLPLPAPSSGVLVALEVSEGERVRAGQRVAILEAMKMEFEVKAPGGGIVRRLAASLGEPLEEGATLLFLEPTEDDDEQAPTEQALDLAHIRADLAEVLERQAALGDERRPQALARRRKTGQRTARENVLDLLDEGSFSEYGGFALAAQRRRRSAEELLELSPADGLVAGTGTVGAASFGAQAARCLVLAYDYTVFAGTQGVMNHKKTDRLLGLAEQWRLPLVLFAEGGGGRPGDTDFVGVAGLDCHTFVGMARLSGLVPLVGVVSGRCFAGNAALLGCCDVIIATRDATIGMAGPAMIEGGGLGRFAAEEVGPTGVQGPNGVIDVLVADEAEAVAVARRYLGYFQGPLADWSCADQRELRHLVPENRLRAYDIRQAIEVLADRGSVLELRRQFAPGLVTALLRIEGRAFGLIANNPGHLGGAIDAAAGDKAARFMQLCDAFDIPIVSLCDTPGFMVGPEAEKQATVRHVSRMFVSAASLTVPFFTVVLRKGYGLGAQAMAAGSFHSPLFTVAWPSGEFGAMGLEGAVRLGFAKELAAEKDPQRREALFRGMVDKAYRNGKALNMASYLEIDAVIDPAETRAWLLRGLAVAGEPAPRTGRKRPFVDTW

SEQ ID NO: 19171 - protein, 304 aa, Hyphomonas neptunium ATCC 15444
MEKWTLENIPSQSGRSAVVTGTGGLGFEDALALARAGAEVVIAGRNSEKGAAAVTAIRKLVPSARVRFGLVDLANLSSVSAFAAEIAWERTSLDLLINNAAVMNPPARRTTRDGFELQLGTNFLGHFALTAHLLPLLKRGAAPRIVTVSSVAARQGAINFDDLQATRTYHPMTVYSQSKLACLMFALELSRRSRAGGWGVASLAAHPGVTRTDLIVNGAGPSSLNGRIRRFLPFLFQPAWQGALPTLYAATDPEARDGAYYGPGGPGGIRGYPAEERPPKHALDEAVAARLWNVSVGLTDAKFL

SEQ ID NO: 19172 - protein, 845 aa, Oryza sativa
  misc_feature (719)..(719): Xaa can be any naturally occurring amino acid
  misc_feature (748)..(748): Xaa can be any naturally occurring amino acid
MLLVGVLLLLFFNLHLPTAAIDTLTLGQSLLWNQTLVSNGGNFELGLFSPGKSNKHYLGIWYKKISKKTVVWVANRERPILEPSSCHLELSVHGDLRLFSTAPSNTLLWSSNASASSSPSPPRTTVATLQDDGNLVVNSNATRSRSRSPSSTTTTHVAWQSFDHPTDTWLPGARLGYDRGRGVHSFLTSWTDSENPAPGAFSMVIDARGLAKFDLLAGGEHRYWTTGLWDGEIFANVPEMRSGYFTGVPYAPNASVNFFSYRDRLPGAVGNFMLDVNGQMRRRQWSETAGKWILFCSLPHDACDVYGSCGPFGVCSNATNPECRCPAGFEPRSSEEWRLENAAGGCVRRHPLECHGDGFLALPYTVRLPNGSVEAPAGAGNDKACAHTCLVDCSCTAYVHDGAKCLVWNGELVNMKAYAANENGQGDPGLAGAVLHLRVAHSEVPASSTEHSWKKSMVILGSVVAAVVLLLASLVTVVAVAAVLRMRRRRGKVTAVQGSLLLLDYHAVKTATRDFSEKLGSGSFGTVFKGALPDGTPVAVKKLDGLRQGEKQFRTEVVTLGMIQHVNLVRLRGFCCEGNKRALVYDYMANGSLDSHLFVMSGSSSGPDSKQVTLTWSQRYNVAVGVARGLAYLHEKCRECIIHCDVKPENILLDQEMAARLADFGMAKLVGRDFSSVLTTMRGTVGYLAPEWLAGTPVTAKADVYSFGLLLFELVSGRXRNSTAPSSSSEGGPGIYFPVHAVVKLNEXGDVAGLVDERVAKDADPKEVERLCKVAGWCIQDEEGDRPTMGLVVQQLEGIANVMLPPIPSRLHILAIENEWVRGVPEDERCSKSGSKPETEAIEEM

SEQ ID NO: 19173 - protein, 869 aa, Vibrio parahaemolyticus RIMD 2210633
MLSLIEQIRTGSLWDFPGGVHPAENKKQSNKADLVRASIPAEIILPLKQHIGKAGNLLVSVGEHVLKGQALTQSETGFTVPVHAPTSGTITAIEPRTVAHPSGLSELCAVITPDGQDTWCEKSPIADYTQESADALIDIIRLAGISGMGGAGFPTAKKIQSGIARTEILIVNAAECEPYITADDKLMQEHAEELIQGIEIVEHILKPKLTIIGIEDNKPDAIKALESAALNKDIVIRVIPTKYPSGGEKQLIKILTNKEVPSGSIPADIGILVQNVGSLYSIKRAIIDGEPMIERVVTLTGKTFKQPRNVWALLGTPVQALLDEFGYKADKKLQRLIMGGPMMGFTLPHSQVPITKTANCILAPTRHEISAHQYEMECIRCGQCAEACPASLLPQQLQWHAKAEEYDKLEELNLKDCIECGACAFVCPSEIPLVQYYRQAKAEIRTRAQEAEAAERAKLRFEEKKARMEREKAERENRFKKAADDRRKEMKSTGGDDAIAAAIARVKAQKSNEDNKAEPAVKPAVAAAIAKAKAKQAAAAKVGATEPDNSEMAKLREERKRLARERKAEKEQSETPANNADDKKSAVAAAIARAKAKKAQQEENASEEPEDKKAAVAAAIARAKARKAQQETESQPVEETASQEPAEDPKKAAVAAAIARAKARKAQQETESQPIEETASQEPAEDPKKAAVAAAIARAKARKAQQETESQPIEETASQEPAEDPKKAAVAAAIARAKARKAQQETESQPVEETASQEPAEDPKKAAVAAAIARAKARKAQQETESQPVEETASQEPAEDPKKAAVAAAIARAKARKVQQETESQPVEETASQEPTEDPKKAAVAAAIARAKARKAQQDANKNNTEENE

SEQ ID NO: 19174 - protein, 880 aa, Rickettsia prowazekii str. Madrid E
MNKLIYYFGNNGSDGNASMNNILGNKGAGLAEMSNLKLPIPNGFTITTELCNYFYKHNNNFPKNFQNELQQAISKLEVTTGKIFGSTTSNPLLLSVRSGSTVSMPGMMDTILNLGMNNEVCNALADACGNKLFALDSYRRFLEMYGSTVLSIPSDLFEQIYENHKIQADIYKDSDITVELLEKIIDDFKRLHIKYDKQLINDPYEQLESAIKAVLYSWKNNRAIIYRKLNNISEDFGTAINIQEMVFGNLGKTSATGVAFTRSPSTGEKKLFGEFLINAQGEDIVSGTRTPMPIIANDSNSMQAMMPEVFKELSQIAKKLEEHYLDMQDIEFTIENNKLYILQTRTAKRTAIAAINIAVQMVKEKLISKEQALMRIDPESLNQLLHTRIDYSKGLTSIAEGLPASPGAATGIVVFSPYDAEKLSHHHKVILVRHDTSPEDINGMHVSSGILTIRGGMTSHAAVVARGMGKPCVCGTNNLSIDEQKQILIAGDIVIKQGDIITIDGGSGKIFLGEMPLIQPTFSEESKLILDWADEISSLKVRANAETVNDALVSIKFGAQGIGLCRSEHMFFDKNKIPLVREMIIAPDIERRQCALQKLLPLQTEDFKSLFRVMKNKPVNIRLLDPPLHEFLPTTEEDKKNLANSLNLPLSMIHQRLHAMHEVNPMLGHRGCRLGICLPEIYQMQIEAIFTAIFELHKKEHIESNLELMIPLISNVAEIKKLKMYIYEVVQELEQRYSYKFSFTLGTMIELPRAALESKKIAKEVDYFSFGTNDLTQTTYGISRDDIASFLPYYLEEKIFESDPFTTLDEEGVGELIEIAIKRGKSSNANLKLGACGEHAGNPTSIAFFHKANLNYVSCSPYRIPIARIAAAQAKIKQGS

SEQ ID NO: 19175 - protein, 423 aa, Kineococcus radiotolerans SRS30216
MLAPVLFTLAGASALVAALLPRVVDRLPVNLPMAFLGGGVLLGLVPGLPTVDPLAHGEVTKHVTELVVIISLMGAGLALDRAVGWRRWASTWRLILIAMPLTIALVAWAGWALAGLPIAAAVLLGATLAPTDPVLASDVQVGEPADEEGTEDEVRFALTSEAGLNDGAAFPIVHLAVVLATAGFSAVTMRDWFLEDVALRGVVGVVSGIVVGWLLGRLFFHSPVPSLRLADNAEGFTALAVTFLAYGVTEVLHGYGFVAVFVAACTIRAAERSHGAHRVAHEFVEQIERMLTSWLLLVLGAALADGLLDALTWPLALVGILLVFVIRPLAGYLSLLRTPGGPRERWVIGIFGVRGIGSLFYLAYALGEAEFPGEELWAVVGFTVALSVFVHGFTAAPVVGALDAARIRKAPSRHSGDVADTHL

SEQ ID NO: 19176 - protein, 229 aa, Medicago truncatula
MLRCLDGLKNLCVGVVNWCYSKVSGSKPPPSGLENPEEISRITVFSVSEVEALYELFKKISSGVVDDGLITKEEFQLALFKTSNKRSLFAERVFDMFDTNSHGVLDFKEFASALSIFHPIAPIDDKIDFLFRLYDLKQQGYIDRERLKQMVVATLSEFGMRLTEEMLNSIMDKTFEEVDTNHDGKIDREEWKNLAMQQTSLLKNMTLPYLTEITTTFPSFIFHTQVDDD

SEQ ID NO: 19177 - protein, 276 aa, Rickettsia prowazekii str. Madrid E
MKIPYINYNNFINTLSQNLQKNKQLEKIIAQFYQNYQIIPIIGVEIEFYLSHNIDIANFEILSSKDLSKFKISKIKKEKGNNQFEIALPPSINLIQYIKNILEVKKILTKNAKQLNGYIDFSPKPFLDDYGNSMHFHINFNSELNDYYILAAQGICHYMLDTLLVFMPTTLDYLRINKKFMSPTHVSYGGNNRSVAVRTPNSLPKRLEHRLSSPETDPYIAMFTILKSILLALTFPNSLKKIEKIYGNAFDPQYNLTPLPTSYQESFRLFKPEFFK

SEQ ID NO: 19178 - protein, 363 aa, Arabidopsis thaliana
MEIDSATNGNSDTVMTESAATITPSPVVVSSSRSNQFTESLKLEHQLLRVPFEHYKKTIRTNHRSFEKEVSTIVNGVGELADSDWSKDDTVSRLTCLVTRLQGLKRKLEEGSNVENLQAQRCRARIDHLDSVDVENITEWNNTKLKRILVDYMLRMSYFETATKLSESSNIMDLVDIDIFREAKKVIDALKNREVASALTWCADNKTRLKKSKSKFEFQLRLQEFIELVRVDTAESYKKAIQYARKHLASWGTTHMKELQHVLATLAFKSTTECSKYKVLFELRQWDVLVDQFKQEFLQVIWHDDGTLIEHLLTGRLVCAENSIWFRRRLYQRGPSLTRELSEASFAFTVLQAAPFKACLLYF

SEQ ID NO: 19179 - protein, 187 aa, Zea mays
  misc_feature (108)..(108): Xaa can be any naturally occurring amino acid
  misc_feature (177)..(177): Xaa can be any naturally occurring amino acid
MDMATSFVYPPPPSMLLNTMSVVGLAALAQIGWSEVRGNHLKYSKFASSSSSASPQPQKHRFGSFSSRIGMLLLYTPAFLAAAASFFVLPSDDLRFLLLKSALALHFXQRIFEVMFIHKYSGEMAVDSAFLITSSYFSSTVLMLYSQSFALGLTEPHFDLKLPRVVMFVVGIVGDLXSHVLLAKLKN

SEQ ID NO: 19180 - protein, 308 aa, Escherichia coli
INGFGRIGRIVFRAAQKRSDIEIVAINDLLDADYMAIMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 19181 - protein, 451 aa, Pseudomonas putida KT2440
MRLERTSFGKRLGTYAEAIELPAQPIVEGRLLRMVGLTLEAEGLRAAVGSRCLVINDDSYHPVQVEAEVMGFAGPKVFLMPVGSIVGIAPGARVVPLDDGGRLPMGMSMLGRVLDGAGRALDGKGGMKAEDWVPMDGPVINPLNRDPISKPLDVGIRSINGLLTVGRGQRLGLFAGTGVGKSVLLGMMTRFTEAEIIVVGLIGERGREVKEFIEHILGEEGLKRSVVVASPADDAPLMRLRAAMYCTRIAEYFRDKGKNVLLLMDSLTRFAQAQREIALAIGEPPATRGYPPSVFAKLPKLVERAGNGEPGGGSITAFYTVLSEGDDQQDPIADSARGVLDGHFVLSRRLAEEGHYPAIDIEASISRVMPQVVDADHLRQAQKFKQLWSRLSQSRDLISVGAYVAGGDPETDLAIALQSKLVEFLRQGLRENVGMAQSREQLGAIFTPPAG

SEQ ID NO: 19182 - protein, 245 aa, Mycobacterium smegmatis str. MC2 155
MGRVAGKVALISGGARGMGAAHARALVAEGAKVVIGDILDDEGAALAAELGDAARYVHLDVTQAEDWDTAVATATTDFGLLNVLINNAGIVALGAIGKFDMTKWQNVIDVNLTGTFLGMQASVGAMKAAGGGSIINVSSIEGLRGAPMVHPYVASKWAVRGLTKSAALELGAHQIRVNSIHPGFIRTPMTEHFPDDMLRIPLGRPGEVDEVSSFVVFLASDESRYATGAEFVMDGGLVNDVPHKL

SEQ ID NO: 19183 - protein, 304 aa, Vitis vinifera
MAITLNSGFKMPILGLGVWRMDGKDIRNLLINAIKIGYRHFDCAADYQNEVEVGEALAEAFQTGLVKREDLFITTKATLEFRSWTSSLKKLQLDYLDLFLIHFPIATKHTGVGTTGSALDEDGVLDIDTTISLETTWHAMEELVSMGLVRSIGISNYDIFLTRDCLAYSKVKPAVNQIETHPYFQRDSLVKFCQKHGICVTAHTPLGGSVSNTEWFGSVSCLDDPALKDLAEKYKKTVPQVVLRWGIQRNTVVIPKTSKLERLEENFRVLDFELAKEDMDLIGSLDRKHRTNQPAKFWGIDLYA

SEQ ID NO: 19184 - protein, 499 aa, Aspergillus awamori
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWFDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 19185 - protein, 308 aa, Escherichia coli
INGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGAMKGVLGYTEDDVVSTDFNGEVCTSVFDAKAGIALNDNFVKLVSWYDN

SEQ ID NO: 19186 - protein, 383 aa, Aspergillus nidulans FGSC A4
MGIPTKAYLVEEERGPFVLKDVVLDQLEPDEVLVEMKYTGLCHTDLVVQAGILPVGSFPAVLGHEGCGVIRQVGSKVSNKALKEGDQVFLSFRTCRECTPCLAGHCGACIHSQELSFLRTRLDKTKPSPISLPDGTPVHGQFFGQSSLSRLAIVSERSVVKCDVEFDSEELGPLAPMGCGYLTGAGTVVNVLKPSSASTMLITGMGAVGVAALLAARALGLTRIVAVDIVDEKLQLALELGASHTINTLKGPDSDLAATIRMYFPGGADYIIDTTGVGKVLQATLRALAVNGTFALVGAMPPDTELKVNALDVLTGCKKIIGVILAWSDPQQIIPQLVQWYKEGKFPVHKIVRIYPATELDKALEDLRAGQVIKPVLAWDSMI

SEQ ID NO: 19187 - protein, 308 aa, Escherichia coli
INGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEDEMKGVLGYTEDDVVSTDFNGEVCTSVFDAKAGIALNDNFVKLVSWYDN

SEQ ID NO: 19188 - protein, 233 aa, Triticum aestivum
  misc_feature (23)..(23): Xaa can be any naturally occurring amino acid
  misc_feature (31)..(31): Xaa can be any naturally occurring amino acid
  misc_feature (47)..(47): Xaa can be any naturally occurring amino acid
  misc_feature (51)..(51): Xaa can be any naturally occurring amino acid
  misc_feature (107)..(107): Xaa can be any naturally occurring amino acid
MACSKMEVKGFFFPRFAPPRGFXKPHFFSGXGFSGIEIGGKFIKFTXAIGXEPSGGNHCPCGCTPNWPAKPPANLASEVAFFRRVVTGEFEKFTRVTMILPLTGAQXSDKVTEKCVAYWKATGVYTDAEAAPVDKFKEAFGPHSFAPGASIFFTQSPAGVLTVAFSKELSVPESGGVAIDNARLWEAVLESIIGEHGVLPAAKFSLATRVAELLKGASHAGGEPAADPPPPPV

SEQ ID NO: 19189 - protein, 313 aa, Pseudomonas aeruginosa UCBPP-PA14
MNREALDTLLQHLLAALSPAPAETRRLFHGRGRCWPGLEQLTADWLQGVLLVTLFKEPQPEELEALRRTLGQLTTAPAWAASQGRHLVLQHRYRPDSACEWLSGEPLETWDIVENGLRFRLDLGRNQNTGLFLDMRLGRRWVQEQAAGRRVLNLFAYTCGFSVAAIAGGASQVVNLDMARGPLNRGRDNHRLNGHDLGRVSFLGHELFKSWGKLRKLGPYDLVIVDPPSFQKGSFVLTQDYRRILRRLPELLVPGGTLLACINDPAIGPDFLLEETAREAPSLHFVERLENPPEFPDVDPAAGLKALLFRNAG

SEQ ID NO: 19190 - protein, 212 aa, Zymomonas mobilis subsp. mobilis ZM4
MSPENDIRLEAGRKLFAGAVNFLKSAPALEFLPAPTAPEVAFAGRSNVGKSSLINALTNRNSLARASTTPGRTQELNFFDVGEPLQMRLVDMPGYGFAKAPKDVVKRWKWLINDYLRGRAVLRRSLILIDSRHGIKDVDRDLMKMLDDAAISYRVVLTKSDKIKAVELEKTVKAITEEMRKHPAAFPEIIATSSEKGTGIAELRAAVYDAII

SEQ ID NO: 19191 - protein, 374 aa, Mycobacterium sp. KMS
MESRPGPGHAPLTKPVRLPPARLARIVETLRTALHRVRFKVVPPFAGILDLTMGFAVAQAIYAAARLGVADVLRDGPMTAADVADRVHADPSAVHRLMRVLAAHQIFRERRDGPFEMTALSQALCSDAAVSIRPLLLMLSHPFYWQHFGRLTDVVRTGRTSLETEYGKGLFECLDEDPEVARVFNDAMSCVTAMSIPPVLAAYDFSRFRTIIDVGGGDGHMLTAILEVATASRGVLFELPALAEQARETVRSVGLTDRATIESGSFFDHVPRGGDLYVLKHVIHDWRDDRAREILRHVRDAMSPRAVLLLVETVIPPGNGMHFGKLLDLDMLIFAGGRERTRAEFSSLLFETGFHLDRIVPTVTHLSLIEATAC

SEQ ID NO: 19192 - protein, 328 aa, Hyphomonas neptunium ATCC 15444
MSKKQDYRFSVAPMMDWTDRHCRAFHRTLTKRALLWTEMVTADAVIHGDRQRLIGFSDVEHPLVLQLGGSEPGKLAEAARIAEGYGYDEVNLNCGCPSERVQSGAFGACLMAEPDLVADCVAAMRAAVSIPVTVKNRIAIDDLPARETLFTFIEKVSVAGCSVFTVHARKAWLKGLSPKENREVPPLDYGLVAELKTARPDLTIILNGGIATIDQCRDHIGVFDGVMLGRAAYQTPGLLGQVDSDLFGEGAMIAAGDAVRAYEPYIAARLAEGSNLHAMTRHMLGLFAGQPGARQWRRILSEQGVKKGAGLDVLRAALGAVENPAMAG

SEQ ID NO: 19193 - protein, 302 aa, Cytophaga hutchinsonii ATCC 33406
MHQSPLQPIILPQTEKAGVQLYLKRDDLIHPLYGGNKIRKLKYNVQQCLREGKIGLLTCGGAYSNHIIATAAYGKEHGLKTKAIIRGEELLIDNPTLKDAAALGMEFVFVSRETYRSIREQNALAFDLSKSNYNEWYFIPEGGTNAFAVEGIAELVAEIEIPFDYIATPCGTGGTFAGLMKGIKVYSPWRTKLLVFSALKNGNYIIDEVAELLKADFDRTTLELFTSEYVFGGYGKVKPELIAFVKSFEHQTGILLDPIYNGKMMFGLLGKIESGYFKKGSVIVAIHTGGIQAWRGFNNNFT

SEQ ID NO: 19194 - protein, 391 aa, Burkholderia pseudomallei K96243
MKALCWHGKHTVRYETVADPAVEDPRDAIVEVRACSIGGADLHLYDAVIPGLKDGDVLGRECVGEVVEIGAGVSRRRVGERVVVPFAIACGECDQCRRGNWSVCETTNPHRALADKVFGHATGGLLGCGHLAGGYPGGQAQYVRVPHADVAPATIPDGVDDERALFVGDSLATGWQAAAQCEIEPGNVVAVWGAGAVGLFAAMSARLLGAAEVIAIDRVPERLALAQKLGATPLDFERLGVADTLAERTRGKGPDKCIDAVGLEAQAGEALDAVTDRFRPTVAAGADQPHVLREMIYACRPGGVLSVPGVYGGLVDKLPMGALMHKGLTLRAGQTHVCRWTAGLLERIADGRLDPSCVITHRATLEEGPAMYETFGARRDGCIRPVLRPRH

SEQ ID NO: 19195 - protein, 229 aa, Medicago truncatula
MLRCLDGLKNLCVGVVNWCNSEVSGSKPPPSGLENPEEISRITVFSVSEVEALYELFKKISSGVVDDGLITKEEFQLALFKTSNKRSLFAERVFDMFDTNSHGVLDFKEFASALSIFHPIAPIDDKIDFLFRLYDLKQQGYIDREQLKQMVVATLSESGMRLTEEMLNSIMDKTFEEVDTNHDGKIDREEWKNLAMQQTSLLKNMTLPYLTEITTTFPSFIFHTQVDDD

SEQ ID NO: 19196 - protein, 512 aa, Rickettsia prowazekii str. Madrid E
MTINASNIENSFSKINSHFSKLTDYIWPIKRHEISKFLFITLLMFCILFIQNLIRALKDSIVTTMIGAETISFLKFWGVMPSAFLITVIYVKLVNRMKAENIFYLIISIFLTFFALFAYVIFPNHEMLHLRPVTVHNLTASLPNLKWFILLLSKWSFSLFYIIAELWPNVVFALLFWQFVNNITTVEESKRFYPLFGLLSQTGIYLAGHFLENLSNINYYVTNKFALQSSFHTLSIQIILTIVLILGIVSIKTFWLLNHKVLDKKHMALLRFKTKNKSITIAKSFQMILSSRHIRLIATLLICYGIAINLVEGPWKAAATKIYKTPTEYAAFIGSYLSYTGVFTIFFVLLGSNIVRRMGWFTSAVITPSIVFITGILFFAVNNFEGFAGLIIANFILTDPALVAITIGAIQNVLSKSSKYTLFDSTKEMAYVPLEPEIKISGKAAADVIGTKLGKSGSAFLQSLIFIILPSASYQSISICLMIIFILTCVTWIWATKELNKEYKNSIKFSQK

SEQ ID NO: 19197 - protein, 182 aa, Methylococcus capsulatus str. Bath
MALMKVSSGRQVPEDIHVVIEIPAFSDPVKYEVDKETGALFVDRFMGTAMQYPCNYGYVPHSLSEDGDPVDVLVIAPCRLLSGSVVRCRPIGVLKMEDEAGSDAKVLAVPVDKLSSLYSKVKSYRDVPEPQLAQIAHFFEHYKDLEPGKWVKINGWGDIDEARREITGSIERYNQAKEKPYF

SEQ ID NO: 19198 - protein, 435 aa, Kineococcus radiotolerans SRS30216
MSEPATVSQRLDALPFTRRHTRLLLGSGVGWALDALDVGLVAYVLVALRQQWGLDAAQLSWIASVGFAGMAVGAALGGLLADRVGRRQVFALTLLVYGLATGAAALSWSLTALLVFRFLVGLGLGAELPVASTLVSEFAPRRIRGRVVVALEAFWAVGWTLAALIGYLLVPASDDGWRWALALGALPAVYAIVVRRGLPESVRFLLAKGRTAEAEAVVRDFEASAGVTSTAPLVPDPPAGARRGIWSAGLRRRTAGLWLVWFFVNFSYYGAFTWIPSLLVEDGFTVIRSLQFTLIITLAQLPGYALAAVLVEVWGRRRTLAVFLVGSALSALAYAGAGTTTTILLAGMALSFCNLGAWGALYAVTPEVYPTAVRGRGAGAAAGFGRIASILAPLSVPLLLDAGGSGAVFVVFGVAFAIAAAASFLLPERRGVALD

SEQ ID NO: 19199 - protein, 329 aa, Azoarcus sp. BH72
MKRLKIAVLGAGAWGTALAQAFADTHEAVLWGRDAAHIDATRHAAENTRYLPGVALHPQLALTADLPAAALGADLHLVVTPLAGLRDTLRLLNDIQPDTPVIWACKGLEAGSGKLPHEIVADELGATPCGVLTGPSFAAEVARGLPAAITLAASDVEFARHWVHALHRPRLRLYANADVVGCEIGGALKNVMAIAAGVSDGMGFGLNARAALITRGLAEIARLATAMGGHAETLMGLAGMGDLILTCTGDLSRNRRVGLALAAGNTLSDILRDLGHVAEGVSTAHEAVRLARRHGVEMPICEAVDALLHGGLAARDAVERLLARDPKRE

SEQ ID NO: 19200 - protein, 478 aa, Neptuniibacter caesariensis
MLKRTKIVATLGPSTDQPGVLEDILRNGVNTVRLNFSHGSADDHKRRAEEVRQASRKLGLSIAVLGDLQGPKIRIARFKEDRIQLAVGDRFALDADLGNNDGDQSQVGIDYKALPADSSPGDILLLDDGRVQLKVVEVQGNRIDTEVIIGGPLSNNKGINRQGGGLSAAALTEKDRRDIKVAAEIDMDYIAVSFPRCAADLLEARELLNAAGSRAEIVAKVERAETVASTEALDEIILACDGIMVARGDLGVEIGDAELIGVQKHLIQRSRELNRFVITATQMMETMIENPMPTRAEVFDVANAILDGTDAVMLSAETAAGKHPVEVVKSMTSICQGAEKHQLSRPAPTNISQKLERFDETIARSAMYTANNLAGVKAIICLTESGSTPLWMSRIRSGLPIYALTRNERTMRRTALYRGVEPIFFDSTRIDKDKLNEEVLAGLKARNLLQTGDLVILTRGASLGEDGGTNSMQVLAVQ

SEQ ID NO: 19201 - protein, 706 aa, Colwellia psychrerythraea 34H
MPHRIMLIPVGSGVGLTSVSLGLLHACQQKGIKVGHFKPISQPSRNSLAKKNKTIDAISLSQNSTSVSLSYVEGKMGDGLHDVVLEEIVANFNAFKEDHDVIIIEGLVPTPRQPYAGRINRDVAQALGANIVLVASPGNDSAEEFEDRLEVSAETYGGIKNRHLIGCVINKLNCPDQEEFGLLPKEEEIENDFNLNHWLDLSIFKGRHFDLLGTVQWEIDLIAPRVCDISNYLEAKVINNGDMEHRRFRSVAFCARTVSNLVSYLVPGRLIVTPGDRTDIIIAACLSALNGTKLGGLILTNGFEPSEQVWELCKQALDAGLPVLSVPWDTWQTSRHIMGFNPEIPKDDIQRQDKVKQHVADNLSSSWLESLTSKNNSYNLLSPPAFRHKLTELARQANKLIVLPEGTDIRTIKAAAICCERNIARCQLIGNKEEILQIAEHQGINLPDNLLITDPDSIRDNYVGPMVELRKNKGLTDVIALENLKDNVVLATMMLQLGQVDGLVSGAVNTTANTIRPALQLIKTAPDSSLVSSVFFMLLPDQVLVYGDCAINPEPNAEQLADIAIQSADSARAFDIEPRVAMISYSTGRSGHGADVEKVAKATEIAKAKRPDLIIDGPLQYDAAIMENVAKKKAPNSPVAGKATVFIFPDLNTGNTTYKAVQRSADLVSIGPMLQGMNKPVNDLSRGALVDDIVYTIALTAIQATM

SEQ ID NO: 19202 - protein, 282 aa, Medicago truncatula
MDKFCCLKSSFSKLVSTRSSCSTGKGKNHEGSIKYGFTLVKGRANHPMEDYHVANFVQVQGKELGLFAIYDGHLGDQVPSYLQKNLFSNILKEGAFWDDPAASISKAYLNTDQAILSHSSDLGRGGSTAVTAILINGQMLWTANVGDSRAVLSRKGQAVQLTTDHEPNTERGIIENKGGFVSNIPGDVPRVNGQLAVARAFGDKSLKSHLRSDPDVHSTDVDVDIDFLILASDGLWKVMANQEAVDIARKVKDPLKAAKQLTAEALKRESKDDISCVVVRFR

SEQ ID NO: 19203 - protein, 640 aa, Neptuniibacter caesariensis
MIQFQQVSLQRGHNLLLEQADLTLHSGWKIGLVGANGAGKSSVFKLIMGELHCDNGDLDLPGGLRISHMAQEVPTSERTALDYVLDGDHQLRQIQQQISDAEAAHDMHRLGELHAELDSHNGYSAESRAAQLLAGLGFSHQDISRSVKEFSGGWRIRLNLAQALMCPSDLLLLDEPTNHLDLDATIWLEQWLRQYPGMLILISHDRDFLDNVVSHITHVEHKKLNLYKGGYSAFELQRADRLAQQQAAFEKQQQRIGEIEDFVRRFRAKATKAKQAQSRIKELERMEKIAPAHVDSPFSFHFRASDKMSSPLLTLYQADCGYTDKAILNKTSLTLVPGMRIGLLGPNGAGKSTLVKTLVGDLGLCSGDRHESENLQIGYFAQHQLEALDMAASPLLHIKRISPKASEQEIRDFLGSFGFFGDRALEPVENFSGGEKARVALSMIAWQKPNLLLMDEPTNHLDLEVRHALTLALQTFEGVLILVSHDRHLLRNTVDEFLLVANGEVSEFKGDLDDYQNWLLEQKREAQRAEAEAFAKPTEDKKSLSAAERKEQKRLAAERRNQLRPLKKKLEKLEAAMETFHEKLSEVEETLSDASIYEEANKEQLKAVLQQQAELKQQAEQTEEEWMEQQEALEALEAEL

SEQ ID NO: 19204 - protein, 135 aa, Vitis vinifera
MQPVGSSDKIRHIVRIRKMLRRWRRKAASVPSDVPAGHVAICVGSGCRRFIVRASYLNHPVFKALFLEAEEEYGFANHGPLAIPCDESVFEEVLRVVSRSESSHPPRLTIGDDFQRRCHVESRPLLHGFAEKSIC

SEQ ID NO: 19205 - protein, 149 aa, Vitis vinifera
MWTPHVRLKKIPYHFLLFVIFFSYQRSRKCFVDGGGWLHVVIRVPSDVPAGHVAICVGSRYRRFIVRASYLNHPVFKTLLLQAEEEYGFANHGPLAIPCDESVFEEVLRVVSRRESSLSPRVTMVDDFQRSCHVESRPLLHRFAENSIC

SEQ ID NO: 19206 - protein, 430 aa, Triticum aestivum
  misc_feature (221)..(221): Xaa can be any naturally occurring amino acid
MQPLLGLALLALLLLASPAPALCRHRAPAAAAATETLDVEASLSRARAAVSTDALPLHQSLAATDTDTNVLVKDEPSGGPSGRLALRLHSRDFLPEEQGRHESYRSLVLARLRRDSARAAALSARASLAADGVSRADLRPANATPVFEASAAEIQGPVVSGVGQGSGEYFSRVGVGRPARQLYMVLDTGSDVTWLQCQPCADCYAQSDPVYDPSVSASYAXVGCDSPRCRDLDAAACRNSTGSCLYEVAYGDGSYTVGDFATETLTLGDSAPVSNVAIGCGHDNEGLFVGAAGLLALGGGPLSFPSQISATSFSYCLVDRDSPSSSTLQFGDSEQPAVTAPLLRSPRTNTFYYVGLSGISVGGEGLSIPSSAFAMDDAGSGGGSGTPGRPRTPNLPGRTLHRRKGSQRGREVLRSGGRESLSRSLSGKLA

SEQ ID NO: 19207 - protein, 304 aa, Arabidopsis thaliana
TGAKFPSVGLGTWQASPGLVGDAVAAAVKIGYRHIDCAQIYGNEKEIGAVLKKLFEDRVVKREDLFITSKLWCTDHDPQDVPEALNRTLKDLQLEYVDLYLIHWPARIKKGSVGIKPENLLPVDIPSTWKAMEALYDSGKARAIGVSNFSTKKLADLLELARVPPAVNQVECHPSWRQTKLQEFCKSKGVHLSAYSPLGSPGTTWLKSDVLKNPILNMVAEKLGKSPAQVALRWGLQMGHSVLPKSTNEGRIKENFNVFDWSIPDYMFAKFAEIEQARLVTGSFLVHETLSPYKSIEELWDGEI

SEQ ID NO: 19208 - protein, 515 aa, Alkaliphilus metalliredigens QYMF
MAEHKLEELRQQKSKIQEGGGEKRIAAQHEKGKLTARERVNLLFDEGSFVEIDGFVKHRCVNFGMETVDAPGEGVITGYGTVEGKLVYTYAQDFTVVGGSLGEMHAKKICKVQDMAVKMGAPIVGMNDSGGARIQEGVDALSGYAHIFYRNTIASGVIPQITAIMGPCAGGAVYSPALTDFIFMVDQSSQMFITGPQVIKTVTGEEVTSEELGGGMTHNRISGVAHGVANNDEECILEIRRLLSFLPSNNMEGAPVFETEDDINRIIPELDDMIPDSPNKPYDMKTIIEMLADDGDFFEVQPYFAMNIITGFIRINGQSVGVIANQPKVLAGCLDINASDKAARFVRTCDCFNIPVLNIVDVPGFLPGKGQEHGGIIRHGAKMLYAYSEATVPKITLIVRKAYGGAYIAMCCKELGADLVLAWPTAEIAVMGAEGAANIIFRNEIKDAEDPQALRAEKIANYKQEFATPYKAAERGYVDDVIEPSSTRPRLVSALNMLASKRDSRPSKKHGNLPV

SEQ ID NO: 19209 - protein, 381 aa, Aspergillus nidulans FGSC A4
MLGTTGLLALLSLASATTVIPRQTSSDSTACNNAASLCSKSYGDITHLGAHDSPFLRDESTGNSISGNQYYNTTVQLDAGVRLVSAQVHDSDSQWRLCHSSCDLLDAGRLRTWLSEIKSWLDSNPNEVVTVLLVNSDGATASDLAAEFEAADITDYAYTPTSQSAPSSWPTLQELIDAGTRLMTFVASLDDNSGATYLMDEFTYIFENSYDVTSPSNFSCTADRPSSVKGNAASAISANMLPLQNHFLYQTILLDYQAPNESYVGTTNAPSGGEGNLGDAASTCQTAWGRQPAFILVDFFDKGPAIETVDKLNGVTNPVGRTNITAVAEDEESSASTYSNVFKGLVDLVRSAQAGASTSMGDWIWAGGDWGEILGGGIALS

SEQ ID NO: 19210 - protein, 377 aa, Rheum australe
MADVAMQNPAPVAGQIPDFPTVSTYGGQFIQYNIFGNMFEVTAKYRPPILPIGRGAYGIVCSVLNTETNEMMAMKKIANAFDNYMDAKRTLREIKLLRHFDHENIIGLRDVIPPPLRREFTDVYIATELIDTDLHQIIRSNQSLSEEPSQYFLYQKLRGLKYIHSAHAIHRDLKPSNLLINSNCDLKICDFGLARPTFENEHMTEYVVTRWYRAPELLLNSSDYTSAIDVWSVGCIYMELMNRKPLFPGRDHVPQMRLVTELLGSPLESDLNFSEGGCGEIFSPNAPTTSSAVARVFPHINPMAIDFIERMLTFDPTRRITVEESLAHPYLARLHDAEDEPICPETFSFEFERHTMGEEEMKEMIYQESIALNPELA

SEQ ID NO: 19211 - protein, 620 aa, Bradyrhizobium sp. ORS278
MTTDTPRPHRNPQHWASAAMPPLQRFLSACHADFWPDHDGAVANYIPELGKADPAHFGISLATLDGHVYEVGDSRVPFTIQSMSKPFVFALALDILGSDAVERVIGVEPSGDPFNSIRLNADNHPFNAMVNAGAIACSGLVRGARHADAFETIRDALGRFAGRKLDVDDAVFASEAATGDRNRAIAYLLRTSGVISEPVDDVLAVYFRQCAVLVTARDCAIMAATLANRGVNPVTGEQVVTPYAVSRTLSVMTSSGMYDFAGEWIYRVGIPAKSGVGGGILASLPARLGLGSYSPRLDGHGNSARGIKVCEALSAHYGLHMLNRSDDARTTIIADYDIGASPSRRSRRTQEREILAAHPDAVRVLELVGTLSLSNVDYVSRQLAAGERPQFVIFDLHRVTAMTPAGLRLLAELFHELADFHVTVVLSGLRRTSPEWQEITARTGDIRNVRDFYLLDTAIEWAEDQIVYRYGGAIDFLETTELAEQPLLAGLSADERHELAALATIRHYQQSERILSAGEAASSLFFLRSGVVHVTLPDGIRLATLTAGQCFGEMALLESARSADVTADFSATAFEIALDDFERFRARHPRAGERIMRNLAQLLAERLTIANARLNLLAAD

SEQ ID NO: 19212 - protein, 223 aa, Brassica napus
  misc_feature (204)..(204): Xaa can be any naturally occurring amino acid
  misc_feature (215)..(215): Xaa can be any naturally occurring amino acid
MWCLPSVRPNVSEMFKCSSLRRFHSPILKQPTSAGFSTTSSSPYLPPLFSVAPMMEWTDNHYRMLARIITKHAWLYTEMIAAQTLVHQQTNLDRFLAFSPQQHPIVLQLGGSNVESLAKAAKLSHPYGYDEINLNCGCPSPKVAGHGCFGVSLMLNPKLVGEAMSAIADNTNVPVTVKCRIGVDDHDSYDELCDFVYKVSTLSXTRHFIVHSRKXALLGGISP

SEQ ID NO: 19213 - protein, 519 aa, Bradyrhizobium sp. ORS278
MSWQPELEELARREAFAREMGGPDKVKRQHDQGRLTVRERIDGVVDPGSFHEIGAVAGLGEYDEQGELKHVTPANCVFGRARIDGRTVVVVGDDFTVRGGSADASIAAKPLMAEEMAHDFRLPIIRIIEGSGGGGSVKTIETKGAANLPGGIGGNRWYRYTTENMSLVPVIGLGLGSVAGLGAARLAASHYSVMTRQSAMFVAGPPVVKRLGQDLGKMELGGADIQTKAGGVDHAVDTEAEAFACARRFLSYLPSSVYDLPPTLPCTDDPQRSDELLISAVPRDRRRVYKMRPIIESVVDSGSFFEVAQNYGRPLIVGLARLEGRAVMVLASDPYHFGGSWTADACQKVIRWVDFAETFHLPIVYLMDCPGFMVGLEAEKAATIRHGVRAMAAVNQSTVPWCTVIVRNSFGVAGVVHQPADRFSIRYAWPSAYWGSLPLEGGIEAAYRAEIDAAPDPKAKLKEIEERLNKLRSPFRSAEKFWVEEIIDPRKTRALLCEFARLAEPLRTPGPPAAMTTRP

SEQ ID NO: 19214 - protein, 310 aa, Vitis vinifera
MEHSAGFEVHKSVSEKRNLTWIDEMDNFLVDRLMEQMHKGQKIGGVFTKTAYAMVAREIGENFELSCNSEHIKNRMKTLKKNFYAAQEVLQNGSGFGFNESTQMIEATTEVWTTYTKAHPGASQLRHKPIRNYDKLSILLGKDRATGSLAAGAKERQLRWAQEQNLDDTIPLGSSQHGIRDETFAYVENEATTETSFSSADASVSAPKSNKETKKRKAKYADIVSEELRSIRVGMDAVVAALDRSNLQNYTEEQLFEEIAKVGGMSDVSHMKAYQALTGDVSAARAFLACPIDRRKLWLSVKFGPTFFDA

SEQ ID NO: 19215 - protein, 488 aa, Mycobacterium smegmatis str. MC2 155
MADPRGFLKHTTRELPKRRPVDLRLKDWKEVYEDFDHAPLQTQASRCMDCGIPFCHNGCPLGNLIPEWNDLVYRDRWRDAIERLHATNNFPEFTGRLCPAPCEAACVLGINQDPVTIKQVEVEIIDHAFDQGWVVPKMPDVQTGKKVAVVGSGPAGLAAAQQLTRAGHTVTVFERADRIGGLLRYGIPEFKMEKRHIDRRLEQMAAEGTQFRPNVNVGVDITVAQLRLNYDAVVLAGGATAWRDLPIPGRELDGIHQAMEFLPWANRVQLGDPVTDENGQPPITAKDKHVIIIGGGDTGADCLGTSHRQGAASIHQFEIMPRPPETRADSTPWPTYPLMFRVSSAHEEGGERVFSVNTEEFIGENGHVTALRAHEVKMNAGKFEKVEGTDFELKADLVLLAMGFVGPEKEGLLDKLGVELTDRGNVKRDDNFQTSVPGVFVAGDMGRGQSLIVWAIAEGRAAAAGVDRYLMGRSALPAPIKPTAAPQR

SEQ ID NO: 19216 - protein, 422 aa, Zea mays
MGAKRAVLVGINYQGTKAELKGCHNDVARMRRCLVDRFGFDESGIRVLIDDGSAPQPTGANIRRELARLVGDARPGDLLFFHYSGHGIRLPAETGKDDDTGYDECIVPCDMNLITDQDFTELAQKVPSGCLFTIVSDSCHSGGLLDKTKEQIGHSTKQKQKQTQTQTQSRELEERSPSGTSFREFLKGTVREAFESQGIHLPHRSRSHQQGSGHGDDGDQESRYINTADAHVKNRSLPLSTLIEMLKEKTGKDDIDVGSIRLTLFNLFKDDASPKIKKFMKVMLNKLQQGQHGGIVGFMGALAQEVLKAKLDGKEEEEFDPAMKQHVHSDQEVYAGTTARVPSNGVLISGCQTDQTSADATTPKGVSYGALSNAIQAILAERGTVTNKELVLKARKMLSKQGYTQQPGLYCSDENASAAFIC

SEQ ID NO: 19217 - protein, 298 aa, Bacillus anthracis str. Ames
MPNIAVVGSISMDLVAVSKKRPKAGETVIGEAFHTIPGGKGANQAVAAARLGANVAMVGAVGDDNYGTVVKRNLENERVFIDYVVPVTDAATGIAHIVLAEEDNSIVVVQGANALVNESVVNRSKDLLIKADMVVLQLEIPLETVKYVLAICQEHKIPVMLNPAPAQVLSEDILEKATYITPNEHECRIVLDDFTSPIEDLLAKYPNKLLMTEGSNGVRFHNGTEIVHVPSIAVDVVDTTGAGDTFNGALAVALSEGETLQKAIRFANIAGGLSVTKLGAQGGMPTRDRVREVQVIVG

SEQ ID NO: 19218 - protein, 468 aa, Coprinopsis cinerea okayama7#130
MAHLTLDITLDAAILDVLTGPQPPAKTLKTQLPRRDAALDPLLIAAAAASGPHVTRNHYHHDFYPGALQDVARDCTKWSGKLAYVSRQAPRRQRLSIDQGKENESYRREVSEPQPLQSTENLPSRKRRSSLVAPSNASEGRTRSKSITATEPPPSTKMPPRLQVKCMARTRIPTPHGPAFLHLYHNNRDNKEHLAIVVDPSQLDQSAPSLPPIRSRSLDSVWSENETEMDRIIRGAYVGRLSPTYQKASDPSINTPQSTPSDLPPPLIRIHSECFTGETVGSMRCDCGEQLDEAIRQISNPINSQIPGRGAVIYLRQEGRGIGLLSKIRAYNLQDMGHDTVTANLMLGHKADERGYEIAGAILKDLGLGCGENASCSESVRILTNNPDKMEALRKEGIQISERVPMIPRSWQQRSQTEETVVKQETLGLTLIGGKAVHGDDLDKYLRTKVVRMGHMLPLWFEEASQAL

SEQ ID NO: 19219 - protein, 585 aa, Fusarium oxysporum
MGNTNSSPFNLGDLGQLSQLQTNGESSYGTFDAPDLPTFLTDNPTPNGYPWSTMNSQTNYYQDQPNTGVIRRYDFTVSRGMIAPDGYELSTILVNGQFPAPLIEANWGDTIQVTVHNDMDDEGVSLHWHGILQKGMPWEDGVPGVTQCPIPPKKSFTYQFLADLYGTSWYHSHYSAQVAAGLFGPLVIYGPREKKDYDIDIGPVMLSDWYHKEYFDLVEEIMKPGGNGVVLSDSNLINGKMNFNCSSVAPGDKTPCKSNAGISKFRFKRGKVHRLRLINPSAEAIQRFSIDGHTMKVIANDFVPVQPYDTKVVTLGVGQRTDVLVRADGKLDSYWMRSNISAICSLGRAPAALAAIYYDNTNQKKAPKSQAWDIPDPGTCANDDLSITKPVMKLPLPPADKTIELDISSFKNASNVTLWTLGGVAARINYNSPTLLLSKLGNHTFEPEWNVINTGKAKSVRVVVNNKTPVAHPMHLHGFNMYVLHEGPGSWDGTIINRHNPQRRDVVQIRGNGHLVIQFDAGENPGVWPFHCHIAWHVSAGFLTQFLTNPDQVKKLRIPNVVAETCRQWGHWTLSNIPAQIDSGL

SEQ ID NO: 19220 - protein, 533 aa, Pseudomonas aeruginosa UCBPP-PA14
MTTCGEFLVKQLEAWGVETVFGIPGVHTVELYRGLPGSRIRHVTPRHEQGAGFMADGYARVTGKPGVCFIITGPGMTNILTAMAQAYADSIPMLVISSVNERARLAHGNGYLHELPNQRNLVGNVCAFSHTLMSAEELPAVLARAFAVFDSERPRPVHIELPLDVITAPAEHLALRPRTVASRPAPALAPLREAAARLRNAKKPLLLLGGGCVEAAAEARALAAALDAPTALTINAKGLLPADHPLLLGSNQSCVPVRELAAEADVVLAIGTELGETDYDVVFDGGFALDGELIRIDIDPQQLMRNYTPSLAIHSDARLAMRVLLAELPGGEASPDSPGARRAAAVRQRLAEDFAGWSHYRQLFAAILAEWPDARFVGDSTQTVYSGNHLVDLDEPRRWFNASTGYGTLGYGLPAAIGAKLGEPGRPVVSLMGDGGLQFTLPELASAVEAKVGIVVLLWNNHGYGEIKRYMERREITPLGVDIYTPDFLAIARGFGCAAERARDLEHLRELLRGAPADRPLIVEVLQAAPFHP

SEQ ID NO: 19221 - protein, 640 aa, Fusarium oxysporum
MWITDACKAVVLSFVAVFHYPSVSDEGPHQDVMTFTHGHSTPKIDYPYFDSPSGPDQDGKVFTCNYTDLKGWKPCTTADDRSCWLKGPYGQNFTINTDYENFWPIGITREYHLNVTDQSINGDGVDNPFGKVFNGKYPGPWIQACWGDLIKVTVHNHLKYNGTTIHWHGLRQLETFEMDGVNGVTQCPIAPGDSYTYTFRAVQYGTSWYHSHYSLQYADGLAGPITIYGPSSAPFDEGRNPILITDWSHRSAFQSWQRELVPNPTRPMMNGVLINGVGNFAGSFPRERFNMTVTKGRKYVLRVINTSVDTTWIFSIDNHNFTVMSTDFVPIHPYSVSHIVLGIGQRYHIVLDANPTNTTKMPANPDGNYWIRTVGATRCKGFEPGNEPDERQGILRYNASSKLVPTTFREDYSLECRDEAYDRLSPVYEWNVDPVKINYTKSQFDIGLAKFAHRPELMDNFTWWAFGENPLWLNFSNPTILNLKNTTWNPDYAVDLVVPDSKKDKWVYIAITAPPAPIQTKPNRAFAPVAHPLHLHGHDFALLAQGTNFSDLDTGKVNLKFNNPPRRDVALLPAGGYLVVAFKADNPGSWLFHCHIAWHASSGLAIQILEQQTVCDNWNKWFKNDTNLWNAHIFQDDSGI

SEQ ID NO: 19222 - protein, 566 aa, Fusarium oxysporum
MKLLQFLPAGVLCLSQVYARSPLHQLNRRACSGNTASTRSEWCDYSIDTDYSTEAVDTGVTREYWLELTDVTVAPDGYSRSAMAVNGTIPGPTLFADWGDTVVIHVTNSLSTSLNGTSMHWHGIRQNYTNQYDGVSSITQCPLAVGESVTYTWKATQYGSTWYHSHWALQAWQGIFGGIIINGPATADYDEDLGMVFLNDWDHQTVDELYSSAETNGPPTLDNGLINGTNVYGDDDSSSQTGTRFNVSFESDTSYRMRLVNAAVDTHWKFSIDNHTLTVIAADLVPIEPFETTVLDLGMGQRYDIIVTADQADVADNFWMRAIPQAACSDNDSTDNIKGIVYYGDSPGTPSTTAYDYTDGCDDETDNIVPYISKTVEDANWNNLETATVGKNTAGLFKWMLNSTSMLVDWANPTLAQVLNDTTDFETDDAMIELSEGNQWVYFVVETALPVPHPIHLHGHDFFILAQGTGTYSSSITLNTDNPPRRDTAMLPANGYLVMAWETDNPGVWLCHCHIGWHTSEGFALQFLERSSEIANISTSSYVSDVCDGWSTFQSESLIEQEDSGV

SEQ ID NO: 19223 - protein, 441 aa, Ralstonia solanacearum
MTGKATRIDLFSLRTPQMRAFHLTWLAFFVCFYAWFACAPLMPVLKGEFHLTPGQIANINIAAVAVTILVRLIVGPLCDRFGPRKTYTGLLVIGAVPVLGVALAQSYEAFLFFRLAIGAIGASFVITQYHTSVMFAPNVVGTANAAAAGWGNAGGGVAQGTMPLLLTAIVMLGVTQGLGWRIAMVVPGVAMLIVAALYWRYTQDCPEGNFDDLRAAGKTIEGGKKGGWGSFVTAAGNYRVWLLFVTYGACFGVEIFIHNIAATYYVDRFGLSLSAAGMAAASFGLLALFARALGGIVSDRVARRRGLDARAQLLCVLMLGEGLGLLGFAHAGTATMAVLAMLGFGLFTHMACGATYALVPFIDRRALGGVAGIIGAGGNVGAVAAGFLMKGLGDAQQTLSVLGVLVGLSALCAVAVRFSAEHKAREQALYDNTLAASAANV

SEQ ID NO: 19224 - protein, 607 aa, Fusarium oxysporum
MYFSLSSLIFLPLLLQSFITSVSATYWNNTKKFDLTITWENYAPDGFSRKMLLVNGQSPGPVLEINQDDLVVVKVHNQSPEELTIHYHGTDKLGLEMKGTPWTDGVPGVTQHPIKPGCSFTYKFHATQYGSFWYHSHHRGQIEDGLYGAIIIHPRPHEPNPFHLISDDKETLREIAKATKHVKPVVISDFVHLTSTEKWDMTVAAGIEDSCYDSILFNGKGRVECLPKDVVEANLNEIQKSYLELVPGGADCLPASALNAIAGGLGNEEALLPGTFSGCKETEGQIEVIRVSNKHHSSSKWVAFDIVAAVNFVNGVFSIDGHDVWVYAMDGSYIQPQKVQAIAATNGDRYSILVKIEKSGEFKMRFNSNSAPQIITGHAILSVEGFGYAQEVEPWINLVGIPVSKDVVVFNQMVAFPYPPVSISPTADVTFNLSMEIRGASYLWALNSTGLMSKDLDEQRPTLFNPQPYVHNNVTISTKLGQWVDLVFVAAMFPQPPHPIHKHGSKMYMLGTGTGPFRWSSVEEAAKEIPDQFNLINPPRRDAFLSAPADKEPSWVVVRYHAADPGPWLLHCHINNHMGGGMMMVIQDGVDAWPEVPEEYAEGGDGE

SEQ ID NO: 19225 - protein, 271 aa, Burkholderia pseudomallei K96243
MKCTLKPIGEQTIVITGATSGIGLVTARKAAKKGAKLVLVARNDTALEALCEEIRQHGGLAVAVAADVSRYEDVQRAAAKAVETFGGFDTWINNAGVTIFGSALSVPLDDQRRLFDTNYWGVVHGSLVASEHFRRQSDFRGGAIINMGSEASDAPVPLQSAYAASKHAIKGFTDSLRIELEADNVPVSVTLVKPAAVDTMFVMHAKNYMNVEAKLPPPIYDPDIVADAILFAAEHARRTLFVGGAAKLASSGAYHAPRLFDRLATSLFSRG

SEQ ID NO: 19226 - protein, 546 aa, Fusarium oxysporum
MRILRLALLPAALAATVSYDFSIDWVRANPDGAFERSTIGINREWPIPRIEASIGDTVLVYVRNNLGNQSTSLHFHGLFMNGSNHMDGPSQVTQCPIQPGESFLYNFTITQPGTYWYHSHTESQYPDGLRGPLIIHDSKSPFKGKYDEELIMTISDWYHDQMQTLIPEFMRKGNPTGAEPVPQAALMNETQDLKVPVQTGKTYFLRLANIGAFAGQYFWIEGHNMTIVEVDGAYTKPAQANMVYLSAGQRCSVLIATKDDASANFPIVASMDTDLFDVLPDDLNWNVTGWLVYDEEMPLPKQSVVYDFDPYDDMDLVPYDEMVRLPEPSRSIELDVIMDNLRDGANYAFFNNITYRAPKVPTLYTALTSGKQATNPQIYGTYTHSFVLEKDEIVQLVINNRDDGRHPFHLHGHHFQVLHRSDDDAGDFDGSVEFAETPMRRDTVVVNGNGNVVLRFKADNPGVWLFHCHIEWHVTSGLIATFVEDPLALQASLKLPQNHLDACKAGNIPTVGNAAGNTDLLDLSGENVPPPRLPEGYVPQSLMRHR

SEQ ID NO: 19227 - protein, 309 aa, Hypocrea jecorina
MVATSFKLNNGLEIPAVGLGTWQSKAGEVKAAVSYALQIGYKLIDGAYCYGNEDEVGEGLKEAFAAGVKREDIFVVTKIWATYNTRVVLGLDKSLRSLGLDYVDLLLVHWPVLLNPEGNHDKFPTLPDGKRDVIWDYNHVDGWKQMEAVLATGKTKSIGVSNYSKKYLEQLLPHATVIPAVNQIENHPSLPQQEIVDFCKEKGIHIMAYSPLGSTGSPLMSADPVVKIAEKKGISPTTVLLSYHVNRGSTVLAKSVTPARIKANLEIVDLDDEDMKLLNDYSNDLASKGELKRYVYPPFGIDFGFPDKS

SEQ ID NO: 19228 - protein, 435 aa, Physcomitrella patens subsp. patens
SKPHKSNDINWEAIQALRARDGSLGLSHFKLLRRLGCGDIGSVYLCELRGMDCYFAMKVMDKSALATRKKLSRAQTEKEILASLDHPFLPTLYAHFDTAQFSCLVMEYCSGGDLHSLRQKQAGKCFSDMAAKFYAAEILLALEYLHMMGVVYRDLKPENVLVREDGHIMLSDFDLSLRCAVNPSLIMAQPNLAALPSRNGRRATSEIWMLEPQQVALQSCVPMISSQYRFRKPMSLRSKRSNRSDNDKGTASPPSMPELVVEPTEVRSMSFVGTHEYLAPEIISGDGHGSSVDWWTFGIFLYELLYAKTPFKGADNELTLTNVVSHPLIFPPNTDTVNVPDCAKDLIRGLLMKDPMKRIGSIRGAGEIKAHPFFEGVNWALIRCACPPEVPKPYRSELAAVAGVPTLGQALADEKKKATGWSHEGDNAVSEFECF

SEQ ID NO: 19229 - protein, 209 aa, Azoarcus sp. BH72
MPLFRNAQFEISIAKPSGLPPPNGAEIAFAGRSNAGKSSAINTLAGHVRLAYVSKTPGRTQLINFFRLNCGALLVDLPGYGYAAVPEKIRRQWQGLIETYLRTRESLIGLVLMMDSRHPMTDLDRQMIDWFAPSGKPIHVLLTKSDKLSRGPANATLLAVRAELTARYGDQVSVQLFSSLKKTGVEEVEKVVAGWLVPAAAEGEAPAGA

SEQ ID NO: 19230 - protein, 597 aa, Neptuniibacter caesariensis
MIKYSRLKPTFSSKKRLFKPFFAALVVSALGSSPVFAVEEDLAPESATGISKNASVISEGALVVTAHPLATAAGQQILRNGGTAADAAVAIQAMLTLVEPQSSGIGGGAFMLYWDQQHKQLHAYDGRETAPALAGEKLFYRDGKPMKWHDAMVGGRSVGTPGVLKMLELSHSRHGNQSWKSLFSSAIQQSKEGFTVGPRLHQLIASNINPGLKRYPEALNYFFTGEEEPLPIGFNRTNPELAQSLTLIAEKGASAFYQGPLARKITEKVQQISDNPGLLSMNDMAAYAAKERSPICLPYLSYKVCGFPPPTSGGVTVLQILKLLENQPLADMPPSSLEFNHVFTQASRLAFADRGRYLADADFVDVPVNALLSQPYLDQRAQLISAEQDMGKAAAGEPEKINLSRADDQSPERPSTSHFVVRDQWGNAVSMTTSIEMAFGSTVMAGGFLLNNQLTDFSFVAEKDGQLVANRVQPGKRPRSSMSPFMVFDKNGELYAAIGSPGGSRIINYVAQSLLVMLNTDIPLQEVVNLPHVSNRNSLTELEQGTPAEQLQEQMEKLGHKIKVRDLNSGLHGFRRLNDGRWESGVDNRREGEALSQ

SEQ ID NO: 19231 - protein, 512 aa, Oryza sativa Japonica Group
MDKAYIAVFSIVILFLLVDYLRRLRGGGTSNGKNKGMRLPPGLPAVPIIGHLHLVKKPMHATLSRLAARHGPVFSLRLGSRRAVVVSSPGCARECFTEHDVAFANRPRFESQLLMSFDGTALAMASYGPHWRNLRRVAAVQLLSARRVGLMSGLIAGEVRAMVRSLCRRPAAAAPVQLKRRLFELSLSVLMETIAQSKATRPETTDTDTDMSMEAQEYKQVVEEILERIGTGNLCDYLPALRWFDVFGVRNRILAAVSRRDAFLRRLIYAARWRMDDGEKKSMIAVLLTLQKTQPEVYTDNMITALCSNLLGAGTETTSTTIEWAMSLLLNHPETLKKAQAEIDASVGNSRLITADDVPRITYLQCIVRETLRLYPAAPMLIPHESSADCEVGGYSVPRGTMLLVNAYAIHRDPAAWEEPERFVPERFEGGGCDGNLSMPFGMGRRRCPGETLALHTVGLVLGTLIQCFDWERVDGVEVDMAEGGGLTMPKVVPLEAVCRPRDAMGGVLREL

SEQ ID NO: 19232 - protein, 351 aa, Streptococcus agalactiae NEM316
MRAATYLSANELSLTDKAKPQVIKPTDAVVRLVKTTICGTDLHILGGDVPACKPGTTLGHEGIGIVEEVGSAVNHFKVGDKVIISCVTACNTCYYCKHQLPSHCEDGGWILGHLIEGTQAEYVHIPHADGSLYHAPEGVCDDALVMLSDILPTSYEIGVLPSHIKPGDTVCIVGAGAIGLSALLTAQFYSPAKIIMVDLSQKRLEASKKFGATHTILSTSTQEVKEEIDKITKGRGVDVVLECVGYPATFDICQNVVSIGGHIANVGVHGKPVEFNLQDLWIKNITLNTGLVNANTTEMLLEVLETGKIDATQLVTHHFKLSEIEEAYKVFKAAEENNTLKVIIENDITPA

SEQ ID NO: 19233 - protein, 222 aa, Azoarcus sp. BH72
MTQDELKKAAALAALDYVEDGMIVGVGTGSTVNHFIDGLAGIKHRIRGAVSSSEASSKRLAAHGIALLDLNDVDELPVYIDGADEIDHGFAMIKGGGGALTREKIVAAVARRFVCICDESKRVDVLGRFPLPIEVIPMARSQVMRAAAALGATPRLREGFVTDNGNLIIDLHGLSITDPCATEQALNAVVGVVTNGLFAARGADTLLLASAQGVRRFERSAT

SEQ ID NO: 19234 - protein, 537 aa, Isatis tinctoria
MGNCCGTAGSLAQNDNNKPKKGRKKQNPFSIDYGLHHGGGGGGALKLIVLSDPTGREIEQKYKLGRELGRGEFGVTYLCTDKETDEVLACKSILKKKLRTAVDIEDVRREVEIMRHMPVHPNVVTLKETYEDEHAVHLVMELCEGGELFDRIVARGHYTERAAAAVTKTIMEVVQVCHNNGVMHRDLKPENFLFANKKETAPLKAIDFGLSVFFKPGERFNEIVGSPYYMAPEVLKRNYGPEVDIWSAGVILYILLCGVPPFWAETEQGVAQAIIRSQLDFRRDPWPKVSENAKDLIRKMLDPDQKRRLTAQQVLDHPWLQNAKTAPNVSLGETVRARLKQFTVMNKLKKRALRVIAEHLSDEEASGIREGFQIMDTSQRGKINIDELKIGLQKLGHAIPQDDLQILMDAGDIDKDGYLDCDEFIAISVHLRKMGNDEHLKKAFAFFDQNDNGYIEIEELREALSDEVGTSEEVVDAIIRDVDTDKDGRISYEEFATMMKTGTDWRKASRQYSRERFNSISLKLMQDASLQVNGDAR

SEQ ID NO: 19235 - protein, 103 aa, Arabidopsis thaliana
MAENSQIPDNNNNTSSSAKKPTPEIGSGSGKRYYNPPESVNPDQATLREQWKFAIRQYSKWYSHAWGTAILAGGFFFGLGWIIKGSNPLPSLQSSSKPRDEEK

SEQ ID NO: 19236 - protein, 185 aa, Rickettsia prowazekii str. Madrid E
MLIVPYKGIIPKIAKSAYVAKNSALIGDVVIGNNSSIWFNTVLRGDVESIKIGNNTNVQDGSVIHTSRFNGPVEIGNNITIGHLSLIHACTIHSNAFIGMSATIMDYAVIEEYAFIAAGSLVPPKKIIKSNELWMGSPAQFVRYLTDKDLQYMEDNIRNYVELANLYKTQSQCKSHSTNNCKKLS

SEQ ID NO: 19237 - protein, 445 aa, Colwellia psychrerythraea 34H
MNNNQTKHGITQAQLDAHWMAFTGNREFKKDPRIIVSAQGNYYTDADGRKIFDGLSGLWCCGAGHSRPEITEAVSKQLKQLDYAPAFQFGHPKAFQLAEKIVEFMPKGINRVFYTGSGSEAAETSLKMARAYWRKKGLASKTKLIGRGLGYHGVNFGGISVGGIGANRSLFGPAVDADHLRHTMLDENKFVKGQPQTGVELANELLDLVALHDASNIAAVIVEPMAGSAGVIPPPVGYLNRLREICDQHNILLIFDEVICAFGRMGANTGAEAFGVTPDIINIAKQMTNGTIPMGAVIAKQEIYETFMEQGGPEYMVEFPHGYTYSAHPVACAAGLAALEILQTDKLIERVKDHSPYFEESVHNLKGCKHVTDIRSYGFAAGFTIDPVPGEPALRPYQIAMKMWQKGFYVRYGGATIQLGLPFTSEREEIDSLLSALGETFNEIA

SEQ ID NO: 19238 - protein, 395 aa, Solibacter usitatus Ellin6076
MASALTAKAADLHDAIQSGNLDRVKEAIARGASVNQPDQMGATPLHDAAWVGNREIALYLLEHGANVKARHAEGGSTPVAYACIKNDLAMVELLVAHGADIRAGDNTGETPLHLAVDRGYQELTEWLIGQGAPVNARDKAGSAPLDEAARRGFDGIAGTLLEHGAHADEENPETGSTPINEAARRGNPKVVALLLAKGADPSRRDRSGASAVENAARGRYPEVLELLITGGAASEQAGALLIEAAIKGQEQIADLLIAKGANVNARDKSGATALHQAALKGNLGFATLLLQHHADVNARDGDGATPLHNAALSGHREVAELLLENGGDREARDTEPGGTPIYHAAAWGRTSVVELLIARGADVNAKSKSGVTPLAAAEKNGFAETAKVLRQHGAR

SEQ ID NO: 19239 - protein, 137 aa, Oryza sativa Indica Group
MPSAASDDATLGRHLACRLVQVGISDVFAVPGDLNLTLLDHLIAEPGLRVVDCCNELNTGYAANGYAWARGMGTCTVTFTVCGLLLHGRRHRSHWFWNQETGDEAGAAFRNQERASASPSLPSAVARRSGSVVVGGG

SEQ ID NO: 19240 - protein, 201 aa, Rickettsia prowazekii str. Madrid E
MSYVPVVIEQTSRGERAYDIYSRLLKERIIFVCSTVEDHMANLIVAQLLFLEAENPKKDIYMYINSPGGVVTAGLAIYDTMQFIKPKVATLCIGQACSMGSLLLCGGEHGMRYSLPHSRIMIHQPSGGYKGQATDIEIHARETLKIKRLLNELYSKHTKQELKYIEKSMERDNFMSSEEAKKFGLVDNIISSRDTIAFLAQ

SEQ ID NO: 19241 - protein, 453 aa, Oryza sativa Indica Group
MAGLAAARELRREGLDVTVLEQLAGVGGQWLYDAATDAGDPLGMAGVHSSVFASLRINGPRESIGFSDFPFRPTNDAGGDARRYPVHGELLRYIRDFCDAFGLMDAVRLNTTVTRVAMAPPRRDGSLRWAVRSKRHGEAETEEVFDAVVVAIGHYSQPRLPTIDGMDRWRRKQLHSHSYRVPDSFAGEVVVIVGCSVSGAELALELRRVAKEVHLSTKSTEETITSAMSKSVARYENLHLRPQVEHLREDGTVVFDDGSFVVADAVIYCTGYNYSFPFLDTNGKVTVDDNRVGPLYEHVFPPELAPSLSFVGIPGKVVLPVFIEVQARWVAQVLSGRRTLPSPEEMQRAVEEHTRGMEAAGLPKRWTHDMFLNLERCDDYGERICGFPRMEQWKKEIFVSSLSDMVDDIENFRDGYHDSDLVRDALRRHGWTPVAPRPQEEDDDAKAIGVANI

SEQ ID NO: 19242 - protein, 498 aa, Bradyrhizobium sp. ORS278
MRSIGHFIGGKEVKGTSGRTADVFEPMTGDVQAKVALASRAELRAAVENAKAAQPAWAATNPQRRARVMMKFLELAQRDYDQLAELLAREHGKTVPDAKGDIQRGLEVVEFACGIPHLMKGEYTEGAGPGIDIYSMRQPLGVVAGITPFNFPAMIPMWKFAPAIACGNAFILKPSERDPGVPMKLAELMIEAGLPPGILNVVNGDKEAVDAILEDPDIMAVGFVGSSPIAQYIYERAAAHGKRCQCFGGAKNHAIVMPDADLDQAVDALIGAGYGSAGERCMAVSVAVPVGKTTADRLMEKLIPRVESLKIGTSIDPSADYGPLVTREAVERVKNYVDIGVKEGATLAVDGRGFKMQGYENGFYMGGCLFDNVTKDMRIYKEEIFGPVLSVVRAKDYAEALALPSEHDYGNGVAIFTRDGDAARDFAARVNVGMVGINVPIPVPIAYYTFGGWKKSGFGDLNQHGPDSIRFYTKTKTVTSRWPSGVKEGAEFSIPLMK

SEQ ID NO: 19243 - protein, 631 aa, Pseudomonas putida KT2440
MPTTFQEIPRERPVTPLLDRADTPAGLRRLAEADLETLADELRQELLYTVGQTGGHFGAGLGVIELTIALHYVFDTPDDRLVWDVGHQAYPHKILTGRRNRMLSLRQKDGIAAFPRRSESEYDTFGVGHSSTSISAALGMAIAARLQNSARKSIAVIGDGALTAGMAFEALNHAQEVNADMLVILNDNDMSISRNVGGLSNYLAKILSSRTYASMREGSKKVLSRLPGAWEIARRTEEYAKGMLVPGTLFEELGWNYIGPIDGHDLPTMIATLRNMRDLKGPQFLHVVTKKGKGFAPAEIDPIGYHAITKLEPADKPAAPKKASGPKYSAVFGQWLCDMAAADNRLVGITPAMKEGSDLVDFSERYPERYFDVAIAEQHAVTLAAGMACEGSKPVVAIYSTFLQRAYDQLIHDVAVQNLDVLFAIDRAGLVGEDGPTHAGSYDLSYLRCIPGMLVMTPSDENELRKMLSTGHLYNGPAAVRYPRGTGPNAPISGDLQPLEIGKGVVRRQGEKVALLVFGVQLAEAMQVAEQINATVVDMRFVKPLDEALVLELAGSHELLVTIEENAIMGGAGAAVGEFLASQAVLKPLLHLGLPDIYVEHAKPAQMLAECGLDAAGIEASVKARMARLGL

SEQ ID NO: 19244 - protein, 350 aa, Bacillus anthracis str. Ames
MKALLWHNQRDVRVEEVPEPTVKPGAVKIKVKWCGICGTDLHEYLAGPIFIPTEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNSLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKILVSPK

SEQ ID NO: 19245 - protein, 255 aa, Triticum aestivum
  misc_feature (10)..(10): Xaa can be any naturally occurring amino acid
  misc_feature (167)..(167): Xaa can be any naturally occurring amino acid
MYRAASGLGXALKQHGADTQLLNIAVRSASTSVAQRSSGGFLGWLTGARSNALPPPDFALPGVTIPPPLADHVEPGKTKITTLSNGVKIASETSPGSACSVGVYVHCGSVYETPETLGATQLLKKLAFTTTRNRSQLRVVREIGAIGGSAKASANRELMSYSYGALXLTCPEMVEVLVDCVRNPALLDWEVKGEIMKLKAELAEASSNPEAFLLDALHSSGYSGALANPLIASEASISRLNTDVLEEFLAVRFIP

SEQ ID NO: 19246 - protein, 664 aa, Aspergillus nidulans FGSC A4
MLRSSFLLFFYALYASASWVFEHDFQPEERSLLFGTDVSPLKRRQEEGSSSASDSILSVAGGGGGRSSGRPQPTSTSFTQTRTTSTRPTSTNTRTGTRSSSNTTTRTSTSATSTPTTTATGTPCAGNTPDTRREWCDYSIDTNYHDITPDTGVVREYWLELDEITVSPDGISRPAVAVNGTIPGPTIFADWGDEVVVHIKNNLHETLNGSTIHWHGIRQLNTNEHDGVVSITQCPITPDHEYTYRWRAQQYGTTWYHSHISLQAWDGVVGPIIINGPATENYDVDAGTIFLNDWTHQTFEELFWYAQIVGPPLLNNSLINGTGVYGSSFSGHRAKGQKETGERFSMKVEEGTSYRLRLINGAIDTHYKFMIDSHELTVIAMDLVPVKPYKTTAVSLAMGQRYDVIVTANQRSKSDSFWLRSIPQQSCSDVEDPGNIRGIFYYGDRPSTPKTEPYPFEDSCMDEPMASLVPHVARDVQPPDYQNNALASVSFNEDHFFRWFLNSTTMQVYWEDPTLLQILNGDDSFENSSAVIELPNANEWVYMIVNTTIPVSHPIHLHGHDFFILAQGTNPWDGKYQTSNPPRRDTAVLPGNGYLVMAWETDNPGAWLMHCHIGWHTTEGFALQFVERIDEIRENVDRDFVVNACNTWNGYGEEYGVEQYDSGV

SEQ ID NO: 19247 - protein, 315 aa, Coprinopsis cinerea okayama7#130
MPAYLIDPKIVDLNNLNYDSWSVIAYQRTTVIITELVLATALLRFIPGSVDPSIQRIISAALFLHPGFLIVDHIHFQYNGFMFGILLWSILMARNGNKLASGILFAILLNFKHIYMYLAPAYFIYLLRSYCLTPAGQVEIKNFLSLANAVIAVFISSLGPFVLMGQIPQLLSRLFPFTRGLNHAYWAPNFWALVTALDRVLLRCASIPVDAAGVASSSRGLVGDTVFAVLPQIKPIHTFIITIAWQVRRLIPTTSKVILIKLWSNPSYKSFLTSLTLSGWASFLFGWHVHEKAVLLILVPLRYCIFLDLLWEIEI

SEQ ID NO: 19248 - protein, 623 aa, Fusarium oxysporum
MHFNSLSVEAALLLALPHLASAATRKFDFDIGWVRANPDNAFERPVIGINGKWPIPTIEVDIGDRVIINAHNNLGNQSTSLHFHGLYMNGTTHMDGPAGVSQCPIVPGTSFTYNFTVDQPGTYWYHSHTAAQYPDGLRAPFIVHDKDFPYKDKYDEEVIFTLSDWYHDEMQSMIPKFMSKANPSGAEPVPNNALMNETTNFTMSVKPETTYLFRTINIGAFAGQYLWFEGHKMRIVEVDGIYTEEAEAEMIYISAAQRVSFLLTTKKDTSKNFPIVASMDTTLFDVLPPDLNYNATGWLVYDKQADKPDAATVDTLDPHDDMKLVPYDKMGILGKPDQEFTLDVKMENLKDGANYAWFNNITYVEAKVPTLYTALSAGKDAEDPSVYGTYTHSMVLKKNEIVQIVVNNLDSGRHPFHLHGHAFQSIYRSEEEAGIWADANVTEADLPKTPMRRDTLVIYPNGNIVMRFKADNPGVWLFHCHIEWHVVSGLIATFVEDPLTLQETIQIPKNHLDACAAAGMPTKGNAAANTENFLDLTGENKPAKALPAGFTPRGIVALVFSCICGILGVAVVAWYGFSAPIDPTSAGALSAGIVDGSDSGDGNPAHKGPQETVVSPSGDARSH

SEQ ID NO: 19249 - protein, 297 aa, Aspergillus niger
MFSGRFGVLLTALAALSAAAPTPLDVRSVSTSTLDELQLFAQWSAAAYCSNNIDSDDSNVTCTADACPSVEEASTKMLLEFDLTNNFGGTAGFLAADNTNKRLVVAFRGSSTIKNWIADLGFILQDNDDLCTGCKVHTGFWKAWEAAADNLTSKIKSAMSTYSGYTLYFTGHSLGGALATLGATVLRNDGYSVELYTYGCPRVGNYALAEHITSQGSGANFRVTHLNDIVPRLPPMDFGFSQPSPEYWITSGTGASVTASDIELIEGINSTAGNAGEATVDVLAHLWYFFAISECLL

SEQ ID NO: 19250 - protein, 97 aa, Triticum aestivum
MAPTAMASWATSVAPLQGLKSTAGLPVSRRSNGASLGSVSNGGRIRCMQAWPIQGIKKFETLAYLPPVSTEALLKQVDYLRRSKWVPSLESSKGALI

SEQ ID NO: 19251 - protein, 421 aa, Pseudomonas aeruginosa
MDIKAAVVGLGYVGLPLAVEFGKKRSVTGFDINHSRIRDLQKGYDSTLEVEKEELESAVHLKFTSTLSELQECNFFIVTVPTPIDEHKQPDLTPLVKASESIAKVLKKNDIVVYESTVYPGATEEVCVPVLERESGLRFNSDFFVGYSPERINPGDKEHRVSTIKKVTSGSTPEVAEIVDSLYREIITAGTHKAESIKVAEAAKVIENTQRDLNIALINELAIIFNKLEIDTESVLQAAGTKWNFLPFRPGLVGGHCIGVDPYYLTHKAQSIGYHPEIILAGRRLNDGMGAYVVSQLVKAMLRKRIHVDGARVLVMGLTFKENCPDLRNTKVVDIVRELAEYNIAVDVYDPWVSVEEAQHEYGLTPISAPVEGNYDAVVLAVAHNEFKELGADKIRAFGKLESVIYDLKFILDKSDSDLRL

SEQ ID NO: 19252 - protein, 341 aa, Pseudomonas aeruginosa
MNAYAKALSRLETTTSSWLVTGVAGFIGSNLLELLLKFNQKVVGLDDFSTGHMYNLDEVRGLVGEERWRNFKLIQGDIRDIGDCRRAVEGVDYVLHQAALGSVPRSIADPITTNSVNISGFLNILVASKEAGVKSLTYAASSSTYGDHPGLPKVEEVIGKPLSPYAVTKYVNELYADVFSRCYGFNLIGLRYFNVFGKRQDPNGAYAAVIPKWISAMIKGEPVYINGDGETSRDFCFINNVIKANLLAAFCETEEAKNQVYNVAYGGRTTLGQLFDSLKVELSRNGINYEQGPIYREFRAGDVRHSQAEIKKAQAYLGYNPEYDIQAGIAEAMPWYISFVK

SEQ ID NO: 19253 - protein, 87 aa, Desulfovibrio desulfuricans G20
MTKNIYVGNLSWECTDQDLHALFADFGDVTSARVISDRETGRSRGFGFVEMDANGAAQAIDSLNASSFQGRNLKVNEAQPRERRPRY

SEQ ID NO: 19254 - protein, 762 aa, Zymomonas mobilis subsp. mobilis ZM4
MPPSQQIATIAAREILTRLHDVMASRSNAQSKLDQVVQIISTALLSDVCSIYLLRDGVLELFATYGLKQEAVHVTRLSLGQGLVGTIARDMAILNLSEATSHPDFVHNPETGEEFFHSFAGVPIVRREQAVGVLAVQSAESRRFADIEVEALQTVAMVLAELIFSAGLIDENSLASSGSKDQGSLRYNGLKLVEGMGRGYAVFHQPRVTIEFTVAEDVEVERQRLNAAFARMREQIEHMAQEAEFFGNSNDHREVLATYRMFAYDEGWRRRIDEAIDSGLTAEAAIERVQQHNRMRMREIGDPILADRLHDLEDLSNRLLRLVSGQLGTAARLGLHDDAILIARNMGPAELLEYDRRRLKGIVLEEGSLTSHVTIVAKAIGIPVLGRVKEIHQGVREGDLLLVDSNQGAVFIRPTPEIEEAFATRFALSRKRRAEFAAMRDLPAITRDNHRIELMINAGLRDDVAALEATGADGIGLFRTEFEFLVSSTLPRRERQLRLYRDILEAAGDRPVIFRTVDIGNDKTLPYINNSDETVEENPALGWRAIRLALEKKALLKVQARALIEGAAGKTLYVMFPMIAEPWEYEQARAVFEKQNAWLAKHDKPRAKRIYYGSMLEVPSLAETLDILLPKLDFLSIGTNDLIQFFFAADRAYPKLAERYDWLSPALLRFLSRIIDQANAAGCKVGICGEMGGRTLTAMALIGLGLKRLSITPVAIGPIKAMIRSLDRDAFAPFIRELVASGASNIGDQLELWAKKHGVVIN

SEQ ID NO: 19255 - protein, 423 aa, Zymomonas mobilis subsp. mobilis ZM4
MARIVMKFGGTSVAGLERIRNVARRVQKEVEDGNEVAVVVSAMSGETDRLVGFCREAAPLYDPAEYDAVVSSGEQVTSGLLAIVLKSMGVKARSWFGWQIPIHTTDAYANSRIESIDTERLIKAMSSKEVAVVAGFQGVSDEGRVTTLGRGGSDTSAVALAAALDADRCDIYTDVDGVYTTDPRIVSRARRLDRVTYEEMLELASVGAKVLQTRSVGLAMKAKTRLRVLSSFGDPDLSPEGGTLIVSEDEIKENTMERQIITGIAYDKSEAKVTLTGVPDKPGAVAQIFSLLADANIHVDMIVQIAYEGHITDVTFTVPKAQLSQVLDILEKGKEKIGFQKALKNDNVCKVSIVGVGMRSHPGVAATMFDALAKRGINILAITTSEIKVSVLIDDAYTELAVRVLHTAYGLDADNKPVEEAIA

SEQ ID NO: 19256 - protein, 491 aa, Bordetella bronchiseptica RB50
MNPPALPLPADTAAVPVADRWQTQLQIGSIRAASTEPWLVSGRITRAAGLVLHATGLRLPVGAACRIELARGHDHWADAEVVGFDGHTLYLMPQSDISGLPPGARVVPAEPAVQRPVPLPRKAELNGNAKPQVGRHLPVGNAMLGRVVDGAGRPLDGLGPLAGAEQAPLTALPINPLSRAPIDSVLDVGVRAINGLLTVGRGQRMGLFAGSGVGKSVLLGMMARYTRADIIVVGLIGERGREVKEFIEHNLGPEGLARSVVVAAPADVSPLLRLQGASYATRLAEHFRDQGLDVLLIMDSLTRFAMAQREIALAIGEPPATKGYPPSVFAKLPALVERTGMGAPGPNGKAGSITAFYTVLAEGDDQQDPIADSARAILDGHVVLSRHLAEAGHYPAIDIEASISRAMTSLITTEQFQQVRRFKQILSRYQRNRDLISVGAYVAGADPQLDDAIARYPRLEAYLQQNIGDSVDYGTAIDQLQRSLETREAYA

SEQ ID NO: 19257 - protein, 303 aa, Zea mays
ERIKAVRQMIMAPTVELRQLSLDRLLPYQRSDFEGIFRAMDGLSVTIRLLDPPLHEFLPEGNVEEIVRELCSETGANQEDALARIEKLSEVNPMLGFRGCRLGISYPELTEMQARAIFEAAIAMTNQGVQVFPEIMVPLVGTPQELGHQVALIRQVANKVFTSMGKTIGYKIGTMIEIPRAALVADEIAEQAEFFSFGTNDLTQMTFGYSRDDVGKFIPIYLAQGILQHAPFGVFAQRGVGELVKLFPERGRKVRPNLKGGICGEHGGDPSSVVFFPKTGGDYVFCSPFRVPIVRLAAAQVLF

SEQ ID NO: 19258 - protein, 495 aa, Methylococcus capsulatus str. Bath
MSAVSQLPFPESFNMVFFGGAGDLVTRKLLPAMYQCHKNGLLVEAGHILCVDRQDLSEEAFLELADEKACQFIPTADWDAAVWAGFRQRLAYLRIDATQPEQYAPLKERLKKAPAAVTVFYLSTAPSLFATICAHLTRQGLNGPHSRVVLEKPLGHDLASANAITADVDRYFHENQVYRIDHYLGKESVQNLMALRFGNALFEPLWRRMWIRDVQITIAEDVGIGSRAGFYDKAGALRDMVQNHLLQLLCFVAMEPPASLDSNAIRNEKLKVLESLVPFTEEDVHQKTVRGQYRAGICGGKAVPGYLEEEGIPPGSHTETFVAIKAEIANWRWAGVPFYLFTGKRLPERLAEIVIHFHDVPHPIFPLPKSGACAPAKLVIRLQPDEFIRLYLYAKQPGDSMELQPVSLDLNFAEQFKVRRAEGGYERLLLDAIRGNQALFVRHDEQEQAWRWVEPILNTWANDPKGPEPYAAGTWGPAASLDLLRRDGICWHEGK

SEQ ID NO: 19259 - protein, 269 aa, Azoarcus sp. BH72
MPNAAQRLARARALESLVRDIAREEILPRYLKSARSRKADGTLFTEADIESQRRFSQALPTLLPGPVLGEEMSAEEQARLWAKGRGGLWCIDPIDGTTNFANGIPFFAVSIAYLVDHEPRFGVVYNPITDESFYAAQGAGAFLNGTELPLRASAPRLADAVAGVDFKRISHHLGDELAVRPPFYSQRNFGSSALEWCFVAAGRLDVYLHGGQMLWDYAAGRLILAEAGGEAAALDGGSLMAGPAVKRGVIAAASPSLFAEWRAWVLAHS

SEQ ID NO: 19260 - protein, 221 aa, Dianthus caryophyllus
MAEITQIQVESHVFPPEVKPPGSDKTFFLGGAGVRGLEIQGKFIKFTAIAVYIEDDAVSSLAVKWKGKTADELTDSVDFFKDIVTGPFEKFTQVTMILPLTGQQYSEKVVENCVAHWKSVGTYTDAESEATQKFLQVFKNVSNPPGASILFTQSPLGSLTISFSKDGSLPENGKEVIVNKQLSEAVLQSIIGKHGVSPEAKKSLSARLSDLINQHENPKKE

SEQ ID NO: 19261 - protein, 289 aa, Azoarcus sp. BH72
MKHPIIAVTGSSGAGTTTVKHTFEAIFHRENVNAAVIEGDSFHRYTRDEMKALIEEAEQAGQRGISHFGPEANLFEDLENLFRAYGESATGRRRYYIHNEAQSMRWNLPMGSFTEWEDLPVGTDCLFYEGLHGAVTCDRIDVARHVDLLIGVVPTINLEWIQKLHRDTRVRGYSADAVQDTILRRMHDYVHYIVPQFSRTHINFQRVPVVDTSNPFIARDVPTLDESMVVIRFKDPRGVDFPYLLRMIHDAFMSRANTIVIPGGKLDLAMQLILTPLIWKLMERRRQWV

SEQ ID NO: 19262 - protein, 499 aa, Neptuniibacter caesariensis
MSTATFSPSEAAQAFLQRQHKILIGAEWQAAQDGRTLDVVNPADGEKIATVPSGGAEDIDRAVSAAKQAFEDSEWSRIKPVDRQKLLWDFADLIEKNAPLLAELEALDNGKSVVIAEHVDIRLAVDFLRYMAGFATKIEGRSVDVSVPFMPDAQFHGYTRREAVGVVGAIVAWNFPLLLACWKLGPALATGCTVVLKPAEDTPLTALKLAELALEAGYPPGVFNVVTGLGHEAGAALSSHPDVDKLTFTGSTEVGKLIGKAAMDSMTRVTLELGGKSPTIVLQDADLQNAAAGAANAIFFNQGQVCCAGSRLYVHKKHFDNVVADISDIANGMTLGAGLDPNAQMGPLVSAKQQQRVCGYIDQGITSGAKVVAGGSAADGPGFFVKPTVMVDVDHNASVVKEEIFGPVLVAMPFDDIDEAVRIANDSQYGLGASIWSNNLSEVHRMIPRIKSGSVWVNCHTALDPALPFGGYKQSGLGREMGSDVIEHYTEVKSVLMSI

SEQ ID NO: 19263 - protein, 709 aa, Leifsonia xyli subsp. xyli str. CTCB07
MARSLYITSAEGHTGKSTVALGVLEALRHSVERVAVFRPIARSTVERDYVLDLLLTRVTAQIGYEEAVGVSYEDVHADADAALGEIVRRFRAVEAKADAVVILGSDYTDVGSPTELGYNARIAANLGAPALLVLGGRVGQGFGERLGQADPRSPEELRQLAELAVAELRAEHAGLLAVVANRADSDRLETIVEAVGEAVAAGAPAQGARPQVWAIPEDPFLVAPSIRSIMEVTAGELLAGDRELLAREALGVVVAGMSMNNVLPRLVEGAVVVVPGDRTEVLLAVLMANASGTFSSVAGIVLNGGFELPEPIERLLAGLRSPLPIVYTWLDTYETVVRITHARGRLAADSQRKYDTALALFERHVDAGALLARLDVTRHEVVTPLMFEYDLIERARAADKHIVLPEGEDDRILRAAATLLARGVARLTILGEPFEVRSRAIEIGLDISGAEVLSPFDDVLRLRFAHEYAELRAHKGITVDQASDTVTDPSYFGTMMVHAGLADGMVSGAANTTAHTIRPAFEIIKTSPSVSVVSSVFLMALADRVLVYGDCAVIPDPTAEQLADIAVSSARTAGQFGIEPRVAMLSYSTGDSGTGADVDKVRTATALVRDRAPQLPVAGPIQYDAAADAAVGAAKMPGSEVAGRATVFVFPDLNTGNNTYKAVQRSAGAVAIGPVLQGLRKPINDLSRGATVDDIVNTVAITAIQAALS

SEQ ID NO: 19264 - protein, 338 aa, Azoarcus sp. BH72
MTIKIAINGYGRIGRCTLRALYELGLRDQFEVVAINASGDLATNAHLTKYDTTHGRFAFPVETEGDNVMIVNGDRIPFFSTKDPLAINWGDLGVDVLLECTGAYTAKAKAEVHLKQGAKKILISAPGGDDVDATIVYGVNHDVLTAAMTVVSNASCTTNCLAPVAKVLQDNIGIEKGLMTTIHAYTNDQVLVDVRHKDLRRARAAAQNIIPTKTGAAKAVGLVLPALKGKFDGFALRVPTMNVSLVDLTFTASRATSKEEINSLMIEASKGALKGVLAVNEAPLVSMDFNHDPHSSVFDATQTRVMDGNLVKVLAWYDNEWGYSCRMLDAAKALAQAK

SEQ ID NO: 19265 - protein, 217 aa, Nocardia farcinica IFM 10152
MTTLEFHDGIAVLDLGDGENRFSPAFLEQVNAHLDTALSDGALALVTTAGGKFYSNGLDLDWVAAHGERMPWYVEQVQALLARVLTFPLPSAAALPGHAFGAGAMLAMAHDYRVMRADRGYFCFPEVDIHIPFTPGMAALIQAKLTPAAAIASMTTGRRFGGGEAAAIGLVDATAAEGEVTAAALAMLAPLGGKDSGTLTAVKNTMFAGAVAALRAA

SEQ ID NO: 19266 - protein, 789 aa, Leifsonia xyli subsp. xyli str. CTCB07
MWVVTALYRRYRPDTFAEMIGQSQVTDPLTTALRTNRVNHAYLFSGPRGCGKTTSARILARCLNCAEGPTDIPCGVCPSCVELSRGGGGSLDVVEIDAASHNGVDDARDIRERAIFAPARDRYKIFILDEAHMVTPQGFNALLKIIEEPPDHVKFIFATTEPEKVIGTIRSRTHHYPFRLVPPALMLEYVQTLCDSEGITVAPGVLPLVVRAGGGSPRDTLSLLDQLMAGSEGSSIEYERAVALLGYTHAALLDEVVDAIAARDAAGAFAAVDRVIQTGQDPRRFVDDLLERLRDLIVVAATSVEGAAAVLRGVPADVLDTMGRQAMMFGAAELSRCADIVNAALTEMTGATSPRLHLELMVARVLVPSSDDTERGALARVERLERRVGVSDAAGGGPARGAALTAAAARSAPAPEPPAIRAAEPAPRAEPPARAEKAAPESDAVAEPQPESAPSIGPVTTQQVKDSWPQILDAVQRAKRSAWMVVFTAQVRALSDDVLTLSFPSDNDVQSFRQPPAPGTQGVSEYLRQAIVDILGIRVKFIARADGGSGSPGPGEPAASAAETWPGADGPGGAPHGGGGMAAGVPDRLAFEGPASGSPVSGRSAPGASPSATAPPGTSGSGVAATAAAEASGAAGAASRSAAAPSSRPVTEWATVAIPVAEPVGAASPVVTLERPGPAAVPAASRADSPTRGGTPLSDDVPPEETEPPFEPDVPEEPGEGGAGAPPPPLGSAPAPSTVPAPRTVRAPSTGVRPPAFQAPQRYGEAVVREILGATFLEEQPAPATPGMR

SEQ ID NO: 19267 - protein, 408 aa, Rickettsia prowazekii str. Madrid E
MPIKILMPALSPTMREGNLARWLKKEGDKVNPGEVIAEIETDKATMEVESVDEGILAKIIIPQNSQNVPVNSLIAVLSEEGEDKADIDSFIAQNNSVSLSLKTDATLKKSNDSITNVEGIKHDSNKIFASPLAKRLAKIGDIRLENVQGSGPHGRIVKQDILSYDSSTSSNKIVYRDTEEYRSVPNNNIRKIIAKRLLESKQTVPHFYLSIECNVDKLLDVREDINKSFSEDKVTKISVNDFIILAVAKALQEVPNANASWSEDAIRYYNNVDISVAVAIENGIVTPIVKDANKKNIIELSREMKTLIKKAKDNKLTPIEFQGGGFTISNLGMYGIKNFNAIINTPQSCIMGVGASTKRAIVKNDQIIIATIMDVTLSADHRVIDGAVSAEFLASFKRFIENPVLMLI

SEQ ID NO: 19268 - protein, 394 aa, Azoarcus sp. BH72
MQVKKLTDLDVRGKKVFIRADLNVPQDEAGNITEDTRIRASIPSIQYCLDNGAAVMVTSHLGRPTEGEVGPDDTLAPVAVRLGQLLHKPVKLIANWVEGGFEVKPGEVVLLENCRCNKGEKKDNEELAKKMAALCDVYVNDAFGTAHRAEATTHGIARFAPVSCAGILMGAEIDALSKALHQPARPLVAIVGGAKVSTKLTILKTLADKVDQLIVGGGIANTFLLAAGKRIGESLAEPEMVREAQQVMDIMKSRGAEVPLPIDVVVADEVSALARANRISVDEVGPHDRILDFGPKTSAKLADIIAHAGTIVWNGPVGVFEHAQFAGGTKMMASAIAHSEAFSIAGGGDTLAAIAKFHIADDVGYISTGGGAFLEFLEGKKLPAIAALEARYEG

SEQ ID NO: 19269 - protein, 229 aa, Listeria innocua Clip11262
MKLVLIRHGQSEWNKLNLFTGWHDVDLSEEGVVEAMTAGKRIKEAGLEFDVAFTSVLTRAIKTLNYVLEESDQMWVPVHKSWRLNERHYGALQGLNKQETAEKYGADQVQKWRRSYDTLPPLLEENDERQAKNDRRYQLLDTHAIPSGENLKVTLERVIPYWMDTIAPEIKAGRRVVIAAHGNSLRALVKFLEGISDDEIMELEIPTGVPLVYELNDDLKPVNKYYLDK

SEQ ID NO: 19270 - protein, 55 aa, Rosa foliolosa
ETLEQREAGSTVEVVAAQTKAIAEKVKDWTNIVLAYEPVWAIGTGKVASPAQAQE

SEQ ID NO: 19271 - protein, 428 aa, Leifsonia xyli subsp. xyli str. CTCB07
MALIVQKFGGSSVSDAESIKRVAKRIVETRKAGNEVVVAVSAMGDTTDELVDLAHEVTPIPAPRELDMLLTAGERISMALLAMAIKSMGSDARSFTGSQAGMITDAVHGSARIVDVTPGRIQDALSEGAIAIVAGFQGFSRESRDITTLGRGGSDTTAVALAVALGAEVCEIYTDVDGVFTSDPRQVPLARKIDRITSEEMLELAAAGAKVLHIRAVEYARRHDVTLHVRSSFSNREGTYVLNEAAAAAAAKKDGIVEEPIIAGVATDLSEAKITVVGVPDVPGKAAQIFKIVAKANANVDMIVQNVSAAATSLTDISFTLPKSEGQRVLTALTAEKYEVGFQSLQYDDQIGKLALVGAGMRTNTGVSAKLFEALFDAGINIEMISTSEIRISVVTCADTVAEAARVVHSAFRLDGDQQAIVYAGTGR

SEQ ID NO: 19272 - protein, 337 aa, Petroselinum crispum
MEVERVQAISKMSRCMDTIPSEYIRSESEQPAVTTMQGVVLQVPVIDLGSSNNTEENLVELIAEASREWGIFQVVNHGIPDDAIAKLQKVGKEFFELPQQEKEVIAKPEGYQGVEGYGTKLQKELGGKKGWVDHLFHIIWPKSAVNYNFWPNNPPLYREANEEYAVALRGVVDKLFEALSLGIGLEKHELKKASGGDDLIYMLKINYYPPCPRPDLALGVVAHTDMSAITILVPNEVQGLQVHKDDHWYDVKYIPNALIIHIGDQIEIMSNGKYKSVYHRTTVNKDKTRMSWPVFLEPPPELLTGPISKLITDENPAKFKTKKYKDYVYCKLNKLPQ

SEQ ID NO: 19273 - protein, 283 aa, Mycobacterium smegmatis str. MC2 155
MTASHGQAAAIPTVTLNDDNTLPVVGIGVGELSDSEAERSVSAALEAGYRLIDTAAAYGNEAAVGRAIAASGIPRDEIYVTTKLATPDQGFTSSQAAARASLERLGLDYVDLYLIHWPGGDTSKYVDSWGGLMKVKEDGIARSIGVCNFGAEDLETIVSLTYFTPAVNQIELHPLLNQAALREVNAGYNIVTEAYGPLGVGRLLDHPAVTAIAEAHGRTAAQVLLRWSIQLGNVVISRSANPERIASNLDVFGFELTADEMETLNGLDDGTRFRPDPATYTGS

SEQ ID NO: 19274 - protein, 190 aa, Thermococcus kodakarensis KOD1
MVDMSNVKLRIENIVASVDLFTDLNLEKVIEICPSSKYNPEEFPGIICRFDDPKVALLIFSSGKLVVTGAKSVDDIKRAVYKLIEMLKKIGAKFTREPQIDIQNMVFSGDIGMEFNLDAVALILPNCEYEPEQFPGVIYRVKEPRAVILLFSSGKIVCSGAKSEQDAWEAVKKLLRELEKYGLIEEEEEW

SEQ ID NO: 19275 - protein, 391 aa, Alkaliphilus metalliredigens QYMF
MKHRFLAKRYWNTMTTPMGAVVDLAKQYSDVINLSLGDPDYVTNQEVIQRAFEDAENGHTHYTDSLGDEELRHEIIKYYEEAYEYKVGSKEVMAVVGACHGMYLALEAILDDGDEVIIPAPYFTPYIQQVELVRGKPVILDTYEEDGFQIDINRLKGLINHRTKAIIINTPNNPTGACFSKETLEAVGKVAKEFDLLIIADDIYDAFTFSDPFLPATTMKGMQERTITIGSFSKDYAMTGWRVGYVLAPDFIIQCMRDINEGICFTVPSISQRAAIYALRMRETIQPPMIAEYKKRMYYAYERINAIPNMSVLSPQGSFYLFVNIKKTGLNSVDFCKELLEEAHVLAIPGIAFGGCGEGYIRLACTVGVAALKEAFDRIEKMKVCCAHNLQ

SEQ ID NO: 19276 - protein, 498 aa, Mycobacterium smegmatis str. MC2 155
MNVIGITLLPRGRIMSHGPVSDDTPSIFGDDDQAASSGRTAVRIAAVAALGGLLFGYDSAVINGAVDSIQEDFGIGNYALGLAVASALLGAAAGALSAGRIADRIGRIAVMKIAAVLFFISAFGTGFAPETVTLVVFRIVGGIGVGVASVIAPAYIAETSPPGIRGRLGSLQQLAIVLGIFTSFVVNWLLQWAAGGPNEVLAMGLDAWRWMFLAMAVPAVLYGALAFTIPESPRYLVATHKIPEARRVLSMLLGQKNLEITITRIRDTLEREDKPSWRDLKKPTGGIYGIVWVGLGLSIFQQFVGINVIFYYSNVLWQAVGFSADQSAIYTVITSVVNVLTTLIAIALIDKIGRKPLLLIGSSGMAVTLATMAVIFANATVKPDGTPDLPGASGLIALIAANLFVVAFGMSWGPVVWVLLGEMFPNRFRAAALGLAAAGQWAANWLITVSFPELRNHLGLAYGFYALCAVLSFLFVSKWVEETRGKNLEDMHAEALGH

SEQ ID NO: 19277 - protein, 452 aa, Arabidopsis thaliana
SFLATLISVDFQHCFMYIILLCLFSLLCYSLFFRKPKGTRVGCDLPPSPPSLPIIGHLHHLLSSLTHKSLQKLSSKYGPFLHLRIFSVPIILVSSASVAYEIFKAHDVNVSSRGAAAIDESLLFGSSSFIYAPYGDYWKFMKKIFATKLLRPQVLENSRGVRAEELKRFYRRILDKARKNENIEISKESAMLMNNILCRMSMGRSFSEENGEAERVRGLVGESYALVKKIFFAATLRRLLEKLRIPLFRKEIMGVSDRFDELLERIIVEHKDKLEKEHQVMDMMDVLLAAYRDKNAEYKITRNHIKSFFVDLFVGGTDTSVQTTQWTMAEIINNPNILQTLRKEIDSVVGKSRLIHETDIPNLPYLQAVVKEGLRLHPPGPLLIRTFQERCEMKGFYIPEKTTLVINAYAVMRDPDSWEDPDEFKPERFLSYSRSGQEDEKEQTLKYLSFGG

SEQ ID NO: 19278 - protein, 251 aa, Zea mays
TRPPPSSSSSSDCPHPLHSQVPTTPNPGSPLQRRLRFGYARLEQKKMQRAVQAVRSHGNVLKYAVLQHISAPKPAMLPAAFSRFMSVSSARLEDRGFETATVADVLKSKGKSADGSWLWCTTEDSVYDAVKSMTQHNVGALVVVKPGQNKSIAGIVTERDYLRKIIVQGRSSKSTKVGDIMTEENKLITVNPDTKVLQAMQLMTENRVRHIPVIDGTGMLGMVSIGDVVRAVVAEHREELNRLNDYIQGGY

SEQ ID NO: 19279 - protein, 549 aa, Bradyrhizobium sp. ORS278
MCHVAGQHGPSGPNESTQRATMRSFHFPGRSTVHAQNGMIATSHPQAALAGIEVLRAGGTAADAAVAACALLGVIEPQSTGIGGDCFALVQPKGEGRILAYNGSGRAPAAATVDWYLERKIHSVPLTSAHAVSVPGAIDAWARILHDHGRLGLDRLLQPAIRAAEDGYVVAPRVAFDWNNQFEKLKNGTNTARYFLPHGKAAVAGDVIRQPELAQTLRVIAKEGPKGFYTGAVAEDMVQTLRSIGGLHTLEDFANHQTEVTSPIGTTYKDYDVWQCPPNGPGITMLVMLNILSRFDLTRIAPLSIERFHLEAEAARIAYMMREQHIGDPQHMTTEVASILAKEFADEYISQISLDKLLDLPNVAPPMNPETVYITVVDRDRNVCSFINSIAHSFGSAIVSNETGVLLQNRAGGFRIQPGHPNCIGPGKRPLHTIIPALATKAGRAQMSFGVMGGQYQPVGQTHVLTNILDYGCDVQEAIDMARGLHYEGVYQLEDGVPAEVVEGLQKIGHKTTKVVSPLGGGQAIWIDWDKGTLTGGSDPRKDGCALGY

SEQ ID NO: 19280 - protein, 387 aa, Bacillus cereus ATCC 10987
MEQFINPRVKDIQISGIRQFSNMIQNYDNLISLTIGQPDFPTPSLVKEAAKRAITENYTSYTHNAGLLELRKAACNFVKDNYDLHYLPENETIVTIGASEAIDVAFRTILEPGTEVILPAPIYPGYEPIIRLCGATPVFIDVRETGFRLTADALKNAITEKTRCVVLPYPSNPTGVTLSKEELQDIVNVLKDKNIFVLSDEIYSELVYEQTHTSIAHFPEMREKTIVINGLSKSHSMTGWRIGLLFAPNYLAGHILKVHQYNVTCSTSIAQYAAIEALTAAKDAPKMMRHQYKKRRDYVYNRLTQMGLTVEKPTGAFYLFPYVGHLTSSSFDFALDLVKEAGLAVVPGTAFSEYGEGYLRLSYAYSIETLKEGCDRLEAFLQKKAKS

SEQ ID NO: 19281 - protein, 377 aa, Bordetella parapertussis 12822
MAKRDYYEVLGVAKNASDEDLKKAYRKLAMKYHPDRNPDSKEAEEKFKEAKEAYEVLGDEQKRAAYDRYGHAGVDPNAAGMGGGMGGGMGGGFADAFGDIFGEIFGAGRRGGGGPQVYRGADLKYALEITLEQAASGFDTEIRVPSWENCDTCHGSGAKAGTSPKTCRTCGGSGAVRMQQGFFSVQQTCPTCHGTGKEITDPCPSCDGVGRTRRNKTLQVKIPAGIDDGMRIRSSGNGEPGINGGPPGDLYVEIHIKQHKIFQRDGDDLHCELTIPFTTAALGGELQVPTLGGKAEISIPEGTQSGKTFRLRAKGIRGVRGSYPGDLYCHVVVETPVRLSDEQKAILRQFEASLNDGGDRHSPQSKSWTDRVKEFFS

SEQ ID NO: 19282 - protein, 126 aa, Saccharomyces cerevisiae
MSAPNPKAFPLADAALTQQILDVVQQAANLRQLKKGANEATKTLNRGISEFIIMAADCEPIEILLHLPLLCEDKNVPYVFVPSRVALGRACGVSRPVIAASITTNDASAIKTQIYAVKDKIETLLI

SEQ ID NO: 19283 - protein, 205 aa, Brassica napus
  misc_feature (190)..(190): Xaa can be any naturally occurring amino acid
MAFSNSERRWVFPLAMASLMFIFLIAASFNMGLLSSVRSINSLIFSSNLPSTNETTVSFVESKTNNHSSPPPHVQSSPRFGYLVSGSKGDLESLWRVLRALYHPRNQYVVHLDLESPAEERIELAKRVREDPVFNDVGNVHMITKANLVTYRGPTMVANTLHACAILLKKSKDWDWFINLSASDYPLVTXDDLIHTFTGLDRNLN

SEQ ID NO: 19284 - protein, 179 aa, Colwellia psychrerythraea 34H
MSTTNIRPYKGILPSIGSDNYIDKSAILVGDITLSDDVSIWPLVAARGDVNTITIGARTNIQDGTVLHVTRKSSENPQGNPLIIGSDVTVGHKCMLHGCQLGDRILVGMGAIIMDGAVIEDDVFIGAGSLVPPNKTLLSGYLYVGNPVKQARPLKESEAAFLKQSAINYVELKNEYLNN

SEQ ID NO: 19285 - protein, 480 aa, Azoarcus sp. BH72
MPRHTKIVATLGPASSDPQVLERMVHAGVDVVRMNFSHGKAEDHVARAAAIREASARAGRPVGILADLQGPKIRVGKFENGRVTLTRDAEFILDAHCNLGNGQRVGLDYKDLPKDVRAGDILLLDDGRLKLQVERVLGAEIHTRVRVGGELSNNKGINRQGGGLTAPALTAKDMDDIKTAAQIGVDFLAVSFPKSAADMYMARQLMRAAGGDALLIAKIERTEAVANLEEILAASDGIMVARGDLAVEVGDAAVPALQKKMIRAARDHNKLTITATQMMESMITSPVPTRAEVSDVANAVLDGTDAVMLSAETAAGSFPVEVVEAMSRVCLEAEKSAEVSLDREVLDRVFTRIDQSIAMAAIWTAWHLKVKAVASLTQTGSTALWMSRLNCGVPIYALTPEIGARNQMTLYREVYPLLMSQTHFDRDVLLWEAEQVLLDQGVVEYGDLIVLTIGEPIGASGGTNTLKIVRVGEHKAPGVQ

SEQ ID NO: 19286 - protein, 466 aa, Burkholderia pseudomallei K96243
MSDTKTTTLLVIGGGPGGYVAAIRAGQLGVRTILVERDRLGGTCLNIGCIPSKALIHAAGEFDKVRGFAGDSPLGIRTQAPAIDIARTVAWKDGIVKKLTGGVGALLKKNGVEVVHGDARVVDGKTVDVDTGGGARVRIQCEHLLLAAGSEPVELPAMPFGGNVISSTGALSPGRLPKRLVVVGAGYIGLELGIAYRKLGVEVSVVEARERILPIYDAELTKPVAASLKRLGVRVLLGHKVLGLNARGDAVCVQDDAHAQTELAADQVLVTVGRRPRTQGWGLETLQLDRAGAALKIDDMCRTSMRNVWAIGDLTGEPMLAHRAMAQGEMVAEIVAGKKRHFMPAAIAAICFTDPEVVSVGLAPDEAERTFGACVSASFPFAANGRALTLESADGFVRVVARRDDHLIVGWQAVGAGVSELAAAFSQSLEMGARLEDVGGTIHAHPTLGEAVMEAALRALGHALHI

SEQ ID NO: 19287 - protein, 483 aa, Burkholderia pseudomallei K96243
MGVHVIKMPDIGEGIAEVELGLWHVKVGDRVKEDQAIADVMTDKASVEIPSPVTGVVVALGGKEGDVLAVGSELVRLEVEGDGNHKAEPDGGARAAAAQPERVADTAHAHASAAAKSARGEHGAGHGRDDARAASSGTSSGASHTQHAEREARGHRESSEYREDRSVSRGASQTDVERGPASPPPARRPGERPLASPAVRKRAWDLGVELRYVHGTGEAGRILHEDLDAYLQGRGAAAQRARGGQAAYVERHDEEAVPVIGLRRKIAQRMQDAKRRIPHFSYVEEIDVTELEALRAELNRKYGDTRGRLTVLPLLARAMVIALREFPQINARYDDEAGVVTRHGAVHLGIATQSKAGLMVPVVRHAEARDPWSIAAEVARLADAARAGRAERDELSGSTITITSLGALGGIASTPVINSPEVGIVGVNRIVERPMFRGGAVVARKLMNLSSSFDHRVIDGMDAAEFIQAVRGLLEQPALLFVE

SEQ ID NO: 19288 - protein, 451 aa, Methylococcus capsulatus str. Bath
MGSAGRQWMERDLAVLWHPCSQMKDHESLPLIPIRRGEGVWLEDFDGRRYLDAISSWWVNLFGHCHPAINAALADQLGRLEHVIFAGFSHEPGIRLAERLVDITPPGLERCFYADNGSAAVEVALKMSFHYWRNRGRPGKTRFVTLENSYHGETLGALAVGDVPLYKETYRPLLMEAVAAPSPDAYGREPGETEAGYAERRFRDMLAILERGADEICAVIVEPLVQCAGGMRMYDPLYLRLLRAACDRLGIHLIADEIAVGFGRTGTLFACEQAGISPDFLCLSKGLTGGYLPLAAVLTRPEIYAAFYDDYGTLKAFLHSHSYTGNPLACRAALATLELFDATDVLGRNRELARCMADATERFQEHPHVAEVRQRGMILAIEMVKDKTTREPYPWQERRGLRVYRRALERGVLLRPLGNVIYFMPPYLITPEQIRLMAEVAWEGLLVAAED

SEQ ID NO: 19289 - protein, 435 aa, Leifsonia xyli subsp. xyli str. CTCB07
MRISVIGCGYLGAVHAAAMADLGHTVIGVDVDEAKVTALSEARAPFFEPGLPEVLASATASGRLRFTTDFSAVAEAEVHFVGVGTPQSAEGDAADMRFVDAAFASLLECVKPGDLIVGRSTVPVGTAARLAELVAQRAPEVTLAWNPEFLREGFAVKDTISPDRLVYGVPPGEAGERTARILDAIYARAVGAGTPVIVTDYATAELVKVSANAFLATKISFINAMAEIAEAAGADVTRLADAIGHDARIGRRFLNAGVGFGGGCLPKDIRAFSARARELGQGDAVRFLDEVDKINLRRRARVVDLVAEVAGGVEGVRVGMLGLAFKPHSDDIRDSPALDVATRLAARGAIVIATDPEAVPNASLRAPQLTFAANAHEAVAGADVVVLITEWPEFTGLDPAELGELVAHRRVIDGRNALDPVAWRAAGWEYRGLGR

SEQ ID NO: 19290 - protein, 284 aa, Nocardia farcinica IFM 10152
MAGMEIASRVGSAVGCAVTEVTDLGSSHGWRLARMRLADGRAVFVKHTAAHGPVLAAESTGLRWLAEGDAELPVPVLADGEGLLVLPWLSAAAPSAEAAERFGRGLARLHTSGAEWFGAPWQGLIAELPQDNTRSSGPWSSWFAERRVVPYLRRAAGVLGAEGVRVVEQVVDRIEVLGGPAEPPARIHGDLWSGNVVWTAEGARVIDPAAHGGHRESDLAMLALFGAPYLDRILGAYQEVAPLAEGWRARVPVHQLAPLLVHVVLFGGSYRGQVIAAARAALAG

SEQ ID NO: 19291 - protein, 311 aa, Oryza sativa Japonica Group
MGVPPVDWEAESYPAYSDFAAIPLFAVFLFAVRYLLDRFVFEVVMVFTVLFPHHAHFRIVTGVATHAGRIKIRKFKESAWKCIYFLSAELLALSVTYKESWFTSTKNFWVGPGDQVWPDQRIKFKLKLVYMYAAGFYTYSIFALQFWEIKRSDFGISMVHHVVSVILIALSYIFSRFARVGSIVLAIHDASDVFLELGKISKYSGYQLLADVSFLIFVCSWAVLRLIYYPFWILWSTSFSYEVVPMLDKKKHKFDGPLHYYVFNCLLFSLLVLNIYWWVLMYRMLVEQILSKGHVGDDVRSGRFSPPFIPP

SEQ ID NO: 19292 - protein, 503 aa, Neurospora crassa
MPSLSFLVRPSVVSSRLASGRVGSLSRHFSVTALNMAPISRETDFLVIGGGSGGIATARAAAGKYGIKSMVVEGKRLGGTCVNVGCVPKKVTFYAALVAETIHQAKDYGFSVEQTAPFDWPTFKQKRDAYVARLNGIYERNLANDKVEYVHGWAKLLSPNSVEVTLDDGTKSVVNAKKILIAVGGNPTIPPHIPGSEYGTNSDGFFDIDTLPKKVALVGAGYIAVEFAGMLNALGVETHLFIRHDTFLRSFDPMIQQVSVKEYERIGVKVHKKSQLTSVQKDAAGKLAINFKEGEGEQSISDVDHLIWAVGRTPAVEGLGLDKAGVKTNEKGYIEVDEYQNTSTENIYAVGDVCGQVELTPVAIAAGRKLAARLFGPEEFRTLKLNYDNVPSVVFAHPEIGSIGLTEPEAVAKYGAENLKIYKSSFTAMYYAMMKPEDKAPTAYKLICAGPEEKVVGLHIIGLGSGEILQGFGVAVNMGATKADFDNCVAIHPTSAEELVTLK

SEQ ID NO: 19293 - protein, 908 aa, Magnaporthe grisea 70-15
MSQWKSSIVTCDPPLGSATVLNEKDATFTVGVPALELEHGGVINGVWIWHNYGETWNELPLREHKTRIVGSDQQDRRFFRGELPRLPDKSNFRFTLRLETDTNRTLWIKDLQGIDDGEVFFQSAGFPSRDVGHYLEGINESGFTASVVGQKDKIDDCMVWNLAASIPPAQGPESGRASRRLGKPDCARWFATVRHNLNWFGPRQGTDFMQLDKEAVLVSFLRRDGLHVVLLPVGGLDSSLTTLITDHEGALAAVSRNEDESDGQARLLVSVATGFEQALSSVMAEAKRMASSKLHNGNGHQNGHQNGHQNGHSQNGGPKHSLTQARAQIDDWNDGFAYCTWNSLGQDLSHDKILGALTRLSESGINIANLIIDDNWQSLDGDGSDASRRRWERFEANQQGFPQGLKGLVSEIRKQNPQIRNIAVWHGIFGYWGGMSPSGPMASKYKMRKIQLRDEAEVQPKDFDFYTVDGEDVHKMYDDFYAFLADCGVSAAKVDTQGFLDYPAHANDRKNLIRPYQDAWTAAASKHFGGRAIACMAQTPQSILHSLLQQGRSEGPMLMARNSDDFFPDEVGSHTWHVFCNAHNALLMRHLGVLLDWDMFQTTTPKYAALHAVARSMSGGPIYITDAPGEHDVELIKQMTAQTADGRTIALRADEPGRTLWPYGGHGEQRLLRVRSGHQGVGMLGVFNVCNRGSLLGEQVRLDDIFDGEKAGEGSFVISRFSTGEMIAPASRETVIEVGLEEGGFEIFTAYPITKLGGLAVATLGLVGKMATAAAVSHVSYSKHHEGFIPVGVEVSVSLKALGTLGIFAQSCDAEDSRKVGVKTIVAMDKAVSNPQRFSSTGSQGEIRLDLESLSIDLGLDSCYRDESTVDLTIVLQFEEDIEDSDGFLAESDSPEAAVAWWWRCTIL

SEQ ID NO: 19294 - protein, 369 aa, delta proteobacterium MLMS-1
MKACIALEDGTVFDGTSFTGHGETTGEVVFNTGMSGYQELLSDPSYKGQIVTMTYPLIGNYGVNEEDMESARVQPEAFIVREYCPFPSNFRATATLAQLLQKYGILGIEGVDTRALTRHIRTAGAMKGIVSTEDLDHASLVAKAQAAPGLVGRDLVREVSCSEPYVWTATGPRPGRDFTGATAGRHRVVAIDYGLKYNQLRMLAERGCQVQVVPCDTDAETILAQNPDGIFLSNGPGDPSGIPGVIDTIRQLLGRKPIFGICLGNQLLGLAYGGKTYKLKFGHRGINQPVKDLTTGRVEITSQNHGFCLDMASLDEAEVELTHINLNDNSVEGIRHRRYPAFSVQYHPENAPGPRDAVYLFDRFVQMMN

SEQ ID NO: 19295 - protein, 463 aa, Bacillus anthracis str. Ames
MQHSNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIVATAIVLLIGVILNYLVPAKVFTWLTSISTFGAIWTWGIILVAQIKFRKSLPTQNRQKLSYKMPLYPLSSYFSLAFLVLVLGIMAYSEDTRIALIVGPIWLIGLAIVYYMKGFHKIDETPNSKIS

SEQ ID NO: 19296 - protein, 609 aa, Bacillus anthracis str. Ames
MEHHTSVLSLMVVVAIAFFVPLLLQRFKLKALPVVVAEIIAGIFVGKSGFNIIEPDMWLQVLSTLGFIFLMFLSGLEIDFSIFKQKGKKNTTNEPNTFQAASVIFLFIFILSYALSLLFVWLGFVDNAMFMTLIISTISLGVVVPTLKENNLGKTAIGQIILLVAVIADLVTMILLAVFVGLNSESGQSMWLLLLLFGAGIVIYFVAKRFKNIPYLDSLKAGSVQIDTRAVFALILILVGLSESVGAENILGAFLAGVLVSLLSPNEDMVEKLDSIGYGFFIPIFFVMVGVNLEVWSIFKEPSSMLMIPILIVGLFISKLIPSLVLRKWYPRNIVLGSAILLTSTLSLVIAAAQIGEKLGIISPSLSASLILSAVITCIFAPILFKKMFPKVETPKPKVSIIGASRITLPLSLDLKREDYDVTLYMMRQNKINDEEAKSHDFPIVKLDDITIASLTEQTAFHADRVVVATSDDEQNLLLAEHAKELGVEHVIASVEDPLLQEKATQEHIAVFSTINSTRILLRALIDKPSLVRLITTANETVREVELRSNKYNGVALRRLPFLGDVLVIQIYRGNKALIPHGDTRLQHGDTLLVTGSKEHIDTLKSILE

SEQ ID NO: 19297 - protein, 168 aa, Xylella fastidiosa 9a5c
MMTGLNVRIGQGYDVHAFGPGDHVMLGGVRVPHRCGVLAHSDGDVILHALCDAMLGALGLGDIGQHFPPSDVRWKGADSGVFVRHCHLLLRERDWCVGNVDATAICESPKIAPYVNAMREGIARLLEVQPECVSVKATTSEGLGFIGRGEGLAAQVVVLLYRLNGVVV

SEQ ID NO: 19298 - protein, 127 aa, Zea mays
  misc_feature (112)..(112): Xaa can be any naturally occurring amino acid
MAAAPPLTLLIALSLLFISLQRSESLPENPSMILLGDGFDWPISHGDALDIDGGESFEDAEEEDVADRRSLYWKRRRYYISYGALSANRVPCPPRSGRSYYTHNCFRARGQXDPYSRGCSSITRCRR

SEQ ID NO: 19299 - protein, 292 aa, Zea mays
EEELSTDIDTHHEVKVKDSKTLLFGEKEVAVFGWRNPEEIPWGSVGAEYVVESTGVFSDQEKGLQLSLEGWCQEGVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNITK

SEQ ID NO: 19300 - protein, 273 aa, Zymomonas mobilis subsp. mobilis ZM4
MVPVKNVVLNDGHSMPAIGQGVYQLNPAQAESMVALGYDLGYRAVDTAAWYENEEGVGEGLRSRHARSFITTKLMPQDMGRVNCFVALDKSIRNLGVTSLNLYLIHWPGQDRKRYEETWQTLIQIRAIGKASSIGVSNFTIDHLDHIIADSGVVPAVNQIELHPYFQQKELRAYHAERGIVTTSWSPLGRGAALNDPVIREIALKHGKTPAQVVLNWHLSLGLTVIPKASSKARLQENLEADSFALDEEDMQRIESLDKPDGRQGIDPAVFDF

SEQ ID NO: 19301 - protein, 255 aa, Rhizobium leguminosarum bv. viciae 3841
MSGFNILERFSLSGRRALVTGAGRGLGRSIAEGLASAGAEVTLCARTESEVEEGARCIRDHGFKAEALVADVSDIAGFRATVDAMHAHDIFVNNAGTNRPKPLSDVTIEDFDAVIGLNLRAAVFAAQAVTARMANLGIQGSVINMSSQMGHVGAANRTIYCASKWALEGFTKALAVELGPVGIRVNTVAPTFIETPMTTPFLEDPAARNAIVSKIKLGRLGTPEDVVGAVLFLASDASALVTGSALLVDGGWTAD

SEQ ID NO: 19302 - protein, 309 aa, Saccharomyces pastorianus
MLRSLLQSGHRRVAASSCATMVRCSSSSTSALAYKQMHRHAARPPLPTLDTPSWNANSAVSSIIYETPAPSRQPRKQHVLNCLVQNEPGVLSRISGTLAARGFNIDSLVVCNTEVKDLSRMTIVLQGQDGVIEQARRQIEDLVPVYAVLDYTNSEIIKRELVMARISLLGTEYFEDLLLHHHTSTSSGGADANELVAEIREKQFHPANLPASEILRLKHEHLNDVTNLTNNFGGRVVDISETSCIVELSAKPTRISAFLKLVEPFGVLECARSGMMALPRTPLKTSIEEAADEDEKINEIVDISQLPPG

SEQ ID NO: 19303 - protein, 48 aa, Phanerochaete chrysosporium
IIAKEGVKSLFKGAGANILRGVAGAGVLSLYDKLQQVLFGKVYSGGSG

SEQ ID NO: 19304 - protein, 421 aa, Mesorhizobium loti MAFF303099
MADLKRTQPLARDAMAYVLAGGRGSRLKELTDRRAKPAVYFGGKTRIIDFALSNALNSGIRRLGVATQYKAHSLIRHLQRGWNFLRPERNESFDILPASQRVSETQWYEGTADAVYQNIDIIEAYGPEYMVILAGDHIYKMDYEMMLRQHVDANADVTVGCLEVPRMEATGFGVMHVDAKDNIIAFVEKPADPPGIPGNPDFALASMGIYVFKTKFLMEQLRRDAAEPGSSRDFGKDIIPYIVQHGKAIAHRFTKSCVRSTAENEAYWRDVGTVDAYWEANIDLTDITPELDLYDRDWPIWTYAELKPPAKFVHDEDGRRGSAVSSLVSGDCIVSGATLKKSLIFTGARINSYSTLEEVVMLPDVHVGRNAKLKRVVIDHGVRIPEGLVVGEDPALDAKRFRVSEKGICLITQDMINKLGL

SEQ ID NO: 19305 - protein, 240 aa, Zea mays
KVHFNLFFLQERCAAAETLSLVARILNRSRAHLNSVLSKNNSSVVEEFFRTLVDSVPDLTEHIHRTSARMLLHIDGYPDKIANAKWEVKELGIEHNGYVDLLLGEFKHYKTRLDHGGISRELQHLLLEYGVESISEVLVEGLSRVKRCTDEGRALMSLDLQVLINGLQHIVASNVRPKLQTVDTFIKAYYLPETEYVHWARSHPEFSTSQVVGLVNLVATMKGWRRKTRLETVEKIEAGP

SEQ ID NO: 19306 - protein, 61 aa, Glycine max
MSQTMKLTPNLDQHSTNVLNLMVLQPIDPFIQQILLTAAHVSFYYFDIYSNHYSRNDVEGS

SEQ ID NO: 19307 - protein, 404 aa, Prosthecochloris aestuarii DSM 271
MFDEIEFEKIKRLPKYVFAAVNELKMAERRKGEDVIDFSMGNPDGPTPQHIIDKLVESVQKPRTHGYSVSKGIYKLRLAICGWYRDKYGVELDADTEVVASMGSKEGYVNLVQAITNPGDIAMVPDPCYPIHSQAFILAGGNVHRFKLEMDEEYRLDEEAFFRNIETAMRESSPKPKYLVVNFPNNPTTATVERSFYERLVETARRERFYIISDIAYAEITYDGYQSPSILQVPGAKDVAVESYTLSKTYNMAGWRVGFLVGNPKLVGALMRIKSWLDYGMFTPIQVASTIALNSDQSCVAEIRDTYRKRRDVMLKSFANAGWEIRAPRASMFLWARIPEPLRQVGSLEFSKMLLREAKVAVSPGIGFGPNGDEYVRIALIENEERIRQAARNIRKFLKAHGQG

SEQ ID NO: 19308 - protein, 881 aa, Streptococcus agalactiae NEM316
METKFVYHFDEGCKEMKELLGGKGANLAEMTSIGLPVPQGFTITTQACNDYYDNACHIRESILSQIDQAMAQLEVEQNKQLGSVDDPLLVSVRSGAVFSMPGMMDTVLNLGLNDRSVQGLVKKTEDERFAYDSYRRFIQMFADVVTGIPKYKFDTILDRLKTDKCYQDDTELTGSDLQRLVEFYKELYQKEAGEKFPQDPKRQLLLAIEAVFKSWNNPRAKIYRKLNDISETLGTAVNIQAMVFGNMGNNSGTGVAFTRNPSTGAANLFGEYLINAQGEDVVAGIRTPQSISKLAEQMPIIYQEFVSVTQKLEAHYRDMQDMEFTIENGNLYMLQTRSGKRTAKAAIKIAVDQVNEGLISKEEAILRIEPKQLDQLLHPSFDLESLKKAILLTTGLPASPGAAYGKVYFHAEDVVQEMKKGNPVLLVRQETSPEDIEGMVSANGIITARGGMTSHAAVVARGMGKPCVAGCSQLLVDEVRREISIGHQTIKEGEMLSIDGATGNVYIGQVPMAETSVDCDFEIFMKWVDENRDMMVCSNADNPRDAQKALDFGAEGIGLCRTEHMFFDDERIPVVREMILADDVLSRRKALERLLSFQRDDFYQIFKVLKGKTCTIRLLDPPLHEFLPHDKESIESMARQMGISTLAIEKRIQTLEEFNPMLGHRGCRLAITYPEIYQMQMRALVQGAILAMKEGYEAKPEIMIPLVSAHEEISIIRDLIEETIIEESKSKKINLSFPIGTMIETPRACMIADDIAKFADFFSFGTNDLTQMSFGFSRDDAGKFLGEYVDKGLLKKDPFQALDQKGIGRFIEQAVRLGKEVKPNLKIGICGEHGGEPSSIEFCYQQGLHYVSCSPFRIPIAKLAAAQAKIKQSRNDITIDK

SEQ ID NO: 19309 - protein, 333 aa, Neptuniibacter caesariensis
MLLLSQFLKQQDTEDTLVDLIGTLMLACKEVAIQLREGELAGVLGSTDNTNVQGETQKKMDVIANDLLKKFLLDNPLVAGLASEEEDHPVGGNPEGKYLVIFDPLDGSSNIDINVSVGTIFSILELPEGMDPSQDEAYLQCGRKQVAAGYVLYGQSSVLALTTGHGVNFFTLAHTGDFILTREQVQIPADTKEFAINMSNHRFWEEEMRNYVGDLLQGSEGPRGKNYNMRWIASMVAEVHRVLTRGGIFTYPWDGRDPSKPGKLRLMYEGNPMSMLIEQAGGISSTCYKNIMDLEPQRIHQRSAVALGSKNEVEALLTYHAESGDGQAAKLNI

SEQ ID NO: 19310 - protein, 374 aa, Xylella fastidiosa 9a5c
MTEPAILVLEDGTVFEGDAVGANGLSVGEVVFNTSLTGYQEVLTDPSYAYQLVTLTYPHIGNTGCTDQDDEANKVWAAGLIVRDVPRRPSNWRSQISLSDWLAARGVVAIAGIDTRKLTRILREKGAQHGALMAGEIDVDRAQDAARQFTGIKGMDLAKVVSTKQAYSWYEGQLDLDRNEWKRAAPQYKVVAYDYGVKLNILRMLAERGCDLTVVPAQTPVDEVLALCPDGVFLSNGPGDPEPCDYAVAAIKTFIMRRVPIFGICLGHQLLAQTVGAKVVKMRHGHHGANHPVQDLRSGRVMITSQNHGFAVDEATLPSNVRVTHRSLFDGTNQGIELLDVPAFSFQGHPEASPGPHDVDVLFDRFITMMAAQS

SEQ ID NO: 19311 - protein, 535 aa, Bradyrhizobium sp. ORS278
MTAPANNTPAAAATDTSVAALHDKILIVDFGSQVTQLIARRVREDGVYCEIVPFQKAEAAFRQMNPKAVILSGGPESVHEEGSPRAPQLIFESGVPVMGICYGQMTMAAQLGGTVEGGHHREFGRADVEVKTNSLLFDGVWQPGEQHQVWMSHGDRITQMPPGFSVAGVSPNAPFAVIQDEARKYYGLMFHPEVVHTPDGAKLIRNFVRNISGLGGDWTMHAFREEEIKKIRAQVGQGKVICGLSGGVDSAVAAVLIHEAIGDQLTCVFVDHGLLRLNEAETVVDLFRHHYNIPLVHVDASKLFLGELAGVTDPEAKRKTIGRLFIDVFEAEAKKIGGADFLAQGTLYPDVIESVSFTGGPSVTIKSHHNVGGLPARMNMKLVEPLRELFKDEVRVLGRELGLPDVFVGRHPFPGPGLAIRCPGEITTDKLDILRKADAIYIDEIRKAGLYDTIWQAFAVLLPVKTVGVMGDGRTYDYVVGLRAVTSTDGMTADFYPFDMKFLGNTATRIINEVKGVNRVVYDVTSKPPGTIEWE

SEQ ID NO: 19312 - protein, 488 aa, Xylella fastidiosa 9a5c
MSERQRRTRILATLGPATDPPGVLDALFKAGVNVVRLNFSHGDASDQARRAAEVRAAAAHVGVEIGILADLPGPKIRIGRFTEGKVRLVADARFDLLADSNAPLGDATQVGVSYLGLPQDVAAGDVLLLDDGLMQLQVVQVQGARIVTTVLNDGVLSDRKGLNKQGGGLSLGALTDRDRELIGIVSRMGVDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPMPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEVGADGGVSGLWEL

SEQ ID NO: 19313 - protein, 189 aa, Triticum aestivum
MAGGSPCASCKLLRRRCTKDCIFAPFFPADDPHKFAIVHKVFGASNVSKMLLELPVQQRGDAVSSLVYEANARVRDPVYGCVGAISFLQNQVSQLQMQLAVAQAEILCILMQQRDGCRSQDDAGRSDGHSLAAMQQMVVDDTAAAEAFLMQNGGGGFPPQLMSSYGGAPASNVHHYGQQDHLKRESLWT

SEQ ID NO: 19314 - protein, 215 aa, Brassica napus
ELNTNDFVHLLLDLFGAGTDTNSSTVEWAMSELLRSPKTMAKAQAEINRVLGQKGFVEESDISELPYLQAVVKEVFRLHPAAPLLVPRKAESDVEVLGFMVPKDTQVLVNVWAIGRDPSVWENPTRFEPERFLGKETDVRGRDYELTPFGAGRRICPGLPLAVKIVPLMLASLLYSFDWKLPNGVTSEDLDMHETFGLTLHKTNPLHAVPVRKHH

SEQ ID NO: 19315 - protein, 62 aa, Brassica napus
MRGILVDWLVEVSEEYTLVPDCVYLTVYLIDWFLHGKYLERQRLQLLGITCMLIASKYEEIY

SEQ ID NO: 19316 - protein, 304 aa, Zymomonas mobilis subsp. mobilis ZM4
MDDYSASAKALVAEMQAKAALSPTKAVAFQGAPGCNSNIAIQDLFPDSLPLPCFSFADALTAVKEGRAGRAMIPIENSLNGRVADMHFLLPESGLTIQAEYFLPINHCLVAPKGAGEITHVLSHPQALGQCRHWLQAHNLRALAHADTAGAAAEVADRKQAGLAALSPALAAKLYGLEILEKGIADGDTNITRFVVLAEADTALQDLPPIRQNLSGKMMTSLLFTVKNTPSALLNAIKGFGDNQVNMTKLESYQHGASFSATQFYADVEGEPSEDNVARALDILQENACDLRILGVYAQARPRQ

SEQ ID NO: 19317 - protein, 407 aa, Populus trichocarpa x Populus deltoides
MATASLIESSPLKWKKAFPFQPQPPLLTPNHYPYLIPLKPPKFTSKCISQLPILNPNSKNNNGPFPISPSITKPISQNLSKPPTSKNPLEIIYETMLKALDILKKPAIAAILIGVLLLHDPNSAFAASGGRIGGNSFSRRSSSEYSSRSYSVPRGGSSGFSYSVPYYAPSPFGGGGVYVGPAVGVGVGAGSSLFFILAGFAAFMLVSGFLSDRNEGGVLTAAEKTSVLKLQVGLLGMGRSLQRDLNRIAEVADTSSSEGLNYVLTETSLALLRHPDYCISGHSFVDVKRSMEDGEKRFNQLSIEERGKFDEETLVNVNSIKRQSTSSKRSNGFSNEYIVITILVAAEGVYKLPTINGSGDLKEALQKLGSISASKILAVEVLWTPQNENDTLSERELLEDYPLLRPL

SEQ ID NO: 19318 - protein, 420 aa, Pseudomonas aeruginosa
MSFQTISVIGLGYIGLPTAAVFASRQKKVIGVDVNQAAVDTINRGEIHIVEPDLDMVVHAAVTEGYLRATTNPEPADAFLIAVPTPFKHEHEPDLTFIEAASKSIAPVLKKGDLVILESTSPVGATEQMAGWLAEFRPDLTFPQTHGEASDIRVAHCPERVLPGHVLRELVENDRVIGGMSEKCSEAASRLYKIFVKGECIITNARTAEMCKLTENSFRDVNIAFANELSIICDKLDINVWELIRLANRHPRVNILQPGPGVGGHCIAVDPWFIVSKTPDEARLIRSAREVNDHKPFWVLEKIKLAVADVLQKQPEKTARDVSVACFGLAFKANIDDLRESPAIAIAQQVVASHPGRVLVVEPNIEELPGKFSGNLTLASTDSAMQEADVVVLLVDHKEFREIAPHPRQLVVDTRGLWEA

SEQ ID NO: 19319 - protein, 366 aa, Zymomonas mobilis subsp. mobilis ZM4
MMIFKIPVKASSAAALAICMMMGATPAISMNNQVHSIQTLPRILVLATGGTISGKKNGMSEIGYNAGGVTGKQLVEDIPELAKLAEINVEQIANIGSQDMNDAIWLRLAKRIQDAVAHNEADGIVITHGTDTMEETAFFLDTVIRTDKPIILTGAMRPSTAIGADGPANLYEAIEVAATPKAKDHGVMIVMNDTIHAARWASKTHTTAVETFQSINAGPIGYVDPASVRFIEPKKQPVPSYGLPTTAPLPAVEILYAHSGMGASIINDLIKTGVKGIILAGVGDGNSSKEAMAALNLAVKQGVIVVRSSRTGSGFVNRNVEVNDDKNDFVVSYDLSPQKARILLQILIANGKNKLSDIQSAFEAGF

SEQ ID NO: 19320 - protein, 277 aa, Halobacterium sp. NRC-1
MRMAQDTQQRAAVVEEMPEFGLGTWENEDPSACADSVRTALEMGYRHIDTAQIYENEDAVGDGIAAADVDREDVFLATKVWTSELGDGDVAPATEQSLEKLGVDYVDLLYVHWPANQYDATETLAALADLQADGVTERIGVSNFEPRHLDEAEDVLGELPFANQVEFHPLLQQEELREYADGEDIELVAYSPLARGEVFDVPEIQAVAEKHGVSEAQVSLAWVRRKGVTAIPKATGEDHIADNWASLDLELDDEDVAKIDGIDRRERQVDPEFGPWN

SEQ ID NO: 19321 - protein, 460 aa, Methylococcus capsulatus str. Bath
MSSGKIVQIIGAVVDAEFPRESLPKIYDALRVDEVGLVLEVQQQLGDGVVRCIAMGSTDGVRRGVTVTNTGAPISVPVGTETLGRIMNVLGDPIDEKGPIGEKERWGIHRKAPSYQDQAAANELLETGIKVIDLICPFAKGGKVGLFGGAGVGKTVNMMELIRNIAIEHSGYSVFAGVGERTREGNDFYHEMKESNVLDKVSLVYGQMNEPPGNRLRVALTGLTIAEKFRDEGRDVLLFIDNIYRYTLAGTEVSALLGRMPSAVGYQPNLAEEMGILQERITSTKTGSITSIQAVYVPADDLTDPSPATTFAHLDATVVLSRQIAELGIYPAVDPLDSTSRQLDPLVIGHEHYETTRRVQSTLQRYKELRDIIAILGMDELSENDKLIVSRARKIQRFLSQPFFVAEVFTGSPGKYVPLKDTIAGFKGIVDGDYDDVPEQAFYMVGSIDEALEKAKRLAA

SEQ ID NO: 19322 - protein, 333 aa, Beta vulgaris
MSKSRVYADVNVLRPREYWDYEALTVQWGDQDDYEVVRKIGRGKYSEVFEGLNVNSNERCVIKILKPVKKKKIKREIKILQNLCGGPNVIKLLDIVRDQHSKTPSLVFEFVNSTDFKVLYPTLSDYDIRYYIYELLKALDFCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDELNAYLNKYHLELDPQLDALVGRHSRKPWSRFVNPDNQHLVSPEAIDFLDKLLRYDHQDRLTAKEAMAHPYFSQVRAAESSRMRTQ

SEQ ID NO: 19323 - protein, 468 aa, Arabidopsis thaliana
MGTGNSKENWRQSSFRSTSASSASPSSSSWASQQSYPQYGAESYNYPPPPSYAQPPEYTQPPPPLYSTQPYSAPSYSAPPSQSYGSDNKKRLERKYSKISDDYSSLEQVTEALARAGLESSNLIVGIDFTKSNEWTGARSFNRKSLHFIGSSPNPYEQAITIIGRTLAAFDEDNLIPCYGFGDASTHDQDVFSFNSEDRFCNGFEEVLSRYKEIVPQLKLAGPTSFAPIIDMAMTIVEQSGGQYHVLVIIADGQVTRSVDTENGQLSPQEQKTVDAIVQASKLPLSIVLVGVGDGPWDMMREFDDNIPARAFDNFQFVNFTEIMAKNKAQSLKETEFALSALMEIPQQYKATIELNLLGRRNGYIPERFPLPPPMRGGSSSYNSPKPSRLPSFKPSVPPHPTEGYHVRSSPVPPPTSSASDNQLCPICLSNPKDMAFGCGHQTCCECGPDLQMCPICRAPIQTRIKLY

SEQ ID NO: 19324 - protein, 299 aa, Halobacterium sp. NRC-1
MSDIRYDIVDVFAQSQYTGNQLAVVQPEGELSGEEMQRIANEFDYSETTFIDPDGSHADGFEVRIFSPTTELPFAGHPTLGTAYVLRERLGLSDDELVLHEQVGAIPVSVEKTATGDEILLMEHPEPTFDEIIEPARAADAVSLPADVLDDQFPAQIISTGVPTLIVPVESLSAVKEAETNDEVYSELVDQYGVRNLLVFAPETYEPENELNVRVFAEFFGIPEDPATGASNGCLAAYLTEHQYFDTSEIDVRVEQGYEVNRPSLLYLRGQTTADSIQVEVGGRVIPTATGTLVESNSL

SEQ ID NO: 19325 - protein, 765 aa, Oryza sativa
MMRLLLVAVAVAMAAVVVAAEERATYIVHMAKSAMPAEYGDDHGEWYGASLRSVSGAGKMLYAYDTVLHGFSARLTAREARDMAAMDGVLAVNPEARYELHTTRTPEFLGIAGNDGLFPQSGTAGDVVVGVLDTGVWPESRSYDDAGLGEVPSWWKGECMAGTGFNSSACNRKLVGARFFNRGYEAAMGPMDTTRESRSPRDDDGHGTHTSSTAAGAAVSGASLLGFASGTARGMAPRARVAVYKVCWLGGCFSSDILAGMDAAVADGCGVLSLSLGGGAADYARDSVAIGAFAAMEQNVLVSCSAGNAGPGTSTLSNVAPWITTVGAGTLDRDFPAYVSLGNGKNYTGVSLYAGKALPSTPLPIVYAANASNSTAGNLCMPGTLTPEKVAGKIVVCDRGVSAQVQKGFVVRDAGGAGMVLSNTATNGEELVADAHLLPAAGVGAKEGAAIKAYVASDPSPTATIVVAGTQVDVRPSPVVAAFSSRGPNMLTPEILKPDIIAPGVNILAAWTGKAGPTGIAADTRRVAFNIISGTSMSCPHVSGLAALLRSAHPEWSPAAVRSALMTTAYSTYAGAGDANPLLDAATGAPATPFDYGAGHVDPASAVDPGLVYDLGTADYVDFLCALNYTSTMIAAVARSKSYGCTEGKAYSVYNLNYPSFAVAYSTASSQAAESSGAAATTVTHRRTLTNVGAAGTYKVSAAAMPGVAVAVEPTELAFTSAGEKKSYTVSFTAKSQPSGTAGFGRLVWSDGKHSVASPMAFTWT

SEQ ID NO: 19326 - protein, 514 aa, Bradyrhizobium sp. ORS278
MERIYDLAIVGGGVNGCGIARDAAGRGNSVFLCEMNDLASGTSSWSTKLVHGGLRYLEYYEFRLVREALIEREILWQIAPHIIRPLRFVLPHHSGLRPAWLLRLGLFLYDHLGGRKLLPPTRSVNLRSDEVGRPLIAGRYSSGFEYSDCFVDDARLVVLTARDAADRGAVIRTRTRATEIRQDGSVWLVTTENIQNGERETIKARALVNAAGPWVEQVLSTGAGVNAKAKVRLVQGSHIVVRKLYDHDRAYIFQNADGRIIFAIPYQQDFTLIGTTDRDYQGDPAKVKATDEEIAYLCAALGEYIAKPVTPADVVWSYSGVRPLYDDGASEAKAATRDYVFELDTPGGLPLLSIYGGKITTYRRLSEEALERLAPYLKGTQAEEGWTGKSSLPGGDMNVQAIDALITDLRRTCPFLSDAHAKRIAHAYGTRAKAMLAGATSSADLGQDFGGTLTEREVRYLMTNEWALTAEDIVWRRSKLGLRMSAAEIAALDAWITANRERSTVMAREAGGRA

SEQ ID NO: 19327 - protein, 482 aa, Thermoproteus tenax
MLGKYGVFPPTDPEFEDPPKLDKYDVIVVGGGGGGYHGAFQLSAGGYRVLMVDDKGNLGGNCLYEGCIPSKSVFYMVYLAERLRRLAKRSAGAAEVKAIWEEAVDHKDEVQYLRYLQHIREIKEHGNVDFVKGVARVLDGRRVEVTAVDGSWRKTVEGSRLLLATGSVAVRLPIPGAELAIGSEELFGYRTKRRTLPREVVVIGGGYIGVEVASAMASAGAKVTVVEMLPRIMSGWDSSIVSMIEGALKGRGVEILTNSRVTAIREESGQKVVEFQRPDGSKGTVAGEEVVMAVGRKPYVEGLEALGIVEKGRVVADSSMSTKAPGVYAAGDVLGKYMLYHAAVKESTVAAWNIMMGRPVYEVNFNAIPLTLFTEPEAAMVGISEDEARARGIPYVAVQYPLEDDSYAQIVGVREGWVKLIVERESQRIIGGSVYGEAASMIINEIALAVAVNARVRDLALLAHAHPTIFESIDRAAVRFSL

SEQ ID NO: 19328 - protein, 320 aa, Streptococcus agalactiae NEM316
MKKILVLHTGGTISMNANEKGQVMSSADNPMKYVDLSLDDLDLTVVDFLNLPSPQITPHHMLDIYHYLKQHASNFDGVVITHGTDTLEETAYFLDTMILPKIPIIITGAMRSTNELGSDGVYNYLSALRVANSTKAADKGVLVVMNDEIHAAKYVTKTHTTNVSTFQTPTHGPLGIIMKQDLLFFKATEERVRFDLDKITGTVPIVKAYAGMGDSGIISFLNSQNISGLVIEALGAGNMPPKAAQEIEELIEQGVPVVLVSRCFNGIAEPVYGYEGGGARLQESGVMFVKELNAPKARLKLLIALNAGLTGQNLKDYIEG

SEQ ID NO: 19329 - protein, 101 aa, Glycine max
  misc_feature (15)..(15): Xaa can be any naturally occurring amino acid
  misc_feature (55)..(55): Xaa can be any naturally occurring amino acid
  misc_feature (66)..(66): Xaa can be any naturally occurring amino acid
  misc_feature (75)..(75): Xaa can be any naturally occurring amino acid
  misc_feature (90)..(90): Xaa can be any naturally occurring amino acid
MRTKRKEMASSMISXPADTSGNRASSGLDARFAVLKSMAGFPTSETNKDITLIAXNCGRVLCMQVXSPIVMMKFXTLCYLPDLDDAQLAXEVRYLLKNGWI

SEQ ID NO: 19330 - protein, 279 aa, Thermoproteus tenax
MGDGGALAHVAESLNISGAVMVVNGDVFTDADYRAVLDAHKRAGGVATMMLVEVSPESVSKYGIAVLDDSMRLIEFVEKPKEPPAGSRLANAGIYVFEPEVFKLIPRRRGEVKIAKDIIPELLRRGDIYAFIHRGIWHDIGTPADYLKANYAALDKWGSKEVDKPGIDITPPVYIGEGSIVEEGASLGPYVVLGQGAKVGRYARLKNSVLMRAATVEPGAYISGSIIGEETYIGRWARVLESVVADGVYIKDEVYVGRGSAIGPNREVVEDVPDGSMLP

SEQ ID NO: 19331 - protein, 324 aa, Burkholderia thailandensis E264
MTLAMAITQTGGPEALKAIEIDVPEPGPLDVRIRQSVIGVNFVDTYFRSGLYPVASLPAVLGFEGAGVVEAVGSEVTRLRPGDRVAYTGAPIGAYAESRVLPASRLVRIPDALSFETAGSSMLRGLTAHMLLHKVHPTTRGDWILVHAAAGGLGQIVVRWAKRLGAQVIGTVGSAGKIELARVAGADHVLLHADPGWADEAVRIAERRGVHLAVDGIGGSMVAQTLRVVRPFGVVASLGQPAGPIPPVRVEDLGFARSIGLMRPSSLAYANDPQLYARGTSDLLDALADGMVAPVGARYALSDAARAHAELEAGKTVGSVILTV

SEQ ID NO: 19332 - protein, 1170 aa, Arabidopsis thaliana
MADSQNGKSAFFFFFVSLILLFLSPSYSDVTASESDPIPYENSDASPGVVTSSESDRQGVSLHRLEELVRNLTELVARLDAKLSETPFKVKKEITRDEIEEKAKAFSVTKYSPFWSERFEFTSAVKLDSEATCINVLPFRDHEGLSKYFAVGDSSGRVFVFLRNGDVLVEFFTTCDSPITAMVSYMSVYKNESFVVTGHQSGVILLHRLREGSIGEDLNSAVMENVGKFDGTEDGLQVTLLEVHHVGRVRYILATDLSGKLTVFTENRTVYGSVSPTSRPLVFLKQRLLFLTETGAGSLDLRSMKIRESECEGLNHSLARSYVFDASERAKAYGFTSEGEIIHVLLLGDIMNFKCRVRSKKKVQMEEPVALQAIKGYLLIVNQEKVFVYNVSTQHYVRTTGPRLLFPAALEDIRSTFLSHRESTKTTDHQKLEKVTPLIASDREKLLVMGLGDGYVATYKSKLPISKAEFNTMLWSSPVFFFILFLFGAWHFFSKKKESLTAWGPDDPFSSTTMSSSSTTTAQNSSAFSESTRRNDDHMDLRRRYVSPSRYPPGAATGAYRSVGSNDPSSRAPVETTNYRTTAQEMKYRGGFIYSNIWVPWRIQSHFKKQSVTGPSYRIFSGNSGEVSRLTAEAKSKPIPSGRNPHEFVHRVAPHYHEWSRVYGKTFLYWFGSKPVVATSDPRLIREALTTGGSFDRIGHNPLSKLLYAQGLPGLRGDQWAFHRRIAKQAFTMEKLKRWVPQMVTSTMMLMEKWEDMRNGGEEIELEVHKEMHNLSAEMLSRTAFGNSVEEGKGIFELQERMMRLFYLVRWSVYIPGFRFFPSKTNREIWRIEKQIRVSILKLIENNKTAVEKSGTLLQAFMSPYTNQNGQEEKLGIEEVTDECKTFYFAAKETTANLMTFVLVLLAMNQEWQNIAREEVICVLGQTGLPTLDILQDLKTLSMIINETLRLYPPAMTLNRDTLKRAKLGDLDIPAGTQLYLSVVAMHHDKETWGDDAEEFNPRRFEDPKKQSALLVPFGLGPRTCVGQNLAVNEAKTVLATILKYYSFRLSPSYAHAPVLFVTLQPQNGAHLLFTRISSVAVGGFVIITAVSSAALGAFRYTIEEKRKKSGMACRVCRGKGFYICKLCKGNATIKWSPLYDPVCINPCLCPTCDGHRVQKCLNCLGKEYW

SEQ ID NO: 19333 - protein, 977 aa, Mycobacterium smegmatis str. MC2 155
MSAERSTVGFNFLAEPELPAPQVSEAQAEQILATHYGLQAKAASLGSQQDKNFLVTQGDETVGVLKIANPAFNETELEAQDLAAELIAAAEPTLRIAVPIPNVRGEKRTAVTGLLESRQATAYVRLLRFLPGDALMQRGYLRPSTVAELGALAGRVTRALAEFSHPGLDRILQWDLRYGAEVVATLASHVDDPARRDRLEATTRDAWARIEPFADSLPHQAIHMDLTDANVVVSHEPGGVVRPDGIIDFGDLTDSWTVGELAITLSSVLQHPGATPTSVLPGIRAFHAVRPLSVDEAMVLWPLLVLRTAVLNVSGAQQAAIDPDNAYVTENADGEWQMFEAATSVPLDVMTALITADLGFDCAAPELGALTPMITGLEADAVTTLDLGTVSDTLDSAFTRGGWVRSDIENELARAALADGARVVLTQFGQPRPTRAPALSHDEPAVVPTGITMWCAEDVALTAPFEGEISRDGDSVTLRGNTCELTLTGVSGDADTFGVARAGRPVEVALRPVGAPVAPALVTPSLAPGWLAWSVDPRPLFGLPALATDSTDADLVARRDRAFAPVQEHYYDEPPRIERGWRHFLMSTSGRCYLDMVNNVTVLGHAHPRIAEAAARQLRKLNTNSRFNYASVVEFSERLASLLPDPLDTVFLVNSGSEASDLALRLAIAAAGRPDVVAMREAYHGWTYGTDAVSTSTADNPNALETRPDWVHTVESPNSFRGKYRGSDVGRYADEAVAQIQELAAAGRAPAAFICETVYGNAGGMALPDGYLEKVYAAIRANGGYAVADEVQVGYGRLGEWFWGFQQQGVVPDIVSMAKSTGNGYPLGAVVTSRAVAEAFRSQGYFFSSTGGSPLSCALGMTVLDVLGEERLQENASRVGAHLKSRLLALSDKHPIIGTVHGVGLYLGVEMIRDPATLEPATEETALICDRMLELGVIIQPTGDHQNILKTKPPLCIDTESADFYVDTLDRVLTEGW

SEQ ID NO: 19334 - protein, 255 aa, Zea mays
  misc_feature (42)..(42): Xaa can be any naturally occurring amino acid
  misc_feature (57)..(57): Xaa can be any naturally occurring amino acid
MAASVSRAICVQKPGSKCTRDREATSFARRSVAAPRPPHAKXRRRHPLRLRRGTGPXHCSPLRAVVDAAPIQTTKKRVFHFGKGKSEGNKTMKELLGGKGANLAEMASIGLSVPPGFTVSTEACQQYQEAGCALPPGLWAEVLDGLRWVEEYMGATLGDPQRPLLLSVRSGADVSMPGMMDTVLNLGLNDQVAAGLAAKSGDRFAYDSFRRFLDMFGNVVMDIPHALFEEKLEAMKKAKGLKNDTDLTATDLKEL

SEQ ID NO: 19335 - protein, 573 aa, Xanthomonas campestris pv. vesicatoria str. 85-10
MPNPVMSHSVEDIKSESRRLRGSLQQSLADAVTGALREDDQTLIKYHGSYQQDDRDIRDERRRQKLEPAYQFMIRTRTPGGVITPTQWLALDGIATRYANHSLRVTTRQAFQFHGVIKRELKATMQAINATLIDTLAACGDVNRNVQVAANPLLSQAHATLYADAARVSEHLLPNTRAYYEIWLDEERVSGSGSEEEPIYGERYLPRKFKIGFAAPPLNDVDVFANDLGFIAILRDGQLLGYNVSIGGGMGASHGDAETWPRVANVIGFVTRDQLLDIATAVVTTQRDFGNRAVRKRARFKYTIDDHGLDTIVAEIARRAGFALQPAQPFAFDHNGDRYGWVEGEDGRWHLTLSLPAGRIADTDTAAHLSGLRAIAQLNVGEFRMTPNQNLVIAGVPASERARVDALVAQYALDAGNRAATALARGAMACVALPTCGLAMAEAERYLPDFSAALQPLLQQHGLADTPIVLRVSGCPNGCSRPYLAEMALVGKAPGRYNLMLGGDRRGQRLNTLYRENITEPEILAALQPLLARYASEGDHANDEGFGDFLHRAGVIALPPYPTHRRLDLELLA

SEQ ID NO: 19336 - protein, 139 aa, Bacillus anthracis str. Ames
MTRVRDVMSTHIVQCTPLDNVYEAAVKMKEESIGLIPVVENEQVVGLVTDRDLVVRGIAEKHPGSNKITNVMTTNIISVAPDDSLEKATELMAQHQIRRLPVVESDQLVGMLALGDLAIRESADDQAGFALSEISEHTE

SEQ ID NO: 19337 - protein, 298 aa, Arabidopsis thaliana
MGLEREVYGLVMVSLVLMAIATMCCVQATIEEEAAKDESWTDWAKEKIGLKHEDNIQPTHTTTTVQDDAWRASQKAEDAKEAAKRKAEEAVGAAKEKAGSAYETAKSKVEEGLASVKDKASQSYDSAGQVKDDVSHKSKQVKDSLSGDENDESWTGWAKEKIGIKNEDINSPNLGETVSEKAKEAKEAAKRKAGDAKEKLAETVETAKEKASDMTSAAKEKAEKLKEEAERESKSAKEKIKESYETAKSKADETLESAKDKASQSYDSAARKSEEAKDTVSHKSKRVKESLTDDDAEL

SEQ ID NO: 19338 - protein, 393 aa, Triticum aestivum
  misc_feature (230)..(230): Xaa can be any naturally occurring amino acid
  misc_feature (234)..(234): Xaa can be any naturally occurring amino acid
  misc_feature (246)..(246): Xaa can be any naturally occurring amino acid
NKFVQKSRLVPVRNSRDIVDPRVRSGAGYMPGRLYDIDASKYGNAAELKSLIAALHGKGVQTIADIVINHRCADYKDSRGIYCIFEGGTSDGRLDWGPHMICRDDTTYSDGTANLDTGADFAAAPDIDHLNDRVQRELKEWLLWLKSDLGFDAWRLDFARGYSPEMAQVYIDGTSPSLAVPEVWDNMASGGDGKPNYDQDAHRQNLVNWGDKVGGAPSAGMVFHFPTKGXLNAXVEGELWRLIDPXQGKAPGRDGGGAGQGPVTFVDNHDTGSTQALWPFPSDKVMQGYAYILTHPGTPCIFYDHFFTWGFKDEIAALVAIRKRNGITATSALKILMHEGDAYVAEIDGKVVVKIGSRYDVGAVIPAGFATSAHGNGYAVWEKIGAAATPRRS

SEQ ID NO: 19339 - protein, 190 aa, Zea mays
  misc_feature (16)..(16): Xaa can be any naturally occurring amino acid
  misc_feature (24)..(24): Xaa can be any naturally occurring amino acid
  misc_feature (39)..(39): Xaa can be any naturally occurring amino acid
  misc_feature (65)..(65): Xaa can be any naturally occurring amino acid
  misc_feature (85)..(85): Xaa can be any naturally occurring amino acid
  misc_feature (89)..(89): Xaa can be any naturally occurring amino acid
  misc_feature (103)..(103): Xaa can be any naturally occurring amino acid
  misc_feature (114)..(114): Xaa can be any naturally occurring amino acid
  misc_feature (132)..(132): Xaa can be any naturally occurring amino acid
  misc_feature (141)..(141): Xaa can be any naturally occurring amino acid
MAVPEVESDGVVFPPXTAPPGSAXSHFLEVGGGLGLQIXAYFIKITDIGVYLEDEAVTALGKKWXAGRRADEVNSDDGFFRDDAXGDFXKFARWRMILPLTCXQYADKVTENCXTFWKAAGLYTDCEGASAXKITEVIKPXTFASGASIIFTHSAAGVLTDDFSSAPPGQRTSRPTIKNKRLLRGQSWSP

SEQ ID NO: 19340 - protein, 82 aa, Vitis vinifera
MDELIQSIYYEEIKITILVAAEGVHKLPTINGSGDLKEALQKLGSIPSSRTLAVEVLWTPQNENDTLSERELLEDYPLLRPL

SEQ ID NO: 19341 - protein, 112 aa, Populus trichocarpa x Populus deltoides
MTTSKFYIFLLLSVVLAVRVSLSSSTAVDFLPLESSSECRGSIAECLMDEEFGMDTESNRRILATSRYVSYGALRRNTVPCSRRGASYYNCRPGAQANPYSRGCSRITRCRN

SEQ ID NO: 19342 - protein, 156 aa, Magnetospirillum magnetotacticum MS-1
MRRAKIVCTIGPATESKEQLRALVDAGMDVARINRSHGSAEEHAAVYHGVREAAAESGRSVAVLVDLQGPKIRLGRFAGDEKHWLEEGDTFTITTEDVVGTKELVSTTHKGLPGDARVGDPILIDDGKVLVRVTGVEGPRVVTRVEVAGPVSNNRA

SEQ ID NO: 19343 - protein, 395 aa, Rhizobium leguminosarum bv. viciae 3841
MNAHASTRHQTYLNAAELAVIRSQYPIVKECIYWNNAAVSPISIGVRDAIARQATLHATDTSGIMVASAPTCDKGRSLAAKLVGSTAERIAYIQNTSHGLSLVALGIDWKPGDNLVVPELEFPSNFLIWETLSQQGVEIRTMKARNGALAPDDLRFLVDSRTKLVAVSHVQFYSGFRVDLAGFSQICADHDALLVVDGTQSVGVLSVDMEGEGVDVLVVSAHKWMLGPVGIGFAAFSERAFERIKPRIVGWLSVNDAFSFHRVLDFLPDAKRFEPGTENGAGIFGLAKRLEEIDSIGMEKIESYVMELGARIRTQAKSAGYEIMSDWPEESQSGIILLKNPKMATSVLFADLDAADVKCSVRNDAVRFSPHYYSNEDELALVSDVLRGAASRANA

SEQ ID NO: 19344 - protein, 433 aa, Mycobacterium tuberculosis CDC1551
MAATAHGLCEFIDASPSPFHVCATVAGRLLGAGYRELREADRWPDKPGRYFTVRAGSLVAWNAEQSGHTQVPFRIVGAHTDSPNLRVKQHPDRLVAGWHVVALQPYGGVWLHSWLDRDLGISGRLSVRDGTGVSHRLVRIDDPILRVPQLAIHLAEDRKSLTLDPQRHINAVWGVGERVESFVGYVAQRAGVAAADVLAADLMTHDLTPSALIGASVNGTASLLSAPRLDNQASCYAGMEALLAVDVDSASSGFVPVLAIFDHEEVGSASGHGAQSDLLSSVLERIVLAAGGTREDFLRRLTTSMLASADMAHATHPNYPDRHEPSHPIEVNAGPVLKVHPNLRYATDGRTAAAFALACQRAGVPMQRYEHRADLPCGSTIGPLAAARTGIPTVDVGAAQLAMHSARELMGAHDVAAYSAALQAFLSAELSEA

SEQ ID NO: 19345 - protein, 316 aa, Halobacterium sp. NRC-1
MSSDDAWTAAALPDQSGRRVVVTGANSGLGFEATRAFARAGAHVVMACRSTERGEDARDDIVAELPGASLTVHELDLAALDSVAAFADWFTAEFDSLHVLANNAGVMAIPRSETADGFETQFGVNHLGHVALTAGLLGVLRRTSGETRVVTQSSGAHRRGRIDFEDLQHEAEYGKWEAYSQSKLANLLFAYELDRRLRAASASVTSVACHPGYAATNLQLRGPQAAGSRLRLLAMRAANALVGQSAEQGAWPLLYAATNPSIDGGEYIGPGGVLNMRGHPERQQPSARSRDEDTARRLWTVSADRTGVDFDLPDPA

SEQ ID NO: 19346 - protein, 103 aa, Candida albicans SC5314
MVHVVTEVNEFQTLLKENNLVIVDFFATWCGPCKMIAPLLEKFQNEYSNIKFLKIDVDQLGSLAQEYNVSSMPTLILFKNGEEVNRVIGANPAAIKQALASLA

SEQ ID NO: 19347 - protein, 469 aa, Corynebacterium glutamicum ATCC 13032
MSQEDITGKDRLQELIGADYRLQWIIGHGGMSTVWLADDVVNDREVAIKVLRPEFSDNQEFLNRFRNEAQAAENIDSEHVVATYDYREVPDPAGHTFCFIVMEFVRGESLADLLEREGRLPEDLALDVMEQAAHGLSVIHRMDMVHRDIKPGNMLITANGIVKITDFGIAKAAAAVPLTRTGMVVGTAQYVSPEQAQGKEVTAASDIYSLGVVGYEMMAGRRPFTGDSSVSVAIAHINQAPPQMPTSISAQTRELIGIALRKDPGRRFPDGNEMALAVSAVRLGKRPPQPRTSAMMAQAEAPSPSESTAMLGRVARPATITQEAAPKRGSGIGIGLFIAALLAVIIGAVIYAGTTGILFNDTPEETTTPETITETYTPTVEETTSQWVPPTPPTRSTFTEPETTSHRPTTSEESTSEEPTTEAPTSSRTVPQIPTSTPRTSASVPVETNAPADDLIDAVNGLLDVGGAQ

SEQ ID NO: 19348 - protein, 746 aa, Mesorhizobium loti MAFF303099
MSQRIVSFVMSGGVGSRLWPLSREDNPKQFHDFSGDGSMLAKTLRRLAARPDGQTPIFLIASERHADRVRADLAGLDLAGGGPLFEPTGRNTAAAVALATLRTLSEFGDSLVLVVPSDHEISTAGQFWQSVEAGTEAARAGRLVVFGIKPTQPETGYGYIEVSAEKGGVSDVSRFVEKPDLATAQGYLEAGNFYWNTGIFLFRAAAMRDAFAVFQPDIWRATEAAYKAATSDLSGLYMPLDLYAAIPSNSIDYAIMERARDIAMVPAGFRWNDLGSWQSLLDVGPADDQGNVIVGDVVAIDCENSYIRSEGRLLSAIGMKDVAIVSTADATFVAPVSHSQHVKKVVEQLEKSGRLETRFTPAHDRVIESGAWRRRVHHWLFQETLPLWSTSGVDERHGGFHEALGFDGAPLMKPKRMRTQARQVYAFAVAKEHGWTGPAERLIAHGIDFMAGKGRTERGGWVRTLNVDGAVADATEDAYDHSCVLLALAHAHMSGNTDALRLGEETFAFLDAHLEDSRMTGFLETSDGEGERRSNPHMHLLEAFLAWYQATGERAHLRRAARIIDLFRSHFFDAESWTLGEYFDAEWKPSTGEKGSWTEPGHHFEWASLLVDFAERSGQAELSGFARKLYASAIANGLNRATGLAYGAVSRQGLPLDLISRSWPQAEAIKAAIALDGSGGPDLKPEIEARVGRLFRWHIDPAPLGLWIDRIDERGRSLASDVPASIFYHLVCALTQYLDRTAKKAV

SEQ ID NO: 19349 - protein, 487 aa, Mesorhizobium loti MAFF303099
MRAQPTASHYVNGRYIDDEQGAPLPVIYPATGETIAMLRSATPNVLELAIEAARAAQPAWARLKPVERGRILRRAADILRARNADLARIETLDTGKAIQETLVADAPSAADCLEYFGGAVAAYNGEAVDLGGPFAYTRREALGVCVGIGAWNYPIQIAGWKSAPALAMGNAMVFKPSENTPLSALALAEIYSEAGLPDGLFNVVQGYGDVGAGLVGHDVVAKVSVTGSVPTGRKVLSLAGSKMKHATMELGGKSPLIVFDDADIENAIGGAMLGNFYSTGQICSNGTRVFVQSGIHDRFVERLVERTKKIRIGNPLDPETQMGPLVSKAQHEKVVGYIGIGKQDGAVLACGGNVPSLQGFDGGFFVEPTVFTGVTDTMRIAREEIFGPVMSVLKFDGEDEVIDRANDTEFGLAAGVFTRDLPRAHRVIAELQAGTCWINAYNLTPVEIPFGGFKQSGIGRENSLAALALYSQLKSIYVETGDVASPY

SEQ ID NO: 19350 - protein, 370 aa, Zea mays
MSVLTCVIESMGSSCSRSHSFDEAEAAENAKSADIDRRILQETKAEQHIHKLLLLGAGESGKSTIFKQIKLLFQTGFDEAELRSYTSVIHANVYQTIKILYEGAKELAQVEPDSSKYVLSPDNQEIGEKLSEIGARLEYPSLNKERVQDVRKLWQDPAIQETYSRGSILQVPDCAQYFMENLDKLSEEDYVPTKEDVLHARVRTNGVVETQFSPLGESKRGGEVYRLYDVGGQRNERRKWIHLFEGVNAVIFCAAISEYDQMLFEDETKNRMMETKELFDWVLKQRCFEVPLSVCEWFKDYQPTAPGKQEVEHAYEFVKKKFEELYFQSSKPDRVDRVFKIYRTTALDQKLVKKTFKLIDESMRRSREGT

SEQ ID NO: 19351 - protein, 476 aa, Burkholderia thailandensis E264
MNIHPVILCGGSGTRLWPMSRGGYPKQYLKLAGNTTLVQQTALRVRDVEGVGAPIVVTNNEQRFLVAEQLRQVGITPSSIVLEPMGRNTAPAIAIAALLALRESPDALLLVLPSDHVIDNETAFVDVVKTAASVASDAHLVTFGVTPTQAHTGYGYIRRGEAFAGDTRVYRVDAFVEKPDAPAAERFIADGGYYWNSGMFMLKASTYLDELRRHAPDIANQAELALGAAKRDHDFLRLDPEAFGASPNVSIDYAVMEKTERAAVVAAANLGWNDIGSWSALADIAATDAQRNALIGDVYTDAVENSYIRAEHRMVAALGLDNIVIVETADAVLVAHRDRAQDVKKVVEWLNASGRRESVTHRRVIRPWGAYEGIDQGERFQVKRIVVNPGAQLSLQMHHHRAEHWIVVKGTALVTNDGKEIILTENQSTYIPLGTTHRLKNPGKIPLELIEVQSGSYLGEDDIVRFEDTYGRTSAT

SEQ ID NO: 19352 - protein, 485 aa, Arabidopsis thaliana
  misc_feature (430)..(430): Xaa can be any naturally occurring amino acid
MGKRGRACVVVLGDLGRSPRMQYHALSLARQASFQVDIVAYGGSIPHEAVLNHPSIHIHTMAQPRFIQYFPKILYPVTLLLKAFIQFTMLLWFLFVKVPAPDIFLVQNPPSVPTLIAVKWASSWRRAAFVVDWHNFGYTLLALSLGRNNLLVSLYRWSENHYGKMATGSLCVTKAMQHELDQNWGVRAKVLYDQPPEFFRPALLEERHELFCRVRKDLCHPIGVYDFISRELENQELNETLFTTKFNADISLKQNRPALVVSSTSWTPDENFGILLEAAVMYDRRVAARSKGSETAEISEEQHHYPNLLFIITGKGPEKEMYEEKIKRLNLRHVAFRTMWLAAEDYPLLLGSADLGVCLHTSSSGLDLPMKVVDMFGCGLPVCSVSYSCIQELVKDGKNGLLFSSSSELADQLLILFKGFPGNCDALMSXLKAGAMETWFLSGSEWGLTRSGERFVPKTLLNHLQGRVLQIADFMKRESSKIDGL

SEQ ID NO: 19353 - protein, 262 aa, Physcomitrella patens subsp. patens
MRKRERENPCFVCGHYHKFEDGEVCGICGHRLQEATEKGPQQSAFSTEILPQFLYLGSYDNASRAELLKAQNITRILNTVPTCQNLYKNSFTYHSLKEEKTIPFAECLEFIEQARVDKARVLVHCMSGQNRSPAVVIAYLMKHKQWRLPQAYQWVKDRRPSINLSEAVAQQLQQFEIEVFGNNVPTTPIYNTPAGVTFGFGYPTPVPEPIVPTFTPQPMANPLGQAPVFGSVGVPIMPSSNFVFGAVRHEPRAAMDQSMDGS

SEQ ID NO: 19354 - protein, 500 aa, Physcomitrella patens subsp. patens
MAEAVAAGVGVSRIGLAGLAVMGQNLALNIAEKGFPISVYNRTDSKVDETVERAKEEGDLPLVGFKDPKEFVLSIQKPRSIIILVKAGAPVDQTIQTLSQYMEPGDCIIDGGNEWYENTERRAKQVAEKGLLYLGMGVSGGEEGARNGPSMMPGGTEEAYHYIEDVVSKVAAQVDDGPCVTYVGQGGAGNYVKMIHNGIEYGDMQLISEAYDVLKSVGGLTNEELHETFAEWNEGELESFLVEITRDIFSVKDDKAEGFLVDKILDKTGMKGTGKWTVQQAAELSIAAPTIAASLDSRFLSGLKEERLEAARIFKEAGVDDIIAVKNLDKKVLVDDVRKALYASKICSYAQGMNLIRAKSIEQGWNLNLGELARIWKGGCIIRAKFLDRIKKAYDRNPELASLLIDPEFTKEMVERQSAWRRVVSLAIEVGVSTPGMTASLAYFDTYRRGRLPANLVQAQRDYFGAHTYERIDMPGSYHTEWFKIAKQFVNSKTPVKASA

SEQ ID NO: 19355 - protein, 281 aa, Oryza sativa
HEAHLTSPPDKARGDYLLPLLLLSPPTTPPSYISAVLIAWSRGEERRPTLRGEESGGGEGSEPYLTRSAEAYGLGVGHADRAGMEEVDMDEEVRPEFACPYCYEDHDVVSLCAHLEEEHPFEPHAAPCPICSDKIAKDMLNHITVQHGYLFKNRRRLRRFVIPGSQALSLLSRDLREAHLQVLLGGGGHRSNNSSNTTNISADPLLSSFGLSFPTSDTEETSKPPISIPDDASVIKETPAQPWDSSIDSSLTREEREQKRKQASVRATFVQDLLLTTLFGD

SEQ ID NO: 19356 - protein, 428 aa, Triticum aestivum
NKFVQKSRLVPVRNSRDIVDPRVRAAAGINPQRVLPVMIDVGTNNEKLLKDPLYLGLQEHRLEGEEYVEIIDEFMEAVFSRWPNVIVQFEDFQSKWAFRLLQRYRKTYRMFNDDVQGTAGVAIAGLLGAVRAQGRPMIDFPKQKIVVAGAGSAGIGVVNAASRTMARMLGNNEVAFESARSQFWIVDAHGLITEERVDIDPDARPFARRKSELTHQGLNEGASLIEVVKKVKPDVILGLSAVGGLFSKEVLEALKDSSSSRPAIFAMSNPTKNAECTPEEAFSIIGEKVVFSSGSPFDDVDLGDGKIGHSNQGNNMYLFPGIGLGTLLSGARIVSDGMLQAAAERLASYMKEEEVLQGIIYPPTSRIRDITKEVAAAVVREAVAEDLAEGYRDMDARELARLSEEETVDYVKNNMWNPVYPTVVYKKD

SEQ ID NO: 19357 - protein, 359 aa, Solanum tuberosum
PFDAPGVIKGQGTIGTEINRQLKDIHAVFVPVGGGGLISGVAAYFTQVAPHTKIIGVEPYGAASMTLSLYEGHRVKLENVDTFADGVAVALVGEYTFAKCQELIDGMVLVRNDGISAAIKDVYDEGRNILETSGAVAIAGAAAYCEFYNIKNENIVAIASGANMDFSKLHKVTELAELGSDNEALLATFMIEQPGSFKTFAKLVGSMNITEVTYRFTSERKEALVLYRVDVDEKSDLEEMIKKLNSSNMKTFNFSHNELVAEHIKHLVGGSASISDEIFGEFIFPEKAGTLSTFLEAFSPRWNITLCRYRDQGDINGNVLVGFQVPQSEMDEFKSQADGLGYPYELDNSNEAFNIVVAE

SEQ ID NO: 19358 - protein, 224 aa, Porphyromonas gingivalis
MTLIAERLVPILRSLPQGVRLAAVSKFHPVEELMEAYEAGQRVFAESRVQELMSKVEAMPDDVEWHFIGPLQTNKVKYIVPFISMIQSVSSLKLFDEISRQASKVGRTVPVLLEVHIASEDTKSGFTPEELPQVLEAVLARGSDTGVKIAGLMGMATFTDDREQIRREFRRLASLFREMRERFFSDSADFCELSMGMSGDFELAIEEGSTIVRIGTTIFGERRY

SEQ ID NO: 19359 - protein, 638 aa, Magnaporthe grisea 70-15
MLSQRTVAAIGFLVAVNIVVLTFALNSGFISRPASVFSFGSNHPQASSNLESESKSHGTHPPGLVGQQPAKLEEWRLDTDQYILDRSWDLTAPPTTRTYDLVITRGKAWPDGVVRDVLLVNGKFPGPLIEANKGDTVVVNVTNKLDSEPTAIHWHGIQQKETPYYDGTVGVSQCGIPPGQSLVYNFTLEGQFGTFWWHAHHEGQAMDGVLGPLVIHAPEEKQVRQTYDEDRIVILQDWYHDPSQVNLARYLAPGVENDEPIPDNGLINGRNYFNCSSYGTESNRTCHDGTSHAILSLNRNSKTRLRLINAGGFASFEFGIDKHLLNIIEADGILTRPTSVRRVPIHVGQRYSVVVDTNQGTESNNYWIRSRMISHCFKGEENPVLDSTTKAVLHYQGKDQGIIPTAASKDWEDAMAVMCEDPAKGVLVPLISQPPPPATKIVAVDFHFNIGAYQMTYAKINETVTWMPLKNSTTLLEAVDGLRSPKASGWSETGRIGLFPEDQYVIGVSNSNTTEVVDLLVYSLDDGSHPFHLHGHDFWIMATGDSGFDWNKYNSEIMSSTGESLANVTKRDTLTIKPYAWALIRFVADNPGLWAFHCHMSWHMEAGLMMQFMSGAKGLEKLHIPDDVANLCTAPHPG

SEQ ID NO: 19360 - protein, 319 aa, Xanthomonas campestris pv. vesicatoria str. 85-10
MALYDNILDTIGRTPVVKLQRLAPDNVTLYVKVESFNPGGSVKDRLALAIILDAEQRGLLKPGDTIVEATSGNTGVALAMVAAARGYKFVATMVETFSIERRKLMRAYGAKVILTPAAERGSGMVRKAKELAEQHGWFLASQFANPANPAYHRNTTAAEILRDFAGHRLDHFVTGWGTGGTLTGVGEVLRVARPEVRITASEPAGAALLQGQDWKPHKIQGWTPDFVPEVLNREAAHQVLSVEDTDAITVARRLAAEEGIFTGISGGATVATALRVAEGAASGAVILAMLPDTGERYFSTPLFADINEGSDDDWLAGLP

SEQ ID NO: 19361 - protein, 574 aa, Legionella pneumophila subsp. pneumophila str. Philadelphia 1
MLDFSLNRDPQTGELYIETSLCGKPLLTTPQLNKGTAFTQEERKDFGLLGKLPHRVETLDEQVKRAYLQYSSYTTRLQQHIYLNNLHDKNQIVFYKLLSRHLGEMLPIIYTPIVGAAAKRFSHEYRQPRGLYIAHSDKNQLEEIINNRSNPDIDLVVVTDGEGVLGIGDQGIGGMDIPVAKLMVYSLCGGIDPTRTLPIFLDVGTNNQELLNDPMYLGCRHPRIKSSEYDDFIKTFVNEIHKQFPNAFLHWEDFGRGNARRILDQFQDELCTFNDDIQGTGAVTLAAILAACDVTGLPLHEHRIVVFGAGSAGTGISDQIVDAMVKSGLSLTDAYDRFWLIDKQGLLLATDQELTDAQKPYARNPIDIQSWEINNKQHPSFTDTIRHVKPTILIGCSAQTGAFSQDIVETMSTSCERPIIFPLSNPDEKCEAQPSDILAWSKGRALIATGTAFAPIEYQNRMVQIAQCNNALVFPGIGLGVLAVSASRLTKDMILAAAQTLSKFAPSKKDSFLPLLPSLDNAQIVAKEIAIAVAQCAIDSGYAQKNQDKELPRLIDELFWEPRYLPFRKKGWSE

SEQ ID NO: 19362 - protein, 188 aa, Exiguobacterium sibiricum 255-15
MIVLIDNYDSFTYNLYQYAAVYDDIQVIRNDAIEVTALADLHPDGIILSPGPGNPNDAGICLDVIKTYSGKIPILGVCLGHQAIGQAFGGHVIEADEIRHGKTSTIKQTGRLFTGLPERFDVMRYHSLIVDRTTLPEVLEVTATTDDGIIMALEHRDHPTYGIQFHPESIGTPFGQDMIQRFIELMKE

SEQ ID NO: 19363 - protein, 334 aa, Xanthomonas campestris pv. vesicatoria str. 85-10
MSIEQLAETAQAMVAPGKGIIAIDESTSTIAKRFASVGIENIEENRRAYRELLLTTPKLSDYISGAILFDETIRQKTKDGVPFAEYMTAHGIIPGIKVDKGAQPLAGMPGELVTEGLDGLRTRLEEYYTLGARFAKWRAVINIGEDIPSGTCIEANSHALARYAALCQEQGLVPMVEPEVIMDGSHDIETCYEVTEATLRSLFGALYEQNVVLEGTILKASMVISGKSCEEQASIEEVAESTVMCLKSTVPAILPGIVFLSGGQTDEQSTAHLNEMHQLGNLPWPLSFSYGRAMQQAALKLWAKDMTGNFAKAQQVIYERAKENGLAALGKWKG

SEQ ID NO: 19364 - protein, 273 aa, Triticum aestivum
  misc_feature (50)..(50): Xaa can be any naturally occurring amino acid
  misc_feature (52)..(55): Xaa can be any naturally occurring amino acid
  misc_feature (80)..(80): Xaa can be any naturally occurring amino acid
  misc_feature (117)..(117): Xaa can be any naturally occurring amino acid
  misc_feature (151)..(151): Xaa can be any naturally occurring amino acid
  misc_feature (179)..(179): Xaa can be any naturally occurring amino acid
  misc_feature (185)..(185): Xaa can be any naturally occurring amino acid
  misc_feature (224)..(224): Xaa can be any naturally occurring amino acid
MASSADPWVREYGEAARVADDVASMVADRAALPQSGPSLRQLNREYRRSXPXXXXDRLDSLQGMLARLPPKSITDKELHXRPDTPANLGILDHNRWQKSFNMSTFANREDLLGQSKXKAADDLSRVPGLDYQGIVGLQRQIMKEQDEGLEXLEQTVLRHKTLIALPVNEELDLHATLIXDDLDDXVGGTNSRLQRVQKRLAVLNKRAKGGCSCMSLLLSTVGIXMLVVIVWSSSSTVTLPLKSFKCHSKIYGTRSHIWENGIACLRLINQLSN

SEQ ID NO: 19365 - protein, 488 aa, Xanthomonas campestris pv. vesicatoria str. 85-10
MKERQRRTKILATLGPATDAPGVLDTLFKAGVNVVRLNFSHGDPSGQAKRAAEVRAAAARVGAEVGILADLPGPKIRIERFAEGKIKLTMGDRFDLVADANAPAGDQTQVGVSYLGLPQDVTAGDVLLLDDGLMQLQVTDVQGERIVTKVLNDGVLSDRKGLNKQGGGLSLGALTERDKELIGIVAKIGVDFIAVSFCRNAQDMHDARQIAQQHGCDAQLVSKIERTEAIENLVEIVEASDVVMVARGDLGVEIGDAELPGLQKKIIRESLAQNKVVITATQMLQSMVESPIPTRAEVLDVANAVIDGTDAVMLSAETAAGAYPVRAVEAMARICLGAEHQFEFDTDFEAAQRNLQRADQAIAMATMFLSEHIGLGGVVALTESGGTPRFLSRFRSNMPIYAFTRHDGARRQMAMMRGVFPISFDSRGLTPREAARAAIRLLVENERMGPGDRVVFTSGEHMETHGATNTLRLLEVGEDGRATGLGEL

SEQ ID NO: 19366 - protein, 330 aa, Alkaliphilus metalliredigens QYMF
MPVNLKGRSFLTLKDFTSQEIQHLLDLSRDLKAKKRMGVKGESLLGKNIVLLFEKASTRTRCAFEVAALDEGAHVTFLGSNDSQIGKKESIEDTAKVLGRFYDGMEFRGFKQETVETLAAHAGIPVWNGLTDLYHPTQILADFLTIMEHIDKPLNKVKFAYVGDARNNMGNSLMIGAAKMGMDFRAVAPKELLPKGELVEEMRAVAAETGGEITLTDDVAEGVKDADVIYTDVWVSMGEEDQFEVRIKQLLPYQVNMDMIKATGNPDMIFMHCLPAFHDLETTVGKEIHEKFGLKSMEVTDEVFRSRHSVVFDEAENRLHTIKAIMVATL

SEQ ID NO: 19367 - protein, 129 aa, Volvox carteri
MAGRGKGKTAGKKAVSRSAKAGLQFPVGRIARYLKKGKYAERIGAGAPVYLAAVLEYLTAEVLELAGNAARDNKKNRIVPRHIQLAIRNDEELGKLLGDVTIASGGVLPNIHAVLLPKKSKGGKGEEAA

SEQ ID NO: 19368 - protein, 354 aa, Populus trichocarpa x Populus deltoides
MASEDVKTSESAVSTIVNFAEEAKLAREGVKAPGPALLSICKSLVAGGVAGGVSRTAVAPLERLKILLQVQNPHSIKYNGTIQGLKYIWRTEGLRGMFKGNGTNCARIVPNSAVKFFSYEEASKRILWFYRQQTGNDDAQLTPLLRLGAGACAGIIAMSATYPMDMVRGRLTVQTDKSPRQYRGIAHALSTVLKEEGPRALYKGWLPSVIGVIPYVGLNFSVYESLKDWLLKTNPFGLVEDNELGVTTRLACGAAAGTVGQTVAYPLDVIRRRMQMVGWKDAASVVTGDGRSKAPHEYSGMVDAFRKTVRHEGFGALYKGLVPNSVKVVPSIAIAFVTYEMVKDVLGVEMRISD

SEQ ID NO: 19369 - protein, 374 aa, Zymomonas mobilis subsp. mobilis ZM4
MCLYLRSFLFMVEDRKAIVIAQAIDALRRGWPISISDQGEILSLLAVERADDHRLKVFDPDQTADILLSAARAAILNLANDKEAATPDQPVTLVRTPWIDCASALALADPSMDLEMPMKGPFKVKKTVIKSAAASALELARMAGLLPAFFVQEGQSEQSLLTIPAQDIVDFFQGQGVYIAARARLPIALGDHGKAIENSQIVAFRNDADAVEHVAVIIGHPDGQPPVVRLHSECLTGDVFGSLKCDCGPQLHQALRIMDESGYGILLYLRQEGRGIGLINKLRAYSLQDQGFDTVDANVRLGFVNDARDFRLAAQMLGELEIKQIRLLTNNPDKVEGLKKAGIDVVERLPLKIKPNPHNQAYLETKRDRSGHQL

SEQ ID NO: 19370 - protein, 420 aa, Salmonella typhimurium
MRGSHHHHHHGMASHMATEQTAITRATFDEVILPVYAPADFIPVKGKGSRVWDQQGKEYIDFAGGIAVTALGHCHPALVEALKSQGETLWHTSNVFTNEPALRLGRKLIDATFAERVLFMNSGTEANETAFKLARHYACVRHSPFKTKIIAFHNAFHGRSLFTVSVGGQPKYSDGFGPKPADIIHVPFNDLHAVKAVMDDHTCAVVVEPIQGEGGVQAATPEFLKGLRDLCDEHQALLVFDEVQCGMGRTGDLFAYMHYGVTPDILTSAKALGGGFPVSAMLTTQEIASAFHVGSHGSTYGGNPLACAVAGAAFDIINTPEVLQGIHTKRQQFVQHLQAIDEQFDIFSDIRGMGLLIGAELKPKYKGRARDFLYAGAEAGVMVLNAGADVMRFAPSLVVEEADIHEGMQRFAQAVGKVVA

SEQ ID NO: 19371 - protein, 129 aa, Volvox carteri
MAGRGKGKTAGKKAVSRSSKAGLQFPVGRIARYLKKGKYAERIGAGAPVYLAAVLEYLTAEVLELAGNAARDNKKNRIVPRHIQLAIRNDEELGKLLGDVTIASGGVLPNIHAVLLPKKSKGGKGEEAA

SEQ ID NO: 19372 - protein, 386 aa, Yersinia pseudotuberculosis IP 32953
MSTLSFIPDSKLPAQGTTIFTQMSALAQKHQAINLSQGFPDFDGPDYLKQRLAYHVDQGANQYAPMIGVAPLRHAIAEKTANLYGWRPDAEHEVTVTTGASEALFAAITALVRPGDEVICFDPSYDSYAPAVKLAGGVLKRITLKPPAFTTDWAEFTRLLSERTRLVIVNTPHNPSATVWCAEDFEQLWQVIAERNIYVLSDEVYEHICFSRSGHASVLAHPQLRQRAIAVSSFGKTFHMTGWKVGYCIAPAAISAEVRKIHQYLTFSVCTPVQLALADMLNAEPEHWQQLPKFYRARRDRFVKALAASRLKILPSEGTYFLLADYSGISDLDDVEFCQWLTEHVGVAAIPLSVFCEAPFPHKLIRLCFAKQDATLDAAAERLCQL

SEQ ID NO: 19373 - protein, 311 aa, Micromonospora echinospora
MESAAVPPTRPSLVLTGHQEGVIGAVFHPDDHLVATSGEDGTVRLWDATTGEQVGRTLTGHTDTVWLVVFDPEGRLLASASEDRTARIWDVSTGEQVGEPLTGHTAGVYGVAFHPDGGLLATGSADHTVRLWKVPGGEPVGEPLTESTDEIDGVAFHPDGHLVASTGDAVRLYDTATGRPVGTPLVGHTKGAVSVAFSPDGRLLASGSDDLTVRIWDHAAGGAAVEPLVGHTDAVDGVVFHPNGRLLVSAAEDCTVRVWDVATGRQVGEVETGHTAPVWNIAFDRSGERIVTASQDGTARILPFPAYPAAG

SEQ ID NO: 19374 - protein, 504 aa, Micromonospora echinospora
MLPGGTSNRPRGRSRVPPPAGVAMVHARRAPARVPTGTRTDSSRTQMDSVHSDLKVAIVVADIAIVLIVGSLLIMLFRRLKQPPVIGEITAGIVLGPSLLGLLPGDVTGFLFPVELRAHLSMISQVGLLLFMFLVGWEFNGQLLKRRSGAVATVSLSAIGLAFTLGIGAAALLYDRHDVVDGEKISFGYFAAFLGIAMSITAFPVLARLLTETGLARTRVGALSLAAAALDDVMAWTLLAFIVVIFGAGGDGTSTLVTVLGLFLLYVALMVFAVRPLLRRLVARLVRGGTASPFLVPLIAAGAFLSAYATSWIGVHAVFGAFAFGLVMPREPRALLAESLHMPLESATRLLLPIFFIVTGLNVNIGALGWTGLGELAIIMVAAIVGKLVAASLAARASGMNWQESYAVGLLMNTRGLTELVILNIGLSLGVLDGEMFTMMVLMALLTTAMAVPLLPRGLPRAPGGLFDIPSVTVPSGAAARRTPAQGDATDAATTGQEVPSGKS

SEQ ID NO: 19375 - protein, 401 aa, Rhizobium leguminosarum bv. viciae 3841
MSQINRDARKALDLPRLRADTPGTRNRNHLNNAGAALMPSPVIDAVIGYLSREGEIGGYEAAAEANSLLEGAYDSLATFVNCARDEIAIAENATIAWQRAFYSLSFGPGDRILTASAEFAANYVAFLQVAKRTGVSIEVIPNDASGVLDPDALTKMIDERVRLIAVTWIPTNGGLINPAAAIGRIARDNGILYLLDACQAAGQTPIDVNALGCDILTATGRKFLRAPRGTGFMYMRKSVLEKIEPAMIDLYGAPWTAPDRYELRPDARRFETWEKNCSVRLGLRAAVDYALEIGLENIEARCSHLSSRLREGLRGMRAVSVHDLGAPLASIISFTVNGWDSPAVMAYLAGKGINVSVSPPSSTPVDAYTRQLPPVVRASPHYYNSEEEIEAFLEAIAGIAA

SEQ ID NO: 19376 - protein, 392 aa, Bacillus cereus ATCC 10987
MKSFQPSEIVTSLPTQFFASLVAKVNKVVAAGHDVINLGQGNPDQPTPQHIVKALQDAAEKTIHHKYPPFRGHESLKEAVATFYQREYGVELNSKTEVAILFGGKAGLVELPVCFTNPGDTILVPDPGYPDYLSGVALAKAKFETMPLIAENNFLPDYAKIDDSIAERAKLMFLNYPNNPTGATASKDFFDETIHFANKHNILVIHDFAYGAIGFDGQKPVSFLQADGAKDTGIEIYTLSKTFNMAGWRIAFAVGNESVIETINLLQDHMYVSIFGAVQDAAREALLSSQSCVIDLVNSYEARRNALISACHSIGWNVNIPTGSFFAWLPVPKGYTSEQFSNILLEKAHVAVAPGVGFGEHGEGYVRVGLLHTEDRLREAIHRIDKLNFFKK

SEQ ID NO: 19377 - protein, 276 aa, Candida albicans SC5314
MAAPTAIRKSTEKSGINEQIQENSTLQSNQALDQNNDDEDMLIDTNAIPTTTVEDQDQSEPSNSLTIQQGETTELQLDESGKPKFSAASKSNMKVKLESRKVAVPPHRMTPLKNVWSKIYPPLVEHLKLQVRMNLKTKTVELRTNKYTTDVGALQKGADFVKAFTLGFDVDDAIALLRLDDLYIETFEIKDVKTLTGDHLSRAIGRIAGKDGKTKFAIENATRTRIVLADSKIHILGGFTHIRMAREAVVSLILGSPPGKVYGNLRTVASRMKERY

SEQ ID NO: 19378 - protein, 100 aa, Physcomitrella patens subsp. patens
MADEISTHSEDYSFPRVKLLCSYGGKILPRPTDNQLRYVGGETRLITVSRDISYHELILKMAELYAQAHTIKYKLPEEDLDALVSVSSNEDVANMMEEYD

SEQ ID NO: 19379 - protein, 449 aa, Pseudomonas syringae pv. phaseolicola 1448A
MTLSASQPVPGTLDVQAFINAQPLSGYQWRVVALCFLIVFLDGLDTAAMGFIAPALSQDWGIDRASLGPVMSAALIGMVFGALGSGPLADRFGRKVVLVFAVFLFGLFSLASAYSSNIDQLLVLRLLTGLGLGAAMPNATTLLSEYTPERLKSLLVTSMFCGFNLGMACGGFVSAKLIPSMGWHSLLMLGGILPLILAVVLMVWLPESARFLVVRNRGAERIRKVLAPIAPNALAGITDFSVPEQKTVSSRNVLKVIFSGTYSAGTLLLWLTYFMGLVIVYLLTSWLPTLMRDSGASMEQSAFIGALFQFGGVLSAVGVGWAMDRYNPHKVIGLAYALAGVFAWLVGQSLGNVALLATLVLLAGMCINGAQSAMPSLAARFYPTQGRATGVSWMLGIGRFGAILGAWAGATLLGLGWSFEQVLTALVVPAALAAIAVLIKGWVSHSDAT

SEQ ID NO: 19380 - protein, 585 aa, Bordetella parapertussis 12822
MSVDAFATGQSATSTYTAHRPVIAANRHAVSSGHYLASHAAFQILESGGNAVDAGVAAGLVLGVVHSDQVNIAGVAPMMIYLAAEDRVITIDGLGSWPAAASCERFEREFGGVVPEGLLRTVIPAAPGAWITALQRYGTRSFAEVAQYAIRFAREGFIMYPFLADRLQEAEAKYRRWPSNAAIYLPGGRPPRVGERFVQSDLAASLQYMADQETATAGSRVRKLQAARDAFYQGDIASKIVAFHQENGGLLTAADLAGYAPTIEAPLSTRYGDMDVYACNFWCQGPALLQALNILKSFDLKEMGHNSTRYIHHVAEALKLTFADREHYYADPRFIDVPAQTLLSDAYARQRAQLVRADRAWPEMPPCGEIAGYETLRAIHGNISREIDPPLDTSYVCVVDRYGNAFSATPSDVSSDTIVIPGTGLCPSSRGSQSRADASHPASLAPGKRPRLTPNPAMAIQRGKRILPLGSPGGDSQVQAMLQVLLNITLFGMDPQTAIEAPRFISYSHPDSFAPHAYYPGRLNVEGRIPAQTEQTLAALGHDMQRWPDWLWRAGGVCAIDADLEQGIYQAGADPRRAAAYALGW

SEQ ID NO: 19381 - protein, 413 aa, Zea mays
  misc_feature (153)..(153): Xaa can be any naturally occurring amino acid
METSTKKLSSLRITSLDDDDDETEIPHQPPQAGLSTAEADYEDDDDEEEEAEVTLGVLSKPKHPGLLLRHLFPSKAGGIPAWLDPVNLPSGKSSYCGFCGEPLQFVLQIYAPIEDNVAAFHRTLFMFMCPSMACLLRDQHEQWKHKYGNPCRXIFRCQLPRNNAFYSAQPPKHDGSDKPLCPGAPVCHWCGTWKGDKICSSCKKARYCSEKHQALHWRTGHKNDCLQIISSAASNSVLPAVGIVPASISWPEFEIKIDYEGTFDSDSGDENNSKSLVMQRHGKLDAMMQSWMDHFEADADNKCWASFQERVSRAPNQVLRYCREPNAKPLWALSFGCPSDADIPSCSYCRGPLCYEFQVMPQLLYFFGVGNQPDSLDWATIVVYTCQGSCDQTVSYKEEFAWVQLYPTTTTRR

SEQ ID NO: 19382 - protein, 505 aa, Nocardia farcinica IFM 10152
MIYAKPGTEGSIVDYAARYDNFIGGEWKAPVEGRYFENPSPVDGEVFCEVARSSAADVELALDAAHAAADAWGKTSASERANILNKIADRIEQNLEALAVAETWENGKPVRETLAADLPLAVDHFRYFAGAVRAQEGGISEIDNDTIAYHFHEPLGVVGQIIPWNFPILMATWKLAPALAAGNAVVLKPAEQTPASILKVVELIADLLPPGVLNVVNGFGVEAGKPLASSSRVAKVAFTGETTTGRLIMQYASENIIPVTLELGGKSPNIFLPDVMAADDAFLDKAVEGFVMFALNQGEVCTCPSRALIHSSIYDEFMARAVERTKAIVSGNPLDDATMIGAQASNDQYEKILSYIDIGRKEGAEVLTGGGPRKVDVFPNGYYVEPTIFKGRNDMRIFQEEIFGPVVSVTTFDSVDEAISIANDTLYGLGAGVWTRDMNTAYRLGREIKAGRVWTNCYHAYPAHAAFGGYKKSGIGRENHKMMLDHYQQTKNLLVSYSPDKLGFF

SEQ ID NO: 19383 - protein, 427 aa, Exiguobacterium sibiricum 255-15
MKTETLTMPQLGESVTEGTISLWLVKPGDTVKKYDPIAEVITDKVTAEVPSSFDGVIDKLLAEEGDTLQVGEAIVTLQVSGGSTEVAATEEAVPAIEETPVSSDQSMKKRYSPAVLKLSAEHGIDLEQVSGTGAGGRITRKDLLKIVETGQIKQPDTVEAPTIESVPAAKPAEQRESAQPSRPQAAKSTASTTEDGDIEIPTAGVRQAIATNMVRSKHEAPHAWLMIEVDVTNLVEARNRHKDAFFKQEGVKLTFLPFFMKATVEGLKKHPIMNSTWAGDKIIQKKAINLSLAVATQEALFVPVVKNADELSIKGLARSIDDFGKRAQAGRLSSSEMQGGTFTVNNTGSFGSIQSAPILNFPQAAILSVESIVKRPVWINGMFAARDMVNLCMSIDHRVLDGLVAGQFLQTVKQSLESIDPNQLSLY

SEQ ID NO: 19384 - protein, 264 aa, Oryza sativa
  misc_feature (143)..(143): Xaa can be any naturally occurring amino acid
  misc_feature (166)..(166): Xaa can be any naturally occurring amino acid
  misc_feature (172)..(172): Xaa can be any naturally occurring amino acid
  misc_feature (194)..(194): Xaa can be any naturally occurring amino acid
  misc_feature (215)..(215): Xaa can be any naturally occurring amino acid
  misc_feature (224)..(224): Xaa can be any naturally occurring amino acid
MGGAYLSSPYSSKKTEEVSFDNLKFGVSEMQGWRITMEDAHIAKYNIVPNVHIFGVFDGHGGKEIAVYVSNNFIKELVANQSFKEKDYEKALTETFIQMDVNIISPLGKKEIDQIRAEDGRSTELDSFAGCTAIVALIADGTXYVANAGDSRCVLSSKGLAVEMSXDHKPDXSEEKIRIANAGGYVVEGRVNGXLNLSRAMGDFEYKKNELLSSXEQLISGVPXIKKRQLTDDDEFIIMAWDEYGKPIRTKKLSILLKRNENHY

SEQ ID NO: 19385 - protein, 289 aa, Pisum sativum
MEAKEQDVSLGANKFPERQPLGIAAQSQDEPKDYQEPPPAPLFEPSELTSWSFYRAGIAEFIATFLFLYITVLTVMGVVRESSKCKTVGIQGIAWAFGGMIFALVYCTAGISGGHINPAVTFGLFLARKLSLTRAIFYMVMQVLGAICGAGVVKGFEGKQRFGDLNGGANFVAPGYTKGDGLGAEIVGTFILVYTVFSATDAKRSARDSHVPILAPLPIGFAVFLVHLATIPITGTGINPARSLGAAIVFNKKIGWNDHWIFWVGPFIGAALAALYHQVVIRAIPFKSK

SEQ ID NO: 19386 - protein, 391 aa, Xanthomonas campestris pv. vesicatoria str. 85-10
MSIVRMTDLDLSGKRVLIRQDLNVPIDNGQITSEQRITASVPTIKLALEKGAAVMVTSHLGRPKEGSWTEEDSLAPVATRLAALLGVDVPLVRDWVDGVDVAPGQVVLLENCRMNVGEGKDDETLARKYAALCDVFVMDAFGTAHRAQASTHGVIRFAPVAAGGPLLMAELDALAKALDNPAKPLLAIVAGSKVSTKLELLSNLVNKVDQLIVGGGIANTFIAAAGHAVGKSLNEPDLIPTANQIVADAKARGAEIPLPTDVVVAKQFLPDAQASVKSLDAVDADDLILDIGPHTAQRYAELIASAGTVVWNGPVGVFEFESFSHGTETLARAIASSKAFSIAGGGDTLAAVDKYDIAQEVTYISTGGGAFLEFLEGKTLPAVAALQARGQ

SEQ ID NO: 19387 - protein, 295 aa, Erythrobacter sp. SD-21
MSTHNPIKKAVFPVAGLGTRFLPATKAIPKELLPIVDRPLIQYAVDEAREAGIEQIIFVTGRGKTAIVEHFDMAFELETTMEERGKDMSVLEPTRATPGDIITVRQQVPMGLGHAIWCARAIVGDEPFAILLPDELMVANKGGTGCMKQMVEAYNEVGGNLISVLEVPQEEVSSYGVIAPGGQVSDTLTEVTGLVEKPPVAEAPSNKIISGRYILQPEVMRTLENQGKGAGGEIQLTDAMARMIGNQPFHAVTFAGNRYDCGSKAGFVEATLALALEREDMGKEVRAMAERLLAR

SEQ ID NO: 19388 - protein, 473 aa, Exiguobacterium sibiricum 255-15
MAREFDVVVLGGGPGGYVAAIRAAQAGKTVAIVEQGKLGGTCLHRGCIPSKAFLKSAAVYQTVKHAATYGVDVPESFLRFEQVKQRKQDIIDGLESGIQHLMKKGKIEVFHGRGSILGPSIFSPMPGTISVEPEEGDGELILPRQLIVATGSRPRPLNGLAFDSEYVLSSDEALDMNALPKSIVIIGGGVIGIEWASMLTDFDVEVTVVEFSDRILPTEDQAVSREVARQLKKRGVKIMTSAAAQSDSFQLTESGVTIDVDRNGDKTTLAADKLLVAIGRMANVEGIGLENTNIIVENGFIQVDDEFRTKDNHIFAIGDVIGRLQLAHVASAEGAKAVETIVNGSTTPLNYAFVPRCIYSVPEAASVGLTEAEAKAAGLDVKTGMFSFNGLGKARIEGEAAGFIKLVSDAKTDDLVGVHIVGPKATELISEGGLALVLNATAWEVGQLVHPHPALSEAFGEAALAVDGLAVHA

SEQ ID NO: 19389 - protein, 333 aa, Xanthomonas campestris pv. vesicatoria str. 85-10
MAIKVGINGFGRIGRNVLRSAAQNFANDIEIVAINDLLEPDYLAYMLQYDSVHGRFKADVSVDGNTLIVNGKKIRLTQERDPANLKWDAVGADVVIESTGLFLTKETAQKHIDAGAKKVILSAPSKDDTPMFVYGVNDKTYKGEAIISNASCTTNCLAPLAKVINDKWGIKRGLMTTVHAATATQKTVDSPSNKDWRGGRGILENIIPSSTGAAKAVGVVIPELNKKLTGMSFRVPTSDVSVVDLTVELEKPATYAEICAEVKAQSEGALKGVLGYTEDKVVATDFRGETCTSVFDADAGIALDSTFVKLVSWYDNEWGYSNKCLEMVRVVAK

SEQ ID NO: 19390 - protein, 143 aa, Triticum aestivum
KVTPVLGSILVPNSARGASGHIPVIATVAADETGQAYNINADTARGEIAAAVGAEKLLLLTDVSGILADRNDPGSLVKEIDIAGVRQMVSGGQVAGGMIPKVECCVRALAQGVHTASIIDGRVPHSLLLEILTDEGTGTMITG

SEQ ID NO: 19391 - protein, 399 aa, Streptococcus thermophilus CNRZ1066
MAKLTVKDVELKGKKVLVRVDFNVPVKDGVITNDNRITAALPTIKYILEQGGRAILFSHLGRVKEEADKEGKSLAPVAADLAAKLGQDVKFIPGVTRGAELEAAVNALEDGQVLLVENTRFEDVDGKKESKNDPELGKYWASLGDGIFVNDAFGTAHRAHASNVGISANVEKAVAGFLLENEIAYIQEAVENPERPFVAILGGSKVSDKIGVIENLLEKADKVLIGGGMTYTFFKAQGIEIGNSLVEEDKLDVAKALLEKSNGKLILPVDSKEANAFADYTEVKYTEGEAVDPGFLGLDIGPKSIAKFDEALTGAKTVVWNGPMGVFENPDFQAGTIGVMDAIVKQPGVKSIIGGGDSAAAAINLGYADKFSWISTGGGASMELLEGKELPGLAALTEK

SEQ ID NO: 19392 - protein, 382 aa, Mycobacterium smegmatis str. MC2 155
MTRNGKRGGEKAVLVLEDGRVFTGVSFGAVGQTLGEAVFSTGMSGYQETLTDPSYYGQIVVATAPQIGNTGWNDEDGESRGDKIWVAGYAVRDPSPRASNWRATRTLDDELVAQGIVGIAGIDTRAVVRHLRTRGSMKAGVFSGDALADVDALLERVRNQPSMLGADLAGKVTTGQTYVVDPDGDHRFTVAAVDLGIKTNTPRNFARRGVRTHVLPASATFDQIADFKPDGVFLSNGPGDPATADHIVEVTREVLGAGIPLFGICFGNQILGRALGRSTYKMVFGHRGINIPVVDHITGRVAITAQNHGFALEGEAGEKFDTPFGTAEVSHTCANDGVVEGVRLVNGKAFSVQYHPEAAGGPHDAEYLFDQFIDLMAGEHHS

SEQ ID NO: 19393 - protein, 167 aa, Alkaliphilus metalliredigens QYMF
  misc_feature (43)..(43): Xaa can be any naturally occurring amino acid
MLRIGQPAPEFTVPSTQGELSLRDYRGKWVVLFFYPLDFTPVXSTEIPELNRNLPAFQRLNSIVLGANTDSVPTHEAWAKSIDGVSFPLLSDYDKKLSEKYEVLVKEAGGIALRGLFIIDPQGDLQYISVNNLAVGRNVGEILRVLAACQAGGACPINWEEGQETLS

SEQ ID NO: 19394 - protein, 219 aa, Zea mays
MSASVAAASPTLRFSSATHPLHRPLRRRLPSVRCSLAAAAGPGVRAPPELVDSILSKVKGTDRGVLLPKDGHQEVAEVALQLGKYCIDDPVKSPLIFGEWEVVYCSVPTSPGGLYRTPLGRLVFKTDEMVQAVEAPDVVRNKVSFSVFGLEGAVSLKGKLNVLDSKWIQVVFEAPELKVGSLGFQYGGESEVKLEITYVDEKIRLGRGSRGSLFVFLRR

SEQ ID NO: 19395 - protein, 517 aa, Triticum aestivum
  misc_feature (175)..(175): Xaa can be any naturally occurring amino acid
  misc_feature (186)..(186): Xaa can be any naturally occurring amino acid
MDKAYIAILTIAFLFLIHYVLGNGRRGGKGAAQLPPSPPAIPFLGHLHLLEKPFHAALRRLAARLGPVFSLRLGSRRAVVVSSAECARECFTEHDVTFANRPRFPSQLLVSFDGAALVTSSYGPHWRNLRRVAAVQLLSAHRVACMSGVIAGEVRAMARRLFRAAAASPGGDGAXARVQLKRRLFXLSLSVLMETIAQTKATRSEADADTDMSVEAQEFKKVVDELIPYLGAANTWDYLPVLRWFDVFGVRNKILAAVSRRDAFMLRLIDNERRPTRPAGTEGDKKSMIAVLLNLQKTEPEVYADTMITALCANLFGAGTETTSTTTEWAMSLLLNHPAALKKAQAEIDAAVGTSRLVTADDVPRLAYLQCIVSETLRLYPAAPMLLPHESSADCKVGGYNVPSGTMLMVNAYAIHRDPAAWERPLEFVPERFEDGKAEGRFMIPFGMGRRRCPGETLALRTIGMVLATLVQCFDWERVDGAEVDMTEGGGLTIPKVVPLEAVCRPRPAMRDVLQSL

SEQ ID NO: 19396 - protein, 666 aa, Burkholderia sp. 383
MTIPTPTVNPGLAGGDAHALPHAPLPAGLPDPATLARLASEFFATPPGQATAPGLSAGSGAVGGVPSALPAAAPILASVSNPVPGGSPLAGPGGAGTGVPGLALPQGKVPGANLAPSAPTHVLSLGNRAPALAPHAAAQNGLPDNVVSIAPALEPRVGGAALGVPQVNAPAPEGAAKASPYYFTDGSLQGWQATPQDIVVPSNGLASPEAFGLPGDDALRALLAVHRDVPVSRTSGADVPRYFIDDAHAAEPQGQLHRGAHPPFDVNAIRRDFPILQERVNGKQLVWFDNAATTHKPQAVIDRLAYFYAHENSNIHRAAHALAGRATDAYEHARDTVRRFIGASSPDEIVFVRGTTEAINLIAKTWGVQNVGEGDEIIVSHLEHHANIVPWQQLAALKGAKLRVIPVDDSGQVLLDEYRKLLNDRTKIVSVTQVSNALGTVVPVKEIVDLAHRAGAKALVDGAQSISHLRVDVQALDADFFVFSGHKIYGPTGIGVVYGKRAILDDMPPWQGGGNMIADVTFERTVFQPPPNRFEAGTGNIADAVGLGAALDYVSRVGIENIARYEHDLLAYATSVLAPVPGVRLVGTARDKASVLSFVLKGYETEEVGQALNEEGIAVRSGHHCAQPILRRFGLEATVRPSLAFYNTCDEVDALVSVVRRLATRR

SEQ ID NO: 19397 - protein, 373 aa, Halobacterium sp. NRC-1
MTEFSDRVAQVSISGIRAVFEAAGEDAINLGLGQPDFPTPDHARQAAVDAIESGAADGYTSNRGTAALVDAIVEKHARDQGVDVAPAGVIATAGGSEALHLAMEAHVDPGDEVLFPDPGFVSYDALTRMAGGNPVGLPLRDDLTLAPETVEDHITDDTAAFVVNSPANPTGAVQSPADMRAFARIADEHDVLCISDEVYEHIVFEGEHRSPMEFADTDNVVVVNACSKTYSMTGWRLGWVAASERRAERMLRVHQYVQACASAPAQYAAEAALSGPQGVVDEMVAAFEARRDVLLDGLEAMGLDVPTPGGAFYAMPTVPDGWIDEVVDRGVVVVPGSAFGDHGAGTARISYATDMATLRDAIDVMRAATAAVQ

SEQ ID NO: 19398 - protein, 90 aa, Oryza sativa
MASRLAQLRSKAAQASELVSKHGCAYYKEVMEKNKQHVVQPPTVEKCQELSKQLFYTRLASLPGRYEAFRKEFDGVKQVWKNRKELKVED

SEQ ID NO: 19399 - protein, 344 aa, Saccharomyces cerevisiae
MSAGIGESRTELLTWLNGLLNLNYKKIEECGTGAAYCQIMDSIYGDLPMNRVKFNATAEYEFQTNYKILQSCFSRHGIEKTVYVDKLIRCKFQDNLEFLQWLKKHWIRHKDESVYDPDARRKYRPIITNNSATKPRTVSNPTTAKRSSSTGTGSAMSGGLATRHSSLGINGSRKTSVTQGQLVAIQAELTKSQETIGSLNEEIEQYKGTVSTLEIEREFYFNKLRDIEILVHTTQDLINEGVYKFNDETITGHGNGNGGALLRFVKKVESILYATAEGFEMNDGEDELNDKNLGEHGTVPNQGGYANSNGEVNGNEGSNHDVIMQNDEGEVGVSNNLIIDEETF

SEQ ID NO: 19400 - protein, 318 aa, Rhizobium leguminosarum bv. viciae 3841
MIVVCGDALIDFLPVALPEGGSGYIPVCGGSCCNIATAIGRLGGKVGFMGGLSEDFFGAMLVQQFNEAGIDLRYATRLPFDTTLAFVRLGDDEPEYAFYDSGSAARHWTLKGAPSLGTEVDVLHIGSVTLIHPPVSSACESLFENEQGKRVLSIDPNCRPGLAQDPEAYRQRLNRLCGMADIVKLSVTDLGFMQPGVGPHSAAESWLSNRAKIVLVSRGAGGATVYLAGGRVVEVPARPARVVDTVGAGDALIAGFLTHLQQSGDLHRDSIGALTGDRARKALEFAAHVASLACEHRGSDPPWRREIIVAGYDESSQM

SEQ ID NO: 19401 - protein, 703 aa, Populus trichocarpa x Populus deltoides
MSLRQESLVLFITIITIFIAATSTPTRAQKSNSSDCESSCGSGKSAKVVPYPFGFSIGCPIILQCNHTVGDVKIGEFQVQNITPNVIMINILADCNRSIERIKPLFGKNFCPSSKNSLLLQNCDKPLNSCVIRTSSLRRDLKLTNCGDKNYDLNCYSQVPRDFDTLGYDNMTSTRCKSVFSSLFRGWEGSAVSFQFERVELEWWLEGDSNNLCSNNANSTKVKLWNGRGGFRCHCADGFAGDGFAAGNGCRKVSKCSASKYMSGECGGTTRVGVLVGGLIAGALLMAGLAFLCYYVWRKSTSTSSRNRLSAKRLLCEAAGNSSVPFFQYKEIEKATNGFSEKHRLGIGAYGTVYAGKLNSDDLVAIKKLRHRDTDSIDQVMNEIKLLSSVSHPNLVRLLGCCIEEGEPILVYEFMPNGTLCQHLQQERGTGLPWTVRLTVAAETAKAIAYLHSAMNPPIYHRDIKSSNILLDYNYRSKVADFGLSRLGMVESSHISTAPQGTPGYLDPQYHQYFHLSDKSDVYSFGVVLVEIITALKAVDFSRPHSDVNLAALAIDRIGRGCVDEIIDPYLDPNRDAWTLTSILSVAELAFRCLAFHRDMRPTMLEVAGELEQIMLSAWIPTMYMASPSASSCSSQNGSQKSLSVSIGRKAGLARGKLILPQRTDSLTSLEETKDSSPVSDQDTWLSEQSSPSTNSLLGNVVR

SEQ ID NO: 19402 - protein, 393 aa, Halobacterium sp. NRC-1
MLSIALAGKPNAGKSTFYTAATRSEVDVANYPFTTIDANRGVTHVRTACPCLTREERCGHEHCHDGKRYVPVELLDVAGLVPGAHEGRGLGNQFLDELSNADVIVNVVDASGATNEEGEPVEIGDHDPVEDIDFVEEEMDLWLAGIVEDNWESVERASRSPGFDIETAITEMMTGFGASEYQVAAVLREFDYPDDPIQWSGEDREALARGVRERTKPIVVVANKVDVAPEENVQRLLDLDKPVIPATAQGELAVRRGADAGFLDYDPGDEDFDITGDVGDDQREALEALRETMQEYGGTGMQRALDYAVYDLLEMVTAFPVQDQSKWTDATGTVLPDAVLLDAGSTPVDLAYAVHSDIGDGYLHAVNAKTNREIGEDDELGEGDVVKIVSTAN

SEQ ID NO: 19403 - protein, 356 aa, Streptococcus pneumoniae
MRGKTILITGVAGFIGSNLVRKLLELEGTMTIIGLDNLNDYYDIALKDYRLLQLNKLIQDYPEKNWIFIKGDIADKMLINKIFKSYHPQIVVNLAAQAGVRYSITNPDVYIESNIVGFHNVLEACRHSYEIYDGGVEHLVYASSSSVYGGNKKIPFATEDKVDNPISLYAATKKTNELQAYAYSKIYNIPSTGLRFFTVYGPAGRPDMAYFGFTDKLRSGSDIEIYNHGNCKRDFTYIDDIVEGIVRVMQSAPKKLVGSDNLPLAPYKVYNIGNSKPENLLDFVDVLQQELIKAGVLPENYDFDSHKKLVPMQPGDVPVTYADTSDLERDFGFKPKTSLREGLRKFAEWYKDYYNV

SEQ ID NO: 19404 - protein, 410 aa, Streptococcus pneumoniae
MKIAVAGTGYVGLFIAILLAQHHQVVAVDIIPEKVELINKKKSPIQDDYIEKYLAEKELNFVATLNAEEAYENADFIVIAAPTNYDPKKNFFDTSSVEAVIEAVMKYNPDAIIIIKSTVPVGYTKSVRRKFLTDNIMFSPEFLRESKALYDNLYPSRIIIGTDKDDKDLVKSAEIFVKMLQEGAVKENIETLYMDFTEAEAVKLFANTYLALRVSYFNELDTYSEMKGLDTQAIIDGVCLDPRIGSHYNNPSFGYGGYCLPKDTKQLLANYSDVPQEMITAIVQSNRTRKDYIADRILDLAGSYVGNDFYKPDKEKEIVVGIYRLTMKSNSDNFRQSSIQGIMKRLKAKGVTIIIYEPTLESGTTFYGSQVVNDFEIFKKSSQVIVANRFDETLEDVRGKVYTRDIFKRD

SEQ ID NO: 19405 - protein, 323 aa, Streptomyces coelicolor A3(2)
MTHTEQQPLNSPFSAATTAEDVMAGHDLSGVTAVVTGGYSGLGLASTRALTAAGARVLVPARRPDIARAALRDVKGSEVVPMDLTDLDGVRSAAAHIGDRIDRIDLLMAAAGVMATPERRVGPGWEFQLAANHFGHFTLACELYPLLAAAGGARVVAYSSAGHAMTDIRRHDPHFRTGYDRWLAYGQAKTANALFAVHLDALGKDDGIRAFALHPGKIITGLQREMPLQEQIDAGWVDEHGNVVAADFKTASQGAATGLWAATSPLLDGRGGLYLADCDVARVFPPDTPMDDNGVRPYAVEPANAARLWEMSLAATGATPPTR

SEQ ID NO: 19406 - protein, 449 aa, Saccharomyces cerevisiae; identical to SEQ ID NO: 1530

SEQ ID NO: 19407 - protein, 391 aa, Bradyrhizobium sp. ORS278
MKALVWHGKEDIRCDTVSDPEIEHSRDAIIKVTSCAICGSDLHLFHNYIPAMMPGDIMGHETMGEVVEVGSGVNGKLKKGDRIVVPFTIICGECDQCRRGNFSVCETTNRNKHMAEKVFGHSTAGLFGYTHLTGGYPGGQAEYLRVPYADATHIKVPDGMSDEQALFLSDIFPTGWQGAAQCDIEPDDTVAVWGCGPVGQMAIRSAILLGAKQVVAIDRIPERLAMAEAGGAITINFDRESVVERLNELTDNKGPEKCIDCVGFESHISMAQPDSVLDRAKQMFMIENDRPHALREIIYVCRPGGIVSIPGVYSGFSDMVPMGALMNKGLTIRTGQTHVNRWTDDLKHRIQDGQIDPSFVITHTVPLAQGPEMYRAFRDKQDSCVKVVLKP

SEQ ID NO: 19408 - protein, 514 aa, Triticum aestivum
MANIDMAAVLADLERDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEITVSTDYDIKGDTNTISMSYKKLPQDVKPGHVILCADGTISLAVLSCDPAAGTVRCRCENTAMLGERKNCNLPGIVVDLPTLTEKDKEDILEWGVPNDIDMIALSFVRKGSDLVTVRQLLGQHAKRIKLMSKVENQEGIVNFDDILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNDAVFKEMIKAAPLPMSPLESLASSAVRTANKARATLIVVLTRGGTTAKLVAKYRPRVPILSVVVPVLTTDSFDWTVSSEGPARHSLIYRGLIPLLAEGSAKATDSESTEEILQAALKSAVKKQLCKAGDAVVVLHRIGMASVIKICTVK

SEQ ID NO: 19409 - protein, 333 aa, Rhizobium leguminosarum
MGRGVALIAAVVLVGTIVLASIRVAHHAELLAVKVGDPYGTMILTLSAVAVEVIILAIMMGGESSPTLVRDTIYSALMLDINGILGLAALLGGLKHGEQPYNDNSGKTYGVMILTAMGISMIVPEFVPSDKWHYYSAFTIVAMIALYGLFLRMQVGQHSYFFSYSYPRSERKKESPDEHSADESTTISIATILVGVVIIGLLAEFMATFMTEGLRDSGAPIAVTAVVVAAISAAPEILTALRAALRNRMQATVNIAMGASLSTVILTVPVMEAIALYTGQPFIMAMTPVQTVMVAITLIAAAINLNDGETNAIEGMTHFILFATFVMLTALGL

SEQ ID NO: 19410 - protein, 586 aa, Azoarcus sp. BH72
MAARPSPPRRMSAPVERLFPFLAWPKRWSAASVRGDVIAGITVALVMVPQSLAYAQLGSLPPHVGLYAALLPAVVGALFGSCGQLSTGPVALTSLLTGASLLPLASPDSPRFLALAVLLALMSGLIQLALGALRLGWLLNLLSHPVLMGFLNAAALVICLSQLPPLLGLSLPQSGRFLADIAAAFSPPHLPQLAPALFGIGALAALLVLRRAAPRLPGVLVVVAAATALSAWSGFAASGGPVVGAVPSGLPAFALPSFDFPAIVTLLPTAFVIALVSFMEAASSAKVIAGRTRQAWDQNQELIGQGLAKLAAAFTGGLPVSSSFSRAALNYAAGARSGLSSLVSAAVVLLTLLYLTPLLWHLPKPALAAVILLAVANLLDFGALRRAWRTQRDDGLAGLITFFATLAFAPNIQNGILTGLLLSLALMVYRSMSPRVALLGLHPDGTYRDLERFGLSHPHPQLVILRFDSPLTFVTAATFEDAMLRAARAQPDVRAVVVSAAGINAIDATGLHVLGGLLDRFGAQLQQIAFCGLKKQVLDTMQRDPLWPALAPHAGYRTEQQAIDALLPSLAAPTRGSSGPASAPSA

SEQ ID NO: 19411 - protein, 107 aa, Glycine max
MAKRNVAANSSFERSTLASLDQKLAMAKRCSHEGVMAGAKAAVVATIATAIPTLASVRMLPWAKANLNHTAQALIISTGAGAAYFIVADKTVLATARKNSFNPPTNA

SEQ ID NO: 19412 - protein, 485 aa, Escherichia coli
MSDKSFIAVVMAGGTGSRLWPLSRELYPKQFLKIGGELSLLQSTLNRLSKLSFDAPLVITNDNHRFIVAEQLRQMNQLSGNIILEPCGKNTAPAIALAAFSALKRDKNKDPILLVLAADHIIKNEEAFCEAIKSAMFMAEEDKIVTFGIIPTYAETGYGYINIGARVESNIEVDNAHFYVAKKFVEKPERELAEKYFSSKKYLWNSGMFMFKASVFLSELKKYRPDIFEVCEEAISASSKDLDFIRLPERMFEKCPSESIDFAVMENTKRCVVCPVDIGWSDVGSWQSLWELSDKSPSGDVCKGDTLTYNTKNNYIYSDSALVAAVGVENIVIVQTKDAVLVANKSEVQDVKKIVDLLKKNNRTEHVTHREVFRPWGKFDSIDQGDRYTVKKIVVKPGEGLSLRMHHHRSEHWIVLSGTAKVILEGTEKLITVNESIYIPLGASYSLENPGVIPLILIEVSSGDYLGEDDIVRQKERYKKKINHE

SEQ ID NO: 19413 - protein, 142 aa, Triticum aestivum
  misc_feature (58)..(58): Xaa can be any naturally occurring amino acid
  misc_feature (72)..(72): Xaa can be any naturally occurring amino acid
  misc_feature (82)..(82): Xaa can be any naturally occurring amino acid
  misc_feature (92)..(92): Xaa can be any naturally occurring amino acid
  misc_feature (95)..(95): Xaa can be any naturally occurring amino acid
  misc_feature (104)..(104): Xaa can be any naturally occurring amino acid
  misc_feature (109)..(109): Xaa can be any naturally occurring amino acid
  misc_feature (112)..(112): Xaa can be any naturally occurring amino acid
  misc_feature (118)..(118): Xaa can be any naturally occurring amino acid
  misc_feature (123)..(123): Xaa can be any naturally occurring amino acid
  misc_feature (141)..(141): Xaa can be any naturally occurring amino acid
MAPTVMASSATSVAPFQGLKSTAGLPVSRRSSSAGLSSVSNGGRIRCMQVWPIEGIKXFETLSYLPPLSTEXLLKQVDYLIXRSKWVPCLRXNKXGSFSREHNXPPGYXDGXYWDMLXLPMFXGCTDATQVLNEWRRSKKXT

SEQ ID NO: 19414 - protein, 334 aa, Erythrobacter sp. SD-21
MNDTPRWTMPPEWAPQDWLWIGFPHDADEWPEVLPRAQEQIAAFANAVAESGQEVRLLVRDAANEQRARDLVSGSVTLERREYGDVWLRDTGPLVLTDATGHRMAQRFGFNGWGGKYLMEGDHTIGAELAEDAGLPLEVADWVLEGGAIDGDGTGLVATTEQCLLNPNRNPQLTREEIEERLKSDLGFTRVLWLGDGLINDHTDGHVDNLARFVGANTLALPRATGKDDPNAAIYEDAKARAEEAGVVVQSIPSPGLITSGDRVEPASYANFAITSHLVVVPTFGSPYDEEGVAAIADLFPDRATIGISGDAVLAGGGGFHCASQQMPAARARI

SEQ ID NO: 19415 - protein, 387 aa, Corynebacterium efficiens YS-314
MRNKYVVERLRPFGETIFATMTQRANEAGAINLGQGFPDEDGPAPMLEIASQQILGGNNQYSGGRGDLGLRTAVASDRHKRFKLDYDPDTEVLITVGATEAISASVLGLVEPGDEVIVLEPYYDAYAAAIALAGATRVAVPLKEEDNTWVLDTDAVHAAVTKKTSMIIVNSPHNPTGSVFSKRSLEALAGIARAYDLLVLSDEVYEHLTFDKVSHTAVASLPGMWDRTITVSSAAKTFNVTGWKTGWALAPAPILEAVIRAKQFMSYVGATPFQPAVAHAVAHEKPWVKQMRKGLQNKRDILTDALTQAGLKVHDSHGTYFVVADIGERDGAEFCFDLIDRVGVAAIPVQAFVDKPEQWSSKVRFAFCKQEDTLREAAQRLRAAGSL

SEQ ID NO: 19416 - protein, 468 aa, Escherichia coli
MSKQQIGVIGMAVMGRNLALNIESRGYTVSVYNRSREKTEEVVAENPGKKLVPYYTVKEFVESLETPRRILLMVKAGAGTDAAINSLKPYLDKGDIIIDGGNTFFQDTIRRNRELSAEGFNFIGAGVSGGEEGALKGPSIMPGGQKDAYEMVVPILTKIAAIAEDGEPCVTYIGADGAGHYVKMVHNGIEYGDMQLIAEAYSLLKGALNLSNEELASIFNEWNEGELSSYLIDITKDIFNKKDEEGKYLVDVILDEAANKGTGKWTSQSSLDLGEPLSLITESVFARYISSLKDQRVAASKVLSGPQAKLASDKAEFVEKVRRALYLGKIVSYAQGFSQLRAASEQYNWDLNYGEIAKIFRAGCIIRAQFLQKITDAYAENKDIANLLLAPYFKHIADEYQQALRDVVSYAVQNGIPVPTFSAAVAYYDSYRSAVLPANLIQAQRDYFGAHTYKRIDKEGVFHTEWLE

SEQ ID NO: 19417 - protein, 313 aa, Bacillus anthracis str. Ames
MRNVFCIGELLIDFVCRNTNVSLVNGSNFEKKAGGAPANVAAAITKLGGHATFMGQVGNDPFGEFLEQTLQHAHVDTSMLIKDKQTTLAFVSIDQNGERDFTFMRGADGEYHFNSIDLSKIKTNDLIHFGSATALLSSPLKDTYFQLLQHARESGQFISFDPNYRNALITNTEQFIQDCLTFIKHAHFVKVSQEEAIMLSKESDLQQSALKLLNHGAKAVAITLGKDGTLLATKDKQTIVPSISIQQVDTTGAGDAFVGAMLYQIAKSEQMFLHNFEGLTTFISFANKVGALTCTNYGAISSLPSLTDVKAYE

SEQ ID NO: 19418 - protein, 312 aa, Burkholderia sp. 383
MAAFDIDDIVQSLQTVRRAWREKQRRSLEPGGRDLPAREALAQIIGALKGVLFPMRLGPPDLRQESENFHVAHALDAALNALLAQVKLELRYAARQRNADGPVDRVDDVASTAVQAFAARLPEIRRLLDSDVLAAFHGDPAAGSVDEVLLCYPGILAMIHHRLAHELYGLGLPLLARIIAEQAHAETGIDIHPGARIGAGFFIDHGTGVVIGETAIIGERVRVYQAVTLGAKRFPRDAAGHLEKGLARHPIVEDDVVIYAGATILGRVTIGRGAVIGGNVWLTQDVPAGANITQAVLRSEANTAPRAAARVA

SEQ ID NO: 19419 - protein, 247 aa, Glycine max
  misc_feature (30)..(30): Xaa can be any naturally occurring amino acid
  misc_feature (240)..(240): Xaa can be any naturally occurring amino acid
MAAYKLVLIRHGESAWNLENRFSGWYDADXSAGHEEAKRGGQALRDAGYEFDICFTSVQKRAIRTLWTVLDAIDQMWLPVVRTWRLNERHYGGLTGLNKAETAAKHGEAQVKIWRRSYDVPPPPMEPDHPFYSNISKDRRYADLTEDQLPSCESLKDTIARALPFWNEEIVPQIKEGKRVLIAAHGNSLRGIVKHLEGLSEEAIMELNLPTGIPIVYELDKNLKPIKPMQFLGDEETVRXAMGAVAA

SEQ ID NO: 19420 - protein, 457 aa, Streptococcus pneumoniae
PSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWAENGAPLHDYKAGSMGPQASFDLLEKFDAK

SEQ ID NO: 19421 - protein, 460 aa, Streptococcus pneumoniae
YPSLFRLYQSGNLSKHFAVIGTARRPWSKEYFESVVVESILDLADSTEQAQEFASHFYYQSHDVNDSEHYIALSQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEKLWAENGAPLHDYKAGSMGPQASFDLLEKFGAKWT

SEQ ID NO: 19422 - protein, 454 aa, Streptococcus pneumoniae
PSLFRLYKSGNLSKHFAVIGTARRPLSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWAENGAPLHDYKAGSMGPQASFDLLEKF

SEQ ID NO: 19423 - protein, 286 aa, Saccharomyces cerevisiae
MTYTLAILGCGVMGQALLSAIYNAPKAADETAAAFYPSKIITCNHDEPSAQQVTDLVETFDESPNGIKVESTYGHNVSAVEEASVVLLGTKPFLAEEVLNGVKSVIGGKLLISLAAGWTIDQLSQYTSTVCRVMTNTPAKYGYGCAVVSYSADVSKEQKPLVNELISQVGKYVELPEKNMDAATALVGSGPAFVLLMLESLMESGLKLGIPLQESKECAMKVLEGTVKMVEKSGAHPSVLKHQVCTPGGTTIAGLCVMEEKGVKSGIINGVEEAARVASQLGQKKK

SEQ ID NO: 19424 - protein, 470 aa, Streptococcus pneumoniae
DLAKRKLYPSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATANKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVCASWKLIDRIEKLWAENGAPLHDYKAGSMGPQASFDLLEKFGAKWTWQP

SEQ ID NO: 19425 - protein, 568 aa, Bacillus cereus ATCC 10987
MTLNIQGIAASSGIAIAKAFRLENPEFNIEKKSITNEAAEIARLEAALEKAKTELEAIKDHAFAELGADKAAIFEAHLLVLNDPELVNPVKDKVNSEKVNAEFAMDEVASMFISMFENMDNEYMKERAADIRDVTKRVLAHLLGINFSNPGTISEEVIIIAEDLTPSDTAQLNRKYAKGFTTDIGGRTSHSAIMARSMEIPAVVGTKFVMEKIQNGDIVIIDGLDGEVIVNPSEETLRSFEEKKAKFEEQKAEWAKLKDQATVTSDGHHVELVANIGTPNDVQGIIDNGGEGVGLYRTEFLYMGRDNLPTEEEQFEAYKAVLEGVKEGQPVVVRTLDIGGDKELPYLHLPKEMNPFLGYRAIRLCLDEQDVFRTQLRALLRASVYGNLKIMFPMIATLDEFRQAKAILLEEKAKLVEAGTTVSNSIEVGMMVEIPASAVLADQFAKEVDFFSIGTNDLIQYTMAADRMNEQVSYLYQPYNPSILRLVKMVIDAAHKEGKWAGMCGEMAGDSLAIPLLLGLDEFSMSATSILPARTQLSKLSKAEMETLAEKALMMSTAEEVVELVKSI

SEQ ID NO: 19426 - protein, 451 aa, Streptococcus pneumoniae
LYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHILQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEKLWAENGAPLHDYKAGSMGPQASFDLLEKFGA

SEQ ID NO: 19427 - protein, 129 aa, Arabidopsis thaliana
  misc_feature (70)..(70): Xaa can be any naturally occurring amino acid
  misc_feature (76)..(76): Xaa can be any naturally occurring amino acid
  misc_feature (117)..(117): Xaa can be any naturally occurring amino acid
TARTEWWPTHRLSLYNLRPIVNTWQRKALQYPDLEILPERSNEILLLYEAVTNNNIQDKNKPVKQRYEEXAIKNNXQLPDPNCVPTDTTSRETKDCEAKHKATERNWQKRKEDHMSXKICGKTGHYTQR

SEQ ID NO: 19428 - protein, 225 aa, Zea mays
MEWRDSFLDLALIPLSLLLPMAYHAWLWREVRLRPLRTAVGINAATRRLWAIGMMKDNAKNAVTVVQSVRNVIMGSTLMATTAILFCTGVAAVLSSTYTIKKPLSDTVFGAHGEYMMALKYVALMLLFLLAFLCHSLAICFLNQASFLINTSACLFSSSADSDAAVLGLPLPPTRDYIGDVLERGFTLNLVGNRLFYAGVPLLLWIFGPLLAFLSSMVMVPILYS

SEQ ID NO: 19429 - protein, 245 aa, Idiomarina baltica OS145
MSEVANKVVIITGASSGLGEETAKMLASKGAKLVLGARREERLKALADSIKNDGGEAIFKTVDVTDKSQVQALADAALEQFGRIDVLVNNAGLMPLAPLDELKIDEWDQMIDVNIKGVMYGVAAVLPSMRKQKSGHIINLSSVAGHVVFPGATVYCATKFAVKAISEGIRQESNGEIRATNISPGAVSTELTDHISHKDSKEMADDLYQDAIGSDSIARAITFAIEQPGDVDVNEMIIRPTKQEL

SEQ ID NO: 19430 - protein, 566 aa, Oryza sativa Japonica Group
MNELCDLKVHINGHHTLLLHQSVMCAFSGRLRTMVTQEKKKRKTSRAESLSVKLADFPGGGEGFELVARFCYNNGRVPLCPSNLPLLHCAAVFLEMTEEVCTCNLLTQAEAFVDGLYYWTWADVLAAVKSCEPFAAAADASGLLERLISALFSKITANPETPVAAGAVGTPNRSSSSCSSSPDTLGFGRSSSTKTPESMKPCFAREWWFDDMTSLCPQTIEKAMRVLGCYGIENKNLILTRFLLHYLRAATRRPALCREGGGGLAGLADTAVHGVALVGGTAFSCRGLFWVLRIVSAVGLSKECRHKLERLMGLMLDQATLDDLLVSGDDGGVYDVNLVMRLVRVFVGSEEEADLPSQRMRKVGRLVDKYLGEISPDHGLRVSKFLAVAESLPDSARECYDGVYRALDIYLESHPTLTIEERTTLCRCLNYEKLTLEACKDLAKNRRIPPGIAVQALASQQSKLQIRPAAAAAKGTGGCRPDPSQTPRKIIVSGSRARSVDLDAMDEKELLKLNLQKMQNRVVELERACKEMRGQMSKMAKGGRPSSSFGAAACHQTGGRGLPRLC

SEQ ID NO: 19431 - protein, 330 aa, Idiomarina baltica OS145
MSRKILITGAAGFIGFHTAKRLLSEGFHVVGIDNLNDYYSVQLKYDRLKQLKKFDSFSFHSIDIDNPIALSDCLADYTIDDVIHLAAQAGVRYSIDNPQAYGRSNLIGFLNILEWVRSHPVDHFIYASSSSVYGNTERVPFSTNATADKPVSLYAATKRANELMAESYSHLYNIPATGLRFFTVYGPYGRPDMAPMKFAKQIMQGGQIDVYNHGDLSRDFTFIDDIVEGIYRLLDKPIQTQSEGARHRVLNIGRGEPVNLLKFIEILESAFEKPVKKRYLPMQDGDVSTTWADVTELSKITGYSPQVDIESGIQKFAEWYKKYNAHGQLA

SEQ ID NO: 19432 - protein, 504 aa, Streptomyces coelicolor A3(2)
MTAETSSSGSVPASTGTVTTAVPARLDRLPWSRWHWMIVIGLGTVWILDGLEVTIVGNVAGRIAEDGSGLDISSAQITGLAAALYVAGACSGALFFGWLTDRHGRKKLFMLTLVVYLAATALTAVSFESWWFFLFRFLTGFGIGGEYAAINSAIDELIPSHYRGRVDLIINGSYWLGAIGGALLSIVMLDTDIFAKDVGWRLSFALGVVLGLVVLLVRRHVPESPRWQFIHGQGEKADTLVSSVEREIEREKGAKLPPPAGEITIHQRKSIGFGLIAKTVFRRYPRRAVLGLSLFIGQAFLYNAITFGFGTILITFFDVPTGSTGYYFAVIAAGNFCGPLLLGHLFDTVGRRIMISSTYLLSGVLLFGTAWLFDRGSLTATTMTACWCVVLFFASAGASSAYLTVSEIFPMETRAMAIAFFYALGTAAGGISGPLLFADLTESGVVGDTVLAFQIGAGLMCAAGLVAAFLAVKAERRSLEDIAEPLSTAVPETPGTAGPGAKTA

SEQ ID NO: 19433 - protein, 536 aa, Prosthecochloris aestuarii DSM 271
MNHRDGRKTGTDFLFNHLMFTFMQSVLVLDFGSQYTQLIARRIREIGIYSEIIPYSTPLDTIKEHKPGAIILSGGPNSVYGEDALLPDKGIFSLGVPILGICYGLQVIATHFGGEVAVSSKQEFGRAKILVDRENDVAASRLFSDIPDSDVWMSHGDKVVRMPEGFSITASSGNSEMCAIEATGSKAALKVYGLQFHPEVQHSLYGKQLLSNFLIDIAGLKPDWSPKSFIEHQIEEIRKTAGNATVICGISGGVDSTVAAVLVSKAIGKKLHCVFVNNGLLRKNEGEKVMSILKPLGLNITMVDAEEIFLKRLKSVASPEKKRKIIGRTFIHIFEEQIHEEKFLVQGTLYPDVIESVSVKGPSETIKSHHNVGGLPKRMKLKLIEPLRELFKDEVRAVGRELGIDEDILMRHPFPGPGLAVRVLGSLTKERLDILRDADEIFLEELKKQNLYQQVWQAFSVLLPVQSVGVMGDKRTYENVLALRAVESSDGMTADWAHLPHEFLSHVSNRIINEVRGINRVAYDISSKPPATIEWE

SEQ ID NO: 19434 - protein, 477 aa, Bordetella parapertussis 12822
MTESTSSDAPVTDAPTRTFADFGLHPLLLKSIADTGYTNPTPIQAQAIPVVVEGRDVMGAAQTGTGKTAAFTLPILHRLMPLANTSASPARHPVRALILTPTRELADQVYESVKRYSLHTPLRSAVVFGGVDIGPQKEALRRGCEVLVATPGRLLDHVEQKNVNLSQVGILVLDEADRMLDMGFLPDLERIIRLLPAQRQGLLFSATFSNEIRKLGRSYLNHPVEIEVAARNATADTVTQIAYQMHGDTKRAAVVHLVKSRGLKQVIVFSNTKIGTARLARQLERDGVKAESIHGDKTQGDRMKALEAFKAGDLEVLVATDVAARGLDVAGVPCVINYDLPYNAEDYVHRIGRTGRAGASGEAIALFTADEERYLLDIEKLIKRQVPRGKLELPADLVARSHGRDRDAPRERGADRHRGERRTSGAAAPRQPVDELFYKPYEPANGQPASPETPKQEGRSNAPKRQLAVLLGGSRKG

SEQ ID NO: 19435 - protein, 166 aa, Oryza sativa Japonica Group
MAAAAEEKNKKMIKVISSDGEAFEMTEAAASMSRILLHMIEDGCTGDGGAGITLPNVAGSALAKVIEYCTKHAIAAAEGSSSSRKAKEELKKFDVEFMEVGIDMLYDLIMAANFMGVEGLLSLAAQRTAELIKGKSPEQIREMFGIKNDHTPEEEEQIRKEYEWAF

SEQ ID NO: 19436 - protein, 443 aa, Pyrococcus furiosus DSM 3638
MEPLEIVRRYEKVIAPANRTTYYPLIPVKAENAKVWDITGKEYIDFLSDAAVQNVGHNNPRVVKAIKDQIEKLVHASYIYLFPIEPLLLAEKLVEIAPIENAKVSFGLSGADANDGAIKFARAYTKRNMILSYMKSFYGSTYGAMSLTGLDFQVRALVGELSGVHYIPYPNCYRCPFGKDRNSCKMECVEYIKEKFEGEVYSEGVAALFAEAIQGDSGMIVPPQDYFKKVKRILDEHGILLVVDEVQSGLGRTGKWFAIEHFDVKPDIITIAKPLGGGLPISATIGRAEIMDSLPPLSHAFTLSGNPTAAKAALAVIEEIEEKDLLKRAEKLGEYTKKKLEELKKKHELVGDVRGLGLMLGVELVKDRETKERAFEETKKVVWRAFELGLIVTFLQGNVLRIQPPLTIEKDVLDEGLEILDQAIEDVEEGKVPDEVIKNVRGW

SEQ ID NO: 19437 - protein, 338 aa, Haemophilus influenzae
MAILVTGGAGYIGSHTVVELLNVGKEVVVLDNLCNSSPKSLERVKQITGKEAKFYEGDILDRALLQKIFAENEINSVIHFAGLKAVGESVQKPTEYYMNNVAGTLVLIQEMKKAGVWNFVFSSSATVYGDPKIIPITEDCEVGGTTNPYGTSKYMVEQILRDTAKAEPKFSMTILRYFNPVGAHESGLIGEDPNGIPNNLLPYISQVAIGKLAQLSVFGSDYDTHDGTGVRDYIHVVDLAVGHLKALQRHENDAGLHIYNLGTGHGYSVLDMVKAFEKANNITIPYKLVERRSGDIATCYSDPSLAAKELGWVAERGLEKMMQDTWNWQKNNSKGYRD

SEQ ID NO: 19438 - protein, 388 aa, Escherichia coli
MKITISGTGYVGLSNGLLIAQNHEVVALDILPSRVAMLNDRISPIVDKEIQQFLQSDKIHFNATLDKNEAYRDADYVIIATPTDYDPKTNYFNTSSVESVIKDVVEINPYAVMVIKSTVPVGFTEAMHKKYRTENIIFSPEFLREGKALYDNLHPSRIVIGERSERAERFAALLQEGAIKQNIPTLFTDSTEAEAIKLFANTYLAMRVAYFNELDSYAESLGLNTRQIIEGVCLDPRIGNHYNNPSFGYGGYCLPKDTKQLLANYQSVPNNLISAIVDANRTRKDFIADAILSRKPQVVGIYRLIMKSGSDNFRASSIQGIMKRIKAKGVEVIIYEPVMKEDSFFNSRLERDLATFKQQADVIISNRMAEELSDVADKVYTRDLFGSD

SEQ ID NO: 19439 - protein, 510 aa, Zea mays
MAVAAPGQLNLDEAPSWGSRSVDCFEKLEQIGEGTYGQVYMAKETGTNEIVALKKIRMDNEREGFPITAIREIKILKKLHHQNVIKLKEIVTSPGPERDEQGKPIDGNKYKGSIYMVFEYMDHDLTGLADRPGMRFTVPQIKCYMRQLLTGLHYCHVNQVLHRDIKGSNLLIDNEGNLKLADFGLARSFSSDHNGNLTNRVITLWYRPPELLLGSTKYGPAVDMWSVGCIFAELLNGKPILPGKNEPEQLTKIFELCGTPDDTIWPGVTKMPWYNNFKPPRPLKRRVKDFFKHFDRHALDLLEKMLTLDPSQRISAKDALDAEYFWTDPLPCDPKSLPKYEASHEFQTKKKRQQQRQAEEAAKRQKLNHPPPHSRLPPLQQPGQAHPQMRPGQGMHNVPPVAAGPGHHYAKPRGPGGPNRYPQGGNQGGGYNPNRGGQGGGYGSGPYPQQGRGPPYPGAAGPRGSGGSGYGAGGPNYQQGGPYGTSGPGRGPNYSQGSGSRNQQQYGNWQ

SEQ ID NO: 19440 - protein, 754 aa, Bacteroides fragilis YCH46
MSHLPTLIADLALILMSASIITLLFKWLKQPLVLGYIVAGLLAGPYVRIFPTVGDMENINTWAEIGVVFLLFALGLEFSFKKLMNVGSAAFITATTEVISMLLIGFMVGHLLGWSTMNSVFLGGMLSMSSTTIIIKAFDDLGLRSQRFTGIVFGTLVVEDLIAILMMVILSTMAVSKDFVGEELLMSVLKVAFFLILWFLVGIFILPFFLKKAKRLMNNETLLIVSLGLCLAMVVLATRTGFSAALGAFIMGSILAETVEAEHIEHIIQPVKDLFGAIFFVSVGMLVNPSVLLQYAWPVVIITLVTLVGKSIFSSLGVLLSGEPLKVSVKSGFSLAQIGEFAFIIAGLGASLKVLDPFVPPIIVAVSVITTFTTPYFIRLANPFSEWLYKVLSPRTREFLDRYASGKKTVNHDSDWKRLLKTIVGRVIIYSVLLTAIWLLSVQTVYPTINGMFDSPGRWLSVVMCLLTLLLMTPFLWALVSDKYNSPDVFLKLWNDDNYNHGRLVALILFRVSVAVFFIAGVVISYFSLNYGIGIVIAVAVLGLILLLRENLTQYSHLENHFLTNLNGREEAARNRYPLKSRFNSEFSDKDIELTSVWVSPYSSYIGKSLEELPFRREFGVNVVGIVRGERRIYIPQSDECIYPQDKLIVVGTDGQLQKFRSELDIRQDFPDEKNVRQEVTLHSFTVDEESPLLNKSIAQSRLGKQYDSLIVAIEREDELISMNQSTVFRLGDLVWIVGDREKIRQLLMRKKHV

SEQ ID NO: 19441 - protein, 84 aa, Glycine max
  misc_feature (62)..(62): Xaa can be any naturally occurring amino acid
  misc_feature (64)..(64): Xaa can be any naturally occurring amino acid
LFKNMTCYVSREVPRESKLYAIPAFGGIIFWEGERAPFGESDQSISYQIVDREAQGHPFLSXNXVQPQWAYECVNARYFLPTDH

SEQ ID NO: 19442 - protein, 458 aa, Streptococcus pneumoniae
PSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHILQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEKLWAENGAPLHDYKAGSMGPQASFDLLEKFGAKW

SEQ ID NO: 19443 - protein, 578 aa, Coprinopsis cinerea okayama7#130
MASTASSPPSESTTSSSPVTTIEAPVQSTTGQPQSANEQQPQPPQQGRQNQFHPPAKRILIPDQLTAFQNSQTHADIVEFITRLNKSVKGAKLSDRFEGEGRPIIQAILKILDEVQQIAKETPPIENPGSRFGNPAFRTFYDRVGEATEPLHTTHLVPLGLPPASIPEIGTYFKECWGNRTRIDYGNASNTTSPSSTGTSSSTSPSPAEDLATPLVLRIFWTYIQTMRLLQSQYWLEPAGSHGHKFIRPRAIHDAEVVEEYAKDYMYFACIAFINSIKTASLRWHSPMLDDISAVKTWDKVNEGMIKMYKAEVLGKLPVMQHFLFGSLLPFPVYVPSTEAGSVVAPSVPNASAIVVPSSASPSASSSTTSSAPTRGAPDGKEGDKKEHVHDPNCLNAVGVGGGPEAQGHAHHAHSHVPRNIHPKVLASLKARGEVVEGLGGGHGHREYEEAIERFQNAPSEREAEDAEDAKSKLHDVVLVCVVIVLAATGPFSECSAGKEWAQLSKSEVTPASTSTRTSDYALLPTSGHHPKDAFRSGFCVGAFVRFGQPPWSEDFSRFADDVAPAPPPLHYNYNDCY

SEQ ID NO: 19444 - protein, 469 aa, Streptococcus pneumoniae
LAKRKLYPSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEKLWAENGAPLHDYKAGSMGPQASFDLLEKFGAKWTWQP

SEQ ID NO: 19445 - protein, 511 aa, Bacteroides fragilis YCH46
MEDINKAYATFAERDRIASLGGGAAKIDIQHESGKMTARERIDMLLDKGTFVELDKLMVHRCTNYGMDRNKIPGDGVVSGYGKIDGRQVFVYAYDFTVYGGSLSASNAKKIVKVQQLALKNGAPIIALNDSGGARIQEGIESLSGYADIFYQNTMASGVIPQISAILGPCAGGACYSPALTDFIFMVKEKSHMFVTGPDVVKTVIHEEVSKEELGGAMTHSSKSGVTHFMANTEEELLMSIRELLSFLPQNNMDEARKQNCTDDVNREDASLNSIVPSDPNVPYDMKEIIERVVDGGYFFEVMQNFAKNIIIGFARMGGRSVGIVANQPAYLAGVLDIDASDKASRFIRFCDCFNIPLITFEDVPGFLPGYTQENNGIIRHGAKIVYAFAEATVPKLTVITRKAYGGAYIVMNSKQTGADVNFAYPSAEIAVMGAEGAVNILFRKADAETKAQELNAYKEKFATPYQAAELGFIDEIILPKQTRKRLIQALEMTENKMQTNPPKKHGNMPL

SEQ ID NO: 19446 - protein, 272 aa, Triticum aestivum
  misc_feature (258)..(258): Xaa can be any naturally occurring amino acid
AYLGDTIEQVCTKKQAGTGPEFPGYRRPTRPVAYNKDPSPVKVNLGVGAYRTEEGKPLVLNVVKRAEQMLIHNESRVKEYLPITGLADFNKLSAKLIFGADSPAIQENRVATVQCLSGTGSLRVGGEFLARHYHERTIYIPQPTWGNHPKVFTLAGLTARSYRYYDPATRGLDFQGLLEDLSSAPSGAIVLLHACAHNPTGVDPTLEQWEQIRQLMRSKALLPFFDSAYQGFASGSLDKDAQSVRMFLADGGGLLMAXSYAKDMGLYGKPVG

SEQ ID NO: 19447 - protein, 127 aa, Aspergillus oryzae
MSKLFIGGLAWHTTDESLRSGFEKYGAVEEAIVVKDRDTGRSRGFGFVRFSSEADAEAAAHEMNNQEFDGRTIRVDKASERAPRNDGGFQCRGGYNQRGGNGGGYGGYGGGSRGGYGDGDWRRSDGN

SEQ ID NO: 19448 - protein, 451 aa, Streptococcus pneumoniae
FRLYQSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRSVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEKLWAENGAPLHDYKAGSMGPQASFDLLEKF

SEQ ID NO: 19449 - protein, 454 aa, Streptococcus pneumoniae
FRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRSVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWAENGAPLHDYKAGSMGPQASFDLLEKFDAK

SEQ ID NO: 19450 - protein, 454 aa, Candidatus Kuenenia stuttgartiensis
MFEEIRKEQLQTWDKTYLWHPFTQMQEYVKETPLVIAEGKGIYLKDIDGNEYIDGVSSMWCNLHGHRKKEIDDAIKAQLDKIAHSTFLGPTNIPASELGKKLIEIVPNGLSKVFYSDNGSTANEVALKMAFQYWQHKGRRDKTQFIALQYGYHGDTIGTMAVGGIDIYHKVFSPLYFKTHFAPSPYCYRCPLNKIPEDCSMECLGTLEKILQEHADNVAAMIMEPLVQGVGGMLMHPKGYLAGVSKLCKQYDVLLILDEVMTGFGRTGKMFACEHECVVPDLMPLSKGINGGYMPLAATLATQEIYDAFLGEYTHLKTFFHGHTYTGHPLGCAASLASIHLFEKENILENLQPKIKHLKEKLSSFKVLKHVGEIRQCGLIAAIELVKDTKTKEPYSWVERIGIQICLEAKKQGVLIRPLGHIIVIMPPLIITTAELDRLLGVIYESIRTVTEKV

SEQ ID NO: 19451 - protein, 511 aa, Debaryomyces hansenii CBS767
MVLDVESIAIIGAGPSGLAALYEFLHTSKDGASSFGGKEPEEKAFKKVVVFEQKSNPGGVWAVPDEETISYLKDLYQYNSLKDIIKSKEANLQNALKNSDTKYPLKVDKSKDSVSWKGTPLYKNLFTNVPKRFTRFSTSPYKPIGDDRVIDPFLRDYELRSHIQNYVSANDLEKYIQFNTEVVKAVKKGSKWQLTLKREEKEAGDVEFYQKEFDAVVVANGTFLLPYIPPIEGLKEYEEAYPGSILHSKFFRDYEDYANQKIVVLGSSVSGMALSQYLKPLAKEFILSRKDRKETLEWMNDIIYSKEFTVKPSIKRFISSSREIVFDNGSKVKNFDKILLATGYYPYYPFFEKNFLSLSVSPDKNGPANNSRVKNLYYNIFKIDDPTLAFVGLIKTSQLFTVFESQSAAIAGVWSNAKQLPSLVEQYEWERKTLEHTPDTSRFYVFSNEDVKTQYLDRIKTFFPFERKGPLNENYFEHFEDFKNGEKKLTKLSLSMMKKQVVFENGEYIEK

SEQ ID NO: 19452 - protein, 158 aa, Zea mays
MSSPSKRREMDLMKLMMSDYKVEMVNDGMQEFFVEFKGPAESIYQGGVWKVRVELPDAYPYKSPSIGFINKIYHPNVDEMSGSVCLDVINQTWSPMFDLVNVFEVFLPQLLLYPNPSDPLNGEAAALMMRDRPVYEQKGKGEEQVIQEEPQGEEYDLI

SEQ ID NO: 19453 - protein, 469 aa, Streptococcus pneumoniae
DLAKRKLYPSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWAENGAPLHDYKAGSMGPQASFDLLEKFDAKWTWQ

SEQ ID NO: 19454 - protein, 610 aa, Saccharomyces cerevisiae
MPPVSASKAKRDAKKAEREAKKAAAGKTIRKLGRKKEAAAEESEVDAAAREIKMMKLQQDKDGLSDRVVTGVLSSLETSRDIKLSSVSLLFHGKVLIQDSGLELNYGRRYGLLGENGCGKSTFLKALATREYPIPEHIDIYLLDEPAEPSELSALDYVVTEAQHELKRIEDLVEKTILEDGPESELLEPLYERMDSLDPDTFESRAAIILIGLGFNKKTILKKTKDMSGGWKMRVALAKALFVKPTLLLLDDPTAHLDLEACVWLEEYLKRFDRTLVLVSHSQDFLNGVCTNMIDMRAQKLTAYGGNYDSYHKTRSELETNQMKQYNKQQEEIQHIKKFIASAGTYANLVKQAKSRQKILDKMEADGLVQPVVPDKVFSFRFPQVERLPPPVLAFDDISFHYESNPSENLYEHLNFGVDMDSRIALVGPNGVGKSTLLKIMTGELTPQSGRVSRHTHVKLGVYSQHSQDQLDLTKSALEFVRDKYSNISQDFQFWRGQLGRYGLTGEGQTVQMATLSEGQRSRVVFALLALEQPNVLLLDEPTNGLDIPTIDSLADAINEFNGGVVVVSHDFRLLDKIAQDIFVVENKTATRWDGSILQYKNKLAKNVVL

SEQ ID NO: 19455 - protein, 606 aa, Aspergillus oryzae
MNSKLPGLSMQTVVTELDLTYRRRFSDLKIPEAYESLILDALKGDHSNFVRDDELDASWRIFTPLLHYLDDNKEIIPMEYPYAARWVGSPSIKGRTEAMRMALLTFSLLGLQFTWGIEMTYRSRSKWGRRRPFMIIGSLIVAMCLLVLGWTTEIVGLFVKDAEKANRVTIALAVLSIYAVDFAINIVQACCRSLIVDTLPIPSQQAGSAWATRMSAIGQLISYVIGSIDTVSIFGTTIGDTQFKQMTVIAALSLLIAVLVTCYAVKERVLITARDSEGKAGAFQVMSQLFKTTMDLPPRIQAICWAQFWAWIGWFPFLFYSTTWVGETYFRYEVPKDATHPTDMLGEVGRVGSLSLVVFSSITFFSSVLLPFCVQPPDDRRPRFTPRPPPGIAALLKKITLIRPDLQTTWLISHVMFAATMIFAPLARSRAFATFLVALCGIPWAVSSWAPFAFMGVEINKLALGPTQASRLSGVTMITSSSIRSGAYSDRSGDTEMDVLRLNHNDTDSDSDTEGGASDLPSTGELAGIYLGVLNVYTTLPQFVGTFISWIVFSVIEPGSTKRDASETQWINLDKGSPNAISICLFIGALSTLVAIEATRRLRHVR

SEQ ID NO: 19456 - protein, 708 aa, Oryza sativa Japonica Group
PPHLATAIDRERERERELNSRAMARSGRERRDQEEEAAVVSVERVFEGRVVPGWKEQVTLRALAVSALLGAMFSVIVMKLNLTTGIIPSLNVSAGLLGFFLLTSWTKLLDKAGVASVRPFTRQENTVVQTCVVACSGIAFSGGFGSYIFAMSDRISDQSGEARDEHNIKNPSLGWMIGFLFIVSFLGLFSVVPLRKIMIIDYKLIYPSGTATAHLINSFHTPQGAKLAKMQVKMLGKFFVMSFSWGFFQWFYTGGDGCGFMSFPTLGLEAYRNKFFFDFSATYVGVGMICPYLVNISVLLGGVMSWGIMWPLIEHKKGDWYPADLKPSSLRGIVGYRVFISISLILGDGLYNFLKVMTRTTTALVMQVRAMMSEPTLPVSGGGGQTPEETFDDKRRTELFLKDQIPNWLALSAYVVIAVVSIATVPRIFHQLRWYHVAVSYVVAPVLAFCNAYGCGLTDWSLATTYGKLAIFTVGAWADASDGGIIAGLAACGVMIGIVSTASDLTQDFKTGYMTLASPRSMFVSQVIGTAMGCVIAPSVFWLFYKAFHDIGMPGSEYPSPNALVYRNMAILGVQGLGSLPKHCLDLCIGFFVAAIAVNLARDLAAPKVARFLPLPMAMAIPFYLGPYFGIDMCIGSLIRFVWDRLDGARAKAFAPPVASGLICGDGIWTLPQSVLALAGVKPPICMKFLSRTTNIKVDAFIAKLPSS

SEQ ID NO: 19457 - protein, 222 aa, Aspergillus oryzae
MDHEEYLRRVRSYIKTPTKEIEEQLDSFCQLCSYVSGQYDKDESFQNLTRHLEDIEKGHKEQNRVFYMALPPSVFTTVSEQLKRNCYPKNGVARIIVEKPFGKDLQSSRDLQKALEPNWKEEEIFRIDHYLGKEMVKNILIMRFGNEFFNATWNRHHIDNVQITFKEPFGTEGRGGYFDEFGIIRDVMQNHLLQVLTLLAMERPISFSAEDIRDEKVTVSFN

SEQ ID NO: 19458 - protein, 249 aa, Saccharomyces cerevisiae
MIYTSSKSLQYLAVPIYTIFKNLTIILIAYGEVLFFGGKVTSMELTSFIMMVLSSVVATWGDQQAIAIKASSLEDLDQELVESTIFVLNPGYLWMFTNCISSALFVLIMRKRIRLTNFKDYDTMFYNNVLALPLLLVFSFIMEDWSTKNLSVNLSADSLAAMVISGLMSVGISYCSGWCVRVTSSTTYSMVGALNKLPIALAGLVFFDAPKNFLSFFSIFLGFLSGLLYAVAKQKKIQQQKVLAATLEK

SEQ ID NO: 19459 - protein, 145 aa, Bacillus cereus ATCC 10987
MKTLGYIVMENGEKIDLEFFPEEAPKTVENFKKLAEQGFYDGVTFHRVIPGFVSQGGDPTGTGAGGPGYSIPCETDGNPHRHLVGSLSMAHAGRNTGGSQFFIVHEPQPHLDGVHTVFGKVTSGIETVLNMRQGDVMKEVKVWEE

SEQ ID NO: 19460 - protein, 706 aa, Burkholderia xenovorans LB400
MTLNPSADVVTRELRGKVLLVTIDHAPVNALSADVRRGLLAAVEAADADSAVQAVLIVGAGRNFIAGADIREFGKPPLPPALPDVCNRIEACTKPVVAAIHGAALGGGLEVALAAHYRIAVEGAKLGLPEVQLGLLPGAGGTQRTPRLIGAQAALDLILSGRHASAKEALALGLIDRLGSSGDILAEGLAYVHELLAAHAPVRRTRDAVAPGDRAASLAAVTAARAETAKKSRGLFSPLKIVDAVEAAIEQPFDEGLRLERKLFLECLDSPQRAGLIHAFFAEREVLKAPETRDAKPRALNAIGVVGGGTMGAGIAVAVLDAGLPVTMIERDDASLARGLAHIEKVYDGLIARGRMSAEKKAAVMTRWNGSTSYDALTDADLVIEAVFEDLAVKQAVFAELDRVCKAGAVLATNTSYLDIDAIAASISRPADVIGLHFFSPANIMKLLEVVVPKRVSADVVATAFELAKKLRKTPVRAGVCDGFIGNRVLAVYRAAADAMMEDGASPYQIDAAVRAFGFPMGPFQVVDLAGGDIGWAARKRRAATRNPAARYVQIADRLCERGWFGQKTGRGFYLYPEGSRSGTPDPEVEAIIDAERARAGITPRSFTDDEIIRRYMAAMINEGANVVHERIALRPLDVDVTLLYGYGFPRYRGGPMKYADMVGLPKILADIREFAKEDPLFWKASPLLVELVERGADFASLNQTA

SEQ ID NO: 19461 - protein, 476 aa, Pseudomonas syringae pv. phaseolicola 1448A
MYPDVQLYIDGQWRASRDGRSIPVIDPATGQSLGSVAHAGITDLDEALAAAERGFATWRATSAYDRYKLMQKAANLIRERADNIARILTQEQGKPLAEARMETLSAADVIDWLAEEGRRSYGRIVPSRGVAIEQKVVKEPVGPVAAFTPWNFPINQVVRKLSSALAAGCSIIVKAPEETPASPAELIRAFADAGVPAGVIGLVYGDPAEISGYLIPHPVIRKVTFTGSTPVGKQLAALAGKHMKRATMELGGHAPALVFDDADIDLAARVLATAKFRNAGQVCVSPTRILVQRKVLDAFTERFVGLTREIKVGNGLEAGTTMGPVANERRIPALVDLIEDAVRGGATLSAGGKAVEGAGYFFEPTVLSGLTPQMRIMNEEPFGPVALLVPFDTVEEAIAESNRVPFGLASYAFTTSMKTAQALSTYIEAGMLSINHQGIGLPEVPFGGIKDSGYGSEGGTEAIEAYLNTKLVTQYN

SEQ ID NO: 19462 - protein, 558 aa, Physcomitrella patens subsp. patens
MERTNRRTAPQPTRRSLARLVGLEPGLVELGMGRRREGRVRVRVVDKRREDEGFERFYRGLGEEGVEERDLCWCRGASNTLSAVNGHTVQRRSVGSAGSVGQSNTGLSFQCQPVQNPGGHSDSARLHTNGNCGDNKQCRGEFLSAKDASRRKRFGVPSILALGVPHSRSAAETMAMQKWISVGVNRTAKLKQCKLDARREQWLSQGSQGKQDRAEQQQQSNAQQHQSCKHHHKAGDGECMAQERAGPSGHPRSQASGSSGSAGERTPVGSPATHSRSSGSVSGNEAKNSKIEAPPRRQDGSSRASKYFGDEELHGGSDHKQDLANNGRASSNASKSRSNSSCASSSYTGSGSEDNDESHEAEDDWESAFDALHVQSSPHRSEGSHKGPSSDRAQHNEGKELHDKKQNGAHQYNQHHSDMQSGQLKPEYKYKNSGFGGRRGHGGRAWRPDDVSRPPTLPRLTKQHTYPNHSSSNHQGWGNMHGNLWGNQPATPSYCPICTEELDMTDSSYMPCTCGFQLCLFCYHRISSDDGRCPGCRKAYNADSAVKLSRSSSVWLRV

SEQ ID NO: 19463 - protein, 279 aa, Bordetella parapertussis 12822
MQVVRKAVFPVAGMGTRFLPATKAMPKEMLPVVDKPLIQYAVEEAVAAGITDLIFVTGRNKRAIEDHFDAAPELETDLEAKGKHELLALVRDILPAHVNCLYIRQSAPLGLGHAVLTAAPAVGNEPFAVLLADDLIDADTPVLKQLIDVAVARQGSVLGVQEVPREDTRKYGIVASQPVDARTERVTHIVEKPAPEQAPTTLAVVGRYVLEAAIFDHLRATTVGAGNEIQLTDGIAALLRERDVYAHRYDGKRYDCGSKAGMFQATVALGRKYHGLIPE

SEQ ID NO: 19464 - protein, 303 aa, Mesorhizobium loti MAFF303099
MRVHVVGNVCVDTTFQLGRFPRPGETLNASSHVDGLGGKGANQAVAAARTGADVCFRAAIGDDTAGLWIRERLSRDLDASHLTVLALPSDRSTIIVDVRGENLIVTGASCAAAFDPLADGGFATSIEHGDIVVMQGNLLPDVTTSCLQAARSAGAMTILNPSPLAVGSTPCMDAVSLAVVNAGEAEQLTGTGDAASAARELIRQGTEGTIVTLGAAGCLVADREGRIDRFAAPKVDVVDTSGAGDVFCGCLAGFLAAGISLAAAARIAVRAAAISVGRPGTLGSCPDRQEMKILMETTEAETA

SEQ ID NO: 19465 - protein, 285 aa, Pisum sativum
MAKDVEVQEQGEYSAKDYQDPPPAPLIDLDELTKWSFYRALIAEFVATLLFLYVTILTIIGYSHQTDANAGGTDCDGVGILGIAWAFGGMIFILVYCTAGISGGHINPAVTFGLFVGRKVSLLRAVFYMAAQCAGAVCGTGLAKGFQKSFFDRYGGGANFIHDGYNKGTALGAEIIGTFVLVYTVFSATDPKRNARDSHVPVLAPLPIGFAVFMVHLATIPITGTGINPARSFGSAVILNQGKIWDDQWVFWVGPIIGATVAAIYHQYILRGSAIKALGSFRSNA

SEQ ID NO: 19466 - protein, 395 aa, Lactobacillus plantarum WCFS1
MVESKRNSAKLLWVIGTAWLFDALDVALLSFVMPVIKESWQLTAGQLGAVSAITTLGMMIGALVCGYLADKLGRKPVLIGTLLLFSLGNLLLTITPNVEWFLVVRLLTGIGLGGELPVAATMIADHYTGTQRSRMLVLVDSFWAFGWIAASLLAFLVMPHIGWRMTVLITALMGLYALLLRRRLPAEQEANRPQKVDFRQALRQVWSAKYRRATICLSILWFVIMFAYYGMFLWLPSVLVLRGFSLVHGFGYTMLMSLAQLPGYYLAAWLIGVVKRKAVLATYLIGTVVSAAAFGTANNPTMILISGAWLSFFTLGAWGIMIAFTPGQFAPAVRGIGMGVAQSIGRIGATIGPFLVGALMAIGFGIPAIFMVFVAVLLLGVGVLLFGLPNQETDD

SEQ ID NO: 19467 - protein, 128 aa, Physcomitrella patens subsp. patens
MGSEAVNPKAYPLADAQLTITITDIVQQAANYKQLKKGANEATKTLNRGIAEFVVMAADTEPLEILLHLPLLAEDKNVPYVFVPSKQALGRACGVSRPVIACSVTTNEGSQLKSQIQQLKDAIEKLLI

SEQ ID NO: 19468 - protein, 129 aa, Triticum turgidum subsp. dicoccoides
QGRNEFVIRLQPSEAMYMKLTVKKPGLEMATEQSELDLSYGMRYQDVKIPEAYERLILDTIRGDQQHFVRRDELKAAWQIFTPLLHDIDAGKLKAVSYKPGSRGPREADELSEKVGYMQTHGYIWIPPT

SEQ ID NO: 19469 - protein, 284 aa, Corynebacterium efficiens YS-314
MSPTPSPTLSLSDGSEIPQIGLGTWQMHGEEAYRTVREAIGMGYRHIDTAKLYDNEVEVGRAVTDAIRSGEVTRDELFITSKVWNDDQGREQAARAFQASLARLGLDYLDLYLVHWPCPRKGLYNETFEAVARIQGLGQVQSIGVANFYAGVLEDLVVTTGIVPAVNQVELHPGFSQAPLRALHDRLGVVTTAWAPLARGGVLSHPVIKGIAGRYGVPASAVVLRWLVQLGVVAIPKSSDPGRLRSNLDVHGFQLSVEEVERITALDEGPGMGRLFHDPEEFPA

SEQ ID NO: 19470 - protein, 517 aa, Lactobacillus plantarum WCFS1
MALLEVTDLSQSFADRKLYDDANFTLERADHMGIVGQNGAGKSTLIKILTGQILPLSGQIKWQRNVRTGYLDQYADIPAGMTLYAFLKTAFQRLYDLDAQMQQLYADYAEKMDDQLLERAGRIQETLEANNFYDVETEMERVITGLGLDEIGRDHVISEMSGGQRSKIILAKLLLENPDVIILDEPTNYLDTAHISWLEDYLNGFEGAVMVISHDYDFLQQVTNCICDVAFGKIIKYRGDFKAAMRQKEARKEAQLKAFEKQQVVIEKAEKFIRKNKAGSKSTMAKSREKMLSHLDRVDPPSENEHAKFAFPYLDTGSQNALSVTKLSVGYGKPLLEPVTFTMTNGEKLAFKGFNGVGKSTLIKSILGVIPALSGKSDFSPSAKINYFNQDLEWDNPQLTPLQTIQNEYPTMLPKTIRTKLAKCGINAANAMKPMHLLSGGEQTKVKLALLELVPSNFLIMDEPTNHLDDETKEGLKRALQAFQGNLILVSHESSFVNGWVDKELNVEKLSLKERQG

SEQ ID NO: 19471 - protein, 166 aa, Erythrobacter sp. SD-21
MPMTDTRPNRRSFLGLLGSGVAATTLAACGSREAQARDYPVSLSEAQWRKKLTKSEYYVLRDAGTERAYSSPLNDEKRAGTFICAGCGNALYSSKTKYDSGTGWPSFWKSLPGAVDTSTDYKIGYPRTEVHCADCGGHLGHIFNDGPKPTGKRHCINGVAMDFRTA

SEQ ID NO: 19472 - protein, 227 aa, Haemophilus influenzae R2866
MELVFIRHGFSEWNAKNLFTGWRDVNLTERGVEEAKAAGKKLLDKGYEFDIAFTSVLTRAIKTCNIVLEESHQLWIPQVKNWRLNERHYGALQGLDKKATAEQYGDEQVHIWRRSYDISPPDLDPQDPNSAHNDRRYANIPSDVVPNAENLKLTLERALPFWEDQIAPAMLSGKRVLVVAHGNSLRALAKHIIGISDSEIMDFEIPTGQPLVLKLDDKLNYVEHYYL

SEQ ID NO: 19473 - protein, 283 aa, Triticum aestivum
  misc_feature (126)..(126): Xaa can be any naturally occurring amino acid
DYLGDFPEQVCTKKQFPRPRCYTTGAGPEERRPTRPRRPPMEQPEAGDGAPQQRHKKSSAAKKAKKGGATGSGSGGAWPAVKPKKDLLVNRLKGTQLLTVPDFLTSAEAKAFVDVAESMGFTHQGXALGPLKGEAYRDNDRISVTDPLLAQTLWESGINRVFMDINISGKAATGLNPNIRLYRYVEGQRFGRHIDESVNLGDGSRTQYTLLVYLSGKGSAKDSQALVGGETVFYDHRGGIVAEVAPVQGMALLHLHGARCMLHEARVVKKNVKYVLRSDVVFA

SEQ ID NO: 19474 - protein, 470 aa, Streptococcus pneumoniae
DLAKRKLYPSLFRLYQSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVCASWKLIDRIEKLWAENGAPLHDYKAGSMGPQASFDLLEKFGAKWTWQP

SEQ ID NO: 19475 - protein, 127 aa, Zea mays
  misc_feature (33)..(33): Xaa can be any naturally occurring amino acid
  misc_feature (110)..(110): Xaa can be any naturally occurring amino acid
MDSVVNPKAYPLADAQLTMAILDIIRHDANYKXLGREPNESTKTLNKDISQIVLMPTDAETLEILVHLPLLADDENEPYVFVPSKQALARACVVTRPDIACSETSTEAQXLELQIRDLKDSIDKLLI

SEQ ID NO: 19476 - protein, 462 aa, Streptococcus pneumoniae
PSLFRLYQSGNLSKHFAVIGTARRPWSKEYFESVVVESILDLADSTEQAQEFASHFYYQSHDVNDSEHYIALSQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEKLWAENGAPLHDYKAGSMGPQASFDLLEKFGAKWTWQP

SEQ ID NO: 19477 - protein, 470 aa, Streptococcus pneumoniae
DLAKRKLYPSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRSVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWDENGAPLHDYKAGSMGPQASFDLLEKFGAKWTWQP

SEQ ID NO: 19478 - protein, 398 aa, Halobacterium sp. NRC-1
METTRAFEGLECVDCGESFAAAAATHRCPECGGILDPAYDLENLDVDAETFGARRFDSLWRYAELLPFTRGSAVSMDEGATALVPCPGLADELGVGELYIKDEGRNPTGTFRDRGQTVAMTAAAQHGASEVALASTGNAGQSAGAYAGRAGLDAHVFLPSRSGFTTKAMVNVHGGDMNVVQGRIGDANAAFEDAMDEHGEAWYSLQAFATPYRHEGKKTLLYETVEQLDWETPDHVVYPTGDGGGLVGMWKAATELRELGITADVPAMYAAQAEGCAPIVRAFQEGRDAHEPWDTPDTICGGIEIPDPAGSRLVLEALRESNGGAVAASDEEILEAGTAVASRAGPEMGATCAAAAAGAWELADRDAFGEDDTVVVVSTGTANKAADVLRSHLMSKGI

SEQ ID NO: 19479 - protein, 470 aa, Streptococcus pneumoniae
DLAKRKLYPSLFRLYQSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVNSDRFRSVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEKLWAENGAPLHDYKAGSMGPQASFDLLEKFGAKWTWQP

SEQ ID NO: 19480 - protein, 232 aa, Triticum aestivum
  misc_feature (45)..(45): Xaa can be any naturally occurring amino acid
MAESDTAAGMMAESDAADGKMANGEVSDDGRAVEVSGGGEDTLPXVLRGFVDGVWPPGDGGDPLLRRLRAATCEAAPRLRDASRNSARDLLAWTKQGSGLRAILVISVGTITMISLTGLLIFMSFLLVATANAIIVSVLMSLAAAGGFLALFFACLVAVYVGAVSIAIFVISATVISAIVGVLIATGWIGFFWMIWFAARKSLDLTKHSIGMTTSAMQSYSASRSVGPKPTD

SEQ ID NO: 19481 - protein, 560 aa, Mycobacterium tuberculosis CDC1551
MTPQKSDACSDPVYTVGDYLLDRLAELGVSEIFGVPGDYNLQFLDHIVAHPTIRWVGSANELNAGYAADGYGRLRGMSAVVTTFGVGELSVTNAIAGSYAEHVPVVHIVGGPTKDAQGTRRALHHSLGDGDFEHFLRISREITCAQANLMPATAGREIDRVLSEVREQKRPGYILLSSDVARFPTEPPAAPLPRYPGGTSPRALSLFTKAAIELIADHQLTVLADLLVHRLQAVKELEALLAADVVPHATLMWGKSLLDESSPNFLGIYAGAASAERVRAAIEGAPVLVTAGVVFTNMVSGFFSQRIDPARTIDIGQYQSSVADQVFAPLEMSAALQALATILTGRGISSPPVVPPPAEPPPAMPARDEPLTQQMVWDRVCSALTPGNVVLADQGTSFYGMADHRLPQGVTFIGQPLWGSIGYTLPAAVGAAVAHPDRRTVLLIGDGAAQLTVQELGTFSREGLSPVIVVVNNDGYTVERAIHGETAPYNDIVSWNWTELPSALGVTNHLAFRAQTYGQLDDALTVAAARRDRMVLVEVVLPRLEIPRLLGQLVGSMAPQ

SEQ ID NO: 19482 - protein, 250 aa, Pisum sativum
MPIRNIAIGTPQEATHPDTLKAGLAEFISTFIFVFAGSGSGIAYNKLTDNGAATPAGLISASIAHAFALFVAVSVGANISGGHVNPAVTFGAFVGGNITLLRGIVYIIAQLLGSIVASALLVFVTASSVPAFALSAGVGVGPALVLEIVMTFGLVYTVYATAVDPKKGNIGIIAPIAIGFIVGANILVGGAFTGASMNPAVSFGPAVVSWSWANHWIYWAGPLIGGGLAGLIYEVLFINSTHEQLPTTDY

SEQ ID NO: 19483 - protein, 332 aa, Pseudomonas syringae pv. phaseolicola 1448A
MIKNQLARFNRLDLISAPTALEKLERLSIWADRDIYIKRDDTTTLALGGNKVRKLEYLAADALAQGADTLITAGAIQSNHVRQTAALAARLGFGCVALLENPIGTEDPSYLKNGNRLLLELFDAKVELVENLDNADEQLHALAARLRSSGKKPYLVPIGGSSPVGALGYVRAGLELAEQIKQTGIDFAAVVLASGSAGTHSGLALALAHELPQLPVIGVTVSRSEEAQLPKVQGLAERTAELLDIALPEHFKVELWDEYFAPRYGEPNAGTLAAIKLVASHEGLLLDPVYTGKAMSGLLDGIGRQRFNDGPLIFLHTGGAPALFAYPDAFDQ

SEQ ID NO: 19484 - protein, 684 aa, Oryza sativa Japonica Group
MVIPGPFFRRSTALQVFSVLCVLRFVVPDPDIEWPLIHGIPACPPFTCGHLSKVASPFHRRGYECGVASYELTCTDDKATIQIDNGTYFVTGIDYSDSTFWVVDANISDSRNNCPLPRWKRIPYYYDDVSSDDEESSPYNIQVELDPASRWWSFFVNCSKEINNNVMYSPVACMGTSSSFVYVLTGRLSCYIENLEPSCGYLAMTPLDGMGRVAPAVDSLSYEDVVKFMRKGFRVQFPFRHHRNRSFKDCLMESIPKSTGIGKLSDWFSLSVTENFMDCATAKIPSPYNILLGIILYALMFWTMLAPPCRYLLAPLVVLIFLAQKYLKRMITIDAVEKFLRMQQMLGPTRYAYTDIIAITGHFREKLGQGGYGSVYKGVLLPGDLHVAIKILNGYSNCNGEEFISEVATIGRIHHVNVVRLVGFCSEEMRRALVYEYMPRGSLDKHIFSSERRFSWDKLNEIALGIARGINYLHQGCDMQILHFDIKPHNILLDDNFVPKVADFGLAKLYPRDKSFVSDRALRGTVGYMAPEMVSRSFGIISGKSDVYSFGMLLLEMVGGRRNADPNADSSASKAYYPSWVYDKLIADQQVDEISNFANMHELERKLCLVGLWCIQMKSHDRPTMSEAIEMLEGGVDALQVPLRPFFCDGDGMPPPQVMDSYFHSSDLSAISEEDDGIAELASS

SEQ ID NO: 19485 - protein, 316 aa, Streptomyces coelicolor A3(2)
MRYDSPLAAVGNTPLVRLPRLSPSDDVRIWAKLEDRNPTGSIKDRPALHMIEQAEKDGRLTQGCTILEPTSGNTGISLAMAARLKGYRIVCVMPENTSQERRDLLTMWGAEIISSPAAGGSNTAVRVAKELSAEHPDWVMLYQYGNPDNAGAHYAGTGPEILADLPSVTHFVAGLGTTGTLMGVGRYLREHKPDVKIVAAEPRYDDLVYGLRNLDEGFVPELYDASVLTTRFSVGSADAVTRTRELLQQEGIFAGVSTGAALHAAIGVGKKAVKAGESADIVFVVADGGWKYLSTGVYTAETTEAAIETLHGQLWA

SEQ ID NO: 19486 - protein, 295 aa, Oryza sativa Japonica Group
MSSPMHVRKAIHFVSMKAKLQSFGGLRLLLVGCLAALLLLFAVRTLSFTTSSATATAAREAAEAGCGKLPAAVAQAMVHYATANVTPQQTAAEIGVSLRVLQLRAPCNFLVFGLGLDSAMWAALNHGGRTVFLEEDASWIASVKAGHPGLESYHVAYDTRVTDADELIALRHEPACTSQPDLAAAAAASCRLALRGLPPVFHEVEWDLIMVDAPTGWTPESPGRMGAIYTAGMAARARTPGAGATEVFVHDVDRHVEDTFSKAFLCDGYLVEQVGRIRRFVIPSHRDKDGTPFCP

SEQ ID NO: 19487 - protein, 656 aa, Oryza sativa Japonica Group
MDFTNLLITVLLLLAPLKYKSDVATASDDEDFFKTCSSHRCSKHGPEIRYPFRLSTQPPSCGAPGMQLSCSGQDTILDHPVLGSCKVTMIYYRHVIMNAIPLVDSSPHCLLHKFISVNQSTAVYRPHTLKAASLVGCSRDSIDTNQYNSIVGPTSCLSLANNASQFWYLAYPYEYMSILPLGCTIVSKDIPMPYSYDKNGPNFDISIFTETAKRVISTGETVFTWYSSNVTSICQQCEHEGRRCGFSSQRDQAFCQHHTLTSSHSFNRVETRTYPSYTTLIRKLCTCIFPAMLCKIIELVTSSVGTFIVLSLIVATALYISLKSRYNEEIHLKVEMFLKTYGTSKPTRYTFSEVKKIARRFKDKLGHGAFGTVYKGELLNGVPVAVKMLENSVGEGQEFINEVATIGRIHHANIVRLLGFCSEGTRQALIYEFMPNESLEKYIFPHGSNISRELLVPDKMLDIALGIARGMEYLHQGCNQRILHFDIKPHNILLDYSFNPKISDFGLAKLCARDQSIVTLTAARGTMGYIAPELYSRNFGAISYKSDVYSFGMLVLEMVSGRRNTEPTVENQNEFYFPEWIYERVMNGQDLVLTMETTQGEKEMVRQLAIVALWCIQWNPKNRPSMTKVVNMLTGRLQNLQVPPKPFTSSQNQLVI

SEQ ID NO: 19488 - protein, 400 aa, Synechococcus sp. CC9311
MSSSPSPNDPLATVPSDRLWLRSELMGTQVITRDSGRRLGVVGEVVVDIDRREVVALGLRDNPLTRFLPGLPRWMPLDRIRQVGDVILVDSADSLSEAFSPDRYSRVINCQVITESGQTLGRVLGFSFDIETGELTTLVMGAVGVPLLGEGVLSTWEIPVDEIVSSGADRIIVYEGAEDKLKQLSSGVLEKLGVGGPSWEEQERERYRMNIVPVENQLSSGQAVEEAPRMLEASESQRFETERELEYVELEDRRSDSTRERRYLDEAPMQERESSYREPYREPERYNEPPSYREPEPFNGRRSFDERQPLDQPQRFNEQQLYNEPERFREPESFQDEDRYPTPQRTSPPPQELDAAPRFEQRPRPASRRPIERPGEPLDVEPIELHSHQDQESQPLDDPW

SEQ ID NO: 19489 - protein, 674 aa, Oryza sativa Japonica Group
  misc_feature (481)..(481): Xaa can be any naturally occurring amino acid
MAIHGVFHCSTTAILRVISVLCLLAVLVPDAGGRHHRHGCPPFTCGNLSSVSSPFRRRGDPSECGVLSYELNCADDKATIQIDNGTYYVTGINYTDSTFLIVDADISDSPSSCPLPRWNSLREPRFQVLWTRIASFVNCSQEIKNSSWIMYMPVACLSTSRSFVYVLTGQKSALIQSLEPSCGYLAMTPLGGRDSVAPVNESLSLSYADVVKSMRKGFRVQFPFRYRTGSFKQCPMDSIPTGKTNWFGTILSADTNFLLCIPVHQIPSRYRMPLGIMLYVIAYALQIWKMIAATCRFLLTPLAVLVFLAHKYWKTRVTIDAVEKFLRMQQMLGPTRYAYTDITAITGHFREKLGQGGYGSVYKGVLLPGDLHVAVKMLNGNSNCNGEEFISEVATIGMIHHVNVVRLVGFCSEEMRRALVYEHMPRGSLDKYIYLSERSFSWDKINEIALGIARGINYLHQGCDMWILHFDIKPHNILLDXNFVPKVADFGLAKLYPRDKSFVPDRALRGTVGYMAPEMVSRSFGVISSKSDVYSFGMLLLEMAGGRRNVDPNADSSKSKAYYPSWVYDQLIADQQFDEISNVANMHELERKLCLVGLWCIQMKSHDRPTMSEAIEMLEGGVDALQVPPRPFFCDGDGIGNGMPPPQVMDSYFHSSKLTAISEEGDGIAKLASS

SEQ ID NO: 19490 - protein, 389 aa, Pyrococcus furiosus DSM 3638
MALSDKLDLVNPSEIRKLFDLAAGMKDVISLGIGEPDFDTPAHIKEYAKEGLDKGLTHYGPNVGLPELREAIAEKLKKQNGIEADPNSEIMVLVGANQAFLMSLATFLKDGEEVLIPSPMFVSYAPAVILAGGKPVEVPTYEDNEFRINVDDLKKHVSEKTRALIINSPNNPTGAVLTKKDLEEIADFANEHDLMIISDEVYEHFIYDGAKHYSIAALDGMFGRTITVNGFSKTFAMTGWRLGFVVAPSWVIEKMVKFQMYNATCPVTFIQYAAAKALRDERSWKAVEEMRKEYERRRNLVWKRLNEMGLPTVEPKGAFYIFPRIKDTGLSSKEFSELMLMEAKVAVVPGSAFGRAGEGYIRISYATAYEKLEEAMNRMEKVLKEKKLI

SEQ ID NO: 19491 - protein, 669 aa, Oryza sativa Japonica Group
MAIPGSFCHPTALQVFVSVQFVFAVLVPHAAGRHHRHGCAPFSCGHLSDVSPPFRRRGDPPECGVASYELTCTDDKPATIQIDNGTYLVMDIKYKDSTFWVIDANISDSRNNCPLPRWNRDFGYYDQMLYERHGEDSRRRSIQAELMPPYQSTTATFVTCSQEILKSNGKYRPVACMSTNSSFVYVLTGMNSDSIGSLEPSCGYLAMTPLGAGDRPLVLENASYADVVKLMRGGFAIRFPYTSRFYVYSSKIKQCIAQSFQIFYTVIFDYHFWGCLLPHPVVQLIVGVIPLAMWTLKWIAVFCRFILVPLVILTFLARNYWKIRITTDAVEKFLRMQLMNGPTRYAYTDLIAITGHFREKLGQGGYGSVYKGVLLPGNAHVAVKVLGNSNCNGEEFISEVSTIGRIHHINVVHLVGFCSEEIRRALVYEYMPRGSLDKYIFSSERSFSWDKLNEIALGIARGINYLHQGCDMQILHFDIKPHNILLDVNFVPKVADFGLAKLCPRDQSFVPLSALRGTIGYIAPEMISRSFGIISSKSDVYSFGMLLLEMAGGRRNSDMYAENSNQTYFPSWVYDQLTEQQVGVGEIPAGTVANMHELERKLCIIGLHCIQMKSHDRPTMSEVIEMLEGGVVGLQMPPRPFFCDDEPVSLAVNSHQFSSELSEILEEDE

SEQ ID NO: 19492 - protein, 608 aa, Salinibacter ruber DSM 13855
MLGFPRPPPCAMSMRPTARILGCALLLVVGVFALPAWTSAPNASRPGSSSGTAGPAPVPEYAENGMVVSAKKRASQAGVSMLKKGGNAVDAAVATGFALAVVHPYAGNLGGGGFMVVRMPDGSVTTIDHREDAPSGATQDVYLDDDGNAVRQRSRRGYLASGVPGTVAGLLTALDEHGTLDRATVMAPAIRLAEEGFPLPHTMAEDLNDRYEAFAEFSATKKYFTKGRASAEYRAGERFVQSDLARTLKRIRDKGKAEFYEGRTASLIAEQFQANGGLIDAQDLAEYEAVERDPVTATYRGYEVHSMGPPSSGGVAIAQLLNAAEMRDIDQMGFNSSATAHYIGEAMRRVFADRAKWLGDPDHVEVPTEGLIQKDYMRERMASFDSSRITPTDSVRAGEPMLAGESMETSHYSVADSSGMAVSVTTTLNSGYGSKVMIDGAGFFMNNEMNDFVLKPGVPNQFGLSGTKRNLVAPDRRMVSSMSPTIVETPEGELSLVIGAPGGSTIITTTFQVIMNVIDHGMDIEQAVTAGRIHHQWKPRHLSHEEFALSRDAVRNLRARGWEVTEGVFGGIPRWGRAQGLRVTQSGDEGRVFYGGSDPRANGAAVGF

SEQ ID NO: 19493 - protein, 603 aa, Oryza sativa Indica Group
METHIGSVDGAAAAADNGAVGCPASAVGCPMTSARPGVSARRGVAGTAPGEAAGAGGRQRRVRVPGDFNLTLLDHLIAEPGLLVGCCNELNAGYAADGYARSRGVGACAVTFTVGGLSVLNAIAGAYSENLPVICIAGGPNSNDYGTNRILHHTIGLPDFSQELRCFQTVTCTQAVVTNLEDAHEQIDTAIATALRESKPVYLSISCNLPGLPHPTFSRDPVPFFLAPRLSNKMGLEAAVEATVEFLNKAVKPVLVGGPKLRVAKAGKAFVDLVDASGYPYAVMPSAKGLVPETHPHFIGTYWGAVSTAFCAEIVESADAYLFAGPIFNDYSSVGYSFLLKKDKAIIVQPERVIVGNGPAFGCVMMKEFLSELAKRVNKNTTAYENYKRIFVLRASAGEEPNEPLRVNVLFKHVQKMLNSDSAVIAETGDSWFNCQKLKLPEGCGYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWTSKVKCEEELTEAIGMALGEKKDCLCFIEVIAHKDDTSKELLEWGSRVSAANSRPPNPQ

SEQ ID NO: 19494 - protein, 618 aa, Zea mays
MAHGYTRQGDDSQSVPQDVISNEEQAGNVDITDPSMATCCDEYTRIACEIFADEVLIGNRSSTHLNKAGYQNVIQKFKERTGVVYTRKQFKNKWDRLKIDYGIWKQLTRQTGLGWDGSGKNIDMPEDWWKKMAKAIKESTRFKTRGLQNEDHLATMFEDLRNTGDDHWSASSGIPPTQQNVEQSPINIDVEFEPTNEDDSEPEEITPSSGKVKRPRIPANNKGKRARSGKGSWVSDGFDQILEMTKRTTETCESIARREDTYGCSIQQVMTLVKECGATVGTKEHFIASIVFTKRSEREMFMTLDTPEDSDDVDDGVDLNDFFLDTDDGQFTSSSDTTDSDSDDDNIIGQVIPLDYIRPIDPNFSTVHSRIAGDRKMMPHFKDCIGALDGTHINATPPVEDVIRYIGRTGKATQNVMAVVDFDMRFTYASIGQPGSMHDTNVLFHALRNDTENFPHPPAGKYYCVDAGYPNRPGYLAPYKGQRYHVPDWRRGPAPNGEQEHFNHLHSSIRNVVERAFGVWKMKWRVLLKMPSYKMEVQKMIVAATMCLHNYIRENHALDLDFVKCDRNPDYVPTIPDRYARFQPSQNASDTSTTQSNDRTMDRFRDDIARAVFLSRSA

SEQ ID NO: 19495 - protein, 215 aa, Haemophilus influenzae R2866
MNQSILSPFGNTAEERVLNAINAFKNGTGVLVLDDEDRENEGDLIFPAETITPEQMAKLIRYGSGIVCLCITDERCQQLNLPPMVEHNNSVNKTAFTVTIEAAKGVSTGVSAADRVTTIQTAIADNAVPTDLHRPGHVFPLRAANGGVLTRRGHTEASVDLARLAGFKEAGVICEITNDDGTMARTPEIVEFAKKFGYSVLTIEDLVEYRLAHNI

SEQ ID NO: 19496 - protein, 264 aa, Erythrobacter sp. SD-21
MWFFGLLLISYLAVALLLWNQQERLIYPAPQGIGPATGGFEEVTYRTSDGLDITAGYRPATPGFPTIAYFHGNGADWVSSVVATDRLVPAGYGVLAAEYRGYRGNPGHPSEEGLYADGRAALGFLAQQGVAANEMVLIGNSIGSGVATQLASEHAPRALILISPFASLRQLAAEKLRFLPTRLLLRSRYDNERKLAQVAAPVLILHGTADTLIPEAHAHQLASVRDDAELVIFPGKGHDLAWDDEAEEAVLTFLAKHPEESEAR

SEQ ID NO: 19497 - protein, 312 aa, Xanthomonas campestris pv. vesicatoria str. 85-10
MTDKIPLLIDTDPGVDDALALLMAFNDTRHEVVGLTIAAGNVGLEHTVRNALKVCEIAGRTDVPVYAGCPQPLLHPSVDAAHVHGLDGFGDVGLAPAKRTAEAEHAALAILRLSHEHAGKLLLVALGPLTNLALALTLDPTLPQRVARLVVMGGALTGHGNITAAAEFNIGFDPEAAHIVFGGFPQFDVADWEATIAHGLLHRDVEQWLAADSGRARFYEEISRKTRLWSEDSRGEYWYAADALAMAFALHPEGAQRLEQRPVHIELSGAHTRGMTLVDWNRQGGAPDNANLLLAYDIQQFYALVGAALAAN

SEQ ID NO: 19498 - protein, 640 aa, Erythrobacter sp. SD-21
MSERPHTPLLDTVDTPADLRKLKQDQLRQLSDELRTEMIDAVGTTGGHLGSGLGVVELTTAIHYVFDTPTDKLVWDVGHQCYPHKILTGRRDRIRTLRQGGGLSGFTKRSESEYDPFGAAHSSTSISAALGFAMANKMQGRPGRGIAVIGDGAMSAGMAYEAMNNAEQAGNRLVVILNDNDMSIAPPVGGLSAYLARTVSSSEYLGLRSLASRLSKKLSRRVHSSLEKAEEYARGMVTGGTLFEELGFYYVGPIDGHNLDHLIPVLENVRDSEQGPVLIHVVTQKGKGYAPAENSADKYHGVAKFDVVTGEQKKSSGGPPAYQNVFGETLAKLANDDPRICAITAAMPSGTGVDKFAQAHPDKAFDVGIAEQHGVTFAAGLAAEGMRPFAAIYSTFLQRAYDQVVHDVAIQNLPVRFAIDRAGLVGADGCTHAGSFDITYLATLPNFVVMAAADEAELAHMTYTAAEYDDGPIAFRYPRGAGTGVEIPEKLEKFEIGKGRIMREGSKVAILSLGARLEEAKKAADQLEAKGLSTTVADMRFAKPLDTALIEQIMRSHEVVVTIEEGAVGGLGAHVLTYASDEGLTDGGLKVRTMRLPDAFQDQDDPTKQYDEAGLNAPHIVDTVLSALRHNSAGVEEARA

SEQ ID NO: 19499 - protein, 205 aa, Zea mays
MGRAINKIVMAVELIKVLLMALVLTNITYHLILIVTVITVKRRIVDLHQNTTTGSTDITDMWEPLEEGLLPLETTRHVSMITITLSKKEMDTSSIGYQSPLPADEVKPLVKYDNDEDAHSPGGRGRGRGGRGRGRGRGRGGRGNGFNEYADAGWEDDHAPAYMGNGYARGRGRSFRGRGRRGGYNNQPEYQQDGGYYEEAPVHAP

SEQ ID NO: 19500 - protein, 355 aa, Streptomyces argillaceus
MKALVLSGGSGTRLRPITHTSPKQLVPVANKPVLFYALEDIAQAGITDVGIVVGETAREIEDAVGDGSKFGLQVTYLPQEKPLGLAHAVLIARDYLGDDDFVMYLGDNFVVGGIAGLVDEFRADRPDARILLTPVPDPTAFGIAELDGEGRVVRLEEKPTHPKSDMAVIGVYLFTPLVHEAVRAIEPSWRGELEITHAIQWLIDNRHDVRSTVIHGYWKDTGNVMDMLEVNRTVLEGVEPCTEGPVDAESEVIGRVRIEAGARVSNSRIVGPAVIGSGTVISGSYIGPYTSVSEGCRIEDSEIEFSIVLRDSRVRGVQRVRGSLIGRSVTVAPAPRKPAGTRLVLGDHSEGQISS

SEQ ID NO: 19501 - protein, 340 aa, Brassica napus
RPRVREMEDEDSSAPTFTITVDAKSGTSTGVSASDRAMTVLTLASLEAKPDDFRRPGHVFPLKYREGGVLRRAGHTEASVDLMILAGLRPVSVLSAILDQEDGSMASLPYMKKLATEHDIPIVSLTDLIRYRRKRDKLVERITVSRLPTKWGLFQAYCYRSKLDGAENIALVKGNIGNGQDILVRVHSECLTGDIFGSARCDCGNQLELAMQLIEKEGRGVVVYLRGHEGRGIGLGHKLRAYNLQDEGHDTVQANLELGLAIDAREYGIGAQMLRDIGVRTMRLMTNNPAKFTGLKGYGLAVVGRVPVVTPITNENRRYMETKRKKMGHIYISDIDQPLV

SEQ ID NO: 19502 - protein, 391 aa, Aspergillus oryzae
MAANFFSNKARAAAAAASSGSKQKPTDGKEEHAQQQPWVEKYRPKTLDDVAAQDHTTNVLQRTLQASNLPHMLFYGPPGTGKTSTILALAKSLFGPALYRSRILELNASDERGIAIVREKVKDFARVQLSHPTGVDKSYFEKYPCPPFKIIILDEADSMTQDAQSALRRTMETYSKITRFCLVCNYVTRIIEPLASRCSKFRFKPLDNSAAGDRLAQIAKLENLELEDGVVDKLIQCSDGDLRRAITYMQSGARLVGATGNSGRQDGGEDAEMTDASSQVITVRMVEEIAGVIPESVLDQLVQAMQPKKIGSSYEAVSKVTTDIVADGWSATQLLAQLYRRVVYNDAIPDIQKNKIVMVFSEMDKRLVDGADEHLSILDVALKISGILGGA

SEQ ID NO: 19503 - protein, 396 aa, Populus trichocarpa x Populus deltoides
MASASFLKSSPVLDKSEFVKGQTLRLPSASIIRCRSTAPSALTVRAGSYAEELVKTAKTIASPGRGILAMDESNATCGKRLASIGLENTEANRQAYRTLLVTVPGLGDYVSGAILFEETLYQSTTDGKKMVDVLVEQKIVPGIKVDKGLVPLAGSNDESWCQGLDGLASRTAAYYQQGARFAKWRTVVSIPNGPSALAVKEAAWGLARYAAISQDNGLVPIVEPEILLDGEHGIDRTFEVAQKVWAEVFFYMAENNVMFEGILLKPSMVTPGAECKDRATPEQVAEYTLKLLQRRIPPSVPGIMFLSGGQSEVEATLNLNAMNQSANPWHVSFSYARALQNTCLKTWGGRPENVNAAQEALLIRAKANSLAQLGKYTGEGESDEAKKGMFVKNYAY

SEQ ID NO: 19504 - protein, 207 aa, Zea mays
MAKPAAVGKPSAASTVALTLVLALASAVLLFLLLRFSPSSPSPNPHPHRRLRLRPRAHAHHHQIPFDPVVADIERRLEDREWERLAAAGLHAPGMEAAPVPEDLTDGEVDADEDYINDAARFNVTLRVEALFPRIDVDPADGAVTGAELAAWNLANARREVLHRTARELELHDRDHDGRVAYGEYERPSWAWRFDDNPDQCLCSGMA

SEQ ID NO: 19505 - protein, 180 aa, Triticum aestivum
  misc_feature (120)..(121): Xaa can be any naturally occurring amino acid
  misc_feature (140)..(140): Xaa can be any naturally occurring amino acid
  misc_feature (142)..(142): Xaa can be any naturally occurring amino acid
  misc_feature (152)..(152): Xaa can be any naturally occurring amino acid
  misc_feature (161)..(161): Xaa can be any naturally occurring amino acid
  misc_feature (166)..(166): Xaa can be any naturally occurring amino acid
TVANIFEGMFWFLLPASLIVINDIAAYLFGFFLGRTPLIKLSPKKTWEGFIGASVTTIISAFLLANVMGRFQWFTCPRKDLSTGWLQCDPGPMFKPEHYYLGDWVPHWFPWKDVFLMPVXXHALALGLFASIIAPFGVFXQXVPKRLFKIKXFGDNIPGMXGPTDXRTANGYLHHYTTVN

SEQ ID NO: 19506 - protein, 267 aa, Aspergillus oryzae
MNPSRSLQRLCRFFPRSSVLPVLSRSFTSSVPSLSKGSPPRGWTPTPFVTETVTSKGTNSRVTHTKPPPKRLQTDQSPQERIICLNGEVDETMSASIVAQLLFLEADNPQKPIHLYINSPGGSVTAGLAIYDTMTYIASPVSTICVGQAASMGSLLLCGGHPGKRYCLPHSSIMIHQPSGGYFGQATDIAIHAKEILRVREQLNKIYKRHLTGKKELSLDEIEKLMERDYFMGAQEALEMGIVDEILDRRVRSKEERGEGDEKPPAP

SEQ ID NO: 19507 - protein, 159 aa, Anabaena variabilis ATCC 29413
MALTTSLIPRYQSKIGWTLIYVFFYIMLMKRYWSRLLALVLVVAIGLVGCGSPDSLTGDYRQDTLAVVNTLRQALEITEDSPDKAALQAEARQKINDFSARYQRVNSVSGLNSFTTMRTALNSLAGHYSSYPNRPVPQKLKSRLEQEFKQVESALKRGA

SEQ ID NO: 19508 - protein, 462 aa, Streptococcus pneumoniae
PSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATANKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVCASWKLIDRIEKLWAENGAPLHDYKAGSMGPQASFDLLEKFGAKWTWQP

SEQ ID NO: 19509 - protein, 463 aa, Yersinia pseudotuberculosis IP 32953
MELPVKNKLKRGLTTRHIRFIALGSAIGTGLFYGSADAIRMAGPSVLLAYLIGGVVAFVIMRALGEMSVNNPQASSFSRYAQDYLGPMAGYITGWTYCFEILIVAIADVTAFGIYMGLWFPDVAHWVWVLSVVLIIGAVNMMSVKVFGELEFWFSFFKVATIIIMILAGIGIIVWGIGNGGQPTGIHNLWTNGGFFSNGFVGMILSLQLVMFAYGGIEIIGITAGEAEDPKKSIPKAINSVPWRILVFYVGTLFVIMSIYPWNQVGTNGSPFVLTFQHMGITIAAGILNFVVITASVSAINSDVFGVGRMLNGMAEQGHAPKAFTAISKRGVPWVTVLVMMCAMLIAVYLNYIMPENVFLVIASLATFATVWVWIMILFSQIAFRRSLSKDQVKALDFPLRGGTFTSVLAIIFLVFIIGLIGWFPTTRISLYVGLVWIVLLLVGYYFKVKYQKKQATLIKNAD

SEQ ID NO: 19510 - protein, 498 aa, Aspergillus oryzae
MTSKIAQNLKQPALDFLSFVNASPTPFHAVQSAKELLSKAGFQEIKEKDSWSSTCRPGGKYYLTRNSSTIVAFAIGKKWKPGNPISMIGAHTDSPVLRIKPVSNKRGEGFVQVGVETYGGGIWHTWFDRDLGVAGRAMVRTGDGSIVQKLVKIDRPILRIPTLAIHLDRQETFAFNKETQLFPIAGLVAAELNRTADSTATGEKTAANNETEKGDFAPLKSVTERHHPYLVELIAAEAGVKPDDILDFEMILFDTQKSCLGGLLEEFVFSPRLDNLNSSFCATVGLIDSVADASALDDEPSIRLIALFDHEEIGSRTAQGADSNVLPAIIRRLSVLPSSTSGNEDLATAFEETLSTSFLLSADMAHAVHPNYAAKYENDHRPEINKGPVIKINANARYATNSPGIVLLQEVARKAAEDGGEGVPLQLFVVRNDSSCGSTIGPMLSAALGARTLDLGNPQLSMHSIRETGGTYDVGHSIRLFTSFFKHYSNTSKTIFVD

SEQ ID NO: 19511 - protein, 527 aa, Saccharomyces cerevisiae
MPMDFQPTSSHSNWVVQKFGGTSVGKFPVQIVDDIVKHYSKPDGPNNNVAVVCSARSSYTKAEGTTSRLLKCCDLASQESEFQDIIEVIRQDHIDNADRFILNPALQAKLVDDTNKELELVKKYLNASKVLGEVSSRTVDLVMSCGEKLSCLFMTALCNDRGCKAKYVDLSHIVPSDFSASALDNSFYTFLVQALKEKLAPFVSAKERIVPVFTGFFGLVPTGLLNGVGRGYTDLCAALIAVAVNADELQVWKEVDGIFTADPRKVPEARLLDSVTPEEASELTYYGSEVIHPFTMEQVIRAKIPIRIKNVQNPLGNGTIIYPDNVAKKGESTPPHPPENLSSSFYEKRKRGATAITTKNDIFVINIHSNKKTLSHGFLAQIFTILDKYKLVVDLISTSEVHVSMALPIPDADSLKSLRQAEEKLRILGSVDITKKLSIVSLVGKHMKQYIGIAGTMFTTLAEEGINIEMISQGANEINISCVINESDSIKALQCIHAKLLSERTNTSNQFEHAIDERLEQLKRLGI

SEQ ID NO: 19512 - protein, 470 aa, Streptococcus pneumoniae
DLAKRKLYPSLFRLYKSGNLSKHFAVIGTARRPWSKEYFESVVVESILDLADSTEQAQEFASHFYYQSHDVNDLEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWAENGAPPHDYKAGSMGPQASFDLLEKFDAKWTWQP

SEQ ID NO: 19513 - protein, 99 aa, Zea mays
PTPACRSPRAPPEDPIANPSTGSQKKLAIDDDQNPRGFHARRISHEVRGDALGEEFKGYAFKIMGGCDPQGYPLKQGVLSSGRVRLLLHRGTPCFRRNG

SEQ ID NO: 19514 - protein, 720 aa, Mycobacterium tuberculosis CDC1551
MPDNTIQWDKDADGIVTLTMDDPSGSTNVMNEAYIESMGKAVDRLVAEKDSITGVVVASAKKTFFAGGDVKTMIQARPEDAGDVFNTVETIKRQLRTLETLGKPVVAAINGAALGGGLEIALACHHRIAADVKGSQLGLPEVTLGLLPGGGGVTRTVRMFGIQNAFVSVLAQGTRFKPAKAKEIGLVDELVATVEELVPAAKAWIKEELKANPDGAGVQPWDKKGYKMPGGTPSSPGLAAILPSFPSNLRKQLKGAPMPAPRAILAAAVEGAQVDFDTASRIESRYFASLVTGQVAKNMMQAFFFDLQAINAGGSRPEGIGKTPIKRIGVLGAGMMGAGIAYVSAKAGYEVVLKDVSLEAAAKGKGYSEKLEAKALERGRTTQERSDALLARITPTADAADFKGVDFVIEAVFANQELKHKVFGEIEDIVEPNAILGSNTSTLPITGLATGVKRQEDFIGIHFFSPVDKMPLVEIIKGEKTSDEALARVFDYTLAIGKTPIVVNDSRGFFTSRVIGTFVNEALAMLGEGVEPASIEQAGSQAGYPAPPLQLSDELNLELMHKIAVATRKGVEDAGGTYQPHPAEAVVEKMIELGRSGRLKGAGFYEYADGKRSGLWPGLRETFKSGSSQPPLQDMIDRMLFAEALETQKCLDEGVLTSTADANIGSIMGIGFPPWTGGSAQFIVGYSGPAGTGKAAFVARARELAAAYGDRFLPPESLLS

SEQ ID NO: 19515 - protein, 587 aa, Yersinia pseudotuberculosis IP 32953
MFLTKWNKPLAVLALLVSGTLHAASTPAVEAKNGMVVTSQYLASQVGADILKMGGNAVDAAVAVGYAQAVVNPCCGNIGGGGFMTIHLADGTDTFINFRETAPSTANADMYLDKDGNVTKDASLYGYLAVGVPGTVLGMDSAQKKYGKLTRQQVMAPAIRLARDGFILTRADTDILDTTVKRFRQDPESARIFLRKDGEALQPGDRLVQADLADTLSAISEKGPDAFYQGKIPQAVEAAAKKGGGILTAADFADYKITETAPITCSYRGYKFVSAPPPSSGGVTLCETLNVLEGYNLKSMGFNSADYIHTLTEAMRHAYMDRNTFLGDPEFVKNPLDRLLSKSYAADIRKQIVANKATPSVEVQPGMQPHEKPETTHYSIVDHEGNAVSTTYTVNGRFGAVVIAPGTGFFLNNEMDDFTVKVGEQNLYGLVQGATNAIAPGKRPLSSMSPTLVTKDGKTFMVLGSPGGSRIISITLQTALNVIDHGMAPQEAVDAPRIHHQWLPDEVYYEQRGVSADSLNILKSMGYKMVEQSPWGAAELILVGLAGVEGVSPANSGNDSAVSGKVREGYLYGANDVRRPAGAAIGY

SEQ ID NO: 19516 - protein, 475 aa, Streptomyces coelicolor A3(2)
MTSAQVDTDKAPEEGYERGLNSRQVQMIAIGGAIGVGLFLGAGANIAKAGPSIILMYALAGVIIFFIMRALGELLLYRPVSGSFAEYSREFLGPFFGYFTGWTYWLMWVVTGMAELTAAAIYIHYWFPDIPQWVSALVFLVLLFVANLISVKLFGEIEFWFSMVKVTAIIGMIVIGVGVLTLGFSQAGDTAAVSNLWEFDGFFPKGIGSSLMTLQGVMFAYLAVELVGVTAGESENPEKTLPKAINTLPWRIALFYVGALTVILAVVKWTEFAEGVSPFVEAFAVIGIPAGAGIVNFVVLTAALSSCNSGMYSTGRMLRTLADNGEAPRIFNKLSSTKTPAIGIAVSVVFMAIGVVLNYLVPEKAFGYVTSVATAAGIWTWLMILISHVRYRRKVVAGRLPASSFPAPGGSVCSYIAIAFLLFVTCLIAYDADARVCLYVMAGWAAALGIGWAVLKSRNPQITERPGEPEFEKIG

SEQ ID NO: 19517 - protein, 591 aa, Prosthecochloris aestuarii DSM 271
MEPILPQSDTGTKKNKAVFHGIGASKGIAIAPAFLFIKNIIEHSSAPLSAEKAEIEVDKFLAALQRSEKELRKIEKVTTKKLGKVYSDLFQAQIMLLNDSVLIECVTKRIRQELKSAPLVIEEEFEKYLEHFNNSTEQMFQERAQDLIDIKNRIIRNLHNQKLQSKIPEGMIVVSTCLSPADIILFTRANVKAFITETGGITSHISLICRSLNIPIIVGLSNFTQKVKTNDLLIVDGSSGEALINPDSETIRQYQNRSEEKSRLEAQTCRLADAPAQTKCGQPLHFCSNIDFKEEIPSIRSVGARGVGLFRSENLFIDNTKPPQEEDQTAYYKEMAEELFPDPLVIRLFDIGGDKLIYSTIREPNPNLGWRGIRILIDVPEILDSQLLAILKANDKGNIQILLPMISSIEEIMQIQSSLKRHVDNLNTIGLSCCEPDIGAMIEIPAAVLIIDEITRMVDFISIGTNDLTQYTLAVDRNNEIVQDLFDKFHPAIIRQLHTIITTANKNGCRVSLCGDMGSDPLALPFLVGCGLRVFSVVSADIPLLKTLGRHLDVKESEALARECLSFDSSEKIKAHLKEFQMRHVPQNVLM

SEQ ID NO: 19518 - protein, 188 aa, Halobacterium sp. NRC-1
MDRLKQSLLDAPIIEKDGYHYFVHPISDGVPMLEPELLREIVIRIIRKAELDEVDKIVTPAAMGIHISTAVSLMTDIPIVVIRKREYGLPGEVALSQETGYSENEMYINDVHEGDRVLVLDDVLSTGGTLRAITDALEQTGADVADVLAVIKKAGPNELDDTDMDVRTLINVDVADGEVVVVDDQGDH

SEQ ID NO: 19519 - protein, 386 aa, Triticum aestivum
  misc_feature (201)..(201): Xaa can be any naturally occurring amino acid
  misc_feature (214)..(214): Xaa can be any naturally occurring amino acid
MAAAASSPSPPAVITCRAAVAWGPGQALVMEDVEVAPPGPLEIRVKVVSTSICRSDVTQWQSTAQPDLFPRIFGHEASGVVESVGEGVTEFQVGDHALTVFIGECMSCKHCVSGKSNMCQTLGLERKGVMHSDQTTRFSIGGKPVYHYCAVSSFSEYAVVHSGCAVKVSPTMPMDRICLLSCGASAGLGAAWNVADVSKGXSSVVIFGLGTVGXLSVAQGAKLRGASKIIGVDTNPAKQEKGKAFGVTDFINPAELNEPVQQVVKRLTDGGADYSFECVGDTGVVSTALQSCSDGWGLTVTLGVPKAKPEVSAHYGLLLSGRTLKGSLFGGWRPKSDIPLLVEKYANKEIQVDGLVTHDMPFSDINKALELMLQNRCLRCVIHMPK

SEQ ID NO: 19520 - protein, 209 aa, Triticum aestivum
AYLGDIPEQVCTKKQVATGPEFPGYRRPTRPGAATSPPASSPPGKQFAEVVVVRHGETSWNATRTIQGQMDPELNETGRRQALVVARRLSREAKPPAVYSSDLKRAAETAQTIATACGVSSLVLDPALRERHMGDLHGLVFDDAVRRNPEIFSSYSRTQEIPVNSMLPSEFTRLFCSVLPLLAWKISWHRVEISGHRILHFLRGVGRTS

SEQ ID NO: 19521 - protein, 159 aa, Triticum aestivum
  misc_feature (39)..(39): Xaa can be any naturally occurring amino acid
  misc_feature (67)..(67): Xaa can be any naturally occurring amino acid
  misc_feature (86)..(86): Xaa can be any naturally occurring amino acid
YGTGLPHGVLQLHSRGIFVQNLQSCNFLLDDNDHAVLGXFGIPSLLFGLPLPNPDLIQRLGTPNYMXPEHWRPNIRGPISYETDSXWGFAWSILEMFSGVQTWCAKSPDEIYQSVVLKKEKPMFLYNLPTEVANVLSGCYEYEFRDHSLMLDILQSFEM

SEQ ID NO: 19522 - protein, 90 aa, Zea mays
VAPVSTKGAGVSMLAAAGTVSESAGPALALVYERMSTEGTGLSLGLSNNLLGWILLGVFGLIWSLYTIYTCDLDEDEESGGLWIRSTLSC

SEQ ID NO: 19523 - protein, 229 aa, Pyrococcus furiosus DSM 3638
MNVEEMKKAVARAALEFIEDDMVVGLGTGSTTAYFIRYLGEMIEKGKVEDIYGVPPPIKQKFLRMESGVPVLSLDQVDAIDIAVDGADEVDPNLNLIKGRGAALTMEKIIEYRAGTFIVLVDESKLVDYLCQKMPVPIEVIPAAWKAILEELSIFNAKAELRMGVKKDGPVVTENGNFIIDAKFPRIDDPLDMEIELNTIPGVVENGIFADIADIVLVGTKEGVKRLER

SEQ ID NO: 19524 - protein, 577 aa, Lithospermum erythrorhizon
MESSNLKDVTGGVEDAYGEHRAIEEQLVTPWTVSVASGYSLLRDPHHNKGLAFTERERDSHYLRGLLPPAVVTQELQEKKLMENIREYQLPIHKYMAMMGLEERNERLFYKLLIDNVEELLPVVYTPTVGEACQKYGSIFRRPQGLYISLKEKGKILEVLKNWPERAIQVIVVTDGERILGLGDLGCQGMGIPVGKLALYTALGGVRPSACLPITIDVGTNNQQLLDDEFYIGLKQRRATGEEYYELLEEFMSAVKHCYGEKVLVQFEDFANHNAFELLSKYRNTHLVFNDDIQGTASVVLSGLIASLKPLGGTLGDHTFLFLGAGEAGTGIAELIALEISKQTKAPVEETRKKIWLVDSKGLVVSSRKEKLQHFKQPWAHEKEPIGNLLDAVKDIKPTVLIGTSGVGRQFTKEVVEAMASFNEKPLIMALSNPTSQAECTAEEAYTWSEGRAIFSSGSPFDPVEYNGKVFVPGQANNCYIFPGLGFGLLISGAIRVHDDMLLAASEALANQVTDEHYAKGLIYPPFSDIRKISANIAAKVAAKAYELGVATRLPRPENLVEYAERCMYSPIYRTYR

SEQ ID NO: 19525 - protein, 341 aa, Wolbachia endosymbiont of Drosophila ananassae
MFIGNQSSNKVERAISEIRRGRPIVIYDESNYLLFAAAEALERDLFNQYKLISSNVYVTLTSSKVKYISQNKEHNSKRLLVNNFDELLHLINCSKEDCIKELQCSKTIDECAIALLKFSELLPYALVADMTFENKYEMRNWCEENDIIALDTLLVNDFQQNQSVYEVCKTSLFLKQTQEVDIISYRTESGGREHHAIIIGNPDKDDEPLVRIHSSCYTGDLLDSLSCDCRSQLHQAIQMIADFGSGIILYLMQDGRGIGLTNKLRAYSVQREHNLDTVDANRILGFEDDERSFVVAAKMLKKLNINKIQLLTNNDRKLSELESSGKRNTKCLPLIVERNKI

SEQ ID NO: 19526 - protein, 319 aa, Thermus thermophilus HB8
MRAIRVHEVGGPEVLRLEELPVPEPGPGEVLVRLLAIGVNFIDTYKRKGLYPVPAPFTLGEEGAGVVEKVGEGVVGVRPGDRVAFANVQGAYAEYLVVPAERLVPVPEGLDPKLAAAALLQGMTVHYLLKSTYPVAPGDQVLVHAGAGGVGQLLIQWAKRLGATVYATASTEEKRGLCLQAGADYALPYEGFAEAVKALSGGGVDVVYDGVGKDTFLGSLAALRPRGMLVLFGQSSGPVPPQDPQILNRMGSLFLTRPTLHHYTASRKELLFRAGEVFRGVLEGWLKVRIGAEFPLENAREAHEALEGRRTTGKVLLLP

SEQ ID NO: 19527 - protein, 367 aa, Arabidopsis thaliana
SESDSEMVPFPQLPMPIENNYRACTIPYRFPSDDPKKATPNEISWINVFANSIPSFKKRAESDITVPDAPARAEKFAERYAGILEDLKKDPESHGGPPDGILLCRLREQVLRELGFRDIFKKVKDEENAKAISLFPQVVSLSDAIEDDGKRLENLVRGIFAGNIFDLGSAQLAEVFSRDGMSFLASCQNLVPRPWVIDDLENFQAKWINKSWKKAVIFVDNSGADIILGILPFARELLRRGAQVVLAANELPSINDITCTELTEILSQLKDENGQLLGVDTSKLLIANSGNDLPVIDLSRVSQELAYLSSDADLVIVEGMGRGIETNLYAQFKCDSLKIGMVKHLEVAEFLGGRLYDCVFKFNEVQS

SEQ ID NO: 19528 - protein, 220 aa, Erythrobacter sp. SD-21
MTVPLISPSILSADFARLGEEVRAVDEAGADWIHIDVMDGHYVPNITIGPAVVKALRPHTKKPFDVHLMIEPVDPYLEAFAEAGADIITVHPEAGPHIHRTLQAIKNLGKQAGVVLNPGTPAKMLDYLIEEVDLVLVMSVNPGFGGQSFIHSQLRKIEAIRKMIDQCGKDIRLEVDGGVDPTTAPLCVEAGADVLVAGSATFRGGPEKYASNIAALKGRG

SEQ ID NO: 19529 - protein, 345 aa, Tuber borchii
MSLPATMKALRYDKPESYAVVEVPLPTLRDNDVLIKVKACGVCGTDLHIHEGEFIAKFPLIPGHETVGVVAAIGKDVKGFTVGERVCADNSELCNECFYCRRGQLLLCEKFEAHGVTMDGGFAEYCAYPAGKVFKIHNLSDVDATLLEPASCAAHGLEKIAPKIGSSVLMFGAGPTGLCLAQLPHNGASHVVIAAPEGLKMDLAKKLDCADIYVPLSRSNPQAQFDQIKSDNPYGFDIVVEATGSPKILEDAINYVRRGGKLVVYGVYSDAARVSWPPSKIFGDEITIIGSFSETYMFPATIGYLDTGKVKVEGIVNKTYKLEQWGECLEAMRNKSAIKAAIVFE

SEQ ID NO: 19530 - protein, 230 aa, Glycine max
MASFVSTHCILPSGVGFVHDQDRSCGRTNTLHLQNAPKSPSSLSFLLSVRASESRSDAVVVQSKGRSSFSQTAAVRHLTGSVTRAHGLRFAVVVARFNEIVTKPLLEGALGTFNNYSVQDEDIDVVWVPGSFEIGVVAERLGKSGKYDAIVCIGAVVRGDTTHYDAVANSAASGVLSASLNSGVPCIFGVLTCDDMDQALNRAGGKSGNKGAEAALTAIEMASLFEHHLK

SEQ ID NO: 19531 - protein, 542 aa, Corynebacterium efficiens YS-314
MANDITTTAAWQSLTERYEAFQGTTLRELFQDGGRAEKLSFDAAGLRVDLSKNLLDDAILTDLVALAEQAGLTDRIEAMFRGEHINNTEDRAVLHTALRLPVEESLEVDGQDVAADVHEVLGRMRDFATALRSGAWLGYTGRTIKKVVNIGIGGSDLGPAMATKALRAYATAGITAEFVSNVDPADMVSVLEDLDAESTLFVIASKTFTTQETLANANAAKNWLIEQLGSEEAVSKHFVAVSTNAEKVTAFGINPENMFGFWDWVGGRYSVDSAVGLSLMAVIGPRDFMRFLGGFRAMDEHFRYTDFGQNVPVLMALLSVWYTDFFGAETHAVLPYSEDLSRFAAYLQQLTMESNGKSVRRDGSPVTTGTGEIYWGEPGTNGQHAFFQLIHQGTRLIPADFIGFARPKQDLPAGEKSMHDLLMSNFFAQTKVLAFGKTAEEIAAEGVDDNLINHKVMPGNRPTTTILAEELTPAVLGALIALYEHIVFVQGVIWDINSFDQWGVELGKQQASDLAPAVSGEVEVDSGDSSTDALIRWYRTNR

SEQ ID NO: 19532 - protein, 485 aa, Triticum aestivum
  misc_feature (62)..(62): Xaa can be any naturally occurring amino acid
LSLSSPILLDLSARREGGAGRPGNPRPRRARRAGMAASEGAMRMGKYEMGRTLGEGHFGKVXLARHADTGRAFAIKILDRQRILAMKIDEQIKTEIATLKLLKHPNVVRLYEVAASKTKIYMVLEYVNGGELFEKIALKGKLPEKEGRKLFQQLMDAVSYCHERGVYHRDLKPENVLVDAKGNIKVSDFGLSALPQHQRGRVGLHTTCGSPNYIAPEVLLNKGYDGSMSDVWSCGVILYVMLTGNLPFDDENMVVLYQKILKGDYRIPKWLSPGAQDILRKLLDPNPITRLGMDGLREHDWFNQSYTPAVPFDDDDDNYVGDDNSHMTKNNGIPDNPAINQMNAFQLIGMSSCLDLSGFFEKEDVSERKTRFASNYPPTYLFEKIESNVINMGFQVQKNNGKLKVIQERKGPTNPRGHGSLLISAEVFEINESLYVVELKRSCGDCSLYRQLCATLSDDLGICKSQQLLKNDSIRQELYRFNSSF

SEQ ID NO: 19533 - protein, 164 aa, Triticum aestivum
VTRLNKFVQKSRLVPVRNSRDIVDPRVRLAQGLKVIACVGETLEQREAGSTMAVVAEQTKAIAGKIKDWTNVVVAYEPVWAIGTGKVATPAQAQEVHANLRDWLKTNVSPEVAESTRIIYGGSVTGASCKELAGQPDVDGFLVGGASLKPEFIDIINAATVKSA

SEQ ID NO: 19534 - protein, 470 aa, Streptococcus pneumoniae
DLAKRKLYPSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEKLWAENGAPLHDYKAGSMGPQASFDLLEKFGAKWTWQP

SEQ ID NO: 19535 - protein, 376 aa, Ocimum basilicum
MANNTNAGVITCKAAAAWKPSEPLVVEEICVEPPKSTEVRIKMLAASMCHTDILLWKGFFPLYPRIPGHEGAGVIESVGEKVANLKVGDTVMPLSIGQCGECSNCATGKTNICFKYPFGISGLMPDGTSRMSAKGQKLYHMFTCSTWSEYTVVDSNFVVKVDPRIPLPHASLLTCGFLTGYGAPWRESRVEKGSTVAVIGLGAVGLGAVSASRILGASKIIGIDVNELKREKATVFGVTEFINPKHSDKTVSQLIQEATGGLGVDCCIECTGVSSLLNEAIASTKVGIGEVVLIGAGEKEKVEISYIPLMLGRSVKGTTLGGVRIHSDLPKIVEKCINKEIDLDELITHEVSLVDVNKGFMEYMNQPDCVKVSVKF

SEQ ID NO: 19536 - protein, 470 aa, Streptococcus pneumoniae
DLAKRKLYPSLFRLYQSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWAENGAPLHDYKAGSMGPQASFDLLEKFDAKWTWQP

SEQ ID NO: 19537 - protein, 237 aa, Saccharomyces cerevisiae
  misc_feature (235)..(236): Xaa can be any naturally occurring amino acid
PKLVLVRHGQSEWNEKNLFTGWVDVKLSAKGQQEAARAGELLKEKKVYPDVLYTSKLSRAIQTANIALEKADRLWIPVNRSWRLNERHYGDLQGKDKAETLKKFGEEKFNTYRRSFDVPPPPIDASSPFSQKGDERYKYVDPNVLPETESLALVIDRLLPYWQDVIAKDLLSGKTVMIAAHGNSLRGLVKHLEGISDADIAKLNIPTGIPLVFELDENLKPSKPSYYLDPEAAAXXA

SEQ ID NO: 19538 - protein, 320 aa, Coprinopsis cinerea okayama7#130
MLTGSGIKIFAAHGLRPLPRLLHDGTSTSLLLRQSQKSLTFVFSIGLPLGKAEVTRSPIGETTVKIHESVREDDVYIINTGCGAVNTSLMELCIMIHACKIASAKRITAVIPLFPYARQDKKDKSRAPITAKLVANMIQKSGCDHVILYAEPSIILYIRTHFDIKDVVIVSPDAGGAKRATSIADRLGVDFALFHKERKKANEVSRMVLVGHVTGKIAILVDDMADTCGTLCLAASHLSEAGATKVFAFVTHGILSGKALKTVEESTLEKLIVTNTLPQQHNQALCKKIEVIDVGKVLGEVIRRSHYGESVSKLFNEVPY

SEQ ID NO: 19539 - protein, 358 aa, Populus trichocarpa x Populus deltoides
MSCFKSKYADELIKNAAYIGTPGKGILAADESTGTIGKRLSSINVENVEENRRALRELLFCAPGALQYLSGVILFEETLYQKTASGKPFVDVLKEGGVLPGIKVDKGTVELAGTNGETTTQGLDGLGQRCAKYYEAGARFAKWRAVLKIGANEPSELAIHENAYGLARYAVICQENGLVPIVEPEILVDGSHDIEKCAAVTERVLAACYKALNDHHAILEGTLLKPNMVTPGSDAPKVAHEVIAEYTVRALQRTVPPAVPAIVFLSGGQSEEEATLNLNAMNKLNTKKPWSLSFSFGRALQQSTLKAWAGKPENVGKARAALLARCKANSEATLGTYKGDATLGEGASESLHVKDYKY

SEQ ID NO: 19540 - protein, 983 aa, Coprinopsis cinerea okayama7#130
MYNNTNANPTRNRQPPLRETITVVGIPSVSIDNDRLVVGSSQTSSTRSYTPIKVLGDGSFGTVWLCDWHTTLPPNTPLSPMQCGQGARPEWAGKRLVAVKRMKKRWEGGWDECQKLKELESLRAIPFHPNIIPLYDFFLLPTSKELYFVFESMEGNLYHLIKARKGRPLAGGLVSSIFQQITLGLDHIHTHGYFHRDMKPENVLVTTVGLFDYTPVSPIAPPNAPKERDVVTIIKLADFGLARETRSRPPYTEYVSTRWYRAPEVLLLSREYSNPVDLWALGTIMAELVNLRPLFPGSDQVDQVARVCEVLGDPAEDYRDNGGNVVGGGQWPHGVSLARDVGFQFPRIEPKDIFSLFDASVPRSLIQCIRDLLRWDPAKRLTSKQCLDHLYLRETIHRNNIPMPSGLRAASVSQTSIPMMSSHLNGSSSHPSLSSHTPRNVPPSHSNSAHHVRPPPVPSHFPEVPPPQNSQPTPLPSVPHQPIPLHAQNGRRPHPIVGWTGPSPQPASDYPMDTSPSEPYANGHANNGHSEHHPPAGHSMPPPKSLKLGPFGKKSSRWALGIFGSEKSHQLPPVDEVTTTALGTRKRSQSSSTDGKSVRDLSPERPQDLREVQKQQKKEAERINREAEKERRKLAEKMAREQARAVMSKRNRMLREAVGEDIDWSGGNQERVVDKGTKQASSGPIRQKSMGNLGNSTLHAASGKYSEPPAPPVSFDRYRDWRGTGERVAKARRREYDDDHSMSSSDVHSLSRVSSISFATVDSDPGPSRLRHHSSFHHAASSRTSRSSLRTSFDDFSPSARSSNSFSLEGSSSLAHEFGAHLNVNPHISGSVSPPPLHMLSLSPTLSPPLSPNPPWIQVQDIKENGLGGQSPPYITLQNRQFSPSPHSPLDIHNYLQQPPSPFNNPSAPAQPPTTGQTPRSANSAINPIFKVPLPPPPLPSLPLPAGQPLSSTSLTNKLPPFSQLEAVAGGEISPTSPMFADP

SEQ ID NO: 19541 - protein, 285 aa, Coccidioides immitis RS
MAGEEIPRRPSRSLVGKVAVVTGAGCLGDGIGNGRATAVLLAEDGAAVICVDTNLEWAERTVEMITKDSKGTGLAFKADVSQAEDCLRVVDLAVSEFGRVDVLVNNVGIGGPRGTAVDVDMEEWARGLEVNVSSMVLMAKYVIPIMKKNEGPVRGSIVNVGSVAGLRGGTPHLLYPTSKGAVVNMTRAMAAHHAPDGIRVNCVCPGMLYTPMMYGPGMSEEAREARKGRSLLKTEGNGWDCGSAVRFLAGGEARWITGTILTVDAGATAAVGSELPKTASINAPA

SEQ ID NO: 19542 - protein, 539 aa, Ralstonia metallidurans CH34
MHDKILILDFGSQVTQLIARRVREAHVYCEIHPNDVTDEFVREFAPKGVILSGSHASTYEDHQLRAPQAVWDLGVPVLGICYGMQTMAVQLGGKVEWSDSREFGYAEVRAHGHTNLLKGIEDFATDEGHGMLKVWMSHGDKVTALPAGFKLMASTPSCPIAGMADEARGYYGVQFHPEVTHTSKGREMIERFVLEICATKADWVMRDHIAEAVEKIREQVGDEEVILGLSGGVDSSVAAALIHRAIGDQLTCVFVDHGLLRLDEGKMVMDMFAGRLHAKVVHIDASEQFLGHLTGVTDPEQKRKIIGREFVEVFQAEAKKLSNAKWLAQGTIYPDVVESGGTKTKKATTIKSHHNVGGLPETLGLKLLEPLRDLFKDEVRELGVALGLPPEMVYRHPFPGPGLGVRILGEVKRDYADLLRRADAIFIEELRKTIATEQDAAAGLCEANQVGKSWYDLTSQAFAVFLPVKSVGVMGDGRTYDYVVALRAVQTTDFMTAHWAHLPYSLLGRCSNRIINEVRGLNRVVYDVSGKPPATIEWE

SEQ ID NO: 19543 - protein, 619 aa, Yersinia pseudotuberculosis IP 32953
MSLDIAKYPTLALAENPEELRMLPKESLPKLCDELRQYLLTCVSRSSGHFASGLGVVELTVALHYVYNTPFDHLIWDVGHQAYPHKILTGRRDRISTIRQKDGLHPFPWRGESEYDVLSVGHSSTSISAGLGMAVAAEREGKGRRTVCVIGDGAITAGMAFEAMSHAGDIHSDMLVILNDNEMSISENVGGLNNHLAQLLSGKLYASLREGGKKAFSALPPIKDLLKRTEEHLKGMVVPSTLFEELGFNYIGPVDGHDVHTLTQTLKNMRDLKGPQLLHIMTKKGKGYAPAEKDPIGWHAVPKFDPASGTLPKSQSSLPTYSKIFGEWLCETAAKDSKLMAVTPAMREGSGMVRFSREYPQQYFDVAIAEQHAVTFAAGLAIGGYKPVVAIYSTFLQRAYDQLIHDVAIQNLPVLFAIDRGGLVGADGQTHQGAFDLSFMRCIPNMVIMAPSDENECRQMLYTGYHHNGPAAVRYPRGNGTGAVLEPLEMLPIGKGVLRREGEKIAILCFGTLLAQAQLAAENLNATLVDMRFVKPLDEELVLEMAAKHQVLVTVEENAIMGGAGSGVNELLMAKRRWVPVLNIGLPDLFVPQGEQDEMRSELGLDAAGIQRQIEAWLA

SEQ ID NO: 19544 - protein, 110 aa, Triticum aestivum
  misc_feature (107)..(107): Xaa can be any naturally occurring amino acid
SCTSTVTVAAAASGYDDDDEDEDEEAEVMLGFLEKPKHPGLLLRHLFPSKAGGIPAWLDPVNLPTGNSSCCGFCGEPLHFVLQIYAPIESNTAAFHRTLFMFMCPSXACL

SEQ ID NO: 19545 - protein, 423 aa, Idiomarina baltica OS145
MTFSELGLCPEILNALTRQGYTEPTPIQAQAIPAVMAGNDVMAAAQTGTGKTAGFTLPILEMLKGNERAKANTARVLILTPTRELAAQVGESVANYGKDLPLSYAVVFGGVKINPQMMKLRKGVDILVATPGRLLDLYQQNAIRFPQLETLVLDEADRMLDMGFIHDIKKIIKLLPAKRQNLMFSATFSDEIRKLAKSLVNNPVEISVAAPNATAERIEQTLYAAEKTHKPRMLMQILRNLNLPQVIVFSRTKHGANRLVKQLDKDGFLAAAIHGNKSQGARTKALSDFKSGAVQVLVATDIAARGLDIEKLPYVINYDLPQVAEDYVHRIGRTGRAGQVGHAISLVMDEEFRTLKAIEKLIGQPIERRTLDGFDEVELTGKTPPPKREQRPPRKSRGAPSDKQKSPGRAKHRRQGSNKSSQR

SEQ ID NO: 19546 - protein, 238 aa, Synechococcus sp. CC9311
MSDLQTQMKQAVAEAAVAQIRDGMVVGLGSGSTAALMIEGLGARLAAGQLRDIVGVTTSFQGEVLAAELGIPLRALNATDRIDLAIDGADEVDPSFQLIKGGGACHVQEKLVADRAERFIVVVDSTKLVRCLNLDFLLPVEVLPGAWVQVQSRLKSMGGVAELRMATRKAGPVVTDQGNLVLDVRFENGISDPIALERDINNLPGVLENGLFVNLADEVLVGEIKDGVAGVRSLDRVG

SEQ ID NO: 19547 - protein, 295 aa, Haemophilus influenzae R2866
MKAIIPVAGLGTRMLPATKAIPKEMLTLVDKPLIQYVVNECVAAGIKEIVLVTHSSKNAIENHFDTSFELETMLEKRVKRQLLEEVRSICPKNVTIMHVRQGNAKGLGHAVLCGRPLVGNESFAVMLPDVLLAEFSADQKKENLAAMIQRFNETGASQIMVTPVPQENVSSYGVADCGGIELNGGESAKINSIVEKPSIEDAPSNLAVVGRYVFSAAIWDLLEKTPIGVGDEIQLTDAIDMLIEKETVEAFHMTGETFDCGDKIGYMEAFVEYGIRHEKLGKEFKSFIKNLAKTL

SEQ ID NO: 19548 - protein, 355 aa, Oryza sativa Japonica Group
MALMLAAFLCEAVSVRFVSTVLGLHWHRSTAPLPDTGQWLLLALNEKLPQIVVDLLRAPIISLHHYLMLFIMLGFSALFDCIKGPGLGIAARYMFTMAVGRSLRTVTFLATILPSARPWCAEARYQIPDHPHPWAQKYYAPYASDPDAIRRVIQEDMPYAFVKEYPREYRPKWGHMSFLVDILRPTVEEGSSWYHFLKKASGGCSDLMYSGHMLVAVLTAMAWTEAYGGWISVVIWFLVLHSAQREIRERHHYSVDCIVAIYVGILLWRMTGFIWSAIDNSHARRLAKLDKVQNRLFQAAKDSDMDEIRGLLNEVELAGQERKGFSQRVILSFSSAMIVFTLSCVLLAFTLTSDG

SEQ ID NO: 19549 - protein, 147 aa, Hanusia phi
MATKRIQKEHKDLLRDPPSNCSAGPSDENLFRWTASIIGPSDSPYTGGVFFLSILFPPDYPFKPPKVQFTTKIYHPNINSNGSICLDILRDQWSPALTVSKVLLSISSLLTDPNPDDPLVPEIARVFKENRSRYEATAREWTQRYAT

SEQ ID NO: 19550 - protein, 334 aa, Spiroplasma citri
MAVNLKGRSFLTLLDFTQREIYYLLDLARQLKEAKYAGTEQKPLAGKSVALLFAKDSTRTRCAFEVGTFDLGMHPVYLGPSGSQMGKKESIEDTAKVLGRMFDGIQFRGFKQTDVEALAKYSGVPVWNGLTDEFHPTQMLADILTLQEEKGQRNMKGLKFVYFGDSRFNMANSYMVISAKLGMHFVACAPKDLWPNAELLKKVQAIAKEHGGSITLTEDHKTAAKDADAIATDVWVSMGEDPAVWGKRIKYLTPYQVTMEKMKQAKEDAIFLHCLPSFHDGNTDTAQQVIKQFGGTGELEVTDEVFQSKYSRVFEEAENRLHTIKAVMLATIRG

SEQ ID NO: 19551 - protein, 215 aa, Xanthomonas campestris pv. vesicatoria str. 85-10
MSEAKRLAAEKAIDYVEDGMIVGVGTGSTVAYFIDALGRIGHRIKGAVSSSEQSTARLRQHGVEVLDLNHTGNLSLYVDGADECDPNRCLIKGGGAALTREKIIAEASERFICIVDPSKQVPVLGKFPLPVEVIPMARSLVARQILALTGGQPVWRDGVVTDNGNVVLDVHHLQITDPVGLERSLNQIPGVVCVGLFARRPADVVIVGGEPPQVI

SEQ ID NO: 19552 - protein, 506 aa, Legionella pneumophila subsp. pneumophila str. Philadelphia 1
MDLLQRLNIKSVNPGAFSGHGWHSVNHAHTLESFNPSTGNKIAEIATCTMDDYEQVMQRAEQAAQAWRKVPAPKRGEIIRQIGQVLRENKDSLGSLVSLEMGKSKQEGDGEVQEMIDIADFAVGQSRMLYGNSMHSERPNHRMYEQWHPYGIVGVISAFNFPVAVWSWNAFLSAICGNVTIWKPSAKTPLCAVAVQHICNQVLKENNCPEIFGLIIPNSHDVVEAMVDDKRIQLISFTGSTAVGKQVAAKVAARLGKSILELGGNNGIILDESADLNLAIPAIVFGAVGTAGQRCTTTRRLFVHESKYQDVIKRLRHAYEQITIGDPLDTRNLMGPLIDLQAVEQFKKAINRIKAAGGQIVYGGEILKQAGSFVQPTLVCDVKNDWDIVQEETFAPILYVMSYRTLDEAIALHNGVPQGLSSALFTQNLKNAERFLSACGSDCGIANINIGTSGAEIGGAFGGEKETGGGRESGSDSWKAYMRRQTNTINWGDELPLAQGIRFNLS

SEQ ID NO: 19553 - protein, 163 aa, Acetabularia acetabulum
WFQGTADAVRQQIRYVEEDKGDEVLILSGDQLYRMDYVPMIQMHRETGADATIAVIPIPTEETYGLGLAVSMTMAGSKGLSKTQDRGRACPGEDVGRLAEKRGVKDTNRQFLGNMGIYLFKKDSLLELLNAPPKATDFGKEIFPRCVDTHKVMTYVFEDYWED

SEQ ID NO: 19554 - protein, 470 aa, Streptococcus pneumoniae
DLAKRKLYPSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPAIFTKDEIRAEKIKVFKNLYHPTDEELKEHFIRGQYRSGKIDGMKYISYRSEPNVNPESTTETFTSGAFFVDSDRFRSVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWAENGAPLHDYKAGSMGPQASFDLLEKFGAKWTWQP

SEQ ID NO: 19555 - protein, 215 aa, Acetabularia acetabulum
TGGAGFIGSIVVEQLVKQGEQVVVFDNLSLGHRESFIRDAAFVHADLNDRAAIDQALETHQPEAVMHFAAYSLVGESMKFPFQYIGENVTNFLNLLQSMIAHDVKKIILSSTANLFDDPERMPIVESERIVPGSPYGESKFICERMLYWLDQIHDLNYAALRYFNAAGASKERGEDHTPSLHLIPIVLQVALGQRERVSMFGGDYDTADGTCVRD

SEQ ID NO: 19556 - protein, 213 aa, Staphylococcus epidermidis ATCC 12228
MLKRMRDDIKMVFEQDPAARSTLEVITTYAGLHAVWSHLIAHKLYKNRRYVAARMISQLSRFFTGIEIHPGAKIGKRLFIDHGMGVVIGETCTIGDNVTIYQGVTLGGTGKEKGKRHPDIGDNVLIAAGSKILGNIKIESNVNIGANSVVLQSVPSYTTVVGIPGHIVKQEGRRIGKTFDHRNLPDPLYEQIKHLERQLEKAKNGEIQDDYII

SEQ ID NO: 19557 - protein, 99 aa, Glycine max
LLSALDTTQTIIWNGPMGVFEFDKFAVGTEAIAKKLADLSGKGVTTIIGGGDSVAAVEKVGVASVMSHISTGGGASLELLEGKELPGVLALDEAVPVAV

SEQ ID NO: 19558 - protein, 361 aa, Bacteroides fragilis YCH46
MKKKFTIFVMLLAGIIYTGHAQDVQWIYQQKQEKKNMKNLSEIYFAGGCFWGTDHFLKQIRGVKSTQVGYANGNIANPTYQQVCTGKTNFAETVKVEYNPQEVPLKLLIDLFFKTIDPTSLNRQGNDKGSQYRTGIYYTDEADLPTIRTAIDELAKEYSKPIVIEVKPLSNFYKAEEYHQDYLDKNPGGYCHINPALFELAKKANAQAEQSQTNYKKTDDATLRSKLTPEQYAVTQKNATEPAFHNEYWDEKRDGIYVDITTGEPLFISTDKFDSGCGWPSFTKPIEKEVIKEKMDTSHGMIRTEVRSKTGDAHLGHVFTDGPKEKGGLRYCINSASLRFIPKEKMKEEGYGEYLKLLPQK

SEQ ID NO: 19559 - protein, 306 aa, Yersinia pseudotuberculosis IP 32953
MSDTHAPVDFKQQLAAHQQRVNQALLDFIAPLPFGNSNLIEAMRYGAVIGGKRLRPYLVYATGQMFGLSLANLDAPAAAIECIHAYSLIHDDLPAMDDDDLRRGQPTCHVKFGEAHAILAGDALQTLAFSILAEAPMPDVADKDRLSMIIELAQASGAAGMCAGQALDLEAETRPVLLGDLEQIHRHKTGALIRAAVRLGALAAGEAGRKTLLSLDRYAEAIGLAFQVQDDILDVIGDTATIGKRQGSDQQLGKSTYPALLGLDCAQTKAMDLYQEALEALDELAKQSYNTDSLQALARFIIERNN

SEQ ID NO: 19560 - protein, 153 aa, Burkholderia xenovorans LB400
MRVSDILKVKGNTLFTVTPDTTLHDAVNTMAEHDIGSLVVMEYGDLVGMLTFREIILTLSKNGGSVGTSTIRKVMDDHPLTCTPETDVNEVRRMMLEHHVRYLPVLESRTLMGVISFYDVAKAVVEEQGFENRMLKAYIRDWPEEQQEQQPAR

SEQ ID NO: 19561 - protein, 479 aa, Bacillus cereus ATCC 14579
MTTSNTYKFYLNGEWRESSSGETIEIPSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGINMVSFTGGTNTGKHLAKKASMIPLVLELGGKDPGIVREDADLQDAANHIVSGAFSYSGQRCTAIKRVLVHENVADELVSLLKAQVAELSVGSPEQDSTIVPLIDDKSADFVQGLVDDAVEKGATIVIGNKRERNLIYPTLIDHVTEEMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNLV

SEQ ID NO: 19562 - protein, 309 aa, Brassica napus
MADLFPPLVTAQIDDKPKVDEKVDYSNLPCPVPYDELHREAYMSLKTDNFEGFRFDFTKGLNQKFALCHSVMMGPTEVPSQSPDTTIKIPTAHYEFGANYADPKLMLVGRVMTDGRTSARVRADLTDKLMMKANAQITNEPHMSSAMFHFDYMGSDYRAQLQFGNSALIGANYIQSVTPRLSLGGEVFWAGGPRKSGIGYAARYETDKMVASGQVASTGLLLMNYVQKVSDKVSLATDFMYNVFSREAVASVGYDYMLRQARVRGKIDSNGVASALLEERLSMGLNFLISAELDHKKKDYKFGFGLTVG

SEQ ID NO: 19563 - protein, 194 aa, Coccidioides immitis RS
MGVQRKTRKFGQVKRAISLRDSRLKQNQAKEEAKTKKPSQDEVIREIPQVSSALFFQYNTALAPPYSVLVDTNFLSHTVQHKLELIPTMMDCLYAKCIPVITDCVLAELEKLGQKYRLALRIAKDPRFERVKCDHKGTYADDCIVDRVIKHRIYIVATNDRDLKRRIRKIPGVPIMSVARAKYVIERLPDAPEK

SEQ ID NO: 19564 - protein, 384 aa, Pisum sativum
MGLLCSKSNRYNDAKAEENAQTAEIERRIELETKAEKHIQKLLLLGAGESGKSTIFKQIKLLFQTGFDEAELKSYLPVVHANVYQTIKLLHDGSKEFAQNDVDFSKYVISTENKDIGEKLSEIGGRMDYPRLTKELAQEIESMWKDAAIQETYARGNELQAPDCTHYFMENLQRLSDANYVPTKEDVLLARVRTTGVVEIQFSPVGENKKSGEVYRLFDVGGQRNERRKWIHLFEGVSAVIFCVAISEYDQTLFEDENKNGMMETKELFEWVLKQQCFEKTSFMLFLNKFDIFEKKILDVPLNVCEWFKDYQPVSTGKQEIEHAYEFVKKKFEESYFQSTAPDSVNRVFKIYRTTALVKKVVKKTFKLVDETLRRRNLFEAGLL

SEQ ID NO: 19565 - protein, 353 aa, Thermus thermophilus HB8
MLLLTPGPTPIPERVQKALLRPMRGHLDPEVLRVNRAIQERLAALFDPGEGALVAALAGSGSLGMEAGLANLDRGPVLVLVNGAFSQRVAEMAALHGLDPEVLDFPPGEPVDPEAVARALKRRRYRMVALVHGETSTGVLNPAEAIGALAKEAGALFFLDAVTTLGMLPFSMRAMGVDYAFTGSQKCLSAPPGLAPIAASLEARKAFTGKRGWYLDLARVAEHWERGGYHHTTPVLLHYALLEALDLVLEEGVAARERRAREVYAWVLEELKARGFRPYPKASPLPTVLVVRPPEGVDADRLVRALYAEGVAVAGGIGPTRGQVLRLGLMGEGARREAYQAFLKALDRALALA

SEQ ID NO: 19566 - protein, 350 aa, Thermus thermophilus HB8
MKDYYAILGVSREASQEEIKKAYRRLALKYHPDRNPGDKEAEERFKEINEAYAVLSDPKKRAAYDRGHLEAPEYRPEDLFDLFFQEVFGVRGHRRPPRGEDLEAEVEVELQDLLHGAEKEVRYTRLVPCEACGGEGGRRTPCPTCRGQGVVESYRQSFFGTVVTRTACPHCKGRGYLLAETCPACRGRGRVPREERVRVQVPPGMDEGHLLRVPGYGNLGPGGPGDLYLRIRVRPHPHLERQGPDLVYRLRLGLAQAALGARVEVPGLEGPIPLDIPPGTGHGEVFALEGGGLPLPGGRGRGTLRVVVELAVPKKLSPKAQKLLRAYAEEVGEEVAPEGFWERLKGFFRK

SEQ ID NO: 19567 - protein, 251 aa, Arabidopsis thaliana
MATAVGGGSDVEVGFAKLQGEDFEYYMQSYSIILGRNSKKATVDVDLSSLGGGMNISRNHARIFYDFTRRRFSLEVLGKNGCLVEGVLHLPGNPNVKLDSQDLLQIGDKEFYFLLPVRSILGGPLGPRHHVLGKASVVPYHNYHSGPGSGSGKNGVRSRELYEYDDEDDDEEEDIRGSGKKTWRDGHEGVYASGEKKREGRSKADREADDQQFLQLMHGSGWSVTDIKGVWKRMASQSSKKIPITRRLGYP

SEQ ID NO: 19568 - protein, 430 aa, Streptomyces avermitilis MA-4680
MGLVVQKYGGSSVADAEGIKRVAKRIVEAKKNGHQVVVVVSAMGDTTDELIDLAEQVSPMPSGREFDMLLTAGERISMALLAMAIKNLGHSAQSFTGSQAGVITDSVHNKARIIDVTPGRIRTALDEGNIAIVAGFQGVSQDKKDITTLGRGGSDTTAVALAAALDAEVCEIYTDVDGVFTADPRVVKKAKKIDWIAFEDMLELAASGSKVLLHRCVEYARRYNIPIHVRSSFSGLQGTWVSNTPLVQKAQQQGEQKVEQAIISGVAHDTSEAKVTVVGVPDKPGEAASIFRAIADAEVNIDMVVQNVSAASTGLTDISFTLPKTEGRKAIDALEKAKSVIGFDSLRYDDQIGKISLVGAGMKTNPGVTAGFFEALSDAGVNIELISTSEIRISVVTRADDVPEAVRAVHTAFGLDSDSDEAVVYGGTGR

SEQ ID NO: 19569 - protein, 147 aa, Proteomonas sulcata
MATKRIQKELRDLTRDPPSNCSAGPNDENLFKWTASIIGPGGSPYAGGVFFLSITFPTDYPFKPPKVHFITRIYHPNINSNGNICLDILRDQWSPALTVSKVLLSISSLLTDPNPDDPLVPEIARVFKENRSRYEATAREWAQRYAT

SEQ ID NO: 19570 - protein, 569 aa, Glycine max
MFSSSSSSSMLPRYCVVPDSHFVPKKFQSFQFLKNTHFNFIPYSSSKINLIPYSSTSTTFHSNNDVDDAVSLFNRLLRRNTTPPAFEFNKILGSLVKSKHYHTVLYLSQKMEFRGIKPNLVNCNILINCFCQLGLIPFAFSVFAKILKMGYVPDTITFTTLSKGLCLKGQIQQAFLFHDKVVALGFHFDQISYGTLIHGLCKVGETRAALDLLQRVDGNLVQPNVVMYNTIIDSMCKVKLVNEAFDLFSEMVSKGISPDVVTYSALISGFCILGKLKDAIDLFNKMILENIKPDVYTFNILVNAFCKDGKMKEGKTVFDMMMKQGIKPNFVTYNSLMDGYCLVKEVNKAKSIFNTMAQGGVNPDIQSYSIMINGFCKIKKFDEAMNLFKEMHRKNIIPDVVTYSSLIDGLSKSGRISYALQLVDQMHDRGVPPTIRTYNSILDALCKIHQVDKAIALLTKLKDKGIQPNMYTYSILIKGLCQSGKLEDARKVFEGLLVKGHNLNVDTYTIMIQGFCVEGLFNEALALLSKMEDNGCIPDAKTYEIIILSLFKKDENDMAEKLLREMIAR

SEQ ID NO: 19571 - protein, 165 aa, Yersinia pestis KIM
MHIMRIGHGFDVHKFGENGSGPLIIGGVRIPYEKGLLAHSDGDVALHAATDALLGAAALGDIGKLFPDTDPAFKGADSRGLLREAYRRILAKGYKLGNLDITIIAQAPKMAPHIPQMRVNLAEDLQCHMDDINVKATTTEQLGFTGRGEGIACEAVVLLVNVEQG

SEQ ID NO: 19572 - protein, 325 aa, Salinibacter ruber DSM 13855
MPDDLRLFALSESRGFGEAIASALDTELDAHHERTFTDGEHEVRPEVNVRGRDVFVVQSLYADDTWSVNDKLCRLLFMLGALRDASAERVTAVIPYLCYQRKDRKTRPRGPVTTRYVAGLFEAVGVDRVLTMDVHNLAVLQNAFQARTEHLLGHPLFVHRLTDVVGAEEVAVVSPDEGGVKRAGKFAEGLGAVLNCEVPTAFVEKMRKDDGVTGGALVGSVEDRTAIVVDDMVSTAGTMTQAIRSCAEEGAESVYAVATHGLFVGEADERLETAPLDALFVTNTVAPRLTGAAAERLQICNAAPRFAAAIQAVHTETSVSALNEV

SEQ ID NO: 19573 - protein, 382 aa, Yersinia pestis KIM
MCDKKPLKESSMSHENLKGAQMAEGIPETMRAVVAYGPRDYRFERVPVPTIDAKEILVKVEGCGICAGDTKAFEGAPSFWGDDKQPAYIKAPMIPGHEFIGHVVGLGADVEGFELGDRVTSEQIVPCWGCRFCNHGQYWMCEKHDLYGFQSNVNGAMAEYLKFTKEAINYHVPDHLPLEKAILIEPYACAFHAVQRAKIKLGDVVVLAGSGTLGLGMIGAIKKSGAAKLIVLDLSDDRLALAKKFGADLVLNPSRDDVNTLIKEMTGGYGCDIYIDATGAQKAVEQGLTLLRKLGTFVEFSVFKDPVTVDWSIISDRKELDVLGSHLGPYCFPLVIEGISNGDLPTEGVVTHILPLEKYAEGIELVKRGVDSLKVVLNPNLT

SEQ ID NO: 19574 - protein, 447 aa, Triticum aestivum
  misc_feature (166)..(166): Xaa can be any naturally occurring amino acid
MAATIQSVKARQIFDSRGNPTVEVDVCCSDGTFARAAVPSGASTGVYEALELRDGGSDYLGKGVSKAVNNVNSVIAPALVGKDPTAQTELDNFMVQQLDGTKNEWGWCKQKLGANAILAVSLAVCKAGASVKKIPLYQHIANLAGNKQLVLPVPAFNVINGGSHAXGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 19575 - protein, 300 aa, Legionella pneumophila subsp. pneumophila str. Philadelphia 1
MMWNLSSRVHALNHFPKQGIECYVKRDDELGCGISGTKIRKYSSLIPFLKIKGIRHLIIIAGAQSNNLLAALQVARECQLKVTAFLVKPKHLKIQGNFKLSLLFLHENEIIWINREEWYRVNEFAEQYLEGLRETAYILSEGASVKESMKGAMSLASDIKENEKILGFAFDHIFVDAGTGFSAIALIKGFYELQHKGFIHVLLLADSEEVFKKKLMHWAGVNPDNYACFYPTTAKSFGSVNQTIKQEIKRLAYEEGILADPIYSAKLFYEARRYIEKYELKGKVLIVHSGGILTMPGFAF

SEQ ID NO: 19576 - protein, 325 aa, Sinorhizobium meliloti 1021
MAQAIVVRELGGPEVLKMEGVTLAAPGPGEVQIRQVAIGLNFIDVYFRTGLYKSATGLPFIPGKEGAGVVTAVGDGVSMFSVGDRVAYASADGAYASERNVDASQLLKVPEGISLETAAAMMLKGMTAQYLLNQTFKVGPETTLLFHAAAGGVGFIAGQWAKALGATVIGTAGSQEKIDLALAHGYDHVINYRTDNFVERVKDLTGGRGVDVVYDSVGRDTYPASLDCLKPRGLWASFGNSSGPVDAFNIGILAQKGALYATRPTLFTYVATRPALEACANSLFDVVQSNKVRININQTYPLAEAGRAHTDLETRKTSGTTLLIP

SEQ ID NO: 19577 - protein, 359 aa, Candidatus Kuenenia stuttgartiensis
MSIDDLRNEIDIIDEKIVDLLNERAKFVLKIGEIKQQNRSQVYVPNREQEVYLRITSKNKGPLSNECLKAIYRELMAGSLVLEKAIRVSYLGPEGTFSYFAAKQKFGSSVEYIPARGIECVFSDVAGNRCDYGIVPVENTIEGGIRETLNMFVKHDVKVCSEIILPIHHYLMANCKKEEIRKVFSKPQILTQCKNWLAVNIPCIELIEVSSSAEAARIVAGAQKSEEGRCFAVIGNSEISHKYGLKILFENIEDDPSNTTRFFVLGKEYSGPSGKDKTAIMCYVKNRSGALVEILGPFKSYSINLTNIESLPTRKKAWEYCFYLDFDGHVSDQNVQKALEEISKKCFDVKILGSFPKGD

SEQ ID NO: 19578 - protein, 483 aa, Anabaena variabilis ATCC 29413
MQKLNGLLTNDIIEESAWEALEKSILYYKGRPVGTVAAFDASVEALNYDQCFVRDFVSSALIFLIKGKTDIVRNFLEETLKLQPKDRQLDAYKPGRGLIPASFKVVSDNGEEYLEADFGEHAIARVTPVDSCLWWILLLRAYVVATKDFSLAYQPEFQTGIRLIMEICLANRFDMYPTLLVPDGACMIDRRLGIYGHPLELQVLFYAALRAAREMLICQGNQDVVEAIDNRLPLLCAHIRQHYWIDINRLNAIYRFKSEEYGKAAVNLFNIYVDSIPYYELDKWLPKKGGYLAGNVGPSQLDTRFFALGNLMAIISDLATEEQSQAIMTLIEDRWEDLVGDMPMKICYPALEDEEYRIVTGCDPKNIPWSYHNAGSWPVLMWMLAAASVKAGKPYIAGKAIEIAQARLLEDEWPEYYDGKKGRLIGKQARKYQTWTIAGFLLAAELMENPSHLSLISFDKLPSELVSRACEFEIGSVDTSISL

SEQ ID NO: 19579 - protein, 261 aa, Candidatus Kuenenia stuttgartiensis
MNSDNQKKRPIILGNWKMNKSLKEGVQYARSLKAAIAGKTWIMCGICPPYVFLKDICAILEGSTICVSAQNMHSEASGAFTGEIAAPMLKEVGCSHVLVGHSERRHIFGEDDFFINDKIKKAISFELVPILCIGETLEEREAGNTKDIVLRQLKNGLRGVGIELIKCIIIAYEPVWAIGTGRTASPEQANEVHSFIRTILSEDYGKDIAKKLSIIYGGSVKADNTEALIHQPEIDGLLVGGASLELESFLTIIEVVQGVDF

SEQ ID NO: 19580 - protein, 590 aa, Mycobacterium avium subsp. paratuberculosis K-10
MAFSVQMPALGESVTEGTVTRWLKQEGDTVELDEPLVEVSTDKVDTEIPSPAAGVLTKIIAQEDDTVEVGGELAVIGDAADGAAGGGAQAPSQPSQPQAPAQPEPQAQEPAQAQPEAPAQPQAPAQPAPQESGGGAATPVLMPELGESVTEGTVTRWLKKVGDSVQVDDALVEVSTDKVDTEIPSPVAGVLISITAEEDSTVPVGGELARIGTGAQAPAPAAPQPPPAPKPEPKPEPAPQPQAQPAPQPQAQPAPEPKAQPAQAQPAAGGEGTPYVTPLVRRLAAENDIDLSSITGTGVGGRIRKQDVLAAAEQKQRQQQAAAQPSAAPAPAAAEARKPAAPTPAPALAHLRGTTQKASRIRQITAAKTRESLLATAQLTQTHEVDMTRLVGLRARAKAAFAEREGVNLTFLPFIARAVIDALKIHPNINASYNEETKEITYYDAEHLGFAVDTEQGLLSPVVHNAGDLSLAGLARAIADIAARARSGNLKPDELSGGTFTITNIGSQGALFDTPILVPPQAAMLGTGAIVKRPRVIVDEFGNESIGVRSICYLPLTYDHRLIDGADAGRFLTTIKHRLEEGAFEADLGL

SEQ ID NO: 19581 - protein, 301 aa, Zea mays
MPRTTVVESPGCPPLRALTTDILGLVKVVEAHARPAGAAKVVETWGAPDASCAIVAASLADRATDPVLAVARKNGVVELLNPLNGDTLAAVKAVGPAPNDGGAEGDPLTALHLFTRQASDSILGTFLACTEQGKASIRSITKENAASGSHIEPSATWDVCGGANVQFCSVDHGENYVMFGGKGIEVSLWDITSCSKTWSAKSPRTNSLGIFTRPWFTAGTFLCKDDHRKIVACTNSHQVRLYDTALQRRPAISVEFKESPIKAVAADPNGHDVYIGTGTGDLASFDMRIGNMLASCYMFSS

SEQ ID NO: 19582 - protein, 725 aa, Nicotiana plumbaginifolia
MRPPSRLHSLFISFLVISLLSFQIYGQEGDNDLDDIKGDADKLSFENPKLRVAYIALQTWKAAMFSDPFNFTANWTGPNVCSYGGVFCAQSLTNDSIRVVAGIDLNHADIAGYLVPELGLLTDLVLFHLNSNRFCGIVPKTFSHLKLLRELDLSNNRFVGGFPKVVLSLPSLKFLDLRFNDFEGPVPSKLFDKDLDALFLNDNRFRFGIPENLGNSPVSVLVFANNNLGGCIPASIGKMSNTLNELILMNDNLTGCLPMEIGMLKKLTVFDVSFNKIQGPLPSTVSRMRSVEQLNVAHNKLTGVIPASICQLPRLQNFTYSFNYFTGEAPVCAATRSGRIVDGEENCIAGKEDQRSAKECSSDDAKPYDCRKSQCFSRSAISAVVKPRPKPTPKPKRPPVQNKPPAPKPSTPSRPVAPIESPPPPSSKSSGSHFKRSPPPPQSTPPPSPPPPVYSSSPSHKHRSPPPPTHKISPVTRHASPPPPPPSPVYYHHPSPSPPPPPVYYAPPTYKPQSPPPPPPPVHYEPPTYTPQSPPPPPPVHYEPPTYTPQSPPPPPPVHYEPPTYTPHSPPPPVYVTPSSPPPPTPVYEHPTPSPPAGYTPPQEPSHPAPPTPPCNEPPTPPPSTPHWQPKPSPPPTYNPSPSYTQSPPPPPPTYTYSSPPPPSPSPPPPTYYYSSPPPPSPPPPSPSPPPPSPSPPPPSYEHVPLPPVVGVSYASPPPPVIPYY

SEQ ID NO: 19583 - protein, 615 aa, Oryza sativa
MDDDDYSWVRRTKFSHSIVKSNSGREQFGAFLDPFDSSTAWRQKGFSGELMIHGHNLQPRAKGAVSKSPRPSIPLAKSPVSQAERKLKAKFSDGELKQRGKISDGSLREASKEKDRKVGHKGEGLSLDISCPILDRTVQDDSSDTLDFSFHSEEQSLRLLRVCSSPAPFYSKDTTTFGDSKIHSTSVKIVGEGSKPRRRAESPMPTRVISEVFKEAKAATKRFSSPQRQRKSSSPHSPRSPDDSPRFGFPSMRTPGNLKARRASSWPRNYDNGVAKAVALDILERWTIDRSQLLIGQRFASGAYSRLFHGIYKEQPVAVKFIRQPDEEEDAELAAKLEKQFTAEVTILARLHHRNVIKSQRTYTRNMSILIGACNAPPVFCVITEFLCGGSLRAFLRKLQRQKLPLEKIICIALDIAHGLEYIHSQRVIHRDVKPENILFDGECCAKVVDFGVACEEVYCNSLEDDPGTYRWMAPEMFKRKPYGRKVDVYSFGLVLWELFSGSIPYEEMTPLQAAFAVVNKNLRPVVPSSCPAQLRLLIEQCWSCQPEKRPEFSQVVQILKNLKEALDRDGTLDKIPSTNCQEPPDQNKKRLSNWIQRLSYSQADFSGPPPPKLL

SEQ ID NO: 19584 - protein, 471 aa, Streptomyces coelicolor A3(2)
MATAPSVSYSMTVRLEVPAGGTAVSQLTTAVESAGGSVTGLDVTASGHDKLRIDVTIAAGSTAHADEIVEQLRGIEGVSLGKVSDRTFLMHLGGKIEMQSKHPIRNRDDLSMVYTPGVARVCMAIAENPEDARRLTIKRNSVAVVTDGSAVLGLGNIGPKAALPVMEGKAALFKRFAGIDAWPICLDTQDTDAIVEIVKAIAPGFAGINLEDISAPRCFEIEARLREALDIPVFHDDQHGTAIVVLAALTNALRVVGKGIENVRVVMSGAGAAGTAILKLLLAAGVKNAVVADIHGVVHTGRADLVDAAPESALRWIADNTNPEGLTGTLKEAVHGADVFIGVSAPNVLDGEDVAAMADGAIVFALANPDPEVDPAIARETAAVVATGRSDFPNQINNVLVFPGVFRGLLDAQSRTVNTEMMLAAAHALANVVTEDEINPNYIIPSVFNDKVAGAVAGAVRDAAKAAGVVA

SEQ ID NO: 19585 - protein, 579 aa, Synechococcus sp. CC9311
MMVRRSQEQSTRMSNPHKQNSEQSLASFDNFIKNANYSLLDTLTPDPESTKDGDDHRPRQVRSGHFVPVNPKPLAQPIYICHSETFFSELGLDQELALNGEFKKLFSGDLSETRDPMRPYGWATGYALSIYGTEYNQQCPFGNGNGYGDGRAISVFEGILKGQRWEMQLKGGGPTPYCRGADGRAVLRSSVREFLAQELMHALRVPTSRSLTLYVSQTETVRRPWYSESSNSSDPDILVEDPIAISTRVAPSFIRVGQLELFARRARNNKNPKILNELRMIVLHLIDREYKSEIDQNLDFSSQLIKLAELYRERLTSLVVHWLRTGYCQGNFNSDNCAAGGFTLDYGPFGFCEVFDPLYQPWIGGGEHFSFFNQPVAAEANFHMFWKAIRLLITDDAAALEQLDKICDGFKPKIKTTIQQMWADKLGLTHYNKALVNELFQLMVQTKVDFTIFFRELCKIPNDLSDLKTSFYALIPTDLERQWQTWLQSWNELIEGRGDPTEITDKMKRVNPKYTWREWLVAPAYQQAKQGDYSLVKELQEVFSHPYEEQSQEIEEKYYRLKPDQYFNAGGISHYSCSS

SEQ ID NO: 19586 - protein, 197 aa, Picea sitchensis
MRKASLVSMMITASFYMLCGFLGYAAFGENAPGNLLTGFGFYEPYWLIDFANACLAVHLVAAYQVFCQPIFSLVEGWISRKWPSNTLISKRIGIRVPLFGFYKVNLLTLCWRTAFVVSTTGIAILFPLFNDVLGVLGALSFWPLVVYFPVEMYIVQKKVQRWTLKWSLLQTLSFIALLISLVTAAGSIEGLVKDKES

SEQ ID NO: 19587 - protein, 45 aa, Zea mays
HYIARVCQDTSKKSPMELINEVPPIKVDGRIAVCEGGRRVGLGHP

SEQ ID NO: 19588 - protein, 312 aa, Coccidioides immitis RS
MTSRSVWRSLHWSAKRRPIPPRTPYHCFSCSIRAQANEPGQNERTTHFGFETIPESAKESRVGAVFSSVAASYDTMNDLMSLGIHRLWKDHFVRSLNPGDQYARDGPENEKGWNILDIAGGTGDIAFRMLDHATNINNDHYTRVTVADINPDMLAEGKKRSLDTPYYNTDRLSFMQANAESIPSIPDNSVDLYTVAFGIRNFTNKQSALVEAFRVLKPGGVFACMEFSKVTVGLFDELYKRWSFGAIPLIGQVVAGDRASYQYLVESIERFPSQEEFRDMIQAAGFITPGKGYENLTMGIAAIHKGVKPLKK

SEQ ID NO: 19589 - protein, 403 aa, Wolbachia endosymbiont of Drosophila ananassae
MINMHTNRLKKYKIAALIVAAGVGSRCSSTIPKQYTELVGKSVLFHTIKRFLTNQYIDHIRIAINRDHENFYEKAISLITDTKLLSPIYGGENRQSSVKLGLESLQKVNPDFVVIHDACRPFVSNVLIDNLAQSMINDQYTGVVPAIDVEDTMSLVSNNFIESTISREKLRAIQTPQIFNFKELLSCHQSTKEFTDDSSLMIEHKKRVVIIKGEKSNFKLTTKEDINMAKLLFEEPKFRVGTGYDIHKFIKVQNGAESFIKICGVKIEHNMAIEAHSDGDVAIHAIVDAILGALGYGDIGEHFPPSSSEWKDCNSSHFLDFAAKKAKEKGYSVSNLDITIVCEEPKISPYKVEMKKFISKALEIDDEFVNIKATTAEKLGYIGRNEGIAVHASVLLHTNFYWK

SEQ ID NO: 19590 - protein, 723 aa, Nicotiana tabacum
MRPPSRLHSLFISFLVISLLSFQIYGQEGDIDLDDIKGDADKLIFENPKLRVAYIALQTWKAAMFSDPFNFTANWTGPNVCSYGGVFCAQSLTNDSIRVVAGIDLNHADIAGYLVPELGLLTDLVLFHLNSNRFCGIVPKTFSHLKLLRELDLSNNRFVGGFPKVVLSLPSLKFLDLRFNDFEGPVPSKLFDKDLDALFLNDNRFRFGIPENLGNSPVSVLVFANNNLGGCIPASIGKMGNSLNELILMNDNLTSCLPMEIGMLKKLTVFDVSFNKIQGPLPSTVSRMRSVEQLNVAHNKLTGVIPASICQLPRLQNFTFSFNYFKGEAPVCAATRSGRVIDGEENCIAGKEDQRSAKECSSDDAKPYDCRKSQCFSRSAISPVVKPRPKPTPKPKRPPVQNKPPAPKPSPPTKPIVPIESPPPPSSKSSGSHFKRSPPPPQSTPPPSPPPPPPVYSSSPSHQHRSPPPPTHKISPVTRHAPPPPPPPSPVYYHHPSPPPPQPVYYAPPTYKPQSPPPPPPPVHYEPPTYTPQSPPPPPPVHYEPPPYTPQSPPPPPVHYEPPTYTPQSPPPPVYVTPSSPPPPVYEHPKPPTPTPSPPAGYTPPQEPSHPAPPTPPCNETPPPPPSTPHWQPKPSPPPTYNPSPSYTQSPPPPPPTYTYSSPPPPSSSPPPPTYYYSSPPPPPPSPPPPSPSPPPPSYEHVPLPPIVGVSYASPPPPVIPYY

SEQ ID NO: 19591 - protein, 191 aa, Pyrococcus furiosus DSM 3638
MVDMSKVKLRIENIVASVDLFAQLDLEKVLDLCPNSKYNPEEFPGIICHLDDPKVALLIFSSGKLVVTGAKSVQDIERAVAKLAQKLKSIGVKFKRAPQIDVQNMVFSGDIGREFNLDVVALTLPNCEYEPEQFPGVIYRVKEPKSVILLFSSGKIVCSGAKSEADAWEAVRKLLRELDKYGLLEEEEEEL

SEQ ID NO: 19592 - protein, 137 aa, Thermus thermophilus HB8
MERTFVMIKPDGVRRGLVGEILARFERKGFRIAALKLMQISQELAERHYAEHREKPFFPGLVRFITSGPVVAMVLEGPGVVAEVRKMMGATHPKDALPGTIRGDFATTIDENVIHGSATLEDAQREIALFFRPEELL

SEQ ID NO: 19593 - protein, 602 aa, Pseudomonas fluorescens PfO-1
MPHEGNLLQAAVVFLLAAVLTVPLAKRLQLGAVLGYLFAGVIIGPSVLGLIGNPQSVSHISELGVVLLLFIIGLELSPRRLWVMRKSVFGVGLAQVLLTGSVIGVLALSVFGQPLNSAIVLGLGLALSSTAFGLQSLAERKELTSPHGRLAFAILLFQDIAAIPLIALVPMLAGVDHHTSTADDIRHSLQVLGSIAVVVIGGRYLLRPVFRVVAKTGLPEVSTATALLVVIGTAWLMDMVGVSMALGAFLAGLLLADSEYRHELEAQIEPFKGLLLGLFFISVGMGANLSLLLSAPITVLGLTLLLIALKLPLLFVVGRLAGGLNKVSAIRLGIVLAAGGEFAFVVFKIGRDQGLFEPRLYDLLVLTITLSMAVTPLLLLVCARLVSPKVQPVEVPEKFRQIETESPRVVIAGMGRMGQIVARILRAQNIKFVALDTSVETIELSRSFGGVPVFYGDPMRPEILSAAKVGEAEYFVIATDDPETNIKTAEIVRKLYPDMKIIARARNRQHVHRLVDVGADPIRETYYSSLEMSRRTLVGLGLTQAQADARIKRFKHHDEQVLEAQHAVYDDAAKVLQTAQEARAELARLFESDQLEEQSGKS

SEQ ID NO: 19594 - protein, 118 aa, Thermus thermophilus HB8
MGEIALLGLEFYGRHGVMPEEGRLGARFVVDLWLSVPFEGKGDRLEETVDYAAVYALVEEAVRHRRFYLIEALADHLAEELLKAFPRLQAVRVRVHKPHAPIPGVFRDVYAETQKSRI

SEQ ID NO: 19595 - protein, 294 aa, Populus x canadensis
GSSQTLHAKDELMPPTRQSATSKKCRVCGDEIGVKEDGEVFVACHVCGFPVCRPCYEYERSEGNQSCPQCNTRYKRHKGCPRVPGDNDDEDANFDDFDDEFQIKHHDHDESNQKNVFSHTEIEHYNEQEMHPIRPAFSSAGSVAGKDLEGDNEGYSNAEWQERVEKWKVRQEKRGLVSKDEGGNDQGEEDEYLMAEARQPLWRKIPIPSSRIHPYRFVIVLRLIILCFFFRFRILTPASDAYALWLISVICEVWFGLSWILDRFPKWNPIERETYLDRLSMRFEREGEPIGGVS

SEQ ID NO: 19596 - protein, 162 aa, Brassica napus
  misc_feature (51)..(51): Xaa can be any naturally occurring amino acid
MGVAVLQPTDPLSIRNIIFPPPHRPDKPTPNRRRRSPPRHQPETSPPPKGXEEEEEDLNHNHVRVPKRGEEKVPDLTVEKPDPRSARQIVSDPVTIPSQSRRSTTPALFYAGTVTSTSPPPSEVPLPAFFAKRSVSSFEPADATTDLIRILGIDVDRSQISD

SEQ ID NO: 19597 - protein, 262 aa, Brassica napus
  misc_feature (80)..(80): Xaa can be any naturally occurring amino acid
KKLDLLFDRVMESHVKMVGKKPEEEEDFLQYLIRVKDEDEKALLSLTHVKSLLMDMVLVGVDRSVNASEFARLEIVSRPXEVFKKIRQELDQVVGKDSIVEESHLPKLPYLQAVMKETLRLHPTLPLLVPHRNSETSVVAGYTVPKGSKIFINVWAIHRDPKHWDEPNEFKPERFLENSLDFNGGDFKYLPFGSGRRICAAINMAERLVLFNIASLLHSFDWVAPKGQKFEVEEKFGLVLKLKSPLVAIPVPRLSDPKLYAA

SEQ ID NO: 19598 - protein, 465 aa, Mesorhizobium sp. BNC1
MEQSAAENTGPDTAGQANALAALECVYQRFGDPQRMVRHGGRISEVTPMYYRVRGLSKTARLGQIISYRSHGSEYRGEVVRISEDDVIVAPFEHSAEASLGQAVFATGTLEIRPHASWRGRVIDALARALDDGPALIRSAPQGPAAMPRTPAALRRQRVAEPFLTGVRVVDLFAPLCLGQRIGIFAGSGVGKSTLLAMLARAEAFDTVVVAMVGERGREVREFLEDTLGEAGMKKTVAVVATSDESAMMRRRAADTAMRVAEHFRDAGEKVLLLLDSITRYAHATREVATGAGEPPVARGYPASVFTDLPRLLERAGPGETGHGSITAVFSVLVDGDDHNDPVADCVRGILDGHLVLDRAIAEQGRFPAVSPLASISRLADRSWTDDRKRVVQRLKAMIARFEETRDIRLLGGFQAGLDPELDLAVRQVPLIYDILRQSPKDPPAMDPFADLAAHLKAREASHGG

SEQ ID NO: 19599 - protein, 470 aa, Streptococcus pneumoniae
DLAKRKLYPSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWAENGAPLHDYKAGSMGPQASFDLLEKFGAKWTWQP

SEQ ID NO: 19600 - protein, 188 aa, Candidatus Kuenenia stuttgartiensis
MDFQKSTIFNLPNSLTLFRLLLAIIFFIFLSYHYYALSLLSFLAASLTDWLDGYVARKKGLLTDFGRIADPFVDKIIVCGGFILLIKHGYENVPPWMVLVIVAREFFVSSIRSYSEARGIEFGATLWGKAKMFVQALTISLMLLFSAYLKHVGSIKNIIIVLLWLTVIITVVSGIKYMVKASPVLLER

SEQ ID NO: 19601 - protein, 486 aa, Bacillus clausii KSM-K16
MTEQAKWNFDNSYARLPQPFFARLKPNPVRSPKLVLFNEPLATALGLNGEALQQPEGVAVLAGNVIPEGGEALAQAYAGHQFGHFTMLGDGRALLIGEQITPDGNRFDIQLKGSGRTPFSRGGDGRAALGPMLREFLISEAMHALGIPTTRSLAVVTTGEEIWRETELPGAVLTRVAESHLRVGTFQYAAGRGEVNDVKTLADYAIKRHYPELAESENPYLSLLEQVITRQANLISQWQLVGFVHGVMNTDNMTISGETIDYGPCAFMDTYDPATVFSSIDTQGRYAYGNQPQIANWNLARFAETLVPLLAEDETKGVEMAQSAIEGFKGQYVSNWLAGIRKKLGLFNAEDGDKDFVEKLLRLMHEHEADYTNTFRLLTLGQPEKTAMNGAAEFSEWLEQWQQRQSRQAQTKDEAMKLMRTNNPAVIPRNHRVEEALAAAVDEEDDSLVKQLIAVLKEPYAYSEEQERYAEVPERCQHGYVTYCGT

SEQ ID NO: 19602 - protein, 428 aa, Aspergillus oryzae
MESPRQSDASTPVEPYSPGCVDTPATQSSVLFDGNLEELLRNFPLDQYILVTGGLGFIGSHTTLELLKANYNVIVIDNLSNAFQNVFDRIKLLASKHHEQQGTKMPEMHLHAHDYRDSVALRKLLEQYQIQSRWGTPKTKISGVIHFAAHKAVEESIRNPLKYYANNVGGLIDFATTLGEFGIKTFVFSSSATVYGTLATSGLPLKEELCVHKDEIFEDRDGSKKLMEPGCTGITNPYGRTKWICEAILADLAASDPEWTIVALRYFNPVGCDESGLLGEDPKQIPTNLLPVVVKVMTGQYKELQMFGTDWDTEDGTAVRDFIHVTDLARGHIAALSAANEGKLKENFRTFNLGTGTGHSVMEVVNTMESVSSKAIPRRAADRRAGDVGSCVAVATRSQEELQWKTEKTLTDACASLCNFLAVSGLSS

SEQ ID NO: 19603 - protein, 470 aa, Streptococcus pneumoniae
DLAKRKLYPSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRSVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEKLWAENGAPLHDYKAGSMGPQASFDLLEKFDAKWTWQP

SEQ ID NO: 19604 - protein, 398 aa, Aspergillus oryzae
MDDLANRTEQITLNDSSKCLESKSSPDLAPFVASHLEVVYSSLKALPGVDFFRDIQHETTNDGSNNGVVDPLASLAALREYMASPASSAMGPVKQQNYSAPISDYFISSSHNTYLTGNQLYSDSDASAYTNVLLNGCRCVEIDVWDGERSSESASADDTSSSSSDSISERKIKQGSKRERLKSMAKRHSRLGSMSTKLGGLIGRKSSPEDVPLDSSAPVDPATEVPPPPEPQVLHGHTLTKGTTFRDVCYAIRDSAFVTSDLPVIVSLEVHASLEQQQAMVEIMEEAWKGMLVEVTPEKEATDPLPAPEDLKRKILIKVKYVAPTSEDKNEETPEGNGDELEALKQHANQGDLSSTDDKPSDAPPKKPSKILEALSRLAIFTKGFHFSHFEQPGNYSD

SEQ ID NO: 19605 - protein, 293 aa, Burkholderia xenovorans LB400
MLKVTKAVFPVAGLGTRFLPATKASPKEMLPIVDKPLIQYAVEEAMAAGITEMIFVTGRSKRAIEDHFDKSYEIEAELQARGKDKLLELVRSIKPSHVDCFYVRQPEALGLGHAVLCAEKLVGDNPFAVILADDLLYGTPPVMAQMIEVFDHYHSSVIGVEEIPAQETKSYGIVDGKEWEDSIIKMSGIVEKPEPNVAPSNLGVVGRYVLKPRIFEHLRALKPGAGGELQLTDAIQSLLADEQVLAYKYHGTRFDCGSKLGYLKATVEFALRHPEVAADFEEYLRTRSPVLEG

SEQ ID NO: 19606 - protein, 129 aa, Brassica napus
  misc_feature (105)..(105): Xaa can be any naturally occurring amino acid
MEVDRAPTAAAGGGSSSGAMAVDAAGGVEKPRFDALMPSEMSGGRPQYRKVQVPPHRFAPLKKAWLEIYTPVYEHMKVDIRMNLKAKRVELKTRHDTPDVSNLQXCADFVHAFMLGFDIADAVALLRLD

SEQ ID NO: 19607 - protein, 489 aa, Bacillus cereus ATCC 14579
MFQKIAKECLAGFTVAIVALPLAIAFGIAATGTSEGALVGLYGAIFAGLFAALFGGTPGQVTGPTGPITVIATGVIATHGLEASFIAFMMAGLFQILFGVCKLGSYVRYIPYPVVSGFMNGIALIIILGEIKHVQNSFLLVVLTIIVMIVSGKWIKAIPSSLVALVGVTALLPLFSSLLEGLTVKLPIIGNLSLNKVIEKIGTIPEAMPTLHIPSLSGTGIAALILSALSIALLGSIDSLLTSVVMDNVTGTRHKSNKELVGQGIGNMMSGLFGGLAGAGATVRSIVNIRSGGKTALSACMHSVILFIFIMGLGSVVQYIPLAVLSGILILTGIGMFDWGSMKKMHVAPKGDVVVMLVTMIVTVKFDLMIAVAFGIILSFIIYMVKCKERKTSIVKEKEETYKIQGPLSFLSVDRIFSTLQDVKSPVILRMKDVRYMDVSGAMALLNFVEQSNKVGASVKLEQVHPSIEKTIAVMASDEQKEQLKILSV

SEQ ID NO: 19608 - protein, 507 aa, Triticum aestivum
MEVEASAHGDTAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAAIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTDNVIAEYYYDHFHLDLRAAGTIAACFGMANIVARPMGGYLSDLGARYFGMRARLWNIWILQTAGGAFCIWLGRASALPASVTAMVLFSICAQAACGAVFGVAPFVSRRSLGIISGLTGAGGNVGAGLTQLLFFTSSQYSTGRGLEYMGIMIMACTLPVALVHFPQWGSMFFPASADATEEEYYASEWSEEEKGKGLHITGQKFAENSRSERGRRNVILATSATPPNNTPQHV

SEQ ID NO: 19609 - protein, 457 aa, Wolbachia endosymbiont of Drosophila ananassae
MNEYDITVIGSGPGGYIAAIRAAQLGFKTAIVEKEKNLGGICLNWGCIPTKSLLRASEVYRLIKRSKEFGIEVKGANFDIQSIVKYSRNVVDKLSSGVAYLMKKNNIKVHQGFGKLAGNGTIKVAGDKEEQEIVSKHIILATGVRARNLPGIEADGDLIWNAQHAMTPERLPKSLLIIGSGAIGIEFASFYSTLGVDVTIIEIKSTILPLEDKDISDLAQEIFTKQGIEIYTSSSVKALTKSKDSAQVLLSSGESKEFERVIVAVGIQANIENIGLENTKIKLSPSGFIETNEWYETSESNVYAIGDVAGPPCLAHKASHEAVICIEKIAGKNAHALKKECIPNCTYSHPQIASIGLTEEQAIKGGYDIKIGKFHSNFNGKSVALSETEGLVKTIIDKKTGEILGSHMIGAEVTELISNFALVKQLEGTDFDIKSTIFPHPTISEMIHESVLAADVK

SEQ ID NO: 19610 - protein, 83 aa, Zea mays
  misc_feature (35)..(35): Xaa can be any naturally occurring amino acid
GKRFGIDKPLIQLWAGQSLIPVTYAGAVSTIDDLXRIKNASKSRFYITLRSTLHISEGHLPYKDTDLRHNKQSIDAQLSKNIW

SEQ ID NO: 19611 - protein, 1128 aa, Vitis vinifera
MIKIGEKMFELLEKWVEQVGEENVIQIITNNHSSYVIAGRLLELKHPHLYWTPCVAHCLDLMLEDIGRLPNIKRTLERAISLNGYIYNHSMLLNMMRQFTEQREFLRPTKTYFASARDMNPISGRVSYYSVLTNIIELHYLSGNRVILFKCDWWDAIVTLKKGAYLLRCGRRGKPKFCPFRLSTDEKFLIWYSGQEEKQLRLSSITKIIPGQRTVNFQRQLQEERECRSFSLVYANGERSLDLICKDKAQADSWFLGLKAVISRCQHPRQLSTFRNCVGVQTCFNSPAGYFRRKHNLGLLEDTPKFSQVRSLCGSPTQSLSERCFSDGLSYSADSFYSSESSVSNVKNVVDVSLPSSPYVEPDHLKQGEEIYAGTEIQTDMLSQVAAPSHASPQMEKNDILRDVMIWGEGIEGGILGGGVYRFGNQNGMQSDALLPKLLESTTMLDVREISLGGKHAALVTKHGEVFCWGEGSGGRLGHKVNMDMGNPKIVESLTGVLVKSVSCGEYQTCALTHSGELYTWGDNGSGIDLVGERRKRSQWIPSRLSGPLNGTSISNVACGEWHMAIVSTSGQLFTYGDGTFGVLGHGKLESISQPKEVESLSGLWVKAAACGPWHTAAIVEVRADRLKFNTKGGKLFTWGDGDKGRLGHGDQERKLLPTCVAQLVDHDFVQVSCGRMLTVGLTCLGTVYTMGRLGDTEDRNSPAVVEELRYRQVESIACGSGFTAAICLHKSISSTDQSACSGCRMAFGFTRKKHNCYNCGLLFCRACSNKKVLNASLAPNKKKPFRVCDPCYTYLQRIKHSSRLLKLENHSPRQLLMTQKTSFDEKEDRGEGTPARTQFSSVGQPCNEASQSYEKKPFKNQVENQQTVEPVSSLSNGLPRWGQVPCPFLFEKYCRENSIALKDFPDTDKILIEEVERLRSEARSLEKLCQMRSEKIQECQQKLQETWSLAREEAAKCKAAKEVIKALSSRLHTMSEKLSSERDAKDGIDSKLPQIITRYVDTPKERQLDSLCGSPIVFSNSLRSMYGRDECQGHTRSVEDSCLEKIDPRQNGTKPSKLEWVEQYEPGVYITFITLASGQRGLKRVRFSRKRFTEKEAERWWEENQIGVYQNYGIEGYISSSQNKMKG

SEQ ID NO: 19612 - protein, 94 aa, Synechococcus sp. CC9311
MGQARKMRRHVCSAMSQESILEKVRSIVTEQLSVDAGEVKPESNFQNDLGADSLDTVELVMALEEAFDIEIPDEAAEGIATVGDAVKYIEDKQA

SEQ ID NO: 19613 - protein, 196 aa, Shigella flexneri
MSYYAFEGLIPVVHPTAFVHPSAVLIGDVIVGAGVYIGPLASLRGDYGRLIVQAGANIQDGCIMHGYCDTDTIVGENGHIGHGAILHGCVIGRDALVGMNSVIMDGAVIGEESIVAAMSFVKAGFSGEKRQLLMGTPARAVRSVSDDELHWKRLNTKEYQDLVGRCHASLHETQPLRQMEENRPRLQGTTDVTPKR

SEQ ID NO: 19614 - protein, 141 aa, Haemophilus influenzae R2866
MMTERTFSIIKSDAVKRNLIGAILTRFEQNGFKIIASKMVRLTREQAEGFYAEHQGKEFFAPLVEYMMSSPIVVSVLEKENAVKDYRTLIGTTNPETAEEGTIRKDFALSQRENSVHGSDSIENANREIAYFFTDCEIFER

SEQ ID NO: 19615 - protein, 425 aa, Nicotiana tabacum
MDNNSVGVPHNLPRGEMGGKQKNAQADGRNRRALGDIGNLVPAPAAEGKPKAAQISRPVTRSFCAQLLANAQEEKNKKPLAEVVNKDVPAKKKASDKEMKTVGGSPLSKRKAKKSGKTLTSTLTARSKAACGLSNRPKYEIEDIDVADADNHLAAVEYVEDIYNFYKLTEGESRVDDDYMNFQPDLNHKMRAILVDWLIEVHRKFELMPESLYLTITILDRFLSLKTVPRKELQLVGISSMLIACKYEEIWAPEVNDFIHISDNAYAREQILQMEKAILGKLEWYLTVPTPYVFLVRYIKAATPSDNQEMENMTFFFAELGLMNYKITISYRPSMLAASSVYAARSTLNKTPLWTQTLQHHTGYSEDQLMECAKILVSYHLDAAESKLKAIYRKFSSPDRGAVAFFPPARNLLPTTTTDAASSSS

SEQ ID NO: 19616 - protein, 226 aa, Oryza sativa
  misc_feature (3)..(3): Xaa can be any naturally occurring amino acid
  misc_feature (12)..(12): Xaa can be any naturally occurring amino acid
  misc_feature (17)..(17): Xaa can be any naturally occurring amino acid
TAXEGAKRARGXLVAKXPIEQVPLLQEEIISICRSMGKAVIVATNMLESMIVHPTPTRAEVSDIAIAVREGSDAIMLSGETAHGKFPLKAVKVMHTVALRTEATIPGGQMPPNIGQVFKNHMSEMFAYHATMMSNTLGTSTVVFTRSGFMAILLSHYRPSGTIFAFTDQKRIQQRLALYQGVCPIYMEFSEDAEETLTRALDLLQKQGMVKSGEEVALRQSGRQPI

SEQ ID NO: 19617 - protein, 305 aa, Pseudomonas fluorescens PfO-1
MLHIRTPLILHPTLSTASRRMWLKLENLQPCGSFKLRGMGLLCSQAAAQGKRKVVCPSGGNAGLATAVAAVSLGLQACIVVPHTTPEATRARIRRTGADVIVHGKVWDEANQRARELASAADTEYVPAFDHPVLWEGHSSMVDEILDDCPQVDTVVTSVGGGGLLAGILTGLLRHDRRDCRIITCETTGAASFAAAVQAGHPVRLSRIDSVATSLGAAQVAAWPVEHIGEFDHECLVLSDDDAIMGVVRYASDLRQLVEPACGVSLAVAYLDHPALAGANDVVVIVCGGVSISAQLVAGWARLGS

SEQ ID NO: 19618 - protein, 342 aa, Vitis vinifera
MSESNLGFILFKNWYLDSRFTQQELPACKPILTPGWVISSFIFVGIIFIPIGLASLFASERVVEIVHRYDTDCVPASYRNDMLAYIQSNETNKTCTRTFLVPKQMKSPVYIYYQLDNFYQNHRRYVKSRSDKQLRSRASENDTSSCDPEDVTSNKSAIVPCGLIAWSLFNDTYGFSVNNTLLGVSKKNIAWKSDQQHKFGSDVYPKNFQSGGLIGGAKLNSSIPLSQQVDLIVWMRTAALPTFRKLYGKIEVDLEANTELTVVIENNYNTYSFGGKKKLVLSTTSWIGGKNDFLGIAYITLGGLSLFLAISFLLIYIIKPRPLGDPTFLSWNRNPAGHFNFN

SEQ ID NO: 19619 - protein, 839 aa, Claviceps purpurea
MNPGPAPKPPSSDRPRLHLTPSANLPGNMANMAISPLRSTATSTYTGSTISLPIARQQTNNMDGMGGVAVKKEGWASVKESKNFIQPWKQKYLILRKESLDFHKAEGGKVSYTLYLRDVVNVGRVEAAGTIFEIKRKPDGSSNSPGDDDGQTKTLQIKVKSEDDLYEWIDFIYGACPGMGGVSNPTNFSHAVHVGFDAQTGEFVGLPPEWSKLLNSSAITKEDYERNPQAVFEVLDFYTDLAKRAENPGQFSSMTPTPQGAMQHKQLGGGNSIAPPRPAPPPPNQRSYNTTPPKSSGGAPRQPSAGDQQQRQQPQQRQQMQNSSNNYATQDAAREEQRRKQMEGHRQREAEERERRELEAYNASLPKNKIPMAQQEIGGYGGSPGSSDRYNPSRAAPSAPKPSGSPANGLRAQRAAPAAPSSNGASRQPPGSQASSNGYRDPASQGQRMPRHDGSPASRTPNGSQTSQPRQPQAAQGVSRLPAPVKPLNVAPKPSQAHQQADSVKAAEAALTAKPAPSERKQDARMSTMSENEVMAKLKEAVSKEDPNLSYSKQKKIGQGASGSVYVAKIKETAQGIARDILRQQGPRAQVAIKQMDLAHQPRKELIVNEIMVMKDSKHRNIVNFVDAFLKNNNQELWVVMEFMEGGPLTDVIDNNPSISEEQISTICNETCRGLHHLHAQSIIHRDIKSDNVLLDARGNVKITDFGFCAKLTDAKSKRATMVGTPYWMAPEVVKQKEYGPKVDVWSLGIMAIEMIESEPPYLNEEPLKALYLIATNGTPRLKKPERLSKELKAFLSVCLCVDVKSRASADELLAHDFLKHGCPLGSLAELLAFKKHAK

SEQ ID NO: 19620 - protein, 470 aa, Streptococcus pneumoniae
DLAKRKLYPSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPIDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWAENGAPLHDYKAGSMGPQASFDLLEKFDAKWTWQP

SEQ ID NO: 19621 - protein, 254 aa, Sinorhizobium meliloti 1021
MSDGMKSVLITGGASGIGLEIARLLHERGWRVYLMDRNADALADACRAIPIDPAQAIACSVTDEKEVESAIATAAAAGAPLRAVINSAGIAMDRPAVETSVDDFRRILDVNLTGTFIVCREAARHWLATATPGAIVNISSVSGLVGNKGRAAYGASKGAVNLLTYILATELGQDGIRVNAIAPGAIDTPLSRAVHTDDVRAQWHERIPQRRYGSSREIAASAAFLISEEASYINGQILAVDGGFVNAGLALKGR

SEQ ID NO: 19622 - protein, 233 aa, Chlamydophila abortus S26/3
MKKDPYLEVKKQLALEAANLVEPGMLLGLGSGSTSREFIKAVAHKHKQENLDIRAVASSKESHSLAKSLGIPLVDDEEFTEIDLAVDGADEIDPQLRMIKGGGGAIFREKILLQSSRRRLILADESKHVQVLGKFGLPIEISPFGRSSIIATLKNLGYLGNLRKNSHGGFFITNNRNYIYDIHTPNVYPHPEEDLLKLLQIHGIIEVGFVIASVEVWFGYANGQIGKKNTGRV

SEQ ID NO: 19623 - protein, 470 aa, Streptococcus pneumoniae
DLAKRKLYPSLFRLYKSSNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPAIFTKDEIRAEKIKVFKNLYHPTDEELKEHFIRGQYRSGKIDGMKYISYRSEPNVNPESTTETFTSGAFFVDSDRFRSVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWAENGAPLHDYKAGSMGPQASFDLLEKFGAKWTWQP

SEQ ID NO: 19624 - protein, 449 aa, Candidatus Kuenenia stuttgartiensis
MKNFQTFNFNSNIVAGIKSVGYVTPTPIQLQAIPLILEGTDVMGLAQTGTGKTAAFVLPILHRLMQGERGKIRALVIVPTRELAEQVLQDFKTLGSKTSLRSISIYGGVSITQQINRLRSGVEIVVACPGRLLDHMKQRTIELSRVEVLVLDEADHMFDMGFLPDIRKIIKCLSHKRQTLLFSATMPDEIRKLAQEALTKPVTVQLGKTAPASTVKHALYPVKQHLKIPLLLKILQHTDTQSVLIFTRTKYRAKSLGDRLIRAGYKATSFQGNLSQPQRQAALGGFRNGAYQILVATDIAARGIDISQISHVINYDIPDTPEAYVHRIGRTGRAARTGDAFTLVTEDDKAMVRGIENILGSRIERYTLEDFDYSMPALKNTGTHAAPTQKKIVRNKMDWHQKSDTRGKTDLKKDMSTSTMKKQYSFIKTKTTRPLSANIKTAPRPLKHK

SEQ ID NO: 19625 - protein, 792 aa, Mesorhizobium sp. BNC1
MRRMEYGPAPEANEDVVAWLKARASGIGHFIGGKFTFPKGAESFVSINPATEAELARVAQGTAADVDAAVKAARAAFPKWSALSGHERARYLYAIARHIQKRERFFSVLESTDNGKPIRETRDIDIPLVTRHFYHHAGWAEMVESEFEGFSPVGVCGQIIPWNFPLLMLAWKIAPALAAGNTVVLKPAELTPLTAAAFAEICLEVGLPAGVVNIVHGDGSTGAAICDHEGIDKIAFTGSTEVGRIIRERTAGSGKKLSLELGGKSPFIVFEDADLDGAVEGVVDAIWFNQGQVCCAGSRLIVQEGIAERFYDKLRRRMETLRVGSPLDKGIDVGAIVSAEQLQRITALVKKGEEEGGTLWRAKGQLPEKGYYFPPAFFTDVDPASTVCGVEIFGPVAVAMTFRTPAEAVALANNTRYGLAASIWSENINVALDAAAKVKAGVVWVNCTNMLDAGAGFGGYRESGFGREGAREGLYEYLVSDVEKALKPGKEPAPLKPRGAAEAKRRFASIAGIDRTAKMYIGGKQARPDGGYSYDVLGKGEAVIGQAPLGNRKDIRNAVEAAVKAASWGGVTAHNRAQVLYYVGENLEARREEFVKLLSESTGRNGKAAAAEFDVALRRIFYYAAQADKYDGAVHATKSRHVTLAMNEPWGVMGIVAPEEAPLAAFISLVLPAIAMGNRVVAIPSTRHPLIATNLYQVLDTSDVPGGVVNIVTGEKDVLAKTLAEHDEVAAMWYFGSKEGSAMIERTSCGNLKATWVSGGKVRDWLDDRQAKGREFLRRATQVKNIWVPYGE

SEQ ID NO: 19626 - protein, 612 aa, Arabidopsis thaliana
MASLSGLYSSSPSLKPAKNHSFKGIAGAISRFLLFPTYLQTHQSTLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKIKPPSSPEGRFTQILSVGIGGSALGPQLSLRLGPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAHLQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHPYIQQLRDGVHNFFATFIEVLRYRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEIEMIYKIIAHMSANDRVLIAEGNCGSPRSIKVYLGECNVDDLYA

SEQ ID NO: 19627 - protein, 513 aa, Aspergillus oryzae
MSSWIQRHAGSQQTQLAATAVLSGAAVAGAIFGYQALKRKEAVKELKASIPNIDEKHIAAKLTKFGGADPVQQLSKEDERSAALARRAQMGDYDDELILEQLARNRVFLTDEGLEKLRSSFIIVVGCGGVGSHAAASLSRSGASKIRLIDFDQVTLSSLNRHALATLADVGTPKVHCIRKRLEQITPWTKFDCRNELFSGSVADGLLAPWSMDDSDKGRKPDYVLDCIDNITSKVELLHYCHSHSIPVISSMGAGCKSDPTCVTVGDISTSTDDPLSRSTRRRLKILGVSTGIPVVFSTEKPGPGKASLLPLAEEEFNKGQVGELSVLPDFRARILPVLGTMPAVFGYTVANHVICDIAGYPRDYSIARKGKDKIYDSVQTATQGFMERLARVEVGQHVIGLRLPITKGDVVFLVDDIWRGKSAITGLPGRLILVPWERPARGFVPDPEWEKQGQKFLPFELKDLVCMTKEESARHEKEVLLGGKKPEDLYDEKTIQRVKERMEEAGFYERFR

SEQ ID NO: 19628 - protein, 470 aa, Streptococcus pneumoniae
DLAKRKLYPSLFRLYQSGNLSKHFAVIGTARRPWSKEYFESVVVESILDLADSTEQAQEFASHFYYQSHDVNDSEHYIALSQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEKLWAENGAPLHDYKAGSMGPQASFDLLEKFGAKWTWQP

SEQ ID NO: 19629 - protein, 247 aa, Coccidioides immitis RS
MSFVMHEVVYFGRSLPWIIIDRIKYFNRWKIQHNKIPTIQEQWNCAKLVLLSHFTVELPQIWLFHPMAQYFGLATGVPFPSIWKMMYQIAIFFVLEDTWHYFSHRAFHWGPLYKSVHKIHHQYSAPFGLAAEYASPIEVMALGFGTVGCPILWCAFTGDLHILTMYIWIVLRLFQAIDAHSGYEFPWSLHHFLPFWAGADHHDLHHEKFVGNYSSSFRWWDYLLDTEYSPEAVQRRREKSKVAKKTE

SEQ ID NO: 19630 - protein, 397 aa, Candida glabrata CBS 138
MLKVETKQRPRRASSVGNIDLGDTVPGFATMHESKASKVAAKRRHERLATQRNLKMTTKLYLKARDYNYHHMWFLPLCILILTYAAYFGISNKRVKGFLHMFVAISYEQESNPQYYGKGIKDLAFVFFHMIFFTFLREFLMDVIIRRITQWLNITSKYKIKRMMEQMFSIFYYGFSSPFGVYVMYHSDLWYFRTNTMYNTYPDILIPKLFKAFYLIQAAFWAQQAFVLVLQLEKPRKDHKELCFHHVVTLLLIWSSYVFHFHKMGLAVYITMDVSDFFLALSKTLNYIDSPLTEVVFGMFVLVWIYLRHVINGKILWSVLTEFRTEGPYILNFATQQYKCWISLPIVFVLIFALQVLNIYWLFLIFKVLYKIVWQGVTEDVRSDEETDSGSDELKKD

SEQ ID NO: 19631 - protein, 450 aa, Microcystis aeruginosa PCC 7806
MSYDFDLFVIGGGSGGIATARRAAEYGAKVGLAEYDRLGGTCVNRGCIPKKLMVYSSRFPQLFKDAEGYGWSPVESQLNWQKLISAVNQETIRLNGIYQKMLDNSQVTLFPNYAKFLDSHTLEVGEEKITADKILIAVGGHPVKPDIPGIEHTVVSDAMFQLPEQPKRIIVLGAGYIGVEFAGIMHGLGTEVVQLIRKDKILRGFDEDIRDEIQAEMIRQGIKIMPETFPTSIEKTDEGLKVHIQGKETSEMLFVDALGLAATGRIPKLEKLGLENVNVEVKNRAIVVNEYSQTSEDNIYAVGDCTDKINLTPVAINEGRAFADTVFGNKPRLMSYENVPSAVFSTPEAATVGLTELQAKKQYGDTGIKVYRSKFRPGYNVLPGREDKTLMKLVVHQESGKILGAHMVGDHAAEIIQGVAIAVKMGATKADFDATVGIHPSAAEEFVTMR

SEQ ID NO: 19632 - protein, 377 aa, Mycobacterium avium subsp. paratuberculosis K-10
MKVVIEADGGSRGNPGPAGYGAVVWTPDRGTVLAENKQAIGRATNNVAEYRGLLAGLGDALKLGATEAEVYLDSKLLVEQMSGRWKVKHPDLIELHAQARSLAARFDRISYTWIPRERNSHADRLANEAMDAAAAATGTAEKPGPAEQSDPTAADAGKTAAAPSPAAPGWTGARGTPTRLLLLRHGQTELSVQRRYSGRGNPALTETGRRQADAAARYLAARGGISAVFASPLQRAYDTAAVVAKALGLDVTVDDDLIETDFGAWEGLTFGEAAERDPGLHRRWLRDTSTAPPGGESFDSAAERVSRVRQKIIAAQQGSTVLVVSHVTPIKMLLREALDAGPGILYRLHLDLASLSIAEFYSDGAASVRLVNQTGYL

SEQ ID NO: 19633 - protein, 593 aa, Prunus persica
SVYWPGPGLSVYQNGRTDYNSSRIAVFDEMGNFVSSDDLIFSASDMGARVKRRLTTDYDGNLRLYSLNSTGSWVITWEALAQQCRVHGICGRNGICVYTPELKCSCLPGYEAVDTSNWNKGCKPKFKPTCSQSQRVKFKQIQYVDFYGFDLNYSESTSIQNCTKLCVEDCRCEAFVYRGQKCYTKGALFSGLRSPTIEGSLYLRLPEPLSMETSPAANLTVFNSCRTNAVKIGTSSMYDNPSKTVRWVYLYSFAAAIGAVEFLFILSGWWFFFRRSQGMSAPLVDKYRLISSNFRMYLYAELKKATRNFKEELGRGGSGTVYKGVLADERVIAVKALADIYQAEEVFWAEVSTIEKINHMNLVRTWGFCSEGKHRLLISEYVENGSLDKHLFPPNFLGWKERFKVAIGIAKGLAYLHHECLEWVIHCDVKPENILLDSNFEPKIADFGLAKLFQRGGLNAVSSHIRGTKGYMAPEWALNLSITAKVDVYSYGVVLLEIVKGIRLSNRVVDTAEEEEAEMKRFVRIARRKIQCGEDEWIEDMLDPRLEGQFGRNQAAKMVEVGISCVEEDRNKRPTMDSVVQMLLECEEESNIQ

SEQ ID NO: 19634 - protein, 279 aa, Ralstonia metallidurans CH34
MHGSPLARSPSHLHRLSSASAFTPSAVAEGVFLELRPSGHLCHTDDPRRGEGHNPHRHHPDPVHHPVPARPPGGHRGVSGLLNVIATACKVIATAASRGALAGVLGSAEHENVQGEVQKKLDVISNAILVHATERGGHLVALASEEMDTIYPIPAAFPRGKYLLVFDPLDGSSNIDANISVGAIFSVLRSPDPEVPPTLEHFLQAGAGQVCAGYALYGPATMLVLTTGQGTHGFTLDRDVGEFILTHPMLRIPAATQEFAINTSRGLLVFSAISDGTQS

SEQ ID NO: 19635 - protein, 474 aa, Coccidioides immitis RS
MMEDTFGASFLQPLDPAARHSFKTPSKQINDHQDVTTFLSSLAYKDIITFVLQLNRAMVPSKVLENGMQKIQMWQLASDAIEFSEPVRRLQLLLTRLESIIDEVPPDTGPRRFGNVSFRKWYQEMEARAETIMDECLPSEVLESGGEDPEAVTAKMELMAYFTGSFGSSQRLDYGTGHELSFVAFLGCLWKLNAFAKSEPGVEERGIVVGVIEPYLKLVRRLITTYTLEPAGSHGVWGLDDHSFIPYILGSAQLAPAIAPSDRTPIEGSIDGAPKTSDVTKPSIVERERRTNLYFSAIGFIYDVKKGPFWEHSPMLYDISGIKDGWGKINKGMIKMYNAEVLSKFPVVQHFPFGSLFRWERDPNAAAPLPSPHLSSRPQPSQTMAPPLGGSRPVADASTRAPWATTSSSFPQGTAQSSLGPTGPGYGGLRNQAMPQDGSTHLPPPTQAPWAMKAQRSREKDPDITTTKAPWAKK

SEQ ID NO: 19636 - protein, 227 aa, Triticum aestivum
  misc_feature (211)..(211): Xaa can be any naturally occurring amino acid
MAAAAKIAPSMLSSDFANLASEAERMVRLGADWLHMDVMDGHFVPNLTIGAPVIESLRKHTKAYLDCHLMVTNPSDYVEAFGKAGASGFTFHIEVARDNWKELIQNIKAKGMRPGVSLKPGTPVEDVFPLVEAETPVELVLVMTVEPGFGGQKFMPEMMDKVRTLRKKHPSLDIEVDGGLGPSTIDAAASAGANCIVAGSSVFGAPDPGRXVSPALRKSVEASQIKS

SEQ ID NO: 19637 - protein, 762 aa, Bacteroides fragilis YCH46
MAKITKEAALLYHSQGKPGKIEVVPTKPYSTQTDLSLAYSPGVAEPCLEIEKNPQDAYKYTAKGNLVAVISNGTAVLGLGDIGALSGKPVMEGKGLLFKIYAGIDVFDIEVNEKDPDKFIEAVKAIAPTFGGINLEDIKAPECFEIERRLKEELDIPVMHDDQHGTAIISSAGLVNALQVAGKKIEDVKIVVNGAGASAVSCTKLYVSLGARLENIVMLDSKGVISKARTDLNEQKRYFATDRTDIHTLAEAIKDADVFLGLSKGNTLSQDMVRSMAPMPIVFALANPTPEISYEDAMAARPDVLMATGRSDYPNQINNVIGFPYIFRGALDTQAKAINEEMKIAAVHAIANLAKQPVPDVVNEAYHVNNFTFGPEYFIPKPVDPRLITEVSIAVARAAMESGVARKNIENWDDYKTHLRELMGQESQLTRQLYDTARRNPQRVVFAEGGHPNMLKAAVEAKSEGICHPIILGNEERIEKLAKELDLSLDGIEIINLRHDREAERRERYAHILSQKRAREGATYEEANDKMFERNYFGMMMVETGDADAFITGLYTKYSNTIKVAKEVIGIRPEYKHFGTMHILNSKKGTYFLADTLINRHPDTSTLIDIAKLADQTVRFFNHTPVISMLSYSNFGSDQAGSPLKVHEAVAYMQQEYPELAIDGEMQVNFAMNRELRDSKYPFTRLNGKDVNTLVFPNLSSANAGYQLLQAMDPDTEFIGPIQMGLNKPIHFTDIESSVRDIVNITAVAVIDAIVEKKKANK

SEQ ID NO: 19638 - protein, 614 aa, Bacillus subtilis subsp. subtilis str. 168
MAHTSVASLVVVLIVAFLTPILLHRFKLSIPVVVAEIIMGLIIGKSGLNLVVEGDTWLQTLSMLGFIFLMFLSGLEIDFSSFEKGKKKQFLPNGKEAPNTFAAASVIFVGIFILSLLLSYGFVLAGFIQNAFLMTLIISTISLGVVVPTLKEERIMNSNIGQIILLVAVIADLATMILLAVFSSLYGEDSGNMWLLMILFAAGVVLYFFGRVFKHRSFVQSMSKGTIQIGTRAIFTLIIVLVALSESLGAENILGAFLAGVLVSLLSPNKELVQQLDSFGYGFLIPIFFVMVGVKLDIWTLFQDKTILIMIPLLLLALLVSKIIPVMYLKKWYDNRTIFASGFLLTSTLSLVIAAATIGQQLHVISTNMSGALILVAVIASIFTPICFKKLYKREEQPEEKKTITFIGANQMTLPVTLELPEEEYDVRVVHVYQENAEEKLSESVFAVETISDYEHETLESLGIFETDILVVATGNEDMNADIALLAKDKGTERVIASVGSPEHEAALKEQGISIFSILLSTKTLLRALIEAPGVMKLLTNQESSLYQINMENSKYDGVILREFPLTGDVIFVRIFRGVDSIVPHGDTRLKLGDRLIVTGSRGYVTDLKKTLEG

SEQ ID NO: 19639 - protein, 444 aa, Bacteroides fragilis YCH46
MNAAKVLEDLKRRFPNEPEYHQAVEEVLSTIEEEYNKHPEFDKANLIERLCIPDRVYQFRVTWVDDKGNVQTNMGYRVQHNNAIGPYKGGIRFHASVNLGILKFLAFEQTFKNSLTTLPMGGGKGGSDFSPRGKSNAEVMRFTQAFMLELWRHIGPETDVPAGDIGVGGREVGFMFGMYKKLSHEFTGTFTGKGREFGGSLIRPEATGYGNIYFLMEMLKTKGTDLKGKVCLISGSGNVAQYTAEKVLELGGKVVTMSDSDGYIYDPDGIDRAKLDYIMELKNLYRGRIREYAETYGCKYVEGARPWGEKGDIALPSATQNELNGDDARKLVANGVIAVSEGANMPSTPEAIKVFQDAKILYAPGKAANAGGVSVSGLEMTQNSIKLSWSSEEVDEKLKSIMKNIHEACVQYGTEPDGYVNYVKGANVAGFMKVAKAMMAQGIV

SEQ ID NO: 19640 - protein, 373 aa, Vitis vinifera
MALSETASESNASIHSTFASRYVRVSLPRFKIPENSIPKEAAYQIINDELMLDGNPRLNLASFVTTWMEPECDKLIMASINKNYVDMDEYPVTTELQNRCVNMIAHLFNAPLGESEAAVGVGTVGSSEAIMLAGLAFKRKWQNKRKAEGKPHDKPNIVTGANVQVCWEKFARYFEVELKEVKLTDGYYVMDPVKAVEMVDENTICVAAILGSTLNGEFEDVKHLNDLLTKKNKETGWDTPIHVDAASGGFIAPFLHPELEWDFRLPLVKSINVSGHKYGLVYAGIGWVIWRSKEDLPDELIFHINYLGADQPTFTLNFSKGSSQVIAQYYQLIRLGHEARTLWKTVKKMQGCSKKDWRRQGTSTLCLKRMECH

SEQ ID NO: 19641 - protein, 477 aa, Oenococcus oeni PSU-1
MKKTKIVSTLGPASNDLKIISALINNGINVARFNFSHGDHDEHAARMALVHDAEKKTGKLIGFMLDTKGAEIRTTVQDTPNGKIEFKKGDRLRISMNEKIKGTKEKIAVTYKGLYDDVKVGGKVLFDDGIIEMTVISKDSEKKELLVQVDNDGVLGGRKGVNAPGVAINLPGITKKDKSDIEFGLEQGIDFIAASFVRKAQDVLDIRKLLKKHHQENHVMIFPKIESQEGIDNFESIIAVSDGLMVPRGDMGVEIPYEEVPVIQKMMIRYMNRLGKPVITATQMLDSMIENPRATRAEINDVENAVWDGTDATMLSGESANGSWPVEAVKTMSTSDEYAENHVHDDGNRIDLRNEPKSSDTEVLAQAAVDAAREAGAKAIVASTASGYTARLISKYRPDMPILAITYDEKVARSLTVNYAVYPVVKDAPETTDDLIELAKKTVHDEKLAKRDDTIVVTAGLPIKKPGTTNLIHVVKL

SEQ ID NO: 19642 - protein, 590 aa, Coprinopsis cinerea okayama7#130
MPLVIEPSSPASDSGNATYISNVSSVDSEKTIREDDKTQLAALLNNMNALMSSDRLPVSASETSMAVNDLSSSDESDYEGSGGTWIKPYQDRPPSARPELTKLRTDLPSTPDPADKVREERPNPSASQSQGYQNGGPSSQYQLPPPQRFPPGNQQHRDHRVSGFADGDDDWAPRPPPEDVYDRLEEFFPEHDLDKLVIEANSGGNSPTNPEPTTAIPTPVSANATVIMPQHPHRRHKKSIRIVAQEQKRKMNDQTSRVDPAPYGQNAMLRKRNTKMWGSKLEEVTTMQVRTSSTIPESPSSAGSPPTFKWVRGELIGKGTYGRVYLALNATTGEMIAVKQVELPQTPSDRNDSRQNTVVQALKLESETLKDLDHPHIVQYLGFEETPANLSIFLEYVPGGSIGSCLHKHGKFSENVTKSFTGQILSGLEYLHSKGILHRDLKADNILVEMTGICKISDFGISKRTDDLHGGAFTAMQGTVFWMAPEVINTQKKGYNFKIDIWSVGCVVLEMWGGRRPWTGQEMVTVMFKLYEAKLPPPVPDDVVLSELGDDFRRKCFAINPDERPPAAELRLHPYLELPPGWTFTSFTSD

SEQ ID NO: 19643 - protein, 463 aa, Streptococcus pneumoniae
DLAKRKLYPSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPAIFTKDEIRAEKIKVFKNLYHPTDEELKEHFIRGQYRSGKIDGMKYISYRSEPNVNPESTTETFTSGAFFVDSDRFRSVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWAENGAPLHDYKAGSMGPQASFDLLEKFG

SEQ ID NO: 19644 - protein, 519 aa, Arabidopsis thaliana
MTDISSLFRNRSRKDQLDYGLTVIVISTLCWCLWLYAKCKRRSPPLPPGPWGLPIIGNLPFLQPELHTYFQGLAKKHGPIFKLWLGAKLTIVVTSSEVAQEILKTNDIIFANHDVPAVGPVNTYGGTEIIWSPYGPKWRMLRKLCVNRILRNAMLDSSTDLRRRETRQTVRYLADQARVGSPVNLGEQIFLMMLNVVTQMLWGTTVKEEEREVVGAEFLEVIREMNDLLLVPNISDFFPVLSRFDLQGLAKRMRRPAQRMDQMFDRIINQRLGMDRDSSDGRAVDFLDVLLKVKDEEAEKTKLTMNDVKAVLMDMVLGGTDTSLHVIEFAMAELLHNPDIMKRAQQEVDKVVGKEKVVEESHISKLPYILAIMKETLRLHTVAPLLVPRRPSQTTVVGGFTIPKDSKIFINAWAIHRNPNVWENPLKFDPDRFLDMSYDFKGNDFNYLPFGSGRRICVGMAMGERVVLYNLATFLHSFDWKIPQGERVEVEEKFGIVLELKNPLVATPVLRLSDPNLYL

SEQ ID NO: 19645 - protein, 470 aa, Streptococcus pneumoniae
DLAKRKLYPSLFRLYKSGNLSKHFAVIGTARRPWSKEYFESVVVESILDLADSTEQAQEFASHFYYQSHDVNDLEHYIALRQLQAELNEKYQAEHNKLFFLSMAPQFFGTIAKHLKSENIVDGKGFERLIVEKPFGTDYATASKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVGASWKLIDRIEELWAENGAPLHDYKAGSMGPQASFDLLEKFDAKWTWQP

SEQ ID NO: 19646 - protein, 356 aa, Aspergillus oryzae
MDVLHTLLTRDEDSGPAPACDAGNEYDGRMGLRISSIFVIMVGSMFGAVFPVLAGQFRRSKYLEWAFFVAKYFGSGVIIATAFIHLLAPAEEALTNECLTGPITEYSWVEGIVLMTIVVLFFVEMMVMRYARFGQSHAHELAHEHNHGEPKHSGSESGSEVLDSKHIPGRDHLGHSREHHDVEMAVHDTSVEEYMAQLTGVFILEFGIIFHSVFIGLTLAVSGAEFVTLYIVLVFHQTFEGLGLGSRLATIPWPRSKRFTPYILGIAFGLSTPIAIAIGLGVRKSYPPEGRTTLIVNGVFDSISAGILIYTALVELMAHEFMFSSSMKKAPIQHVLAAFFLLCLGALLMALLGKWA

SEQ ID NO: 19647 - protein, 499 aa, Sinorhizobium meliloti 1021
MQAVRYEPKDNVTPLERFRRGLDRSGVIEFLRDDLVGATSQIEGPYGIRNLVYADYVASGRALLTVERFILEDVLPFYANSHTEASYCGGFMTRMRREARALIAECCGADERHAVIFTGSGATSGLNRLVKLFGVTEAIAAGKTVRVIIGPYEHHSNILPWRESGAEIVELTESPMGGPDLFLLDQALRTGSPDLTICTLSAASNITGITSDVAAITDLVKSAGAKMIWDYAGAGPYVPISMSPSGSAEIDAIVLSPHKFIGGPGASGILIVRRDGPATNKPSWPGGGTVKFVSPETHDYSDSLEAREEAGTPNVVGDIRAALAFVVKHAIGLKEMARRNRQLTVRAFSAWKDVPQLEILGLPALDRLPIFSFRIRNGKGGYMHQQLVTRMLSDRFGIQARGGCACAGPYVHRLLSIDAQQSEQMRQAILAGDEIKKPGFTRLNFSVLLSDEKVKFILDSVAKLAADAPAFEPDYDFDPARAIFFPRVAAENGGAHAQA

SEQ ID NO: 19648 - protein, 232 aa, Ralstonia metallidurans CH34
MTMHRIAPSILSADFACLGDEVRGVIAAGADWIHFDVMDNHYVPNLTIGPAVAKALKPHTRRADGSSAPLDVHLMVHPVDTLAAEFAQAGAGLISFHPDASVHVDRTLQLIRGAGCKAGLAFNPAAPLDVLDWTLDKIDLVLIMSVNPGFGGQSFIDSALRKIESARRLIDQSGRDIRLQVDGGIKVDNIRRAADAGADTFVAGSAIFGQSNYKAVIDAMRAELAAPMGKVA

SEQ ID NO: 19649 - protein, 365 aa, Ralstonia metallidurans CH34
MPLSHRQTLTRYLIEERRRFPEASGELNALILDVALACKALARVVSFGELGDALSDGSAAPTGGGINVQGEVQKPLDVQSNEMFIRMNEWNGQLAGMASEEMEEPYLIPSSYPRGKYLLVFDPLDGSSNIDVNVSIGSIFSILRAPADVVASGRDVTEADFLQPGAAQVAAGYTIYGPTTQLVLTVGNGVAAFTLDPNLGEFLLTRSDIRVPEQTQEFAINSSNSRFWEPPVKRYVDECLAGKTGPRGKDFNMRWVASMVAEAHRILMRGGVFMYPRDTKDPAKPGRLRLLYEANPVAMLMEQAGGRASTGREPILGVSPTALHQRIGLIFGSKDEVERIERYHQEPASNEAAAPLFAERSLFRD

SEQ ID NO: 19650 - protein, 294 aa, Ralstonia metallidurans CH34
MSEKHPIIAITGSSGAGTSSVTRTFQNIFRREGVKAAVIEGDSFHRYDRKGMKLHQAEAEKSGNTHFSHFGPENNLLVELEQLFRGYSESGTGKRRKYLHDDDEAAPYKQEPGTFTPWEDLPADTDMLFYEGLHGAVVTPEVNIAKHPDLLVGVVPVINLEWIQKLYRDKKMRGYSTEAVTDTILRRMPDYVQYIVPQFSQTHVNFQRVPVVDTSNPFIARDVPSADESLCVIRFANPKGIDFQYLLNMIHNSWMSRANTLVVPGGKMELAMQLIFTPFIWRMMERRKRALGVL

SEQ ID NO: 19651 - protein, 792 aa, Photobacterium sp. SKA34
MQKHTLWFNTLSMNDVNQVGGKNASLGEMVSNLSNAGVSVPNGFATTSFAFHEFLEYEGLNDRIYDLLDTLDVNDVDALRETGAIIRNWILDAPFPSKLEESIRHDYLELIEGNQALSVAVRSSATAEDLPDASFAGQQETFLNVKGVDAVLEATKHVYASLFNDRAISYRVHQGFDHKGIALSAGIQRMVRSDKAASGVMFTLDTESGFDQVVFITSSWGLGEMVVQGAVNPDEFYVHKPMLEAGNAPIVRKNFGSKLIKMIYSDNQEIGKQVDIVDTSSEEQQNFSINDEEIKELAKQAMIIENHYQRPMDIEWAKDGIDGKLYIVQARPETVCSQESQNVIERYELNNKADVLLEGRAIGQRIGSGKVRLVDSLDQMSLVQEGDVLVTDMTDPDWEPVMKRASAIITNRGGRTCHAAIIARELGIPAIVGCGNATEVLKDGTTITASCAEGETGYVYQGELNYEVRRSAVDELPILPTKVMMNVGNPERAFDFAQLPNEGVGLARLEFIINKMIGIHPKALLNFDTQSDELKAQIQEKIKGYNDPIDFYVSKLTEGISTIAAAFWPKRVIVRMSDFKSNEYSNLIGGKEFEPHEENPMLGFRGASRYISPVFEDCFELETQAMKRVRNEMGLKNVEIMIPFVRTPSEAASVIELLAKNDLRRGDQGLKVIMMCELPSNAAVLADDFLKYFDGFSIGSNDMTQLTLGLDRDSGDVAHLFDERNPAVKAMLKMAIDAATKAGKYVGICGQGPSDHDDLAKWLMEQGISSVSLNPDTVIDTWLKLGDVNKNH

SEQ ID NO: 19652 - protein, 335 aa, Ralstonia metallidurans CH34
MTIRIGINGFGRIGRMVFRAAVQDFKNDIEVVAINDLLEPDYLAYMLRYDSVHGRFKGEVVVDGGTLVVNGRKIRLTAVKDPAALAWGDVGVDVVVESTGLFLTHDTCQKHLDAGARKVIQSAPSKDDTPMFVYGVNHTQYAGEKIVSNASCTTNCLAPVAKVLNDSFGIKRGMMTTVHAATATQKTVDGPSNKDWRGGRGILENIIPSSTGAAKAMGRVIPALNNKLTGMALRVPTSDVSVVDLTVELAQETSYEKICAAMKAASQGAMKGVLGYTQDKVVSTDFRGEACTAVFDAEAGIMLDSTFVKVVAWYDNEWGYSSKVLEMVRVMGASR

SEQ ID NO: 19653 - protein, 396 aa, Ralstonia metallidurans CH34
MNVLRFADLVAQGRVCGQRVFIRADLNVPQDDAGNITEDTRIRASVLCIRMALDAGAAVMVTSHLGRPTEGEFKPEDSLAPVAARLAALLGRPVPLKSNWVGGVDVQPGEVVLLENCRLNKGEKKNSEALARQMAALTDIFVHDAFGTAHRAEASTYGIAQFAPVACAGPLLAAEIDAIGKALAAPKRPLVAIVAGSKVSTKLTILQSLAKNVDGLIVGGGIANTFLLAQGLPIGKSLAEPDLVDEARAVIDAMKARGAEVPIPVDVVCAKAFKADAPATVKAVAEVDDDDLILDIGPQTATLLAHKLAAAGTIVWNGPVGVFEFDAFANGTKTIARAIAASDAFSIAGGGDTLAAIAKYGIDKDVGYISTGGGAFLEVLEGKTLPAFEILARRAQ

SEQ ID NO: 19654 - protein, 254 aa, Microcystis aeruginosa PCC 7806
MKLLPAEYQHLQDKVAIVTGASRGIGKAIALELASQGATVVVNYAKSSSAADAVVEEITAAGGKAIALQADVAKSEEVDNLVDSAKEKFGHIDVLVNNAGIARDTLMLRMKLEDWQAVIDLNLTGVFLCTRAVGKLMLKQKSGRIINITSVSGLMGNPGQSNYSAAKAGVIGLTKTLAKEFASRGITVNAVAPGFIETDMTHDLKADEILKYIPLSRYGKPEEVAGMVRFLAADPAAIYITGQVFNVDGGMVMA

SEQ ID NO: 19655 - protein, 559 aa, Wolbachia endosymbiont of Drosophila ananassae
MLSAAVFIVIAFWKMNISPVLGYFVAGAVIGSHGFNLIHSAEAMDNLAEFGVVFLLFIIGLELTFERLIAMRIHVFGFGSLQVIVTMVAIWCIALAFGVNTNIATVIGGGLALSSTAIVLQVLQEKGSQASQVGRLSIAVLLMQDFAVVPLIVLVPLLTGNSEHSLISSLAGSLVQAAIALVLIFITGRLLLRPLFSVIAKMESNEIFISTTLLIVLGAAFITEQFHLSLALGAFVAGLLVAETEYRHSVEHAVLPFKDLFLGLFFMTVGMSINTELLLNKLPLITLLSIILIVLKTSIIYILCRFFGFKSAPAIQAGLLLSQGGEFAFILFRLADELNVLPSEIAQVLMMVTTVTMAFTPLLSGLGDWIANSFSTEKTILDDEAVETDTQDLYNHVIVAGFGRVGYMVTKMLTAEHLSYVVVDIQSKIVKEGKSDSFPIYLGDVTRCEILKSVGIERAQALVISIKNEVTIKKVVSLVAANFPHVNIVIRLPDLSNVEVYRDLGASKIIPETSEIGLQLGGAALSLSGISESGVTSLKSRFRKGNYSMLKDLGSDKDE

SEQ ID NO: 19656 - protein, 412 aa, Shigella flexneri 2a str. 2457T
MPQQNYLDELTPAFTPLLAIKEASRCLLCHDAPCSQACPAQTDPGKFIRSIYFRNFKGAAETIRENNALGAVCARVCPTEKLCQSGCTRAGVDAPIDIGRLQRFVTDFEQQTGMEIYQPGTKTLGKVAIIGAGPAGLQASVTLTNQGYDVTIYEKEAHPGGWLRNGIPQFRLPQSVLDAEIARIEKMGVTIKCNNEIGKTLTLEQLKAENRAVLVTVGLSSGSGLPLFEHSDVEIAVDFLQRVRQAQGDISIPQSALIIGGGDVAMDVASTLKVLGCQAVTCVAREELDEFPASEKEFASARELGVSIIDGFTPVAVEGNKVTFKHVRLSGELTMAADKIILAVGQHARLDAFAELEQQRNTIKTQNYQIRDPQVFAAGDIVEGDKTVVYAVKTGKEAAEAIHHYLEGACSC

SEQ ID NO: 19657 - protein, 474 aa, Pyrococcus furiosus DSM 3638
MPRLIKDRVPTPERSVGERVRDFGEVNLGYSWELALREAERCLQCPVEYAPCIKGCPVHINIPGFIKALRENRDNPSKAVREALRIIWRDNTLPAITGRVCPQEEQCEGACVVGKVGDPINIGKLERFVADYAREHGIDDELLLEEIKGIKRNGKKVAIIGAGPAGLTCAADLAKMGYEVTIYEALHQPGGVLIYGIPEFRLPKEIVKKELENLRRLGVKIETNVLVGKTITFEELREEYDAIFIGTGAGTPRIYPWPGVNLNGIYSANEFLTRINLMKAYKFPEYDTPIKVGKRVAVIGGGNTAMDAARSALRLGAEVWILYRRTRKEMTAREEEIKHAEEEGVKFMFLVTPKRFIGDENGNLKAIELEKMKLGEPDESGRRRPIPTGETFIMEFDTAIIAIGQTPNKTFLETVPGLKVDEWGRIVVDENLMTSIPGVFAGGDAIRGEATVILAMGDGRKAAKAIHQYLSKEK

SEQ ID NO: 19658 - protein, 507 aa, Candida albicans SC5314
MSFDSFGDYATIVVFGASGDLAKKKTFPALFGLFREKQLPSTVQIIGYARSHLEDEEFKQRISEHFKGGDEKTKTEFLKLVSYISGPYDTDEGYKKLESRCQEYEKANKDKNDSYTPERLFYLALPPSVFTTVCEKVKKNVYPPEESKGKLRIIIEKPFGRDLDTYREMQKEISPLFTEDEIYRIDHYLGKEMVKNLLVLRFGNELFSGVWNNKHISSIQVSFKEAFGTEGRGGYFDTIGIIRDVMQNHLLQVLTLLTMERPVSFDPEAVRDEKVKVLKAFDAIDINDVILGQYTKSEDGKKPGYLDDKTVNPDSKAVTYAAFRVNIHNERWDGVPIVLRAGKALDESKVEIRIQFKPVAKGMFKEIQRNELVIRVQPNEAIYLKINSKIPGISTETSLTDLDLTYATRYSKDFWIPEAYEALIRDCYLGNHSNFVRDDELDVSWKLFTPLLNAVEDPAKKFELQYYPYGSKGPKDLRKYLNEHGYIFSDPGTYQWPLTSPNVKGKI

SEQ ID NO: 19659 - protein, 559 aa, Pseudomonas fluorescens
MTTLRIHGMTCASCADRVRDALEGISGVHRADVSYAGGKAEMTADGRVSREQMQAAVEALGYQASFEVASLQPRPGQLDKALGWLRSDTEVGKNGDALHIAVIGSGGAAMAALKAVEAGARVTLIERGTIGGTCVNVGCVPSKIMIRAAHVAHLRRESPFDDGMPATPPTVLRDGLLAQQQGLVDELRHAKYEGILESTPAITVLRGTARFQDGHTLSVELVEGGGREVRFDRCLIATGAGRAVPPIRGLQDTPYWTSEEALASASIPQRLAVIGSSVVALELAQAFARLGSRVTILARNSLFFREDPAIGEALTAAFRMEGIDVLEQTQASQVTLANGEFVLTTNHGELRADQLFVATGRTPNTQSLNLEAAGVLLDERGAIQIDQGIGSSAVDIYAAGDCTNQPQFVYVAAAAGTRAAINMTGGERTLNLDAMPAVVFTDPQVATVGYSEAEAQRAGLETDSRTLSLDNVPRALANFDTRGFIKLVAEAGSGRLLGVQAVAPEAGELIQTAVLAIRNRMTVQELADQLFPYLTMVEGLKLAAQTFTKDVKQLSCCAG

SEQ ID NO: 19660 - protein, 508 aa, Coprinopsis cinerea okayama7#130
MIVSGKLDLANANLGDLQASACPTSDPTFQWIRGELLGKGSYGRVYLALNATTGEVMAVKQVELPKTPSDKMKPQQLDVMKALKFEGDTLKDLDHPNIVSYLGFEESQDYLSIFLEYVPGGTVGSLLVKNGRLREEVTKSWLRQILQGLDYLHGKGILHRDLKADNILVDHSGVCKISDFGISKKAGEINRAKAHTGMKGTSFWMAPEILSPGEKGYDVKVDIWSVGCVAVEMWTGKRPWYGHEWWPVLMKVAEDKSPPPIPEDIPMGHLAQSFHNQCFRPDPADRPHASVMLKHPYLEIQSPWVFNWDDLADNSRPPRIYPELVPPVVRERTVTQSTFKANGPPTEKPRAHKPPLEPLKIPAYGPTSTQRKPSVNGAGPPVVWITPPNTPRRTAKPEDSSASTSTSDAAPWKSTSKRRLVIVNPDLDDDIGPAPQNTPPKPKFVYTPPPLPDPPQPPTFFHADTPKATPEPLVSSPRSVPCTPPRLALPFKAKGIQPRQITHGTYYL

SEQ ID NO: 19661 - protein, 584 aa, Burkholderia xenovorans LB400
MSVPTHGALRAPFTSLRFARILTVSAMLAAFTGGALAPTAALAKTPLPKAVFDASAVAVPDRYSADTAQQIFAAGGNAVDAAVAIAFTLAVTCPDAGNLGGGGFMTMFVDGKPYFLDYRERAPQQATRDMYLDDKGNLLPGMSAVGHRAVAVPGTVEGMWEAQRRFGKLKWKQVLAPAIRYATEGFQVEPWLQQRRDAAAKSFAGKTNFDAYFSGLKAGVTYRQPELAQTLSRIASDGGREFYEGRTADLIAQQMYGHGLVTKQDLIQYKAVWRQPLTADWNGYRVVTAPPPSSGGIGLIQMLKMKADLKQAFDGLDLNSVPYIHLIAQIEDRVFGDRQQYLADPDSFKVPVDKLIDDAYLAQRADEVKPDEVPGAAPVTPGLGDAAPEKAQTTHFSVVDKWGNAVSNTYTLNGDFGSGVVVDGGGFLLNDAMDDFVTKPAGASPSGAGSAEVNTVAPGRRPLSSMTPTILLKDDKVSLVIGTPGGSRILTSIFQVMTDLYDFNLPPADALAAMRFHHQLLPQKTIYFEPYRPITGELAEQLQAKGYTLEGQSFNGDVQMIRIEGATPEPAADPRGVGVARVMH

SEQ ID NO: 19662 - protein, 260 aa, Bacillus clausii KSM-K16
MAETKKTAVVAGGGQNLGEHISWRLAQEGYHVVVADLQGSRAEAVAEKIANQTGSKTLGIGFDATVEDEVAYVMETAANTFGSLDLLVYNAGVARSAKIDHFPTKDWQMALDVNLTGYFYCAREASKIMIKQNSGNIIQINSKSGKVGSKHNVAYSASKFGGVGLTQSLALDLAEHNIRVNAIMPGNLLSSPMFQSLIPSYAKKLGIKESEVEQVYIDKVPLRRGCTYEDVANAVVFYSSDKAAYMTGQSINVTGGQVMF

SEQ ID NO: 19663 - protein, 472 aa, Ralstonia metallidurans CH34
MRRNRNAKIVATLGPSSSDKDTIRRLFAAGVDVFRLNFSHGDEAAHRASFAILRELEREAGRPIGILADLQGPKLRVGTFAAGSVMLDESQPFRLELDTAPGDARRVGLPHPEIFAALAPGAELLLDDGKLRLIVERCGADFADTRVVAGGKLSDRKGVNVPGVLLPISALTAKDRRDLALALDLGADWIALSFVQRPEDVVEARKLIGERAAIVAKLEKPSAVEQLEAIAECADAVMVARGDLGVELPAERVPGIQKRILRTCRRLGRPVIVATQMLESMVTSPVPTRAEASDVATAIYDGADAVMLSAESAAGRYPVEAVDMMSRLITEVEGDPQYLQLMNASRPSAPAGAGAADAVCCAVRHAVALMHASAIVCYTSSGHTSLRVARERPEAPVLSLTPHLRVARRMALAWGIHSVHIEDVADVDQMTAKACAVACQEGFAQGGQTLVVIAGVPFGTPGTTNLMRIATV

SEQ ID NO: 19664 - protein, 272 aa, Ralstonia metallidurans CH34
MDPTPLPPHPVRGQRRRLLVAGNWKMNGSLAGVQALAAAIADGAVARLDRVQLVLFPPFTYLPEAQRRLGASGMAWGAQNVSGHEDGAFTGEVSAQMLREFGCACVLVGHSERRTLFGENDAVVARKFLAVRQAGMTPVLCVGESLPEREQGATEDVVARQLQAVLDLAGASAFADAVVAYEPVWAIGTGKTATPAQAQDVHAFIRGRLAEADPAIAASLHVLYGGSMKRANARELLAMPDIDGGLLGGASLNVDEFMAVAITAQRLAQENT

SEQ ID NO: 19665 - protein, 219 aa, Ralstonia metallidurans CH34
MTQDEIKAMVARAALPHVLPGSIIGVGTGSTVNHFIDALSSLREGIAGAVSSSNATTARLRGHGIRVLEAGEVEQLALYVDGADEIDPHGHMIKGGGAALTREKIVADLAQRFLCIADASKKVEVLGRFPLPVEVIDVAATRIARRFAAIGGRAVLRKGVVTDNGHPILDVHGLAIADPPALEAEINQWPGVVTVGLFARHRAHACLLGTPEGVLTLQF

SEQ ID NO: 19666 - protein, 432 aa, Candida glabrata CBS 138
MSEESDALLNRGSKSNDMGENSQAKYIPRPVNSDRSISDSKDGKLGIIDSKTKGISNIAKVTGRQIRNGAQRTSRTAQKLKLLPEEAFHRDEEVSELRDRDVYSQVNRITDKNARRDAEKLGKAHRHLLPRCTSYCTASSYNMKDLIRWLKDSKKTHHTHPKLFDECLYTPFLYNDWRGDKRFEHEDVIRLDDEGGEINVSDKHPDIFIFEYGVIVLWGFTEREEKAFLNDLEKFEKEKLAEEDIQIEEFNYYVTQSYQPRIYNDFITLRDGSNYMIKLSISHAIAQSVKISLFEELVDNTIEDTQDIPQEIASSGKVSMSKEEIMKSIGELFILRININLHGSVLDSPEIMWSEPQLEPIYQATRGYLEINQRVALLNQRLEVISDLLQMLKEQLGHSHEEYLELIVIVLVVVEVVVSLVNIAVDMIANRT

SEQ ID NO: 19667 - protein, 473 aa, Mycobacterium avium subsp. paratuberculosis K-10
MTITAPETVGESLDPRDPLLRLSNFFDDGSVALLHERDRSGVLAAAGTVNGVRTIAFCTDGTVMGGAMGIEGCSHIVDAYDTAIEEQSPIVGIWHSGGARLAEGVKALHAVGLVFEAMIRASGYIPQISVVVGFAAGGAAYGPALTDVVVMAPESRVFVTGPDVVRSVTGEDVDMASLGGPETHHKKSGVCHIVADDELDAYERGRRLVGLFCQQGHFDRTKAEAGDTDIHALLPESPRRAYDVRPIVTAILDDETPFDEFQANWAPSMVIGLGRLSGRTVGVLANNPLRLGGCLNSESAEKAARFVRLCDAFGIPLVVIVDVPGYLPGVDQEWGGVVRRGAKLLHAFGEATVPRVTLVTRKTYGGAYIAMNSRSLNATKVFAWPDAEVAVMGAKAAVGILHKKKLAAAPEHEREALHDQLAAEHEKIAGGVDSAIEIGVVDEKIDPAHTRSKLTEALAQAPARRGRHKNIPL

SEQ ID NO: 19668 - protein, 320 aa, Physcomitrella patens subsp. patens
MAASILRVFSNWSPSTSLLQPLRGPKLRHAALWNSQTHSIRRLCVRSLSVQDEGNAIESLAMDLALKAGTMIKDKSGLALQVDTKESRFDLVTEVDKACEDFLRTQVQEKFPNHFYLGEETFTDQEFERLRSGLKDSEWTWIVDPIDGTLNFVAGMPLSVVSIGVALGQNMEIGVVYNPFNNELFYARRGQGAYLNGMPIKVLPHDTELEDSTVSVGFPSKPEWRLRMLEDIGKVAPNARSVRALGTAALHMSYVGAGRIGCFFEHNLKPWDVAAARLIVEEAGGKVTDMNGNVLPLTAGSILASNGGILHDRIVQLVSD

SEQ ID NO: 19669 - protein, 580 aa, Coccidioides immitis RS
MAPRKAAATRSSTRIKSAPTTTTAIVPKKAGVKKATAVPTATKNQKASAAALKSTKAASTKATAAKDTTTKAPRKAKADEAPVSKKRKVVSEDETEPRPKKARAAKEEVPKPKRTRVTASPALKPPKPKVVINEAPTEKLNIYVFGEGSSGELGLGTAKNAVDVKRPRLNPLLLADTIGVVQIATGGMHCVALTHDNKIYTWGVNDQGALGRDTTWEGKLKDIDDAGSDSDSDDGSDSGMNPKEATPTPIPADYFPEGTIFVEVAAGDSSSFALTDDGFVYGWGTFRGNEGILGFDATTRVQTTPKLIPSLKKIKHIACGDNHALALDTKGAVFAWGSGQQNQLGRRIVERTKLNGLHPREFGLPKNITYIGCGSFHSFAIHQTGKVYSWGLNTYGETGIPQGAGSDEAVILHPEVVKSLKDKNVIQLCGGSHHSLAVTKDGECLVWGRVDGFQTGLDIKSLPDDAVIKDDRDRARILSVPTAVPGIDAKFVAAGADHSIAIAKDGRAWTWGFSANYQTGQGTDDDIEVATVVDNTAVRGKMLNWAGAGGQYSVLAGPAVTINGVAANADAPNGNVQGAN

SEQ ID NO: 19670 - protein, 751 aa, Ustilago maydis 521
MAAPTPTWGQMHNETNEISETHAPHYEEQHGLQQAHSASDDEKKSPLSSQDRLDSQVPVTGYYDAEKKAVAADEDYQAEDLHSGKQFDLKYFPEEDTQLTIRSLVVGTVLGCVIAASNVYLGLKTGFTFGASLFGAILGYSIIKLMQKTLPEKLGGGFFGPRENCTVQTAATAAGSLTGMFVAAVPAMYQLDLLHDPLKDFGRLLTFSAVSAYYGVFFAIPLRKFYILKQKLIFPSPTATAYTVRSLHAPGGEITAKKQSRALLYSFAAAFTFVVVNQYASGILMDWHIFYWLYSWGWKKALVVDNWGWIIEWTPAFLGAGMLSGMNASFSFLGGSFLMWAMIGPAIIATGQAAGRHTGMLADPPEPLRWAYTSMNFDPNKLPLNSASPRYWGLWPGVLMMLAYSFAEIGMNGPTIYRGVRAGALELYCKITRKEPPSYEDAIADPCEKKDQVPLWAWTSGLLLSIIFTCLVCTLQFHMNLGNVVLAIILAFLFSFVGVQASGATDTNPVGSVAKASQLIVGGALRGQGKTGAAGLLENLIAGSIASSAASHAVDMVGDLKTGHLLRAKPRNQFWAQIFGSFWSIFVSTGLFVLFTKAYPCITKPDADECPFAAPAVAAWKAVAVAVISPKLPVSLSSGMTAIGFAIISVITVVLKYKVVPAKYHVYVPNWNAVGLGFVVPQTYYPIAMCMGATTALIWKNKRPQSFDLLAFAIAAGLIAGEGMAGVFNAILTIVGVDGSIYGTTVGLPPW

SEQ ID NO: 19671 - protein, 624 aa, Synechococcus elongatus PCC 7942
MSPTAAPQKLSKVEDLKARSQYLLEPILSQLQEESTHFNEDGIQILKFHGSYQQDNRDNRVKGQEKDFQFMLRLRSPGGYIPPQLYLTLDQLADDYGNGTLRATTRQAFQLHGILKRDLKTVIRRIVENLGSTISACGDVNRNVMAPPAPFRDRPEYEWARTYANNIADLLTPESGAYYELWLDGEKVLSGEPDPAVLAARRNPKGRVADSVEPLYSDRYLPRKFKIAVTVPGDNSIDLFTQDIGLVVIGNDRGELEGFNVYVGGGMGRTHNKEETFARLADPLGFVPAADIYAAVQAIVATQRDYGDRSNRRHARMKYLIHDWGIAKFKEAVESVFGKAIAPVRELPPFRYRDYLGWHEQGDGKWFLGLPITSGRIKDDGNWQLRSALREIVSRWQLPLLLTGSQDVLIYDVQPGDRAAIDKLLRDRGVHTVEAIDSLQRYAMACPALPTCGLAITESERALPGLLVRIRRLLEEQGLPDEHFVVRMTGCPNGCARPYMAELAFVGSAPNTYQLWLGGSPDQTRLARPFIDRLADGDVETQLRPLFVFFKQSRQAGESFGDFCDRVGFDALRQFSESYQHEAAKPRYRVGLRADVHGRLKAEADKRGVSLTDLACEAIAAYLR

SEQ ID NO: 19672 - protein, 368 aa, Triticum aestivum
HQNFNGRSDTVFCGVFDGHGPHGHLVARKVRDTLPLKLCDLIYDDYGESPTSNSDGSVLEESLSPYPDAEDKSPTFTAQKEEHLEFFDSMKESFRKAFRVMDKELKLHRNIDSICSGTTAVTLIKQAQDLIVGNLGDSRAVLGTRDQNGHLVAHQLTVDLKPDHPREARRIKRCNGRVFAHQDEPDVARLWLPNCNSPGLAMARAFGDFCLKDFGLISVPEVTYRRIMEKDQFIVLATDGVWDVLSNQEVVEVVASCSGRSGAARAVVDLANQTWKFKYPTSKTDDCAVICLFLSKDAAAGGLSGLSVASKGIGSSPGMPPLLRTPQHFSERVIPEDADDECDPNISGDERSLEGLTWMNTLLTLPKI

SEQ ID NO: 19673 - protein, 333 aa, Escherichia coli O157:H7 EDL933
MSKVGINGFGRIGRLVLRRLLEVKSNIDVVAINDLTSPKILAYLLKHDSNYGPFPWSVDFTEDSLIVDGKSIAVYAEKEAKNIPWKAKGAEIIVECTGFYTSAEKSQAHLDAGAKKVLISAPAGEMKTIVYKVNDDTLDGNDTIVSVASCTTNCLAPMAKALHDSFGIEVGTMTTIHAYTGTQSLVDGPRGKDLRASRAAAENIIPHTTGAAKAIGLVIPELSGKLKGHAQRVPVKTGSVTELVSILGKKVTAEEVNNALKQATTNNESFGYTDEEIVSSDIIGSHFGSVFDATQTEITAVGDLQLVKTVAWYDNEYGFVTQLIRTLEKFAKL

SEQ ID NO: 19674 - protein, 479 aa, Escherichia coli O157:H7 EDL933
MSVPVQHPMYIDGQFVTWRGDAWIDVVNPATEAVISRIPDGQAEDARKAIDAAERAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVALGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 19675 - protein, 398 aa, Brucella melitensis 16M
MNIHEYQAKRLLHTYGAPIANGVAVYSVEQAEEWAKTLPGPLYVVKSQIHAGGRGKGKFKELPADAKGGVRLAKSVEEVVANAKEMLGNTLVTKQTGEAGKQVNRLYIEDGADIERELYLSILIDRSVGRPAFVVSTEGGMDIEAVAEETPEKIVTVAIDPAKGVTDEDANKLADALKLEGGAREDGLKLFPILYKAFTEKDMSLLEINPLIVMTNGRVRVLDAKVSFDNNALFRHPDIVELRDLTEEDPKEIEASKYDLAYVALDGNIGCMVNGAGLAMATMDIIKLYGAEPANFLDVGGGASKEKVTAAFKIITADPAVEGILVNIFGGIMKCDVIAEGVIAAVKEVGLKVPLVVRLEGTNVELGKKIINESGLNVISADDLDDAAQKIVAAVKGN

SEQ ID NO: 19676 - protein, 157 aa, Oryza sativa
  misc_feature (91)..(91): Xaa can be any naturally occurring amino acid
SGAPVAVGGARAYHERVVDHYENPRNVGSFENDDPSVGTGLVGAPACGDVMKLQIRVDESSGKIVDACFKTFGCGSAIASSSVATEWVKGXQMEEVVTIKNTEIGKHLSLPPVKLHCSMLAEDAIKAGVKDYEAKKGKLAQKGEEKGGEAMSGKVLS

SEQ ID NO: 19677 - protein, 93 aa, Oryza sativa
  misc_feature (47)..(47): Xaa can be any naturally occurring amino acid
MEQSFIMIKPDGVERGLIGDIISRFEKKGFYLRGMKFMNVERSFAQXHYADLSDKPFFPGLVEYIISGPVFAVLYEKPRVFTSGRFKTPPIIH

SEQ ID NO: 19678 - protein, 408 aa, Brucella melitensis 16M
MATEIRVPTLGESVTEATIGKWFKKAGEAIAVDEPLVELETDKVTVEVPAPAAGVLAEITAKEGDTVEVGELLGQISSDGAAVAAAPAQKKEEAKPAAAAPAAAPVASASSGPAMQPAPAAAKLLAESGLSADQVEGSGKRGQVLKGDVLEAITKGVSAAPAAPVAARPASSADDASREERVKMTRLRQTIARRLKDAQNTAAMLTTFNEVDMSAVMELRNKYKDVFEKKHGVKLGFMGFFTKAVTHALKEIPAVNAEIDGTDIVYKNFCHVGMAVGTDKGLVVPVIRDADQMSIAEVEKELARLARAARDGSLSMADMQGGTFTITNGGVYGSLMSTPILNAPQSGILGMHKIQERPMVVGGQIVVRPMMYLALSYDHRIVDGKEAVTFLVRVKESLEDPERLVLDL

SEQ ID NO: 19679 - protein, 137 aa, Thermus thermophilus HB8
MRLRVVAVGRPRLAYARLGVEEYARRMRRYAPLDLVFVRKGEELLPKAEGHRKVVLDERGRLLTTEELYRRLLAWEGERVAFLVGGAEGHPEAVREEADLLLSLSPLTLQHELALLVLMEQLYRVLTLRAGHPYHRP

SEQ ID NO: 19680 - protein, 213 aa, Frankia sp. CcI3
MSNIAAPRLPVPGPDLRAPGQGGPAFDDQVFNRLLANRIVFLGSVVEDSIANAICAQLLLLNAEDPTRDIFLYINSPGGSVSAGMAIYDTMQFVENDVATVSLGLAASMGQFLLCAGASGKRYSLPHARIMMHQPSGGIGGTASDIAIQAEQMLYTKRMMQERIAFHTGQPIEQIERDSDRDRWFTAEEAKDYGFVDHVVQQARQVPSEGPVS

SEQ ID NO: 19681 - protein, 226 aa, Frankia sp. CcI3
MFHDTLYQQMRHEQARQAAAQPQGRYVLPNIIEKTSRGEYGMDPYSKLLKERIVFLGVQIDDVSANDVMAQLLFLESEDPDRDISIYINSPGGSFTSLTAIYDTMQFVRPDISTICMGQAASAAAVLLAAGTPGKRFALENSRILIHQPSAQGEGQSSDIEIQAREILRMRSLLERMLAVHTGKKEEDIRKDIERDKIFSADEAKEYGLIDEVIKTRKSSRLATAR

SEQ ID NO: 19682 - protein, 704 aa, Arabidopsis thaliana
  misc_feature (376)..(376): Xaa can be any naturally occurring amino acid
MTSIIGAALPYKSPEKAIASSSYSAENDSSPVDAVIFAGTSLVLGTACRYLFNGTRVPYTVVLLVIGIFLGSLEYGTKHNLGKLGHGIRIWNGINPDLLLAVFLPVLLFESSFSMDVHQIKRCMGQMVLLAGPGVLISTFCLGALIKLTFPYNWDWKTSLLLGGLLGATDPVAVVALLKELGASKKMTTLIDGESLMNDGVSVVVFQLFFKMVMGHNSDWGSIIKFLVQNSFGAVGIGLAFGIASVFWLKFIFNDTVAQITVTLSASYFAYYTAQEWAGVSGILTVMILGMFFAAFARTAFKGDSHQSLHHFWYFTTQEMAAYIANTLVFMLSGVIIAESVLSGQTISYKALGHMIQQSSGNSYLSSDTGTRLFCXFLFLTGGIVFLTLVVNGSTTQLLLHLLRMDTLTATKKRILEYTKFEMMKTALKAFENLGDDEELGSADWPTVIRHISSLKDLEGRQVNPHDGYEAGSLDPTNIMDIRVQAAYWEMLDDGRITQCTANVLMQSVDEALDLVSTSSLSDWRGLEPRVHFPNYYKFLQSKIIPHKLVTHLIVERLESACYISSAFLRAHRIARQQLHIFLGNSNIASTVINESEVEGEEAKQFLEDVRDSFPQVLSVLKTRQVTHYVLNHLNGYIKNLEKVGLLEGKEVSHLHDVVQSDLKKLLRHPPSLKLPNVDDLITSNPLLKDRSSFRSLAIGETDA

SEQ ID NO: 19683 - protein, 107 aa, Glycine max
  misc_feature (30)..(30): Xaa can be any naturally occurring amino acid
  misc_feature (53)..(53): Xaa can be any naturally occurring amino acid
HFGYSVRRLDESHRWGEMEMGNTTIAFTPXHQYETDDLTGAVHNPRSCREWVXFVYSDVDAAYKCAVENGAVAVSEPELKEWEQKVGYVRDIDGNVVRMGSHVNPPR

SEQ ID NO: 19684 - protein, 467 aa, Brucella melitensis 16M
MSYDVVVIGTGPGGYVAAIKAAQLGLKVAVVEKRKTFGGTCLNIGCIPSKALLHASEVFAEAGHSFDTLGVEVTPKLNLTKMLAHKDTTVKANVSGVEFLFKKNKITPYIGTGKIVGKGKVSVTSEDGKVEEIEAKNIIIATGSDVAGIPGVKVDIDEKVIVSSTGALSFDKVPGSLIVVGGGVIGLELGSVWARLGAKVTVVEYLDKVLGPMDGEVSKQFQRLLEKQGIAFKLGAKVTGVEKVGKGAKITFEPVKGGDAETLEADAVLIATGRRPYTDGLGLQEAGVAVDERGRVAIDDHWRTNVEGIYAIGDVVQGPMLAHKAEDEGIAVAEIIAGQAGHVNFDVIPSVVYTQPEVASVGKTEEELKAAGINYKVGKFPFTANGRARAMLHTGGFVKILADKATDRVLGAHILGYNAGEMIHELAVLMEFGGSSEDLARTCHAHPTMSETVRESALATFAKPIHM

SEQ ID NO: 19685 - protein, 801 aa, Streptomyces avermitilis MA-4680
MAGLSTPHQFDHPTALAAAVLTDDNRVIVMVIGVVALAALVVAGILVRQVLAAGEGTDSMKKIAAAVQEGANAYLGRQMRTLGVFAVVVFFLLMLLPADDWNQRAGRSVFFLIGALFSATTGYTGMWLAVRSNVRVAAAAREATPAEGEPEKDLTAVSHKAMKIAFRTGGVVGMFTVGLGLLGASCVVLVYAADAPKVLEGFGLGAALIAMFMRVGGGIFTKAADVGADLVGKVEQGIPEDDPRNAATIADNVGDNVGDCAGMAADLFESYAVTLVAALILGKAAFGDSGLAFPLIVPAIGVLTAMIGIFAVAPRRADRSGMSAINRGFFVSAVFSLALVAVAVYVYLPGKYADLDGVTDVAIRAKDGDPRILAMVAVAIGIVLAALIQQLTGYFTETTRRPVRDIGKSSLTGAATVVLAGISVGLESAVYTALLIGLGVYGAFLLGGTSIMLALFAVALAGTGLLTTVGVIVAMDTFGPVSDNAQGIAEMSGDVTGAGAQVLTDLDAVGNTTKAITKGIAIATAVLAASALFGSYRDAITTAANDVGEKVSGAGAPMNLMMDISQPNNLVGLIAGAAVVFLFSGLAINAVSRSAGAVVYEVRRQFREHPGIMDYTEQPEYGRVVDICTKDALRELATPGLLAVLAPIAIGFTLGVGALGAYLAGAIGTGTLMAVFLANSGGAWDNAKKLVEDGHHGGKGSEAHAATVIGDTVGDPFKDTAGPAINPLLKVMNLVALLIAPAVVKFSYGEDKNLGVRIAIAVLSILVIVGAVYISKRRGIAVGDEGNAERVTKSADPAVVS

SEQ ID NO: 19686 - protein, 137 aa, Frankia sp. CcI3
MSVERTLILVKPDGVSRGLVGEVVGRLERKGLTLVALELRTLERSVAETHYGEHASKPFFGELVDFITSGPLVALVAEGPRAVEASRGLIGATDPVKAAPGSLRGDYALEIGQNLVHGSDSPESAKREIDLFFPGLS

SEQ ID NO: 19687 - protein, 481 aa, Pseudomonas fluorescens PfO-1
MKPIRLRADVLAGLTTSFALLPECIAFALVAHLNPLMGLYGAFIICTLTALFGGRPGMVSGAAGSMAVVIVALVVQHGVQYLLATVLLGGLIMMAFGLLRLGKLVRMVPHPVMLGFVNGLAIIIALAQLEHFKSGEQWLSGTPLYLMTGLVLLTMAIVYILPRLTRSVPPALVAILGVGLLVYVLGLPTRTLGDMAHIAGGLPTFALPDIPWTLETLRIIAPYAILMALVGLLETLLTLNLTDEITETRGYPDRECVALGAANVVSGAFGGMGGCAMIGQTVINLSSGGRGRLSGVVAGVLILLFILFLSPLIERIPLAALVGVMFVVSQQTFAWASLRVLNKVPLNDVLVIIAVTTITVFTDLATAVLCGIIIAALNFAWQQARELYADEHLEADGSKLYRLHGTLFFASTTPFLNQFDPASDPQRVTLDCRHLSFVDYSAIAALKTLRERYAKAGKQLQVFHLSERCKKLLKRAGVDHD

SEQ ID NO: 19688 - protein, 121 aa, Glycine max
MASSMLSSAAVGTSPAQATMVAPFTGLKTSAAFPATRKANNDITSIASNGGRVSCMKVCPPDGKKKFETLSYLPDLTEVELGKEVDYLLRNKCTPCAEFQLEHEFVYRDHRSKPGYYDARY

SEQ ID NO: 19689 - protein, 111 aa, Triticum aestivum
  misc_feature (37)..(37): Xaa can be any naturally occurring amino acid
PWMKQEVMKTSSMQKQTRRGLRTRSETFVVVGDSQRXVGIGVKCAKEVVTAIRGAIILAKLYKVAVRRGWWGNKIGLSHSVPCKFSGKCGSVAVLMVSAPRGSVIVEKRVP

SEQ ID NO: 19690 - protein, 420 aa, Listeria monocytogenes str. 1/2a F6854
MSQKIQVENGVLKTPNNPVIPFIEGDGTGPDIWAAAKRVLDAAVKKAYNGEKEIAWKEVLAGEKAFKQTGEWLPQATLDTIDEYLIAIKGPLTTPIGGGIRSLNVALRQELDLYVCLRPVRYFKGVPSPVKRPEDTDMVIFRENTEDIYAGIEFKEGSIESKKLIDFLKSEFGVDKIRFPETSGIGIKPISKEGTERLVRSAIEYAIKEGRKSLTLVHKGNIMKFTEGAFKNWGYNLCEREYGDKVFTWNEYDRIKEAEGTEVADAKQNEALAAGKILVKDSIADIFLQQILTRPAEFDVVATMNLNGDYISDALAAQVGGIGIAPGANINYLTGHAIFEATHGTAPKYAGLDKVNPSSVILSGTLLLEHIGWGEAAALINQSMEKTIAAKTVTYDFARLMDGATEVKCSEFADELIKNF

SEQ ID NO: 19691 - protein, 206 aa, Alkalilimnicola ehrlichei MLHE-1
MNPIYFQARFLTSAPDLRRMPPDQGREVAFAGRSNVGKSSAINTLTNQKSLARTSKTPGRTQLINVFPITDEAALVDLPGYGYAKVPAAVRRRWDQVLPEYLAGRRALRGVVLVMDLRHPLTDFDRQMLDWCGHIGVPLHVLLTKADKFKAGAARNRGQNVGRQLRAEWPGVTWQIFSASKRMGVDEAHARLDEWLGLGPAAGEGR

SEQ ID NO: 19692 - protein, 165 aa, Oryza sativa Japonica Group
MRPASSPVPAVLTAPATAATAAIAVKPTPPQRALQASRRELVVAAAAVALWPCGGAARAASDDEYVSETKDVIGKVRSTINMDRADPGVADAVAELRELSNSWVAKYRREKSLLGRPSFREMYSALNAVSGHYISFGPTAPIPNKRRARILEEMDTAEKALLRGR

SEQ ID NO: 19693 - protein, 405 aa, Sinorhizobium meliloti 1021
MEEFHKVRRLPPYVFEQVNRLKASARAAGADIIDLGMGNPDLPTPQSIVDKLCEVVQDPRTHRYSSSKGIPGLRRAQAAYYARRFGVKLNPETQVVATLGSKEGFANMAQAITAPGDVVLCPNPTYPIHAFGFLMAGGVIRSISVEPDESFFPPLERAVRHSIPKPLALILNYPSNPTAQVATLDFYKDVIAFAKKHDIIVLSDLAYSEIYFDDAPPPSVLEVPGATDVTVEFTSMSKTFSMPGWRMGFAVGNERLIAALTRVKSYLDYGAFTPIQVAATQALNGDGSDIAEVRAIYKRRRDVMVESFGKAGFEVPPPPATMFAWAKIPEKFRHLGSLEFSKLLVEKADVAVAPGIGFGEQGDDYVRLALVENEHRIRQAARNIKRFLSSADETMHNVISLNAHR

SEQ ID NO: 19694 - protein, 825 aa, Trichodesmium erythraeum IMS101
MTNILEIKQETTSTKEKSLILWFDEVSINDIPLVGGKNASLGEMMQQLAPKGINIPKGFATTAYAYRAFIKTAGLEAKLRQLFADLDVENIKNLQQRGKKARALIMKTPFPAELERAITINYKTLCYFCGQDTDVAVRSSATAEDLPDASFAGQQETYLNIHGIKSLLKAVHKCFASIFTDRAISYRTSRNYDHFDIALSVGIQKMVRSDLATSGVMFSIDTETGFPNAALITAAYGLGENVVQGAVNPDEYLVFKPTLQQGFSSILNKRLGTKAVKMVYDGSNSTKNISVPYRKQQQFALSDDEILQLAQWVVVIENHYSQVRGSYTPMDIEWAKDGNNDTLYIVQARPETVQSQKSSNVLHTYHLKDQGKVLVTGRAVGQGIAQGNVCVILDKHKIDKLQPGEVLVTNKTDPDWEPIMKKASAIVTNQGGRTCHAAIIAREMGIPAIVGCENATQLLEDAQAVTVSCAEGEVGMVYEGLLPFEDVETVLDDLPETRTPIFMNVGNPEEAFRLSAIPNDGVGLARLEFVIANHIGVHPLALLNFDEVMDEVEKAKIAKLTMGYETKADFFIDRLAYGMGTIAAAFYPKPVILRMSDFKSNEYANLLGGKQFEPDEENPMIGWRGASRYYHPKYRDAFGLECVALKRVRDQMGLVNVIPMIPFCRTPEEGEKVLREMSKYGLERGQNGLQVYVMCELPSNVILVEQFAEVFDGFSIGSNDLTQLVLGLDRDSALVAQVFDERHDAVRRMIEMAITTAHECGRKIGICGQAPSDYPEFARLLVELGIDSISLNPDSVLKTRFEVAKLEVNSSITPRTVSFSEHMGR

SEQ ID NO: 19695 - protein, 627 aa, Zea mays
  misc_feature (232)..(232): Xaa can be any naturally occurring amino acid
MNGQTPMGLAAAAAAAVRPCRRRLLSSASAAAASKTAARTATPLFPRLPHPHHPPYGRRLPFLVSAASQSQASQTGPDTHVLVPVPSDPRAAVSGNLPFFDRVLFPDSFPLETPPVKEEDAAAAQTDEAVAPAAPLRQETETEREAWRLLRRAVVSYCGEPVGTVAAEDPECTETLNYDQVFIRDFVPSALAFLMRGETEIVRNFLLHTLQLQSWEKTVDCYSPGQGLMPAXSFKIRTLPLDENNEGFEEVLDPDFGEAAIGRVAPVDSGLWWDILLRAYSKITGDSALLERVDVQTGIQLILSLCLADGFDMFPTLLVTDGSCMIDRRMGIHGHPLEIQALFYSALRCSREMLVVNDGSKNLIRAINNRLSALSFHIREYYWVDMKKINEIYRYKTEEYSHDATNKFNIYPEQIPSWLVDWIPEKGGYLIGNLQPAYMDFRFFSLGNLWAIASSLTTPKQAEGILSLIEEKWDDLIANMPLKICYPAMEDDEWRIITGSDPKNTPWSYHNGGSWPPLLWQFILACIKMGRPELARRAITVAEERLSDDKWPEYYDTRSGRFIGKQSRSYQTWTIAGFLTSKMLLENPELASILTCDEDLELLEGCACCLSKKRTRCSRRAAKSHAA

SEQ ID NO: 19696 - protein, 487 aa, Bordetella petrii
MPSKDVSTPGGLRRTLASRHLSMIAVGGSIGTGLFVASGNTIAQAGPGGALLGYALIGLMVYFLMTSLGELAAAMPVAGSFSTYGSRYVEPGFGFALGWNYWYNWAVTVAVDLVAAQLVMAYWFPDVPGVYWSALFLAITFGLNALSARGFGEAEFWFALIKVIAVLVFITLGVLMLLGIIRGGETGGWQNWTVGDAPFAGGFAAMIGVAMVVGFSFQGTELIGIAAGESKDPARNIPRAVRQVFWRILLFYVLAIGVIGLLIPYTDPQLLRNEVTDISVSPFALIFDRAGLLAAASVMNAVVLTSVLSAGNSGMYAATRMLYALACEGKAPAVFGRVSARGVPVLALLATTALAALCFLSFVFSPNKVYIWLLNTSGMTGFIAWLGIAISHYRFRRGYVAQGNRLADLPYVSPFFPFGPVFAFVLCLIITLGQNYQAFLQDRIDWVGAAATYIGIPVFLLIWAGYRLARGSRFVRYHDMKFPVLTR

SEQ ID NO: 19697 - protein, 352 aa, Listeria monocytogenes str. 1/2a F6854
MQVSQGLMVARGDLGVEIPAEEVPIVQKELIRKCNKLGKPVITATQMLDSMQRNPRPTRAEASDVANAIFDGTDAIMLSGETAAGDYPVEAVKMMAKIAVRTEEVLVAQDKFALKLHENTDMTEAIGQAVGHTAKNLNVQTIVAATQSGHTARMISKYRPKSHIVAVTFNEHVYRGLALSWGVYPRLATPVSNTDEMFDLAVKESLASGVAKQGDLIIITAGVPVTESGTTNVMKIQLIGEKVVKGQGIGSKSVIGKAIVAKSNAEALEKAEEGGILIVKTTDKEILPAFEKSAAVVVEEGGLTSHAAVVGINLGIPVIVGAKDATSLVKDGEIITVDSRQGVVYNGKTATH

SEQ ID NO: 19698 - protein, 417 aa, Streptomyces avermitilis MA-4680
MGRGVTRRRAVGNGVLVSTTETLIASADAHSAHTYHPLPVVVATADGAWMTDVEGRRYLDLLAGYSALNFGHGHRRLIDAARAQLERVTLTSRAFHHDRFAAFCTQLAELCGMEMVLPMNTGAEAVETAVKTARKWGYRVKGVPAEMAKIVVAGNNFHGRTTTIISFSTDPEARADFGPYTPGFEIVPYGDLTAMRSALTENTVAVLLEPIQGEAGVLVPPAGYLAGVRELTRDRNVLFVADEIQSGLGRTGRTFACEHEGVVPDVYVLGKALGGGIVPVSAVVASSEVLGVFRPGEHGATFGGNPLACAVALEVIAMLRSGEYQARAAELGEHLHRELGVLAGTGRVTAVRGRGLWAGVDVDPAYGTGREISEKLMDRGVLVKDTHGSTIRIAPPLVISKEDLDWGLAQLRGVLGV

SEQ ID NO: 19699 - protein, 481 aa, Chlamydophila abortus S26/3
MIARTKIICTIGPATNTPEMLEKLLDAGMNVARLNFSHGTHESHGQTISLLKELREKKGAPLAIMLDTKGPEIRLGKIPTPIQVSRGQKITLLEKEIEGSLEGGVTLHPQCVFPFVREGTDVLIDDGYLQAVVTSAGNDWLELEFINSGELKSHKSLSIREIDLALPFMTDKDIHDLKFGVDQGVDVIAASFVRCAEDIESMRKCLADCGRGDMPIIAKIENRLGVENFPQIAKVADGIMIARGDLGIELSVVELPSLQKFMAKISRETGRFCITATQMLESMIRNVLPTRAEVSDIANAIYDGTSAVMLSGETASGSHPIAAVKIMRSVIQETEKNLNYMSFLEINDSESAVKVSPYLQSIGLSGIQIAEKAAAKAIIVYTESGGSPIFLSKYRPRFPIIAVTPNLSVYYRLALEWGVYPMLTEESDRTVWRHQACVYGIERGILSNYDKVLVLSRGAQMKDTNNLTLTTVNDIISASAK

SEQ ID NO: 19700 - protein, 520 aa, Neurospora crassa
MVHLTIIPKEDEIRDGLDIPLTGALKAVHLQLANDEDRFTTSVYGSKFAAADLPRHEMPDEEMPKEVAYRMIKDELSLDGNPLLNLASFVTTYMEEEAEKLMTESLPKNFIDYEEYPQTADIQNRCVSMIGRLFNAPVKDAEASSAVGTSSVGSSEAIMLGVLAMKKRWKNKRIAEGKPADKPNLIMSSAVQVCWEKATRYFEVEEKFVYCTPDRYVIDPKETVDLVDENTIGICCILGTTYTGEYEDVKAVNDLLVERGLDTPIHVDAASGGFVAPFVVPDLEWDFRLKNVVSINVSGHKYGLVYPGVGWVVWRSAEYLPQELVFNINYLGADQASFTLNFSKGASQVIGQYYQLIRLGKHGYRAIMSNLTRTADYLAESLAALGFIIMSQKSGQGLPLVAFRLKEDPDRTYDEFALAHQLRVRGWIVPAYTMAPKTEGLKMLRIVVREDFSRNRCDGLISDIRSCQGILEQMDKETVKKQQEFIHKHHVVSGKASHNHPKYHILWSESNSSRNQATPE

SEQ ID NO: 19701 - protein, 133 aa, Brassica napus
LKCERCGEVTQKETCVTLNETFTPPGGRGTCHLVQKCKFCGREGNVTMIPGKGRPLTLEDSEGGEHAPLMVFDCRGYEPIDFGFGGFWKAEAESGTKFDEIDLSSGEEFTEYDEKGKCPVMISNFRASFTVTK

SEQ ID NO: 19702 - protein, 412 aa, Methanosarcina barkeri str. Fusaro
MTSRDFLTIDDFDTHGKTILVRVDLNSPMDPQGNILDDMRIRSHIATLKDLEDAKVVLLAHQSRPGKKDFTTMKPHANLMSKYLGKQVLYVDDIFGTYAKTRIASMENGDVILLENVRFYSEESLERTPAEQAKTYPVKKLAPFVDIFLNDAFAVSHRSQLSVVGFTEVLPTGAGRVMEKELTSLDRGIKGGERPTIFVLGGAKVDDSLHVAENVLSNGGADRVLLTGVVANVALAASGIDIGKVNLDFIKSQGYEDQIEKAKSILTKFKDKVGLPRDVALNDNKKRVELPVSELNSNSLPINDIGLETIVDFTSEIASAKTVILNGPAGISEVAEFALGTHEIIKAAIKSEFSIIGGGHISAEVEHLGLAHRFSHISTGGGALIDYLSGVKLPGVEALKSAAKRYEEAKKI

SEQ ID NO: 19703 - protein, 463 aa, Pseudomonas putida GB-1
MNAQSSHQLKRGLSTRHIRFMALGSAIGTGLFYGSASAIKLAGPSVLLAYLIGGAAIYMMMRALGEMAVHNPVSGSFGHYASQYLGRYFGFLTGWSYAFSMLVVCLADVTAFGVYMGLWFPETPAWIWVLGIVFFIGALNLCSVKVFGEMEFWLSLLKVTAIVAMIVAGGAVLLLGIQLNDDAGTVAGISNLWSHGGFFPNGIGGMIASFTVVMFAFGGVEMIGITAGEARDPKRVLPKAINSVPLRILLFYILTLLVLMSIYPWTGIGSHGSPFVQIFSGLGISSAATVLNIVVISAAVSAINSDIFSAGRMMYGMAQNGQAPAGFASLSRFGVPWMTVAVMGVALLLGVVLNYLVPEGLFLVLAAVVTFSIVWVWLMILLSQVAMRRGMSKEEVAALDYRVPLWPVGPACAIAFMVFIFGVLGWFPASRTAMYVGVGWLILLSLGYWLWGVRTPRPVSASA

SEQ ID NO: 19704 - protein, 496 aa, Staphylococcus epidermidis ATCC 12228
MENKNNNVDRGNLKQNLSEKFVWAIAYGSCIGWGAFILPGDWIKQSGPIASSIGIVIGALLMILIAVSYGALVEKFPVSGGAFAFSFLSFGRYVSFFSSWFLTFGYVCVVALNATAFSLLIKFLLPNVLNNGKLYTVAGWDVYITEIVIATVLLIVFMLITIRGASVSGSLQYYFCVAMVLVVALMFIGSFFSSHFSLSHLEPLASVDKGWFQSIIMIVSIAPWAYVGFDNIPQTAEEFNFSPNKTFKLIVYSLLAASLTYVVMLLYTGWLSTQATSLNGNLWLTGAVTQDAFGFIGLAVLAVAIIMGIFTGLNGFLMSSSRLLFSMGRSGIMPTVFSKLHSKHKTPYVAIIFLVAVSLIAPWLGRTALTWIVDMSSTGVSIAYFITCLSATKLFSFNKQSNTYAPVYKIFGIIGSIVSFVFLCLLLIPGSPAALSIPSYIALGIWLVIGLIFFIIRLPKLKKMNNDELSRLILNHSEDEVLEMVHEPGQSNSTNK

SEQ ID NO: 19705 - protein, 635 aa, Lactococcus lactis subsp. lactis Il1403
MILLQGNGIARTFGDDVLFENINFSLQDHSRIALVGRNGAGKSTLLKIIAGVEEASRGTVSKTKDLTMNYLAQDTGLNSSRTIFAEMLSVFDSLRQMEKQLRQMELQMGELAGDELTALMKRYDALSEEFRMKNGFTYESEIKSVLNGFRFDDAMWEREISSLSGGQKTRLALAKMLLERPQLLILDEPTNHLDIETLAWLENYLKNYEGSLLIVSHDRYFLDKVVNEVLELSRGELTRFSGNYSRYVEQREQKLLLELKNFEKQQKEIAKLEDYVARNLVRASTTKMAQSRRKKLEKMERLDAPTSDDKSANVTFTPEKTSGNVVLTVSEATVGYEDNRLSGPINIDERKGESLAIVGPNGVGKTTLIKSIVGQIPFLAGQAKLGANVTLGYYDQEQGRLTASNTVLDELWNEHRLLNEVEIRNMLGAFLFSGDDVKKTVGMLSGGEKARLLLAKLAMDHDNFLVLDEPTNHLDIDSREVLENALIDFPGTILFVSHDRYFINRVATKVLEIAPEGSTEFLGDYDYYVEKKEEVQAESNSSENGEPIESLAQQDFTAQKEAQKNRRKVEREIKACEEKLADLEAKIAALLLEMQENTADFVKLGELPAEIDLFNDEKDEIEMTLLEAMEELENL

SEQ ID NO: 19706 - protein, 575 aa, Pseudomonas fluorescens PfO-1
MKYEPFAKSLIATSLALSCLMAHAASVAPVAAENGMVVTAQHLATHVGVDVLKSGGNAVDAAVAVGYALAVVYPAAGNLGGGGFMTIQLADGRKTFLDFREKAPLAATANMYLDKDGNVIPDLSTRGHLAVGVPGTVSGMELALSKYGTKPRKDMIAPAIKLAEEGFELEQGDVELLEYATDVFKKDIKDSGAIFLSNGEPMQVGQKLVQKDLGKTLRTISEKGADGFYKGWVADAIVTSSQANKGIITQADLDKYKTRELAPVECDYRGYHVVSAPPPSSGGVVICQIMNILEGYPMKDLGFHSAQGMHYQIEAMRHAYVDRNSYLGDPDFVKNPIEHLLDKNYATKLRDAIQPQKAGVSAELKPGVAPHEGSNTTHYSIVDKWGNAVSVTYTLNDWFGAGVMASKTGVILNDEMDDFTSKVGVPNMYGLVQGEANAIAPGKAPLSSMSPTIVTKDGKVVMVVGTPGGSRIITATLLTMLNVIDYGMGLQEAVDAPRFHQQWMPEETNLEDFAASPDTKKILESWGHKFAGPQDANHIAAILVGAPSLGGKPVGKNRFYGANDPRRNTGLSLGY

SEQ ID NO: 19707 - protein, 580 aa, Salmonella enterica subsp. enterica serovar Choleraesuis
MSFRSTERQTPIRNDGMSTLKITGMTCDSCAVHVKDALEKVPGVQSADVSYAKGSAKLAIEVGTSPDALTAAVAGLGYRATLADAPSVSTPGGLLDKMRDLLGRNDKTGSSGALHIAVIGSGGAAMAAALKAVEQGARVTLIERGTIGGTCVNVGCVPSKIMIRAAHIAHLRRESPFDGGIAATTPTIQRTALLAQQQARVDELRHAKYEGILEGNPAITVLHGSARFKDNRNLIVQLNDGGERVVAFDRCLIATGASPAVPPIPGLKDTPYWTSTEALVSETIPKRLAVIGSSVVALELAQAFARLGAKVTILARSTLFFREDPAIGEAVTAAFRMEGIEVREHTQASQVAYINGEGDGEFVLTTAHGELRADKLLVATGRAPNTRKLALDATGVTLTPQGAIVIDPGMRTSVEHIYAAGDCTDQPQFVYVAAAAGTRAAINMTGGDAALNLTAMPAVVFTDPQVATVGYSEAEAHHDGIKTDSRTLTLDNVPRALANFDTRGFIKLVVEEGSGRLIGVQAVAPEAGELIQTAALAIRNRMTVQELADQLFPYLTMVEGLKLAAQTFNKDVKQLSCCAG

SEQ ID NO: 19708 - protein, 212 aa, Physcomitrella patens subsp. patens
MDTRDGVLDAILVPLGLLIILAYQVRLVWKVRCAPLLTAIGVNHLARRHWVESVMKDNDKKNILAVQSLRNTIMGSTLMASTAILMCSATAVFMSSAYFNTKEPLYGGVSPKLLNFKFLSLMACFLFSFLAYMQSVRYVNHVNFLVNVPLQEAMAIRISPQYVSDVLAKGCNFYTAGTRGFYVAFPLMLWLFSPIAVFCGCILLVPVMYNLD

SEQ ID NO: 19709 - protein, 329 aa, Staphylococcus epidermidis ATCC 12228
MADLLSVLQDKLSGKNVKIVLPEGEDERVLIAATQLQKTDYVSPIVLGNEDNIKSLASKHALDLTQIEIIDPATSELKDELVDAFVERRKGKATKEQAVELLDNVNYFGTMLVYTGKAEGLVSGAAHSTGDTVRPALQIIKTKPGVSRTSGIFFMIKGDEQYIFGDCAINPELDAQGLAEIAVESAKSAQSFGMDPKVAMLSFSTKGSAKSDDVTKVQEALKLAQEKAEADQLDHVVIDGEFQFDAAIVPSVAEKKAPGAKIQGDANVFVFPSLEAGNIGYKIAQRLGGYDAVGPVLQGLNSPVNDLSRGCSTEDVYNLSIITAAQALQ

SEQ ID NO: 19710 - protein, 279 aa, Sinorhizobium meliloti 1021
MVTYIEADAAPYKNTGVIRLYGPEGFEGMRKACQVTARCLDELVARVSPGVTTDEIDRFVFEFGMDHGALPATLNYRGYTKSSCTSINHVVCHGIPNDKPLREGDIVNIDVTYVVDGWHGDSSRMYPVGEIKRAAERLLDVTHECLMRGIAAVRPGARTGAIGEAIQAYAEAERCSVVRDFCGHGVGRLFHDAPNILHYGSANDGPELKEGMIFTIEPMINLGRPHVKVLSDGWTAVTRDRSLSAQYEHTVGVTADGCEIFTLSPAGLFKPGIHVAGDA

SEQ ID NO: 19711 - protein, 445 aa, Oryza sativa Japonica Group
GPTWRATRRARGRSTSRCCVASTPPSPTSSSSPRTSSSTASTTTSTNGNTQPRFQFIVMNRKNTENLTEDLLGGFEYQVQVPYIMYHNAADEITGIWFYDPQECEQVGYLFSRIQKAFSRVSPKAKVSVTESEYEKPEVVPAVPSNEDTLKQPTSSIMLLDNAKYDFLSALLKGAACVGATMDEASAVQSNKSVGMVHSSTHASPHAIPPQSPAIQSNKSFGMVHSSTQAPLAIPPQSPAIRSNKSVGMIHSSTHASPFDIPPQSPAVQSNKSVGMIHSLTHASHLAIPPQSPALHGLHPSQISAVPVMPHDAHRSSSTSTIQPTSLANPLFFPPMPSLQTASHAASSLCSAAPLHPPITVQQLQSAPLHQPFSLPTASSIQPPYGMPLLQPFPPPNPSPFLTSGVSYGRPVITRDQLKDVLLSLCQNDEFIDMIYREFVKRQLP

SEQ ID NO: 19712 - protein, 210 aa, Oenococcus oeni PSU-1
MQNDKDQPIIIIGITGGSGSGKTSIARDIHNQLKKQSVAIIPQDAFYNDQTSMSIEQRKKINYDHPDSFDSDLFYNDLLKLKNRQKIQLPIYDYEKYTRSKKTILINPARVIIVEGVLLFVDQRIRNLLDIKIYVDADDDIRFIRRLKRDISERGRTTDSIINQYLKTVKPMYHQFVEPTKRYADVIIPEGESNQVGINLLINQIKTILN

SEQ ID NO: 19713 - protein, 467 aa, Sinorhizobium meliloti 1021
MNQYDLIVVGSGPAGRRGAIQAAKLGKKVLVIEQGKRVGGVSVHTGTIPSKTLRETALNLTGWRERGFYGRSYRVKQEISAEDLRRRLIITLNHEVEVLEHQFARNRVQHIRGRASFVGPTTLEISKDDDESMLVSGTSILLAVGTKPFRPDYMPFDGRTVVDSDELLDIRELPRSLVVIGAGVIGIEYATIFSALDIQVTVIDPKTTMLDFIDREIVEDFTYQLRDRAMKLNLGQKAEKVERLDNGKVLLTLDNGRKITTEMVLFAAGRMGATDALNLPAAGLEADARGRLKVNPETFQTTVPNIYAAGDVVGFPSLASTSMEQGRVAARVAVGAIAKEPQKYFPYGIYAVPEISTCGLSEEEVKERGIPYECGIARFRETSRGHIMGLDSGLLKMIFSLRTRRLLGVHIIGEGATELVHIGQAVLNLKGTVEYFVENTFNYPTLAEAYKIAGLDAWNRMGEIKAE

SEQ ID NO: 19714 - protein, 269 aa, Salmonella enterica subsp. enterica serovar Typhi str. CT18
MEKKIGFIGCGNMGKAILGGLIASGQVLPGQIWVYTPSPDKVAALHDQYGINAAQSAQEVAQVADIVFGAVKPGIMVKVLSEISSSLNKDSLVVSIAAGVTLDQLARALGHDRKIIRAMPNTPSLVNAGMTSVTPNALVTPEDTADVLNIFRCFGEAEVIAEPMIHPVVGVSGSSPAYVFMFIEAMADAAVLGGMPRAQAYKFAAQAVMGSAKIVLETGKHPGELKDMVCSPGGTTIEAVRVLEERGFRAAVIEAMTKCMEKSEALSKS

SEQ ID NO: 19715 - protein, 139 aa, Glycine max
ALGIPQPPHFFSKFLPPSNNQTGKRVLKGWGDKYSYVGDALQVWVRDLANGVYDYVYMQIPAAKVYPNVCQNVFKGSPGWVYPGDFVGREEGLKHIWDGARGIKENFDGWGHALGYIASSLLGKPCYILGVMFGSLVFC

SEQ ID NO: 19716 - protein, 414 aa, Sinorhizobium meliloti 1021
MEHPAPPVAAYDVEAVRKDFPILSRTVYGKPLVYLDNGASAQKPQLVIDAVAHAYSNEYANVHRGLHFLSNAATEAYEQAREKVRRFLNAPSVDNIIFTKSSTEAINTVAYGYGMPKLGEGDEIVISIMEHHSNIVPWHFIRERQGAKLVWAPVDDDGAFHIEDFVKCLTERTKLIAITHMSNALGTVVPVKEICRIARERGIPVLVDGSQGAVHMPVDVQDIDCDWYVMTGHKLYGPSGIGVLYGKTGRLKEMRPFMGGGEMIEEVTEDRVTYNDPPHRFEAGTPPIVQAIGLGYALDYMEKVGREAIRAHEASLTAYARERLSSVNSLRVFGDAPGKGSIFSFEIAGIHAHDVSMVIDRAGIAVRAGTHCAQPLLKRFGVTSTCRASFGLYNTRAEVDALADALEHARKFFA

SEQ ID NO: 19717 - protein, 244 aa, Frankia sp. CcI3
MLSTLRHDLRTVKERDPAARSTLEIALCYPGVHAVWGHRISHWLWTRDLRLPGRVVATLTRMLTGVEIHPAATLGPGVFIDHATGVVIGETAEVGADVTIYHGVTLGGTSLEPTKRHPTIGDRVIIGAGAKVLGNITVGSDSRIGANAVVVRPVPPGSVVVGVPGQVITPSRPRPATALPGQDDVLPDLVGVSLKSLLTRVDQLEAVLDGNTGNTDGRADGRVAARPTIRPPQAGVWHGEDFSI

SEQ ID NO: 19718 - protein, 416 aa, Bacillus clausii KSM-K16
MEKQQEPTSMKTSMFKNKLKAIGPGAIVTASFIGPGTVTTATRAGASFGFALLWAVIFSIIATIILQEMCARLGIITQKGLGAAIREHFTHPLLKYASMFLVLVAILVGSSAYMAGDLLGTSMGISTLTGISPNVLAPLFGIVILALGLSGSYKLVEKLMIVLVVIMSITFVTTMVVAKPPLGELFQGAFIPTVPDQSIIMIIALIGTTVVPYNLFLHSENVIERWNKPAHLADSRWDIVISISVGGLITAAILITSATMMQGMEVENVSDLSVQLEPLLGSWALVFTSIGLFAAGFSSALASPLGAAITASSILKWSGGMRDTRFKIVFAAVILFGVVSSSLGFEPLDVLLFAQALNGMLLPFVSIMLLIIMNNKNRLGNYVNSLKMNIVGGIVVVLCTGLGIYSFVDAVRAFFG

SEQ ID NO: 19719 - protein, 458 aa, Alkalilimnicola ehrlichei MLHE-1
MSSGKIVQVIGAVVDVEFPQDQVPKIYDALIVDERGLTLEVQQQLGDGVVRTIAMGSSDGLKRSEKVSATGKPISVPVGKGTLGRIMDVLGEPVDEKGAVETEERWGIHRSAPSFAEQAGGAELLETGIKVIDLLCPFAKGGKVGLFGGAGVGKTVNMMELIRNIATEHAGYSVFAGVGERTREGNDFYHEMKDSNVLDKVALVYGQMNEPPGNRLRVALTGLTMAEYFRDEGRDILMFIDNIYRYTLAGTEVSALLGRMPSAVGYQPTLAEEMGKLQERITSTKTGSITSVQAVYVPADDLTDPSPATTFAHLDATVVLARGIAELGIYPAVDPLDSTSRQLDPLVVGEEHYNVARGVQGVLQRYKELRDIIAILGMDELSEDDKLTVARARKIQRFLSQPFFVAEVFTGAPGKYVPLKDTIASFKAILDGEYDHLPEQAFYMVGTVDEAAEKAKNL

SEQ ID NO: 19720 - protein, 309 aa, Frankia sp. CcI3
MRIAEDITQLIGNTPLVRLRRVTDGVGAQVVAKLESFNPAHSVKDRLGVALIDAVERAGLIGPDTVILEPTSGNTGIALAMVCAARGYRCVLTMPETMSTERRMLLRALGAELVLTPGAEGMPGAIAKAEELAKNDERYLIPQQFENPANPAIHRATTAEEIWRDTDGQIDVLVAGVGTGGTITGVAQVIKERRPEARFVAVEPSASPVLSGGVKGPHPIQGIGAGFVPPVLETGLVDEIIQVDGEDAFDLARRLAQEEGLLVGISSGAAVSAALQVARRPENAGKLVVVVLPDFGERYLSTPLFAGLG

SEQ ID NO: 19721 - protein, 67 aa, Sorghum bicolor
AKKLAELSAKGVTTTIGGGDSVAAVEKVGVADVMSHISTGGGASLELLEGKELPGVVALDEAIPVAV

SEQ ID NO: 19722 - protein, 312 aa, Coprinopsis cinerea okayama7#130
MADAKKGKTPQEFAVDFLMGGVSAAVAKTSAAPIERIKLLVQNQDEMASRCRLATPYKGVTDAFTRTYREEGLVSLWRGNTANVIRYFPTQALNFAFKDYFKSLFGFKKSEGYWKWFAGNVASGGAAGAASLLFVYSLDYARTRLANDAKSAKSGGARQFNGLVDVYRKTLASDGIRGLYRGFVPSVVGIIVYRGLYFGVYDSLKPVVLVGALQGSFLASFALGWGVTIGAGLASYPLDTIRRRMMMTSGSTTHYKSMFDAGSQIIAKEGVRSLFKGAGANILRGVAGAGVLSLYDKLQQVMFGKVYSGGSG

SEQ ID NO: 19723 - protein, 154 aa, Catharanthus roseus
MADDDRKELHVLAVDDNIIDRKIVEKLLISSSCKVTTAENGIRALEYLGNLGVHSESQTPALHQDDAIPTAAGDLKVNLIITDYCKPEMTGYELLKKIKESSILKDIPVIVMSSENIPTRIHKCLEEGAQMFMLKPLKHSDVTRLRCQLMQCRS

SEQ ID NO: 19724 - protein, 442 aa, Bacillus clausii KSM-K16
MSKKKEKNTSLNWWQLSLLGVGCTIGTGYFLGSSIGIGLTGPSIVIAFLLAALGTYVVFIALAKLTADDPQEGSFCYYAEQAFGNRVGFACGWNYWMSNILIIGSQLTALSILSRFWFDNVPLWVFASIYSLLGIGVVLLGTKGFDSVENVLAAVKTAAILLFIVLGFLAVFQWLDGTGPDPSVPSSYNELFPRGIKGFWGSLIYAFYAFGGIEVIGLMAMQLKQKQDAPKSGTALLLLLAIIYTVSLGLAVSMVSFDQFTDKESPFVTALSDYHLAFFPHVFNAAIIVAGFSTMTAALFGVTTLLTTLAHDGNAPKWFEKKIKYKDLPLPSLGLAVVGLICAVIAALLLPGKLFEYITTAAGILILFNWICIVLSNMRLLKQTFFSISGNIIGILLMLLAISGILAEKTGRPGFYLSIGFAAIIVLIAWLVKKPHKEQSSS

SEQ ID NO: 19725 - protein, 330 aa, Caulobacter crescentus CB15
MSTPPRAFSLVETGEALTRGDEPSPTRSAVLTRLSHSHMRFGTFQRLAYLDRRDLMVQLVDHVIESYFPDLADESDRPAVLMRAVVSASARLLSRWMSAGFVHGVLNTDNMVVTGESFDYGPWRFLPRNDPNFVAAYFDHAGLYSFGRQPEAVFWNLQQLAGCLSLVTDQAALLAALNSFSDLYRAALRGAMLDRLGLKSRGAEADIALVNTAFRALAEGGETLRWEPFFFDWFGGAASEERALRGPRAGLYAGEAFLDLRRALADFDPDRPERLAHPAFARPEPEELIIDEVEALWSPIADADDWGPLNAKLARIDAAREAYALGQAQI

SEQ ID NO: 19726 - protein, 165 aa, Prochlorococcus marinus str. MIT 9303
MMATYEGRYTDAQALRIAVVVARFNDLVTGKLLSGCLDCLARHGVDTSSNSDQLDVAWVPGAFELPIVTQTLALSGQYEVVITLGAVIRGDTPHFDVVVAEASKGIASVSRETGVPVIFGVLTTDTMQQALERAGIKSNLGWSYGLQALEMGSLMGVLRSATSAS

SEQ ID NO: 19727 - protein, 503 aa, Anabaena variabilis ATCC 29413
MLCDYLVQILTARVYDVAQESPLEYAPNLSARLNNKLLLKREDMQSVFSFKLRGAYNKMVNLTPDLLAQGVIAASAGNHAQGVALGAKQLGTRAIIVMPVTTPQVKVDAVKARGGEVVLHGDTYDDAYAYARQLEAEKGLTFIHPFDDPHVIAGQGTIGMEILRQYQQPIHAIFVAIGGGGLISGIAAYVKRLRPEIKIIGVEPVDADAMNQSLQAGKRVRLSQVGLFADGVAVREVGEETFRLCQEYVDEIILVDTDDTCAAIKDVFEDTRSILEPAGALAIAGAKAYVEREQIQGQTLVAVACGANMNFDRLRFVAERAEFGERREAIFAVTIPETPGSLRKFCECIGRRNLTEFNYRIADEKIAHIFIGMQIQNRADKIHMVETFAECGFEILDLTDDELTKLHLRHMVGGHSPLAHNELLYRFEFPERPGALMKFVASMSPNWNISMFHYRNNGSDYGRIVVGMQVPPQEMEEWQAFLDSLGYQYWDESQNPAYKLFLG

SEQ ID NO: 19728 - protein, 160 aa, Caulobacter crescentus CB15
MACMIPAPAYHPDPRFQALGGEFADPVEPADFPETVLRFRNDRAAATVGLETLDDRAWLRHFGRFEPLPDNQTRPLAMRYHGHQFRVYNPDLGDGRGFLFGQLREAGTGRLLDLATKGSGQTPWSRAGDGRLTLKGGVREILAASFLEALGVPTSRWCGL

SEQ ID NO: 19729 - protein, 509 aa, Streptomyces avermitilis MA-4680
MAGQQARQAGQTQRTIHVGGEWREADSRATREILDPADAKPFAVVAEGDERDADAAVAAARRAFDSGEWPHTPVAERAALLRRVADLLVRDRESLGLLESRDAGKTLEEGRVDIDCVADAFRYFADLVVGEGGGRVVDAGSPDIHSVVVHEPVGVCAMITPWNYPLLQASWKIAPALAAGNTFVIKPSEITPLTTAALVDLLVEAGAPAGVANIVTGPGHTVGARLAEHPDVDLISFTGGLASGTKVAQAAAVSVKKVALELGGKNPNVVFADACATDEDFDTAVDQALNAAFIHSGQVCSAGGRLIVEESVRERFVAELVRRAGRIRLGRGTEDGVECGPLVSEQQRDKVEGYVASALSEGAVLRTGGRRPEPSDVRPAAGYFFEPTVLDQCHRGMKVVREEVFGPVLTVETFRTEDEAVALANDTEYGLAGAVWTSDAGRARRVAGRLRHGTVWINDFHPYLPQAEWGGFGKSGVGRELGPAGLAEYRETKHVYQNLAPKPVRWFAG

SEQ ID NO: 19730 - protein, 361 aa, Microcystis aeruginosa PCC 7806
MNLRKIVSFAFLLFIPLSVVASRLNWGDQAIFITAALSIIPLSIWLSTSVERVAVVTGPTLGGLVNAIFGNTTTLVIALIALKKGLVDIVQASITGSILSDLLLFMGMGMLTGGIRYKEQEFKPILARVNGSSMTLAVIAIALPTLVIYTSNVVEVADILSLSLVTATVLLIVYGLTLLFSLKTHSYLYEVGLSNENTPDNQVSEEEKAQVWIWLLVLLTSTVAVAYESDLFVDVVESVMEGFNLTPLFIGVIFIPLISDVSGIVTVTQLALKNQMDLTVSVAMGDSLLVALFVAPLLVFIGQFWQQPMDLNFNPFNVVALIVAVVVTNLISFTGRSNWLDGTLLLATYLILAVAFYYHPT

SEQ ID NO: 19731 - protein, 471 aa, Synechococcus elongatus PCC 7942
MALQQFGLIGLAVMGENLALNIERNGFSLTVYNRTAEKTEAFMADRAQGKNIVPAYSLEDFVASLERPRRILVMVKAGGPVDAVVEQLKPLLDPGDLIIDGGNSLFTDTERRVKDLEALGLGFMGMGVSGGEEGALNGPSLMPGGTQAAYEAVEPIVRSIAAQVDDGPCVTYIGPGGSGHYVKMVHNGIEYGDMQLIAEAYDLLKSVAGLNASELHDVFAAWNKTPELDSFLIEITADIFTKVDDLGTGQPLVELILDAAGQKGTGRWTVETALEIGVAIPTIIAAVNARILSSIKAERQAASEILSGPITEPFSGDRQAFIDSVRDALYCSKICSYAQGMALLAKASQVYNYGLNLGELARIWKGGCIIRAGFLNKIKQAYDADPTLANLLLAPEFRQTILDRQLAWRRVIAIAAERGIPVPAFSASLDYFDSYRRDRLPQNLTQAQRDYFGAHTYERTDRSGSFHAQWF

SEQ ID NO: 19732 - protein, 225 aa, Zea mays; identical to SEQ ID NO: 1360

SEQ ID NO: 19733 - protein, 500 aa, Streptomyces coelicolor A3(2)
MTNIVNHWIGGKTAEGASGTYGPVTNPATGEVTTKVAFASVDEVDAAVAAAREAYLTWGQSSLAQRTSILFRFRALLDAHRDEIAELITAEHGKVHSDALGEVARGLEIVDLACGINVQLKGELSTQVATRVDVSSIRQPLGVVAGITPFNFPAMVPLWMFPIAIACGNTFVLKPSEKDPSAAVKVAELLSEAGLPDGVFNVVHGDKVAVDRLLEHPDVKAVSFVGSTPIARYIHTTASANGKRVQALGGAKNHMLVLPDADLDAAADAAVSAAYGSAGERCMAISAVVAVGAVGDELVEKIRERAEKIKIGPGTDPSSEMGPLITKAHRDKVASYVAGAAAEGCEVVLDGTGYTVDGHEEGHWIGISLLERVPTTAKAYQDEIFGPVLCVLRADTYEEGVALINASPFGNGTAIFTRDGGAARRFQLEIEAGMVGVNVPIPVPVGYHSFGGWKDSLFGDHHIYGNDGTHFYTRGKVVTTRWPDPADAPAGVDLGFPRNH

SEQ ID NO: 19734 - protein, 333 aa, Methanosarcina barkeri str. Fusaro
MVTFLEKISERAKKLNKTIALPETTDIRTLQAAAKALERGVANIVLIGDEANIKELAGDLDLSKAKIVNPETYEKKDEYIQAFYELRKHKGITLESAAEIMKDYVYFAVMAAKLNEVDGVVSGAVHSSSDTLRPAVQIVKTAPDAALASAFFIIAVPDCEYGSEGTFLFADSGMVEMPSPEDVANIAIISAKTFELLVQDDPYVAMLSYSTKGSAHSKLTEATIAATKLAQELAPDIPIDGELQVDAAIVPKVAASKAPGSPVAGKANVFIFPDLNAGNIAYKIAQRLAKAEAYGPITQGLAKPINDLSRGCSDEDIVGAIAITCVQAAAQDK

SEQ ID NO: 19735 - protein, 359 aa, Xanthomonas campestris pv. campestris
MGSSHHHHHHSSGLVPRGSHMSLKHFLNTQDWSRAELDALLTQAALFKRNKLGSELKGKSIALVFFNPSMRTRTSFELGAFQLGGHAVVLQPGKDAWPIEFNLGTVMDGDTAEHIAEVARVLGRYVDLIGVRAFPKFVDWSKDREDQVLKSFAKYSPVPVINMETITHPCQELAHALALQEHFGTPDLRGKKYVLTWTYHPKPLNTAVANSALTIATRMGMDVTLLCPTPDYILDERYMDWAAQNVAESGGSLQVSHDIDSAYAGADVVYAKSWGALPFFGNWEPEKPIRDQYQHFIVDERKMALTNNGVFSHCLPLRRNVKATDAVMDSPNCIAIDEAENRLHVQKAIMAALVGQSRP

SEQ ID NO: 19736 - protein, 359 aa, Xanthomonas campestris pv. campestris
MGSSHHHHHHSSGLVPRGSHMSLKHFLNTQDWSRAELDALLTQAALFKRNKLGSELKGKSIALVFFNPSMRTRTSFELGAFQLGGHAVVLQPGKDAWPIEFNLGTVMDGDTPEHIAEVARVLGRYVDLIGVRAFPKFVDWSKDREDQVLKSFAKYSPVPVINMETITHPCQELAHALALQEHFGTPDLRGKKYVLTWTYHPKPLNTAVANSALTIATRMGMDVTLLCPTPDYILDERYMDWAAQNVAESGGSLQVSHDIDSAYAGADVVYAKSWGALPFFGNWEPEKPIRDQYQHFIVDERKMALTNNGVFSHCLPLRRNVKATDAVMDSPNCIAIDEAENRLHVQKAIMAALVGQSRP

SEQ ID NO: 19737 - protein, 327 aa, Staphylococcus epidermidis ATCC 12228
MVKSGKARAHTNIALIKYWGKADETYIIPMNNSLSVTLDRFYTETKVTFDPDFTEDCLILNGNEVNAKEKEKIQNYMNIVRDLAGNRLHARIESENYVPTAAGLASSASAYAALAAACNEALSLNLSDTDLSRLARRGSGSASRSIFGGFAEWEKGHDDLTSYAHGINSNGWEKDLSMIFVVINNQSKKVSSRSGMSLTRDTSRFYQYWLDHVDEDLNEAKEAVKNQDFQRLGEVIEANGLRMHATNLGAQPPFTYLVQESYDAMAIVEQCRKANLPCYFTMDAGPNVKVLVEKKNKQAVMEQFLKVFDESKIIASDIISSGVEIIK

SEQ ID NO: 19738 - protein, 359 aa, Xanthomonas campestris pv. campestris
MGSSHHHHHHSSGLVPRGSHMSLKHFLNTQDWSRAELDALLTQAALFKRNKLGSELKGKSIALVFFNPSMRTRTSFELGAFQLGGHAVVLQPGKDAWPIEFNLGTVMDGDTSEHIAEVARVLGRYVDLIGVRAFPKFVDWSKDREDQVLKSFAKYSPVPVINMETITHPCQELAHALALQEHFGTPDLRGKKYVLTWTYHPKPLNTAVANSALTIATRMGMDVTLLCPTPDYILDERYMDWAAQNVAESGGSLQVSHDIDSAYAGADVVYAKSWGALPFFGNWEPEKPIRDQYQHFIVDERKMALTNNGVFSHCLPLRRNVKATDAVMDSPNCIAIDEAENRLHVQKAIMAALVGQSRP

SEQ ID NO: 19739 - protein, 359 aa, Xanthomonas campestris
MGSSHHHHHHSSGLVPRGSHMSLKHFLNTQDWSRAELDALLTQAALFKRNKLGSELKGKSIALVFFNPSMRTRTSFELGAFQLGGHAVVLQPGKDAWPIEFNLGTVMDGDTVEHIAEVARVLGRYVDLIGVRAFPKFVDWSKDREDQVLKSFAKYSPVPVINMETITHPCQELAHALALQEHFGTPDLRGKKYVLTWTYHPKPLNTAVANSALTIATRMGMDVTLLCPTPDYILDERYMDWAAQNVAESGGSLQVSHDIDSAYAGADVVYAKSWGALPFFGNWEPEKPIRDQYQHFIVDERKMALTNNGVFSHCLPLRRNVKATDAVMDSPNCIAIDEAENRLHVQKAIMAALVGQSRP

SEQ ID NO: 19740 - protein, 455 aa, Staphylococcus epidermidis ATCC 12228
MFWQIFYRRDKTMKNYDLIIIGFGKAGKTLAAHAAGHGQKVAVVEQSTKMYGGTCINIGCIPTKTLIHDGIEGNSFKESITRKKEVVQALNNKNYQGLNSKNNIDVLNYNAKFISNEIIELQDSNGTIQETITADKILINTGSRANIPDIKGIDTAQNIYDSTGLLNIDYQPQELVIIGGGYIALEFASMFANFGTHVTILERGDAIMTNEDQDIANLIVKDLQDKGVTINTNTSTIAFSNNKDQTIIHTNHGEISADTVLLATGRKPNTNHLGLENTDVKIGKQGEVIVNKHLQSTVKHIYAAGDVKGGLQFTYISLDDYRIIKSHLFGDGSRTTENRGAIPYTVFIDPPLSRVGLIASEAKLQGYDILDNKVFVSNIPRHKINNDSRGLFKAVINKDTKEILGASLYGKESEELINLIKLAIDQHIPYTVLRDNIYTHPTMTESFNDLFLEPL

SEQ ID NO: 19741 - protein, 127 aa, Vitis vinifera
MSRHDYVGWMPVFRRGGADSGHWMYGRHVESTAAEVASGRSLLEGYVDRLSSTASLSISSHALSFQSSGGCGSGSSESNMLLFYTDDDPGLKITPTVVLVMNLCFIGFVTVLHVFGKIYRHKSGEVA

SEQ ID NO: 19742 - protein, 210 aa, Sorghum bicolor
STSTRSPSRSTRSLVTLVPGLKDEVMKITPVQKQTRAGQRTRFKAFVVVGDGDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWTQTKFSMTPFQQFTDLLGKPTKGLVLEAPTETAEA

SEQ ID NO: 19743 - protein, 643 aa, Catharanthus roseus
MNLGGGQLVKSMAVPSSSASWKSGGDGVSDQFPAGLRVLVVDDDPTCLRILEKMLKNCLYEVTKCNRAEIALKLLRDNRNGYDIVISDVHMPDMDGFKLLEQVGLEMDLPVIMMSADDSKNVVMKGVTHGACDYLIKPVRIEALKNIWQHVVRKGKHEWKEKDYEQSGSVEDGERQQKPNEDVDYSSSANEGNWKNSKKRKDDEEDQEEKDDSSTLKKPRVVWSVELHQQFVAAVNQLGIDKAVPKKILELMNVPGLTRENVASHLQKYRLYLRRVSGVSQHQNGLNNSFMGTPDATFGSMSSINGLDFQALAATGQIPAQSLASLQAAAIGRPTSKPTISMPVVDQRNLFSFEPHKLRFGEGQQQLNGSTKQISLLHGIPTNMEPKQLASLNQSAQTFGGINMQVSSQASQGNTLLMQMTQPMSRAPMLNENNASQISRLPSSVGQAILSNGIPSGVLGRNGIVDSVRGPVYTPVSQTSSLVDFSVSNSAELPGSTFPHASNSGISSLTPKGMMQEEVNSEGKGSRGFPSSYDIFSELQQHKTQDWGLQNVGSTFDGTQHSSIQGSLEGGRNNPPNFGQQFSSYMVDNSLRIKSERHPDANCQTNLFPQLFGQDDLMSALLKQEGIGSVESDFGFDGYALDL

SEQ ID NO: 19744 - protein, 456 aa, Salmonella enterica subsp. enterica serovar Typhi str. CT18
MESNNKLKRGLSTRHIRFMALGSAIGTGLFYGSADAIKMAGPSVLLAYIIGGVAAYIIMRALGEMSVHNPAASSFSRYAQENLGPLAGYITGWTYCFEILIVAIADVTAFGIYMGVWFPAVPHWIWVLSVVLIICAINLMSVKMFGELEFWFSFFKVATIIIMIVAGIGIIVWGIGNGGQPTGIHNLWSNGGFFSNGWLGMIMSLQMVMFAYGGIEIIGITAGEAKDPEKSIPRAINSVPMRILVFYVGTLFVIMSIYPWNQVGTNGSPFVLTFQHMGITFAASILNFVVLTASLSAINSDVFGVGRMLHGMAEQGSAPKVFAKTSRRGIPWVTVLVMTIALLFAVYLNYIMPENVFLVIASLVTFATVWVWIMILLSQIAFRRRLPPEEVKALKFKVPGGVVTTIAGLIFLVFIIALIGYHPNTRISLYVGFAWIVLLLIGWIFKRRRDRQLAQA

SEQ ID NO: 19745 - protein, 499 aa, Sinorhizobium meliloti 1021
MTNFADLGLSQKVLSAVTDAGYTIPTPIQVGAIPPALQRRDILGIAQTGTGKTASFVLPMLTLLEKGRARARMPRTLILEPTRELAAQVAENFDKYGKNHKLNIALLIGGVSFDEQDRKLERGADVLICTPGRLLDHCERGKLLMTGVEILVIDEADRMLDMGFIPDIERIAKLIPFTRQTLFFSATMPPEIQKLADRFLQNPERLEVARRSSTAITVTQRFVAAHGKDYEKRAVLRELIRSQEDLKNAIIFCNRKKDVAELFRSLDRHGFSVGALHGDMDQRSRMAMLANFKDGNIKLLVASDVAARGLDIPDVSHVFNFDVPIHAEDYVHRIGRTGRAGRSGAAFTIVTKRETKFSDAIEKLIGQKVEWFNGDLSELPEPMESHDSRRDRGSDGRKDRKRERPGKVHADRKPVTASGNNTEELETVPERVDAVKIERNADSKDRHNGRSDRPGRAQNAANDDNRDRRQRNRRDHDDGPTPVGFGDDIPAFMLIVGKA

SEQ ID NO: 19746 - protein, 709 aa, Coprinopsis cinerea okayama7#130
MAPKPPCAKYQYVVTPAGPKIVPVDEPSCKDEESPADYNAGGYLPVKVNDTFKQGRYRVVRKLGWGHFSTVWLVKDSQSGVHSALKVVKSAGRYAETARDEIKLLSRVASVSPDHPGRAHIVSFLDSFSHQGPESSHICIVFEPLGENLLALIERNKKKGVPKALVKIIAKQVLLGLQYLHDECDLVHTDIKPENICFTKSTCLEVTSVRQTLEELDELTRSGIPIQMKGKEKEPEGLSAGSSPLKPSSWIEQASSLSSSYKSKGSPFKSSKPRSSNRHGHSHSQSGAPWQDPGVASPAPAVLVNAVASADGQETSQTAFNSLRTSSSSTSTITIAHSESSSTTATATQPSPTGTPLGPRKTKTMSIINGVSKLISDTSTMLSTGLHPTSETKPNTNTTNRTPQSGETNVTTNHVSLLTQTAPTRISANVEPLRTTTTRPSPPQHISQLSAHMHSEPCPSLPSHDSVLSSHFPSETSRPNFTTVSTAIAQRLVFGTSSSPAPPPPTPVDGPVFGSFPISPPPPFTSQFPNPPPISIKIADLGNATPSKKHFTEDIQTRQYRAPEAIVGRKDWDTRADVWSVACVVFELLTAEYLFDPQGQGELFTKDDDHMAQIIELLGDFPLDVKMGGKYSRELFDHTGALRYIRTLKPWPLKRVMIEKYLYSEEDSDALCAFLEPMLKADMRERAHARDMLDHPWLDVSNEEEVTEW

SEQ ID NO: 19747 - protein, 541 aa, Microcystis aeruginosa PCC 7806
MTTQTPLPTPQETLPSESFTNSLNRQIIIILDFGSQYSELIARRIRETNVYSEVLSYRTSAEQLAQINPKGIILSGGPNSVYDPGAPHCDPEIWNLGVPILGVCYGMQLMVQQLGGRVERAKRAEYGKASLFINDPTDLLTNVEDGSTAWMSHGDSCVELPAGFEILAHTDNTDCAAIADHQKKLFGVQFHPEVVHSVGGIALIRNFVYHICKCDPTWTTEAFVEESIREIRAKVGDKRVLLALSGGVDSSTLAFLLHRAIGDQLTCMFIDQGFMRKGEPERLMQIFNEQFHIGVQYVNARKRFLAQVAGVTDPEEKRRRIGHEFIQVFEEESNRLGPFDYLAQGTLYPDVIESADSNVDPKTGERVAVKIKSHHNVGGLPKNLRFKLVEPLRKLFKDEVRKLGRSIGLPEEIVRRQPFPGPGLAIRILGEVTADKLNILRDADWVVRDEINKQGMYHDFWQAFAVLLPVRSVGVMGDQRTYAYPIVLRLVSSEDGMTADWSRVPYDLLETISNRIVNEVKGVNRVVYDITSKPPGTIEWE

SEQ ID NO: 19748 - protein, 258 aa, Brassica napus
MSVFEDSFVILGDDASESVPVSGSFDTTTDHSFSAYDGSGQVDDSIDDVFAAPSSDYGAYSNGDDVFGSNGGHDGPILPPPSEMESDEGSALREWRRQNAIQLEEKEKKEKELRNQIIEEANQFKEDFHKKRELTCENNKAANREKEKLYMETQEKFYAEASKNYWKAIAELVPKEVPTIEKRRGKKEQDPKKPTISVIQGPKPGKPTDLSRMRQILLKLKQNPPPHLKLAPQQPPAEAAAPPKNVPETKHTEAVAAA

SEQ ID NO: 19749 - protein, 438 aa, Zea mays
  misc_feature (136)..(136): Xaa can be any naturally occurring amino acid
  misc_feature (195)..(195): Xaa can be any naturally occurring amino acid
MERPHHADRSSREILGAADRGRGSKSRIRTETPWKASTRCRDWERQIGHRTQSSWRLGAPTAPYTESETTTPRDDTNPSLGTVGKEGEMENGGGKGDVPNDANEHCPGTQSEEAGKADACAGCPNQQICATAPKGXPDPDVVAIVERLATVKHKLLVLSGKGGVGKSTFSAQLSFALAEMDHQVGLLDIDICGPXSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEINFCKKVGVPVLGVVENMSGLRQPLSDLSFVKPGEAGETDATEWALNYIKEKAPELLSVMACSEVFDSSKGGAEKMCREMGVPFLGKVPMDPQLCKAAEEGRSCFSDQKCGASAPALQSIVKKLIKTG

SEQ ID NO: 19750 - protein, 223 aa, Brassica napus
  misc_feature (175)..(175): Xaa can be any naturally occurring amino acid
  misc_feature (188)..(188): Xaa can be any naturally occurring amino acid
  misc_feature (198)..(198): Xaa can be any naturally occurring amino acid
  misc_feature (206)..(206): Xaa can be any naturally occurring amino acid
MGSIDLPQASSFKGGSETFLRDVLESILKTYLRKNPMANTVWELVQSVDNEKVSYDHFFFRTFKVDGYGIDSLSSFFMDYGYTIGGRLDFPKKHIHVLWLSPPEIHIPGDGHHLGNGPLPRIVIAELLVDELSPESQEIIRKYLKPEGGKQAILSSTLGSLIWEKPTSNDFNQLXAKESEYGAWALFXGYTLNHLAFXAVHRLKHXRFSDIKCVEEYFQRKGI

SEQ ID NO: 19751 - protein, 338 aa, Bacteroides fragilis
MGSSHHHHHHSSGLVPRGSHMKKFTCVQDIGDLKSALAESFEIKKDRFKYVELGRNKTLLMIFFNSSLRTRLSTQKAALNLGMNVIVLDINQGAWKLETERGVIMDGDKEEHLLEAIPVMGCYCDIIGVRSFARFENREYDYNEVIINQFIQHSGRPVFSMEAATRHPLQSFADLITIEEYKKTARPKVVMTWAPHPRPLPQAVPNSFAEWMNATDYEFVITHPEGYELDPKFVGNARVEYDQMKAFEGADFIYAKNWAAYLGDNYGQILSTDRNWTVGDRQMAVTNNAYFMHCLPVRRNMIVTDDVIESPQSIVIPEAANREISATVVLKRLLENLP

SEQ ID NO: 19752 - protein, 343 aa, Zea mays
  misc_feature (285)..(285): Xaa can be any naturally occurring amino acid
  misc_feature (292)..(292): Xaa can be any naturally occurring amino acid
MERYEVIRDIGSGNFGVTKLVRDVSTKELFAVKFIERGQKIDEHVQREIMNHRSLKHPNIIRFKEVVLTPTHLAIVMEYAAGGELFERICSAGRFSEDEARFFFQQLISGVSYCHSMQVCHRDLKLENTLLDGSVAPRLKICDFGYSKSSVLHSQPKSTVGTPAYIAPEVLSRKEYDGKVADVWSCGVTLYVMLVGAYPFEDPDDPKNFRKTITRILSVQYSIPDYVRVTMECGHLLSRIFVGNPEQRITIPEIKKHPWFLKNLPIEMTDEYQQSMQLADMNTPXQSLEEVXMAIIQEARKPGDAMNLAGQLPCLGSVDLDDIDFDDIDDIDTENSGDFVCAV

SEQ ID NO: 19753 - protein, 326 aa, Brucella melitensis 16M
MSTKIAVLGGGAWGTALAAMAAKGGHESWLYARDAETVVAINKDRRNPRYLGDITLADGIRASTDAAAVVTGADAVLAVIPAQAMRNGLSELGTLIPQASPIVLCAKGIEQNTGRLMSEVVAEILPDHRIAALSGPSFASDVARGLPTAVTVACEDANTADRLAALLSGPAFRCYSTTDLKGVETGGALKNVLAIAAGAAIGRGYGASAQAALVTRGFAELRRIGQAMSARPETIMGLSGLGDLMLTCSSSQSRNYSYGLALGRGEDLTSRPLAEGVATAPIAAELCRKHNISAPIIDAVGALLDGKITIDEAVTALLNRPLKTED

SEQ ID NO: 19754 - protein, 467 aa, Escherichia coli W3110
MQTTQQNAPLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWVWCVVFCAIIFGLNVISTRFFAEGEFWFSLVKVVTIIAFIILGGAAIFGFIPMQDGSPAPGLSNITAEGWFPHGGLPILMTMVAVNFAFSGTELIGIAAGETENPRKVIPVAIRTTIARLIIFFIGTVFVLAALIPMQQVGVEKSPFVLVFEKVGIPYAADIFNFVILTAILSAANSGLYASGRMLWSLSNERTLPACFARVTKNGVPLTALSVSMLGGVLALFSSVVAPDTVFVALSAISGFAVVAVWLSICASHFVFRRRHLQQGKALSELHYRAPWYPLVPVLGFVLCLVACVGLAFDPAQRIALWCGLPFVALCYGAYFLTQPRNAKQEPEHVAE

SEQ ID NO: 19755 - protein, 314 aa, Lactococcus lactis subsp. lactis Il1403
MNDKEHQRHRLIYHTNGKSLEEINGTVEVPKNVGFFKMLLTYSGPGALVAVGYMDPGNWSTSITGGQNFQYLLISVILMSSLIAMLLQYMSAKLGIVSQMDLAQAIRARTSKSLGIVLWILTELAIMATDIAEVIGAAIALYLLFNIPLILAVFITVLDVFLLLLLTRVGFRKIEALVICLILVILVIFAYQVALSNPDWKGIIEGFIPNSRTFASSPTVAGMSPLTGALGIIGATVMPHNLYLHSSISQSRKINHQDKSDVARAVRFSTWDSNIQLTVAFVVNSLLLIMGVAVFKTGVIDDPSFFNHSFVDVD

SEQ ID NO: 19756 - protein, 340 aa, Staphylococcus epidermidis ATCC 12228
MKAAVVTKDHRVSIEEKRLRELRPGEALVKTEYCGVCHTDLHVKNADFGDVTGVTLGHEGIGRVIKIADNVDSLKVGDRVSIAWMYAACGNCEYCTTGRETLCRDVLNAGYTVDGAMAEEVIVDANYAVKVPENLDPAAASSITCAGVTTYKAVKVSGIEPGQWLGVFGVGGLGNLALQYAKNVMGAKVVAFDINDDKLNFAKELGADAIINSTNVDPIEEVNRLTNNKGLDATVITAVAKTPFNQAVDVVKAGARVVAVGLPVDKMDLDIPRLVLDGIEVVGSLVGTRQDLREAFQFAAENKVIPKIQLRQLSEINDIFDEMEKGTITGRMVIDMKSTH

SEQ ID NO: 19757 - protein, 224 aa, Triticum aestivum
  misc_feature (174)..(174): Xaa can be any naturally occurring amino acid
  misc_feature (195)..(195): Xaa can be any naturally occurring amino acid
LAWSRPRSSIQQKIVKLCRQLNKPVIVASQLLESMIEYPIPTRAEVADVSEAVHQRADALMLSGESAMGRYPDKALIVLSSVSLRIERWWREEKHHEPLKLEDVSSSFSDKISEEICISAAKMANKLEVDAVFVYTKGGHMASLLSRCRPDCPIFAFTNSTSVRRRLNLQWGLXPFRLTFSDDMESNLNRTFSLXLKARGMIKSGDLVIALSDMLQSIQVMNVP

SEQ ID NO: 19758 - protein, 402 aa, Xanthomonas oryzae pv. oryzae KACC10331
MAPKSNRPTSATGGKSKPARKSAGASVSKQAKTSADTSAIKTAAPVLADVRAKIDEIDRNIQALIAERANFAHQVGKAKGKLAAAVDYYRPEREAQVLRMVVDRNEGPLSDEVLVHVYREIMSACLAQQEPLKIGYLGPEGTFSQQAVLKHFGRSAVGLPMATIEEVFQEVEAGNADFGVVPVENSGQGTIQVTLDMFLTSNLKICGEVELRVHQYLLSRNGRLEDIERIYAHSQSFAQTAGWLRSHLPNVEKIAVSSNAEGARRARNAEDAAAIGGESAAHVYGLKKVIMKSIEDDDDNTTRFLVIGRQIFPSSGHDRTSVLVFIHDKPGALFDVLSPFARHGISMNRIESRPSHQDKWEYGFFIDLVGHVEDDAMKQALAELKAHAAQIKVLGSYPVAIP

SEQ ID NO: 19759 - protein, 259 aa, Frankia sp. CcI3
MDLQLAGKVVLVTGGSNGLGAALVRTLAAEGARVAFCGRDETRLREVAGQAQAGGGEVLAVPADVTSITDLERFVATAVDRWNAVDALVNNAGASAGGTFENQTDEVWNADLELKLHAAIRASRLVLPYLRRAGGGGIVNSLSVAARAPSAGSTPTSVTRAAGLALTKALSKELGPDRIRVNAVLIGLVESGQWDRAAARENITVDELYERMGRTSGIPLGRVGRAQEFADLVAFLLSARAAYITGATINLDGGLSPVA

SEQ ID NO: 19760 - protein, 200 aa, Salmonella enterica subsp. enterica serovar Typhi str. CT18
MVLVTRQAPDFTAAAVLGSGEIVDKFNFKQHTNGKTTVLFFWPMDFTFVCPSELIAFDKRYEEFQKRGVEVVGVSFDSEFVHNAWRNTPVDKGGIGPVKYAMVADVKREIQKAYGIEHPDEGVALRGSFLIDANGIVRHQVVNDLPLGRNIDEMLRMVDALQFHEEHGDVCPAQWEKGKEGMNASPDGVAKYLAENISSL

SEQ ID NO: 19761 - protein, 621 aa, Triticum aestivum
  misc_feature (347)..(347): Xaa can be any naturally occurring amino acid
TRPPERPSYDDAGFGPVPAGWKGKCEGGSDFNSSACNRKLIGARYFLAGYEASKGPVDTSKESRSPRDNDGHGTHTSSTAAGSAVRGADLLGYASGTAKGMAPRARVATYKVCWVGGCFSSDILKGMEVAVADGVDVLSLSLGGGTSDYYRDSIAVGAYSAMERGIFVSCSAGNAGPGAASLTNGAPWITTVGAGTLDRDFPAYVTLGNGNKYNGVSLYNGKQLPTTPVPFIYAGNASNSSMGALCMTGTLIPAKVAGKIVLCDRGTNARVQKGFVVRDAGGAGMVLANTAANGEELVADAHILPGAGVGERAGNAMRTYASSDPKPTANIVFAGTKVGIQPSPVVXAAFSSRGPNTVTPGILKPDLIAPGVNILAAWSGSVGPSGIAGDDRRTSFNIISGTSMSCPHVSGLAALLRSAHQDWSPAAIRSALMTTAYAAYPNGDGLLDVATERAATPLDMGAGHVDPSKAVDPGLVYDLAAADYLDFLCAIEYEPAQIAALTKHSSDHCSPNRTYSVAALNYPSFSATFPAAGGTEKHARTLTNVGKPGTYKVTAAAAAGGTAIKVSVEPPTLSFSKVGEKKSYTVSFAAGGKPSGTNGFGRLVWSSEHHVVASPILATWT

SEQ ID NO: 19762 - protein, 277 aa, Bordetella petrii
MIPTKPLSRSGGTIPALGLGVFRMPAEDTSRMVKTALQLGYRHVDTAQIYGNEADVGRGLAESGVAREDVFVTTKVWVDHYRGAGFRQSVQDSLDRLRTDYVDLLLLHWPSSAVPLAEQIAGLNEAHASGRARHIGVSNFTTALMREAVELSAAPLVNNQVEYHPYLDQSAVRAEAQRLGMSVTAYYGMADGKVLQDPVIGDIARRLGKTPAQIALRWLVQQDNVIALSKTLRADRAADNARIFDFELDAADMQALAGLARADGRLVSPDGLAPQWD

SEQ ID NO: 19763 - protein, 390 aa, Streptococcus mutans
MKKQELNQAFTHVFGREADATFFSPGRINLIGEHTDYNGGRVFPAAITLGTYGAARKRDDKLLRFYSANFEELGIIEISLDHLIFNKKDSWTNYAKGVIKYLQEAGHSIDTGMDVYVFGNIPNGSGLSSSSSLELLIGIMAEELFDLKLDRLDLVKIGKRTENDFIGVNSGIMDQFAIGMGAEKKAIYLDTKTLEYDLVPLDLGDNVIVIMNTNKRRELADSKYNERRTECEKAVEELNVLLDIKTLGELDEETFDEYAYLIKDAKRIKRARHAVSENQRTLKAKKALAAGDLEKFGRLVNASHVSLEHDYEVTGIELDTLAHTAWEQEGVLGARMTGSGFGGCGIAIVAKDKVAALKENVGRIYTETVGYAPRFYIAEIAGGSRVLSRK

SEQ ID NO: 19764 - protein, 333 aa, Streptococcus mutans
MAILVLGGAGYIGSHMVDRLIEKGEEEVVVVDSLVTGHRAAVHPAAKFYQGDLADREFMSMVFRENPDVDAVIHFAAYSLVAESMKKPLKYFDNNTAGMIKLLEVMSEFGVKYIVFSSTAATYGIPNEIPIKETTPQRPINPYGESKLMMETIMKWSDRAYGIKFVPVRYFNVAGAKPDGSIGEDHSPETHLLPIILQVAQGVREKIMIFGDDYNTPDGTNVRDYVHPFDLADRHLLALNYLRQGNPSTAFNLGSSTGFSNLQILEAARKVTGQKIPAEKAARRSGDPDTLIASSEKAREVVGWKPQFDDIEKIIASAWAWHSSHPKGYDDRD

SEQ ID NO: 19765 - protein, 942 aa, Bacillus cereus G9241
MSTYLKRISVICFIFTVLIGQIFMPIIGHAQELNTTGFVDSFAFEKTKLNYGEKTTIHVNFSEKPGKKMKSGDTLTLALPPELKGYSGTIPLKDDSGRIFGTCQINANNVVCTFNDTVEKLENIRGNFNFTVQGTNVEAGKTKDVQTNLGTDLEKQMVSITHPKGEGTEPGIFFYKSGDIQPDKSNEVRWFLNINLKKQYLHDNIVLKDTLQEGQTLNKDSFTITINNKEYLSLKQFQDRGYGYIKLTSDNSFEVVIYRHMANATSFTIFYTSTITDSGKKLKHLQNDYKLDYQILYEKPISESNSVKVENISFGGGAEGVLPAKGTLQIVKHIEGDENKFIPGVSFKLFTESGQQIGDSYTTNQDGIVEAPNLTPGNYYVQEISAPNYVEFDSQAKIPFTIKTDATNGIKLMVPNKLKTISVAGTKTWEGDKVNDRPKTIKVDLLQNGKVIATKEVTAENDWKYEFGKLPAVDSEGKAHTYEVKEQPVSGYQSKVNGYDLTNIKIHEVTEVEEQVEEETTEEIKEEKPEEPKVTEEPKELEKPEVTEKPEIHVKPEEEQVEEETTEEIKEEKPEEPKVTEEPKELEKPEVTEKPEIHVKPEEEQVEEETTEEIKEEKPEEPKVTEEPKELEKPEVTEKPEIHVKPEEEQVEEETIEEIKEEKPEEPKVTEELKELEKPEVTEKPEIHVKPEEEQVEEETIEEIKEEKPEEPKVTEEPKELEKPEVTEKPEIHVKPEEEQVEEETIEEIKEEKPEEPKVTEEPKELEKPEVTEKPEIHVKPEEEQVEEETIEEIKEEKPEEPKVTEELKELEKPEVTEKPEIHVKPEEEQVEEETIEEIKEEKPEEPKVTEEPNMLEKPVVKEQTEVLSKQSVQEKVEVQNKQEVHSKVEIQNKSEVSPSVENNKQSKVLPQTGGASTESTSVIAGMLALIFGARLFRRSKN

SEQ ID NO: 19766 - protein, 468 aa, Bartonella henselae str. Houston-1
MSYDVVVIGAGPGGYVAAIKAAQLGLKTAIIEKRMTLGGTCLNVGCIPSKALLHASEVFAETQHGFETLGISIAKSKLNLEQMMAHKKAVVTANTSGVSFLMKKNKIDTFFGTAKILNAGQIEVVARDGNKQTIETKNIIIATGSESSGIPGVNVEIDEKVIVSSTGALALEKVPTRMIVVGAGVIGSELGSVWSRLGAKVTIIEYLNKVLGSMDGEVSRQFQKIMEKQGIEYKIGAKVTAITQSGSVAQVTFEAVKGGPSETLEADVVLIATGRFPYTEGLGLEEAGVQLDERGFITIDAHWQTNIPGVYAIGDVVKGPMLAHKAEEEGVAVAEILAGQKGHVNFDVIPSVVYTQPEIASVGKTEEELKAAGIDYNVGKFPFMANGRARAMQKSDGFVKILADKKTDRVLGGHILGFGAGEMIHEIAVLMEFGGSSEDLGRCCHAHPTLSEAVREAALATFAKPLHI

SEQ ID NO: 19767 - protein, 406 aa, Bartonella henselae str. Houston-1
MTTEIRVPTLGESVTEATVGKWFKKLGEAVAVDEPLIELETDKVTVEVPSPVAGKLSEIIAKEGDTVEVKALLGLVEAGAAGISQSFSPSATPIPEVPSELKQSSSSGAMQKDTMPPSPSAAKLMAENNIAKSNISGSGKRGQILKEDVLGVLEQEVKAPSVSAASSSASLVQEKHEERVRMTKLRQTIARRLKDAQNTAAMLTTFNEVDMSAVMDLRKRYKDLFEKKHGVKLGFMGFFTKAVCHALKELPAVNAEIDGTDIVYKNYVNVGIAVGTDKGLVVPVVRHADQMSLAEIEKEIGRLGRLARDGKLAVSDMQGGTFTITNGGVYGSLMSTPILNAPQSGILGMHAIKERAMVVGGQIVIRPMMYLALSYDHRIVDGQEAVTFLVRVKESLEDPERLVLDL

SEQ ID NO: 19768 - protein, 127 aa, Photobacterium sp. SKA34
MEIKGIHIAKCHCGAVELELTLPNGLEDPRRCSCSMCRKRGAIAASVLLENLKIIKGEDNLTLYQFNTNTAKHYFCKTCGIYTHHQRRSNPHQFAINVACLDGVNPYDLEPVKIYDGINHPTDTINL

SEQ ID NO: 19769 - protein, 398 aa, Bartonella henselae str. Houston-1
MNIHEYQAKRLLHEYGAPIANGVAVYSVEQAEKWAKKLPGPLYVVKSQIHAGGRGKGKFKELDPDAKGGVRLAKSVEEVVANVKEMLGKTLVTKQTGPEGKQVNRLYIEDGADIERELYLSLLVDRNVGRVAFVVSTEGGMDIETVAEETPEKILTLPINSTQGVTSSDCARLCDALDLHDSAREDGEKLFPILYKAFCEKDMSLLEINPLIVMTNGHLRVLDAKVSFDNNALFRHPDILELRDTSEEDPKEIEASKHDLAYVALEGTIGCMVNGAGLAMATMDIIKLYGAEPANFLDVGGGASKEKVTAAFKIITADPNVKGILVNIFGGIMRCDVIAEGVVAAVREVGLKVPLVVRLEGTNVEQGKAIISDSGLNVIPADDLDDAAQKIVAAVKGA

SEQ ID NO: 19770 - protein, 392 aa, Streptomyces avermitilis MA-4680
MDLFEYQARDLFAKHGVPVLAGEVIDTPEAAREATERLGGKSVVKAQVKVGGRGKAGGVKLAATPDEAVARATDILGMDIKGHTVHKVMIAETAPEILEEYYVSYLLDRTNRTFLAMASVQGGMDIEEVAEKTPEALAKVPVDAVEGVSIEKAREIVALAKFPAEVAEKVAEVLVTLWDTFVAEDALLVEVNPLAKVASGDILALDGKVSLDENAEFRQADHAALEDKASANPLEAAAKEKNLNYVKLDGEVGIIGNGAGLVMSTLDVVAYAGENHGGVKPANFLDIGGGASAQVMANGLEIILGDPDVKSVFVNVFGGITACDEVANGIVQALQLLADKGEEVTKPLVVRLDGNNAELGRRILSDANHPLVQRVDTMDGAADKAAELAAAK

SEQ ID NO: 19771 - protein, 492 aa, Bacillus cereus G9241
MFQKIAKECLAGFTVAIVALPLAIAFGIAATGTSEGALVGLYGAIFAGLFAALFGGTPGQVTGPTGPITVIATGVIATHGLEASFIAFMMAGLFQILFGVCKLGSYVRYIPYPVVSGFMNGIALIIILGEMKHVQNSFLLVVLTIIVMIVSGKWIKAIPSSLVALVGVTAMLPFISSALEGLTVKLPFIGNLSLNKVIEKIGTIPEAMPTLHIPSLSGTGIAELILPALSIALLGSIDSLLTSVVMDNVTGTRHKSNKELVGQGIGNMVSGLFGGLAGAGATVRSIVNIRSGGKTALSASMHSVILFIFIMGLGSVVQYIPLAVLSGILILTGIGMFDWESMKKMHVAPKGDVIVMLVTMVVTVKFDLMIAVAFGIILSFIIYMMKCKERKASIVKENEATYKIKGPLSFLTVDHVFYALQDVKSPVVLRMKDVRYMDVSGAMALLNFVEQSDKVGASVTLEQVPAHIENTLVTMASNEQKDKLLFAEADVM

SEQ ID NO: 19772 - protein, 449 aa, Photobacterium sp. SKA34
MNRLQADSLTALAALDSVPIARVTGRLVKVNGLMLQAVGCRFKLDQRCLIVADDGEQIEAQVVGFDHNIAYLMPVRQLGGLYAGAKVIPIQGGSTVNVSHKWIGRVVNGLGEPLDNGLPLQGGECLSLEPKPINPMKRQPVESPLDVGIKAINGLLTVGKGQRIGLMAGSGVGKSVLMGMITKYTAADIIVVGLIGERGREVREFIERSLGEEGRKRAVIIAAPADESPLMRLRATKLCHRVAEYFRDQGKDVLLLMDSLTRYAMAQREIALALGEPPASRGYPPSVFSLLPQLLERAGNGENPNGSLTAIYTVLAEGDDQQDPVVDSARAILDGHIVLSRTLAEQGHYPAIDINASISRCMSNCTEQAHVTVANQFRQLNANYQQVKELLPLGGYQQGQDPELDQAVMMQPQLKQFLQQPVTEHCDYQASLTQLANLFSVNQPNSSAP

SEQ ID NO: 19773 - protein, 429 aa, Fusobacterium nucleatum subsp. nucleatum ATCC 25586
MEKLKLAKHLINFIDESPSNYFACINTKNILNDKGFIELFETEEWKLKKGGKYFVTINDSGIIAFTIGSEKISKSGYKIAASHTDSPGFLIKPSPEINRKGFNILNTEVYGGPILSTWFDRSLSFSGRVFVESDNALKPKKYFIKYDKDLFIIPSLCIHQNRGVNDGMAINAQKDTLPLVTITDENEKFSLKKLLAKQLKVKEDKILSYDLNLYSREKGCLLGAKGEFISVGRLDNLAALHAGLMSLVDNKDKRNTCVVVGYDNEEIGSNSIQGADSPTLKNILERISNAMKLSFEEHQQALANSFVISNDAAHSIHPNYLEKSDPTNEPKINAGPVIKMAANKSYITDGYSKSVIEKIAKDFKIPIQTFVNRSDVRGGSTIGPIQQSQIRILGIDIGSPLLSMHSVRELGGVDDHYNLYRLISEFFKI

SEQ ID NO: 19774 - protein, 444 aa, Silicibacter sp. TM1040
MAVGHQVSGVRSERLSAQEIAENFADLHAPYDAHEAAVAADRCYFCYDAPCMTACPTSIDIPQFIREIQAGHAESAAKTILEQNILGGMCARVCPTETLCEEVCVREVAEGKPVEIGRLQRYATDMLMEKGAHPFTRAAATGKRVAVVGAGPAGLAAAHRLAMHGHEVTIYESKPKAGGLNEFGIAAYKSTNDFAAREVEWLLQIGGITIEYGQGLGAGLTLDGLQADFDAVFLSVGLQGVNALRAEGEDKDGVRDAVDFIAELRQAEDLRSLPVGRNVVVIGGGMTAVDAAVQSKLLGAENVTIAYRRGRDAMGASRFEQDLAASKGVKLMFNVMPKAIHGNGAAAEIELEYTEIVDGRVKGTGETLRLAADQVMKAIGQTLEGQPDALALEGGKIKVSETGKTSVAGVWAGGDCASGGDDLTVTAVAEGRDAAEDIHASLMG

SEQ ID NO: 19775 - protein, 476 aa, Arabidopsis thaliana
MQISSSSFITKFTNLHMVRSTSDHHQWRHNYNLKQLFIPNLSVSNSQHLPLNQSVAAIVFGGGSDSELYPLTKTRSKGAIPIAANYRLIDAVISNCINSGITKIYAITQFNSTSLNSHLSKAYSGFGLGKDRFVEVIAAYQSLEDQGWFQGTADAIRRCLWVFEEFPVTEFLVLPGHHLYKMDYKMLIEDHRRSRADITIVGLSSVTDHDFGFGFMEVDSTNAVTRFTIKGQQDLISVANRTATRSDGTSSCSVPSAGIYVIGREQMVKLLRECLIKSKDLASEIIPGAISEGMKVKAHMFDGYWEDVRSIGAYYRANMESIKSYRFYDRQCPLYTMPRCLPPSSMSVAVITNSIIGDGCILDKCVIRGSVVGMRTRIADEVIVEDSIIVGSDIYEMEEDVRRKGKEKKIEIRIGIGEKSRIRRAIVDKNARIGKNVMIINRDNVEEGNREAQGYVIREGIIIILRNAVIPNDSIL

SEQ ID NO: 19776 - protein, 486 aa, Streptomyces avermitilis MA-4680
MSSYFTDLAQQYIGGEWRPGTGSWDIIDFNPYDGEKLASITIATVDEVDEAYRAAAAAQKEWAATNAYARRAVFQRALRLIEDREAEITEAIIAELGGTHLKAGFELHLAKQFLLESINLALRPEGRIIPSPVDGKENRLYRVPVGVVGVISPFNFPFLLSLKSVAPALALGNGVVLKPHQNTPIVGGSLIAKIFEDAGLPGGLLNVVITDIAEIGDAFLEHPVPKVISFTGSDKVGRHVATVCAAQFKRSVLELGGNSALVVLEDADIDYAVDAAVFSRYVHQGQVCMAANRVLVDRSIEAEFTEKFVAKVKTLKSGDPRDPQTIIGPVINSSQADAISGAVDQAIADGAIALVHGTTTDNLVEPSVLTGLAADAPILQEEIFGPVALLIPFEGEEEAVRIVNDTPYGLSGAVHTADVERGVAFAKQIDTGMFHVNDGTVHDEPLVAFGGEKSSGIGRLNGEATVESFTTQKWISVQHGRSFFPF

SEQ ID NO: 19777 - protein, 470 aa, Streptomyces avermitilis MA-4680
MPLHKGPVKSDERPMSFNPFFGEANPVSGMTEAPPKHRLADGPLPPSTAYQLVHDELMLDGNARLNLATFVTTWMEPQAGVLMAECQDKNMIDKDEYPRTAELEKRCVAMLADLWNAPDAGAAVGCSTTGSSEACMLAGLALKRRWARRNADRYPARDVRPNLVMGINVQVCWEKFCNFWEVEMRQVPLEGERYHLDPGAAAELCDENTIGVVGILGSTFDGSYEPIAELCAALDALQERTGLDIPVHVDGASGAMIAPFLDEDLVWDFRLPRVASINTSGHKYGLVSPGVGWALWRDSEALPEELVFRVNYLGGNMPTFALNFSRPGAQVVAQYYTFLRLGREGFRAVQQTTRNVARSLAERVAALGDFHLLTRGDELPVFAFTTAPEVASYDVFDVSRRMREHGWLVPAYTFPPNREDLSVLRVVCRNGFSTDLAELFVEDLSRLLPDLRRQARPQTHDKDAATGFHH

SEQ ID NO: 19778 - protein, 149 aa, Desulfitobacterium hafniense Y51
MEKTFIMLKPDAVQRGLVGQIIARFETKGCKLVGMKLMSVDQALAEQHYAEHKGKSFFEPTVQYIMSSPVVAMVWEGKNVVALARELMGATNPANANPGSIRGSFGMDISRNVIHGSDSVASAEREIALYFRPEELCDYRKAGEEWLSE

SEQ ID NO: 19779 - protein, 436 aa, Borrelia burgdorferi
MSNFFENYLRQVDDIETVSFVGRVQKIKGLLVESLGPQCAIGDLCLIDQRNGKKVCAEVLGFNGPYVSLMAYEGFNGIEVGNKVYSLNKGLEINLSDELLGRVIDSLGRPIDNKGSFLNNSYKELIFEKINPINRSIFEDQILTGVKVLDGFLPVAKGQRVGIFSGSGVGKSTLLGMIAKNSNADVNVIAFIGERGRELNEFIEHELGEERLKKSVLVVSTSDESPISRYKGAYVATMIAEYFREQGKDVAFCFDSITRFANAKREMSLSLGEPPVAKGYPPSVFVEIPILLERSGFNGNGGSVTGFYTVLVEGDDFTEPVADNIKAVLDGHIILDRDLFDRGIYPSINVLSSTSRSIHRIMSLEKQKLIMKARNLLSIYKDYEDLIRTGIYLKGSNKDVDFAISKYPKIINFISQGINETFDFENLEDEIKEILS

SEQ ID NO: 19780 - protein, 188 aa, Zea mays
ARHDRDRNGAVTLREFFADWSNMGHGKMARWMDKFASADRNGDGSLNAVEFNDFLHPEDTSQESVMLWLLKDKLSEMDHDGDGRINLEEFVAQSDLERAEAEEKFRELDADMDNYLTVEEARSVLQSLITGEFSYATSHAKFLMKADVNQDGKLSLEEMLDDYVSFYSTVYTDDHYSNEVDSDSHDEL

SEQ ID NO: 19781 - protein, 175 aa, Oenococcus oeni PSU-1
MDIDLHDYIATTPDFPEKGVMFRDINPLIGNGPAYRQAINELIDFARPLKPDIIAGPEARGFVVGSPMAYALGIGFVPARKYGKLPRKSVSSSYSLEYGKNELQMHVDSIKPGQRVFIVDDLLATGGTITATMDLVRQLGGQVVGTGFFIELADLQGRKKIMEVENVPFKSLLEY

SEQ ID NO: 19782 - protein, 156 aa, Salmonella enterica subsp. enterica serovar Typhi str. CT18
MNIIKANVAAPDARVAITIARFNQFINDSLLDGAVDALTRIGQVKDDNITVVWVPGAYELPLATEALAKSGKYDAVVALGTVIRGGTAHFEYVAGGASNGLASVAQDSGVPVAFGVLTTESIEQAIERAGTKAGNKGAEAALTALEMINVLKAIKA

SEQ ID NO: 19783 - protein, 232 aa, Arabidopsis thaliana
  misc_feature (150)..(150): Xaa can be any naturally occurring amino acid
MDDWEDEKIAPLPAKVELKSNWDDEDVDENEIKDSWEDDDDEPAQPPVINPAPEKAPKKAAPKTVEKKGKAVEVPKEAPKEKPLDPIAEKLRQQRLVEEADYRATAELFGVKDDDKNLDMFIPKSESDFLEYAEMISHRIKPYEFGFCCXKSYHYIALLKTIMRLSLTNMKAADVKDVASSITTIANEKLKAEKEAAAGKKKGGKKKQLIVDKANDDLVAGPYDAMDDFDFM

SEQ ID NO: 19784 - protein, 440 aa, Chlamydophila abortus S26/3
MPPVVYKFGGTSLGTAESIRKVYDIVHKDTPWFIVVSAVAGITDLLDMFCSVSSEYREHIILDIANKHNEIIHDLQLTFSIAPWMEKLQRCMHKEKISLRDRAEILAIGEDISASLFHAFCCSHDFSLEFLEARTVILTDGEYSCATPDIPRMRENWHALNFRSDVCYITQGFIGANAAGETTLLGRGGSDYSGALIAEMSHAKEVRIYTDVNGIYTMDPRIIEDAQLIPELSFEEMQNLATFGAKILYPPMLSPCVRSGIPIFVTSTFDLSKGGTWIYAMDKIMSHEPRVKALSLRQHQRLWSIDCSGSSTVGFDKILSILDTHHVLPGLITSQDSTVSFTTDDDDVSDDVIRELYDQLSSIGTVHMLYDLALITMIGSGLASTKVVTTVTEKLRHYPSPIFCCCQSCMALSLVVPENLAGNVVEQLHNDYVKQKFSVV

SEQ ID NO: 19785 - protein, 620 aa, Salmonella enterica subsp. enterica serovar Typhi str. CT18
MSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKDRRTVCVIGDGAITAGMAFEAMNHAGDIRPDMLVILNDNEMSISENVGALNNHLARLLSGKLYSSLREGGKKVFSGVPPIKELLKRTEEHIKGMVVPGTLFEELGFNYIGPVDGHDVMGLISTLKNMRDLKGPQFLHIMTKKGRGYEPAEKDPITFHAVPKFDPSSGCLPKSSGGLPGYSKIFGDWLCETAAKDSKLMAITPAMREGSGMVEFSRKFPDRYFDVAIAEQHAVTFAAGLAIGGYKPVVAIYSTFLQRAYDQVIHDVAIQKLPVMFAIDRAGIVGADGQTHQGAFDLSYLRCIPDMVIMTPSDENECRQMLFTGYHYNDGPTAVRYPRGNAQGVALTPLEKLPIGKGLVKRHGEKLAILNFGTLMPEAAKVAEALNATLVDMRFVKPLDDTLILEMAAQHDALVTLEENAIMGGAGSGVNEVLMAHRKPVPVLNIGLPDFFIPQGTQEEARAELGLDAAGIEAKIKAWLA

SEQ ID NO: 19786 - protein, 419 aa, Vibrio vulnificus CMCP6
MSLLAIGINHHTASVDLREKVAFGPDKLANALQQLSQHEAVNGSVILSTCNRTEVYCDVKSGARSKVIDWLSQFHQIGLEELKPSLYVYEEQAAIRHLMRVSCGLDSLVLGEPQILGQVKQAYSDSREQQAVDASLEKLFQKTFSVAKRVRTETDIGGNAVSVAYAACTLAKHIFESLEKSTVLLVGAGETIELVAKHLHANGCSKMIVANRTRERALTLAEQFDAQVISLQEIPNHLAKADIVISSTASPLPIIGKGMVETALKQRRHQPMLLVDIAVPRDVEAQVGDLNDAYLYTVDDLQSIIDSNIEQRKVEAIQAEAIVAEESAAFMSWLRSLQAVDSIREYRQSANEIREDLLSKALLSLESGSDPEKVLRELSNRLTNKLIHAPTRALQLAAEQGEPAKLTVIRQSLGLDELK

SEQ ID NO: 19787 - protein, 521 aa, Arabidopsis thaliana
MEEVMISPVEHDPQGQVKQQQAAGVGILLQIMMLVLSFVLGHVLRRHRFHYLPEASGSLLIGLIVGILANISDTETSIRTWFNFHEEFFFLFLLPPIIFQSGFSLQPKPFFSNFGAIVTFAIIGTFVASVVTGGLVYLGGSMYLMYKLPFVECLMFGALISATDPVTVLSIFQDVGTDVNLYALVFGESVLNDAMAISLYRTMSLVNRQSSSGEHFFMVVIRFFETFAGSMSAGVGVGFTSALLFKYAGLDTENLQNLECCLFVLFPYFSYMLAEGVGLSGIVSILFTGIVMKRYTFSNLSEASQSFVSSFFHLISSLAETFTFIYMGFDIAMEQHSWSHVGFILFSILFIGVARAVNVFGCAYLVNLFRQENQKIPMKHQKALWYSGLRGAMAFALALQSLHDLPEGHGQIIFTATTTIVVVTVLLIGGSTGKMLEALEVVGDDLDDSMSEGFEESDHQYVPPPFSIGASSDEDTSSSGSRFKMKLKEFHKTTTSFTALDKNFLTPFFTTNSGDGDGDGE

SEQ ID NO: 19788 - protein, 311 aa, Vibrio vulnificus CMCP6
MKLFAGNATPELAQRIADRLYISLGDATVSRFSDGEVAVQINENVRGSDVFIIQSTCAPTNDNLMELVVMIDAMRRASAGRITAVIPYFGYARQDRRVRSARVPITAKVVADFLSNVGVDRVLTIDLHAEQIQGFFDVPVDNIFGTPVLLEDMHARGLEDPVVVSPDLGGVVRARATAKALGDIDIAIVDKRRPRANVSEVMNLIGDVEGRDCVIVDDMIDTGGTLCKAAEALKERGAKRVFAYATHAVFSGNAAKNIKNSVLDQVIVTDSITLSKEMAATGKVTQLTLSGMLAEAIRRISNEESISAMFN

SEQ ID NO: 19789 - protein, 218 aa, Glycine max
MPIRCILHWQPNQGSVVNSQVLNEISQCVESLNGVKEGRCKASLTFYRPNLRDQSVTIDFPRDFLGISMLEQPNKYYFIIRGQKIVLEADSSILLIMEKLQSYKSKVALHFEGVLYKLGDFQIRVIKVVPSQAESLRGIMIEIEYLPISSVEKSKQILEEFIDIWKEVVSKKSLAGQFMHTEPNYAEYGLSDNYTSQHTAVQYAAALAQLIQSAQLRN

SEQ ID NO: 19790 - protein, 178 aa, Glycine max
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 19791 - protein, 315 aa, Rhodopirellula baltica SH 1
MPTEKHFGPQGWTPDRIGSLQGKTYVITGANAGAGFEATRALLSKGAKVVMMNRNADKSAAAIETLKREFGRDADVTFVRLDLAVLDSVREAASELLDTVPQIDALICNAAIAQVAKQEITVDGFESQLGVNHFGHFLLCGLLFDWIEQSHGRIVVVGSNAYKMGLKKIQFEDLNFDKNYTAWNAYAQSKLAQMMFAYELQRRVEASSKHVQVRVCHPGASRTNLLNDTASLPMKMLWKVISPFIAQSAERGSWPEVMCATEDGLKPQALYGPTKRAETVGPVGECPLEPLALNQEAATQLWSVSEQKVALTWSP

SEQ ID NO: 19792 - protein, 396 aa, Photorhabdus luminescens subsp. laumondii TTO1
MFEKITAAPADPILGLADSFRSDPRTNKINLGIGVYKDETGKTPVLTSVKKAEQYLLENETTKNYLPISGLAEFGRVTQELLFGKDHPVVTDKRARTAQSPGGTGALRIAADFIAKQTNAKRVWISNPTWPNHKNVFSAAGLEVCEYKYYDAEKHALNFEDMLASLSEAQAGDVVLFHGCCHNPTGIDPTPAQWAKLAEMSAEKGWLPIFDFAYQGFAKGLNEDAEGLRIFAKNHNELIVASSYSKNFGLYNERVGACTIVASDSDTAEKAFSQAKAIIRANYSNPPAHGASIVTTILSNEDLKAAWEQELTTMRERIQRMRQLFVNTLQEKGAKQDFSFIISQNGMFSFSGLTKEQVERLRDEFGIYAVSSGRINVAGLTLENMAPLCEAIVAVL

SEQ ID NO: 19793 - protein, 423 aa, Brucella melitensis 16M
MARIVMKFGGTSVADLERIYNVARHVKREVEAGNQVAVVVSAMSGKTNELVDWVQNMPKVCGASSPFYDAREYDTIVASGEQVTSGLLAIALQSIGVDARSWQGWQIPIQTDNAHGAARIQEIDGSQIIRRMEMGQVAVVAGFQGIGPDNRVATLGRGGSDTSAVAVAAAVKADRCDIYTDVDGVYTTDPRIEPKARRLPKISFEEMLEMASLGAKVLQVRSVELAMVHKVRTFVRSSFTDPDAPGMGDPINPPGTLICDEEEIVEQQVVTGIAFAKDEAQISLRRVADRPGVSAAIFGPLAEEHINVDMIVQNVSEDGSKTDMTFTIPTGDIDKALKVLDKAKSEISFDNIQSETGLAKISVIGIGMRSHAGVAATAFKALAEKGINIRAITTSEIKISILIDGPYAELAVRTLHAVYGLDK

SEQ ID NO: 19794 - protein, 294 aa, Escherichia vulneris
IVFRAAQERSDIEIVGINDLLDADYMAYMLKYDSTHGRFNGTVEVKDGHLVVNGKTIRVTAEKDPANLKWDEIGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAASYEEIKKAIKAASEGDMKGVLGYTEDDVVSTDFNGEICTSVFDAKAGIALNDNFVKLV

SEQ ID NO: 19795 - protein, 515 aa, Agrobacterium tumefaciens str. C58
MSGENNIFDLFVIGGGINGCGIARDAVGRGYSVALAEKGDFASGTSSAATKLIHGGLRYLEHYEFRLVREALMEREILWAMAPHVIWPMRFILPVQKGGVRPSWMVRLGLFLYDNLGGRKLLPPTRTLDLRKDPAGKPLKPVFAKAFEYSDGWVDDARFVVLNARDAADRGATIMNRTRVVSARREGRLWLIETLDEKTGRPAMHKARMLVNAAGPWVDNVLSGVFGRNDVHNVRLVQGSHIIVRRKFSDPRAYFFQNPDNRIIFAIPYEQDFTLIGTTDRDYKGDPAKVRISEEEISYLCNAASDYFSEPVRPEDIVWTYSGVRPLFDDGASKAQEATRDYVLKVEQAEGEAPLLNIFGGKLTTYRRLAEHALEKIGAAIGEKGKPWTAGSHLPGGDFGVQRFDAQVKTLLSRYPFLDERHAYRLVKNYGTKAANLLGAATDISGLGRHFGGTVYECEVRWLVENEWAFSAEDILWRRTKQGLRLSKDEAAALDEFVAVLTGIREKPEAMAQRA

SEQ ID NO: 19796 - protein, 511 aa, Medicago truncatula
MGFLSLCHIQLFIDKIDAIAPPRKDGGEELSKRLVVTLLGLMDGIRRNEGLVVIAATNRLDRIDPALRRPGRFDKEVEIGVPSQVERGDILRAILGEIDHSLSETQIEELASITHGFVGADLVGLRNWAALICLRRYAEQKLKKTCNASSDDITKQPTPLKSATNSKDHSGIITSSVSDMSVASSLLLPSFLMGETSEIIDETPDHGEEEHILKVTFEDFQKARPEIRPSAMREVTLEVPKVNWEDIGGQKEVKNQLLEAVVWPQKHRDAFTRIGTDPPTAVLMFGPPGCSKTLMARAVASEAGLNFLAVKGPELFSKWVGESEKAVRSLFDKARANAPAIIFFDEIDSLAITRGKDGDGVSVSDRVMAQLLVQLDGVLKRVDVIVIAATNRPDKIDPALLRQGRFDRLLYVGPPNEIDREEIFSIHLRKTPYDSDVSMKELAQLTDGYTGADIAHICRQAALAALEESFDASVVTMKHFKMAIKQVQPSEFQSYQKLSAKFQRAVFSDAI

SEQ ID NO: 19797 - protein, 756 aa, Brucella melitensis 16M
MRELTTGPRVLLKRLRELMAEPLEPQARLDRIVREIAQNMVAEVCSFYILRADGVLELYATEGLNPQAVHLAQLRLGQGLVGTIAASARPLNLTDAQSHPAFAYLPETGEEAYNSFLGVPVLRAGRTLGVLVVQNRTKRAYREDEVEALETTAMVLAEIIATGDGLRLARPGIELDLGRPMSVSGHGFNDGIGLGHVVLHEPRIVVTNLFNEDSQAELNRLDEALGSLRISIDDMLSRRDVAVEGEHREVLEAYRMFAHDRGWVRRLEEAVHNGLTAEAAVEKVQSDTRARMVHLTDPYMRERLSDFDDLANRLLRQLMGRDVKTIAESLAKDAIIVARSMGAAELLDYPRERLRGVVLEDGAATSHVVIVARAMGIPVVGQAKGVVSMAENNDAIIVDGDEGIVHLRPQADVESAYAEKVRFRARRQAHYRELRDKPAITKDGVDIALLMNAGLLVDLPQLSASGAVGIGLFRTELQFMVASTFPRSEQQERLYRSVIDAAGDKPVTFRTLDIGGDKVLPYFRSTAHEENPALGWRAIRLTLDRPGLLRTQLRALLKAAGGRELKLMLPMVTEVSEVKAAREIIEREVRHLSRFAHSLPLCLKLGAMVEVPALLWQLDELMTAVDFVSVGSNDLFQFLMAADRGNSLISDRFDQLSPSFLRALRHIVKAGARHEKPVTLCGEMAGRPLTAMTLIGLGFRSISMSAAAIGPVKAMLGALDAGKLNALLLEELNKPNNAHSLRELLLRFAEDNEIPL

SEQ ID NO: 19798 - protein, 122 aa, Desulfitobacterium hafniense Y51
MDRDRIALRGLKFFAYHGMLREEKILGQTFIVDIDLYADLSKAGKSDQVEDTINYAEVYARIKTIVKREKYQLIERLAERIAEDVLGEFPCEGVRVVIHKPQAPIPGIFDEAFVEIYREKKR

SEQ ID NO: 19799 - protein, 510 aa, Agrobacterium tumefaciens str. C58
MPGILEQLETRRQEARLGGGVKRIEAQHAKGKLTARERIDVLLDEGSFEEYDMYVTHRAVDFGMAEQKVAGDGVVTGWGTINGRQVYVFSQDFTVLGGSLSETHAQKICKIMDMAVRNGAPVIGLNDSGGARIQEGVASLGGYADVFKRNVVASGVVPQISVIMGPCAGGAVYSPAMTDFIFMVRDTSYMFVTGPDVVKTVTNEIVTAEELGGASTHTKKSSVADGAYENDIETLEHVRLLFDFLPLNNREKPPVRPFHDDPARLEARLDTLIPDSSNKPYDMKELIHALADEGDFFELQEAFARNIITGFIRLEGQTVGVVANQPMVLAGCLDIDSSRKAARFVRFCDAFNIPLLTLVDVPGFLPGTAQEYGGVIKHGAKLLFAYSEATVPMVTLITRKAYGGAYDVMASKHIGADVNYAWPTAEIAVMGAKGAAEILYRSELADPEKIAARTKEYEERFANPFVAAERGFIDEVIMPHSSRRRIARAFASLRNKSVETRWKKHDTIPL

SEQ ID NO: 19800 - protein, 273 aa, Pseudomonas syringae pv. tomato str. DC3000
MSVQQRNNVNIMGDGPATLIFAHGFGCDQHMWRFMAPHFAERFKVVLFDLVGSGNSDVSAWYPHKYASLKGYATDLLELADEFAGTGPVVHIGHSVSCMIAVLAELQSPSRFDSHIMVGPSPHYLNDGDYLGGFTRADVDSLLETLESNYLGWASTMAPTLMGAGDRPELSEELASSFCRTNAEIAKQFARVTFLSDHRADVARFNSRTLILQSSDDLVVPVQVGEYLHHVIADSALHMIDNVGHYPHMSAPQECITAMNLFLAPYESPDHAA

SEQ ID NO: 19801 - protein, 356 aa, Hypocrea lixii
MSRSNPPNNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPEDEPTAPPIPEEFFDFDKHKDTLSKEQLKQLIYQEIMR

SEQ ID NO: 19802 - protein, 538 aa, Myxococcus xanthus DK 1622
MPRITSRIDPGSESFKVNRADMLARVSELRAIEAKVRNTENQAKEKFHKRGQLLPRERLMLLLDRGSPFLELSTLCGYGYHDDSDGSLAGGNSIIGIGYVSGVRCIVFVNNSAIKGGTASPWGVQKALRAQALALENKLPMVSLVESGGANLMYQQEIFIPGGETFYNQARLSAAGIPQVTVVHGSSTAGGAYLPGLSDYVVMVKKKAKVFLAGPPLLKAATGEVATDEELGGAQMHATVAGTADYLAEDDADAIRMAREIVAKLGWNAQLPPTERPAYAEPVYSPDELCGAVPVDYRKPYDCREVIARIVDGSEFTGFKDEYDAHTVCGWANLYGHPLGIIGNNGPISPQGATKAAQFIQLCCQKDTPILYLQNTTGYLVGTQPEQGGIVKHGAKMIQAVANATVPQLTVLIGGAFGAGNYGMCGRPFHPRFIFGWPNSRTAVMGGEQAAKVMSIVFGEKLARQGQVVDEEQLKAFCQPIIDQFDKESHPFNCSARMFDDGLIDPRDTRRVLGFALSVCREAKRRQVHPNTFGVARL

SEQ ID NO: 19803 - protein, 297 aa, Aspergillus nidulans FGSC A4
MSSERDQEQLSLEESREGEGKSTTSQTESNASDVAEDPSTKEQTGDKEDSAAARARERKERFKALQARAKSATERNLKETAAETQRLATDPSLLSSLSRKHAFASHNLLKADTEAAGEDFERKRAWDWTVDESEKWDRRMEKKQRHRDDVAFQDYTQDARKVYKRQLREMKPDLEGYENEKMAAIEKAAASGDLEIVETNDGEMIAVDKNGTFYSTADTIGFTESKPDRAAVDKLVADLRKAEEVRLKKRRDRRGGDEDGDVTYINEKNKQFNQKLARFYNKYTTEIRDSFERGTMI

SEQ ID NO: 19804 - protein, 339 aa, Bacillus subtilis subsp. subtilis str. 168
MKAVQVRKAYDLVTAEVKKPVLSKDDEVLVKVKRVGICGSDMHIYHGTNPLATLPRVIGHEVTGQVEAVGANVQSLKPGDHVVIEPISYCGSCYACRKGRPNVCAKLSVFGVHEDGGMREYIVLPERQLHAVSKDLPWEEAVMAEPYTIGAQAVWRGQVEKGDTVLIQGAGPIGICVLKMAKLAGAAVMMTDLNNERLAFAKENGADAVVNVQAEHVAERVLEWTGNEGANVVIDAVCLPETFALSIEAVSPAGHVVVLGFDERAAQISQLPITKKEVTITGSRLQTNQFPKVVELLNGGRLMHNGLVTHTFSVDDVHHAFQFIKEHPDQVRKAVITFD

SEQ ID NO: 19805 - protein, 560 aa, Eschscholzia californica
MEKPILLQLQAGILGLLALICFLYYVIKVSLSTRNCNQLVKHPPEAAGSWPIVGHLPQLVGSGKPLFRVLGDMADKFGPIFMVRFGVYPTLVVSTWEMAKECFTSNDKFLASRPPSAASSYMTYDHAMFGFSFYGPYWREIRKISTLHLLSHRRLELLKHVPHTEIHNFIKGLFGIWKDHQKQQQPTGREDRDSVMLEMSQLFGYLTLNVVLSLVVGKRVCNYHADGHLDDGEEAGQGQKLHQTITDFFKLSGVSVASDALPLLGLFDLGGKKESMKRVAKEMDFFAERWLQDKKLSLSLSSETNNKQNDAGEGDGDDFMDVLMSILPDDDDSLFTKYSRDTVIKATSLSMVVAASDTTSVSLTWALSLLLNNIQVLRKAQDELDTKVGRDRHVEEKDIDNLVYLQAIVKETLRMYPAGPLSVPHEAIEDCNVGGYHIKTGTRLLVNIWKLQRDPRVWSNPSEFRPERFLDNQSNGTLLDFRGQHFEYIPFGSGRRMCPGVNFATLILHMTLARLLQAFDLSTPSSSPVDMTEGSGLTMPKVTPLKVLLTPRLPLPLYDY

SEQ ID NO: 19806 - protein, 275 aa, Vibrio vulnificus CMCP6
MPDLRLDELAKIVNPQRILPTTMEFVDIAGLVAGASRGEGLGNKFLANIRETDAIGHVVRCFENENIVHVAGKVSPIEDIEVINLELAMADLDSCERAIQRQAKKAKGGDKDAKFELTVLEKLLPVLTEGGSARTVELSKEELAAVGYLNFLTLKPTMYIANVNEDGFENNPYLDAVREFAAKENNVVVPVCAAIESEMAELEDDERAEFLADMGIEEPGLNRVIRAGYELLSLHTYFTAGVKEVRAWTIPIGATAPKAAGKIHTDFRKASSVQK

SEQ ID NO: 19807 - protein, 181 aa, Halobacterium salinarum
MGSSHHHHHHSSGLVPRGSHMTDHDERTFVMVKPDGVQRGLIGDIVTRLETKGLKMVGGKFMRIDEELAHEHYAEHEDKPFFDGLVSFITSGPVFAMVWEGADATRQVRQLMGATDAQDAAPGTIRGDYGNDLGHNLIHGSDHEDEGANEREIALFFDDDELVDWDRDASAWVYEDLADHD

SEQ ID NO: 19808 - protein, 216 aa, Oryza sativa Japonica Group
MGGAVSGGGAGAAGAGAGAEGEGAYTVVLNVYDLTPLNNYLHWCGLGIFHSAVEVHGSEYSFGAHDHPTSGVFEVEPKCCPGFMYRCSIFIGRTSLNPLEFRDFIQRMASEYHGDTYHLISKNCNHFTDDLSTRLTGKPIPGWVNRPAKLGAFCNCLLPESMRLESTGTKHLADCHFSDDSRTSSNEHFEDEDLEDKHLLSQSSVSEDAIVKEVHR

SEQ ID NO: 19809 - protein, 322 aa, Bacillus clausii KSM-K16
MKWIERLSSFAGKYFALLVIAAAITAFLVPEIFIPINAYVPILLGVVMLGMGMTLKPVDFKLVATRPLPVLLGLVAQFTIMPFTAFMIAYLLQLPPELAAGLVLLGSVPGGTASNVMVYLAKGDLPLSITMTSMSTLLAPIATPALLYLLAGQWLPVNFVDMFTMIVQVIVIPVIAGLLINRFLPKVAAKTSVAMPLVSVLAILAILSAVVAANTGSLIQAGLISFVAVMLHNAAGLALGFIAALAFRLPASQRRAISIEVGMQNSGLGVALATAHFTPLAAIPSVLAAAWHNISGPILATYWSKRPLPPEATSPLNKKRAS

SEQ ID NO: 19810 - protein, 520 aa, Ganoderma lucidum
MVKFQSLLSCVTLLFAASAHAGIGPKADLTISNANIAPDGYTRAAVVVNGVFPGPLITGNKGDRFQLNVIDQLTNHTMLKTTSIHWHGFFQKGTNWADGPAFINQCPIASGHSFLYDFQVPDQAGTFWYHSHLSTQYCDGLRGPFVVYDPKDPLKGLYDVDNDSTVITLSDWYHVAARLGPSFPLGSDSTLINGLGRSTTNATAGLAVINVTQGKRYRFRLVSLSCDPNYTFSIDGHDMSVIEADGIATQPVTANAIQIFSAQRYSFVLTANQTIGNYWIRANPSFGNIGFTNGINSAILRYSGADPIEPTTAQQTTQNLLNEVDLHPFVAKQTPGRATQGGTDVAINMVFNFNGSNFFINNASFTPPTVPVLLQILSGAQAAQDLLPSGSVYTLPINKSIELTFPATVNAPGAPHPFHLHGHSFAVVRSAGSTEYNYNNPVWRDVVSTGTPAAGDNVTIRFQTDNPGPWFLHCHIDFHLEAGFAVVFAEDTADTSLANHVPQAWSDLCPTYDALSADDH

SEQ ID NO: 19811 - protein, 127 aa, Streptococcus pneumoniae R6
MEEITMALNIENIIAEIKEASILELNDLVKAIEEEFGVTAAAPVAVAAADAADAGAAKDSFDVELTSAGDKKVGVIKVVREITGLGLKEAKELVDGAPALVKEGVATAEAEEIKAKLEEAGASVTLK

SEQ ID NO: 19812 - protein, 417 aa, Tuber borchii
MKTSDILYLLAHPNQLRAIIQWKIWHNPLHERNIEKESPTLRRCFEFLDLTSRSFSAVIQELCPELCVSVALFYLILRGLDTIEDDMTIPLGIKEPLLRSFDEILEKEGWSFDGNGPKEKDRQLLVEFYTVIKEFALLPESHRVIIKDITKKMGNGMADYANNAEHNVNGVNTVADYDLYCYYVAGLVGDGLTRLFVDTGKANPALLERPHLINSMGLFLQKTNIIRDYREDLDDKRRFWPKEIWTKHIEKYEELPLPENEEAALNCISEMCLNSLQHADECLFYLAGIKDQSVFNFTAIPQVMAIATLALVFRNKDVFQKNVKIPKGEACELMIEVGNLRSTCDIFRKYMKIIHKKNTPKDPNYLNISVTLGKVEQFIESIFPTPVEPKAVAARAQMRATGETPEQAAAAKKRRCS

SEQ ID NO: 19813 - protein, 389 aa, Methanosarcina mazei Go1
MATKRDYYEILGLSKDSSVEDIKKTYRKLALQYHPDRNKEPGAEEKFKEISEAYAVLSDAEKRAQYDRFGHAGIDNQYSAEDIFRGADFGGFGDIFEMFFGGGRRGGPMGPRRGSDLQYDLYVTFEEAAFGVRKDIDIPRTERCSTCSGTGAKPGTSPKRCPNCGGTGQVRTTRSTLGMQFVSTTTCSACHGRGQVVESPCPTCSGAGRVRSRRKMSVNVPAGADSGMTLRLSGEGDAGEPGAPSGDLYIIVHVMEHKYFKRVDYDVISELPISFTQAALGADIMVDTLYGKVKMNIPSGTQTHSVFRLKDKGIQRLQGHGKGDQLVRVIIRTPTKLTQEQKDLLHQFEYLSNGKKPEAEERSRSDKQKSEKPRKSKGLFEKVKDAFES

SEQ ID NO: 19814 - protein, 389 aa, Zygosaccharomyces rouxii
MSAAADRLNQTSDILSHSMKKTDTSMSIVTAENPYKVAVVGPGNWGTTIAKVVAENTKEKPELFQGRVDMWVFEEQIDGTPLTQIINTKHQNVKYLPNIDLPENLVANPDLISTTKDADVIVFNVPHQFLGRIVSQMKGQIKPDARAISCLKGFEVGPKGVQLLSDYVTQELGIQCGALSGANLAPEVAKEHWSETTVAYQVPDDFKGEGKDIDHRVLKQLFHRPYFHVNVIDDVAGISIAGALKNVVALGCGFVTGLGWGNNAAAAIQRVGLGEIIKFGRMFFPESKVETYYQESAGVADLITTCSGGRNVRVATEMAKTGKSGEQVEKDILNGQSAQGLITAKEVHQWLESSGHTEEYPLFEAVYQITYENVPMKELPSMIEELDLH

SEQ ID NO: 19815 - protein, 273 aa, Gibberella zeae PH-1
MAPGTPTKDSPVEKTDDTKQESAPDNVSKAQDRMARFKALQARAKTSSEKNLQEATLESQRLATDPSQLTAIHRKHAIASHKLLKADVEESGGDFERKRAWDWTVDESEKWDKRLKKKAARRDNNAFADFTQEANKIYKRQLKNIDMNMEKYEKDKQALIEKAAASGGLDIVETEDGELIAVDKDGSFYSTADSTTFAQNKPDKTAVDRLVADLQRAEEQRLKKRKERMAQNGDDGDVTYINEKNKQFNQKLSRFYNQYTAEIRDSFERGTMI

SEQ ID NO: 19816 - protein, 488 aa, Cucumis melo
MELRLCPPPYVIGDGVRLFLQPLKRLDGFRSYPFLPNLQVKCTTLTKQTHRFLSTLSTTGATGDQSATNRLIRKFVASSPKSITLSVLSNIVSTHTPQPELCSAALTLYSRITEASWFTWNSKLVADLVAFLGQNGLYSESEALISEAISKLGSQERKLVNFYSQLVESQSKHGFERGFGDSYSRLFELLYNSPSVYVKRRAYESMVTGLCSMKRPHEAESLVKEMRSKGITPTAYEYRSIIYAYGTLGLFEEMKRSLKQMENDNIELDTVCSNMVLSSYGAHNKLGDMLLWLQRMKTSSHCKSSVRTYNSVLNSCPKITSMLQDHKSGDLPVLIEDLIAILDGDEEALLVKELLVGSSVLNEIMVWDAMELKLDLHGAHVGAAYVIMLQWIKEMRLNFEDESNVIPAQVTLICGSGKHSIVRGESPVKALIKEIMVRTESPLRIDRKNTGCFISKGKAVKNWLCSLPGKKDTVANRKCYKRPFIPKP

SEQ ID NO: 19817 - protein, 336 aa, Zea mays
  misc_feature (151)..(151): Xaa can be any naturally occurring amino acid
  misc_feature (208)..(208): Xaa can be any naturally occurring amino acid
  misc_feature (259)..(259): Xaa can be any naturally occurring amino acid
  misc_feature (280)..(280): Xaa can be any naturally occurring amino acid
MASSPRSPPAPTPEFEISRQSRLFAALSKKVIGLDELRMLAAQGVPDAAGVQATVWKLLLGYLPNDRALWPVGAEELAKKRGQYAAFKGEFLRNPYSEIMEQIDRDVKRAHPDMHFFCSDSSFAKSNQESLKNALLIFAKLNAGIRYVQGXNEILAPLFVFRSDPDDKNAVWTGSLFCFVELVSGFRDNFCQKLDNSAVGVRPTLADXAKLSQLVAKHDGGLQQHLEITTEVNPQFYAFRWIPLPLTQEFNFADTIHIXWDTVLSDRDSLQDTLLRICCXLVRKRLLAGDFTSSLKLLQNYPPTNISHHLYSAHKLQCTDLFLRPKRCCVCSAGCG

SEQ ID NO: 19818 - protein, 175 aa, Methanosarcina barkeri str. Fusaro
MIMNFKGKSPKISETAFIADSADVIGDIEIWDFSSVWFNAVLRGDRNKIKIGSRTSIQDNVVIHADPENGVQIGNDVTVGHGAVLHGCRIENNVLIGMNSTVLNGAEIGKNSIVGANALISEGKKFPENSLIIGVPGKVKREIKKFEIEAIAENAAEYVEFVKEYREEVKKIQKK

SEQ ID NO: 19819 - protein, 662 aa, Cucumis melo
MAPLTFLILLFFIMPPYFFADSKFLYNGFREGKGLFLDGAAIVKSSGALCLTSNSQNVVGHAFYPDPVKLFDTNYPSNASSFSTTFVFAIDPSIPGHGGHGLAFTLAPSTKFDEAESGHYLGLFNPLNDGNSSNHIFAVEFDTVKGHGGVRNSRDNHIGININGVSSVASKYAASSYYIDDTFWKEIQIDSGDPIVAWIDYDGRSKNLSVTIGHLEQKPEKPLIIYSIDLTSVMKNQMFVGFAASTGIETSAHYILGWSFAVNAPARQLKYSLLPNVPKEQNLSSSSDNNPQLKAVLAVSSIVVIMTIVVLTFLFIRMKKAESLEDWEKDCPHRFNFKDIYTATNGFNDSAQIGIGGFGSVYKGKLSSTGAEIAVKRVRRDSSQGMKEFAAEIESLGRLRHKNLVNLQGWCKKKNDLLIVYDYIPNGSLYSLLHTPKQSVILKWEQRFNILKGIAAGLLHLHEDWEQVVIHRDVKPSNVLIDADMNARLSDFGLSRQYDHNEMSHTTRVVGTIGYIPPELFRTGKASKSADVFAYGVLLLEVACGRKPLGSNQFILVDWVMERYETGDILHVADPKLNSIYKVEEMEMVLQLGLLCTHWKQEARPSMKQVMRFLNGEDPLPAFDAWTNSQSIFGSSSRLTMTDRSSSLFVGPISSASINAGR

SEQ ID NO: 19820 - protein, 161 aa, Escherichia coli
AEMRIGHGFDVHAFGGEGPIIIGGVRIPYEKGLLAHSDGDVALHALTDALLGAAALGDIGKLFPDTDPAFKGADSRELLREAWRRIQAKGYTLGNVDVTIIAQAPKMLPHIPQMRVFIAEDLGCHMDDVNVKATTTEKLGFTGMGLGIACEAVALLIKATK

SEQ ID NO: 19821 - protein, 413 aa, Hypocrea lixii
MADLQGRKVFKVFNQDFVVDERYTVTKELGQGAYGIVCAAVNNQTNEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLRRIGSPRAQEYVRNLPFMPKKPFPALFPDANPDALDLLDKMLAFDPSQRISVEQALEHPYLHIWHDASDEPDCPTTFNFDFEVVEDVGEMRKMILDEVLRFRQLVRTAPASGNQGAAQQIQVPMPSAGGQWTAEDPRPQEYMGHPNGLEQDLQAGMDIRR

SEQ ID NO: 19822 - protein, 851 aa, Fusobacterium nucleatum subsp. nucleatum ATCC 25586
MKQVYEFKDGGKEMVALLGGKGANLAEMAKIDLPIPKGIIISTTACNEYFKNDKKLSTVLEEEILTNIRVLEYETGKKFQSTKPLLVSVRSGAPVSMPGMMDTILNLGFNDYVAEKMLEITKDEKFVYSSYLRFVQMFSEIAKGINRKKFMHLKATDYKAQIIESKNIYREECGEMFPENYKAQILIAVKSIFDSWNNDRAILYRKLHNIDNNMGTAVVIQEMVFGNFNDKSGTGVLFTRNPSTGEDKIFGEVLLNAQGEDIVAGIRTPDNIELLKTSMPNIYNELAETVKRLEKHNRDMQDVEFTIEDSKLYILQTRNGKRTAEASLKIAMDLVKEGIITKEEAILKVEPASINKLLNGDFEEKYLKGATLLTKGLAASSGVAVGRIMFDAKRVKIREKTILVREETSPEDLQGMALAQGIVTLKGGATSHGAVVARGMGKCCVTGCSEIKIDEINKTMTVGKYTLKEGDFISVSGHTGEIYLGKIPLKENSFSDELKEFVLWASEIKRMGVRMNADTPEDVEQGKAFGAKGIGLCRTEHMFFKKDKIWTIREFILSDRGEEKEKALRKLHNLQKEDFLNIFKILEGDEANIRLLDPPVHEFLPKTLEDKKKMAEILSISVENIEKRIYRLKDENPMLGHRGCRLGVSYPELYRIQARAIIEAAYECAKKGIKVHPEIMIPFIMEAKELAYIRAEIEEEVENFFKEVGVTVEYKLGTMIEIPRACLLADEIAEYADFFSFGTNDLTQMSMGLSRDDSVKFLDDYREKGIWEGEPFYSIDTKAVTKLVEIGVKNGKTTKPNLTIGICGEHGGDPKSIEFFEGQKFDYVSCSPFRVPTAILAAAQSYLKLKK

SEQ ID NO: 19823 - protein, 218 aa, Silicibacter sp. TM1040
MIPRQAGPMIDPTETYMNTLVPMVVEQTSRGERAYDIFSRLLKERIIFLNGPVHDGMSSLIVAQLLHLEAENPSKEISMYINSPGGVVTSGLSIYDTMQYIKPKVSTLVIGQAASMGSLLLTAGEAGMRFSLPNSRVMVHQPSGGYQGQATDIMIHAEETLKLKRRLNEIYVKHTGQDYDTIEKALERDNFMSPEQAKEFGLIDEIVENRSKADDAES

SEQ ID NO: 19824 - protein, 371 aa, Photorhabdus luminescens subsp. laumondii TTO1
MITLSRLYTHPVKSMRGLQLSHALVSESGLIFDRNFMVTTTDGTFITARKYPQMLLFTPAMLNNGIYLRAPNGENATVLYRDFLPEQQPTEVWGNHFTALIAPETVNQWLSSFFDIPVQLRWLSHELTRRVKKHPEIPLSFADGYPFLLINEVSFHLLQQRCPASIKLEQFRPNIVITGAEAFAEDSWQSIQIGDVIFDLPKPCSRCILTTVSIDKGIKNPNGEPLTTLQSFRTAENGDIDFGQNLIARSSGIIRIGDNVTVLAKKDPRQYGSSEKAENIDVPKTNEQSVIIEYNRQTFTGNNQQTILEQLEQQGIRVPYSCRAGICGCCKIALIKGDVFPLKATAIKENGHILACCCIPKNNLILNNMTR

SEQ ID NO: 19825 - protein, 656 aa, Methanosarcina barkeri str. Fusaro
MKAGFCNSLFYILLIMLTILGMAPGMVHALGDNESSVSDSGSSDTGDSVSDSGSSDTGDSVSDSGSSDTGDSVSDSGSSDTGDSVSDSGSSDTGDSDTDKVDSGSSDGSSDSGSSDSSSDSDLSDGNSDSDSSDSSSDSDLSDGSSDSGSSDSSSDSGLDDGNSNNSPDDGNSDSGLDDGNSNNSPDDGNSDSGLDDGNSNNSPDDGNSDSDLSDGSSDSGSNDSNSDSGLDDGNSDTSPDDGNSDSGPNNGSSDSDSNDKNSDSGSNDSNSDSSLDNGNSSTSPDAGNSDSGLDDGNSGTSSDDKNSTSDSDNVDSSKGDSDSGSGDSDTKNSDTGNSDTNQDTGNSETQNSDTVSSDNGNSDTQNSDNTSSDSGDSDTQNSDNTSSDNGSSDTGNEDSGSSGSGSSGSGSSGSGSSGSGSGGSGMNLVSSEPATNIAAQELSIMSIVSGYPVQFDFTKNATCIVNIEFDPKKTFRKTTTVVEELKNRSTLVQTSPEGTVYKYVNIWVGDRGAGLPTSINSGFVEFKVEKAWIKDNNISETQVVLQRYDSNWQPLYTEKVGEDDNYIYFKSETPGYSFFAITEYTGQNLMNINGAEKIQETLRNLGNEGKAALYGNAGNNSSRIKNPMGTARILMAISLPLFMLLVGYGIFKKKI

SEQ ID NO: 19826 - protein, 379 aa, Frankia sp. CcI3
MAVDYYAVLGVRREASNDEIKRAYRKLARELHPDVNPDPDAQQRFRGVTAAYEVLSDPEKRQIVDLGGDPLAPGGSGGGGSPFGAGFGGLGDIMDAFFGGGSSRGPRSRVRRGNDALLRIELDLSETAFGATREITVDTAAVCSTCTGAGAAPGTHPSTCGTCGGRGEVQQVTRSFLGQMVTSRPCPRCSGTGTVIEHPCRDCGGDGRVRKRRTLTVKIPSGVEDGMRIRLSGEGEVGPGGGPPGDLYVEVSEKQHPVFTREGDDLHCELPLPMTSAALGTSATLETLDGTETIAVKPGTQPGEVIKLAGRGVPHLRAAGRGHLHIHINVETPTKLDGEQERLLRELAKLRDEEAPAVVGGSAGGAAGLFRRRGTRRGR

SEQ ID NO: 19827 - protein, 473 aa, Fusobacterium nucleatum subsp. nucleatum ATCC 25586
MLSNNLKKETEKEKDLLENIQLIDMNGNDYTFSRDKNIYIKFWASWCPTCLAGLEELDRLAGETNNFEVVTVVFPGINGEKNPAKFKEWYDTLDYKNIKVLYDTDGKLLQIFKIKALPTSAIIYKDLIIDNIIVGHISNGQIKNYYEEKGENITMENNTKNIKEIYLAGGCFWGVEEYFARIDGVIDSVSGYANGSFDNPSYENVCNNSGHAETVHITYDSTKVSLDTLLKYYFRIIDPTSVNKQGNDKGVQYRTGIYYQNEEDKQIALNAIKEEQKKYSKPIVVEIEKLKRFDKAEEYHQDYLKKNPNGYCHINLNKASEAIIDEKKYQKPSDEVLKEKLSTLEYQITQEAATERAFTHEYYKNQEDGIYVDITTGEPLFSSKDKYDAGCGWPSFTKPIATEVVNYKKDSSHGMNRVEVRSRAGEAHLGHVFEDGPRDRGGLRYCINGASLRFIPYDKMDEEGYGEFKKYVK

SEQ ID NO: 19828 - protein, 447 aa, Escherichia coli
MDQTYSLESFLNHVQKRDPNQTEFAQAVREVMTTLWPFLEQNPKYRQMSLLERLVEPERVIQFRVVWVDDRNQIQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSLPVDIALPCATQNELDVDAAHQLIANGVKAVAEGANMPTTIEATELFQQAGVLFAPGKAANAGGVATSGLEMPQNAARLGWKAEKVDARLHHIMLDIHHACVEHGGEGEQTNYVQGANIAGFVKVADAMLAQGVI

SEQ ID NO: 19829 - protein, 259 aa, Physcomitrella patens subsp. patens
MAALFSKQAREYALARAIYPKSLFSYLASLTPSHAVAWDVGTGSGQAAVQLADHYEKVVATDASKQQIQQAAQRPNITYAVTNPHLTEEEVRTLVGDAETVDLVVCAQALHWFDLDNFYGHVKRVLRRPGGIIAAWTYQTPSVSPAVDAVLHDFNEKVFQDWAPQVRYIEEEYKSISFPFQPVVGSKLTTTGPFQFEATKQATLNEYLTHLRSWSAVQKAIDSGREVLNEQQQKLFADAWGDTPHRIVKWTLYTLIGTL

SEQ ID NO: 19830 - protein, 454 aa, Oryza sativa
MHQHSPSTQLSLYLRHAMAKHSTTMSCLLFFVLLCLGSHLAQAQVLFQGFNWESWKKQGGWYNFLHSHVDDIAATGVTHVWLPPPSHSVAPQGYMPGRLYDLDASKYGTGAELRSLIAAFHSKSIKCVADIVINHRCADYKDSRGIYCIFEGGTPDSRLDWGPDMICSDDTQYSNGRGHRDTGADFGAAPDIDHLNTRVQTELSDWLNWLKSDVGFDGWRLDFAKGYSATVAKTYVDNTDPSFVVAEIWSNMRYDGNGEPSWNQDGDRQELVNWAQAVGGPASAFDFTTKGELQAAVQGELWRMKDGNGKAPGMIGWLPEKAVTFIDNHDTGSTQNSWPFPSDKVMQGYAYILTHPGVPCIFYDHVFDWNLKQEISTLAAVRSRNGIHPGSKLNILAADGDVYVAMIDDKVITKIGTRYDVGNLIPSDFHVVAHGNNYCVWEKSGLRVPAGRRH

SEQ ID NO: 19831 - protein, 857 aa, Candida albicans SC5314
MIRQVNKKAISNGLFKRLSLSSSAFANITANKKSSTHQLNQKTQLTNVRFYSTKSTVIQLLNNIGSKREVEQYLKYFTSVSQQQFAVIKVGGAIITQQLNELASCLAFLYHVGLYPIVLHGTGPQINELLENEGVEPEYIDGIRITNPKTMEVVRKCFLEQNLRLVTALEKIGVHARPITAGVFEAEYLDKDKYQLVGKITSVNKSPIEAAINSGYLPILTSLAETSSGQLLNVNADVAAGELAREFEPLKIVYLNEKGGIINGNTGEKVSAINLDEEYEDLLKESWVKYGTKLKIKEIHDLLQHLPRSSSVAIIDVNDLQKELFTDSGAGTLIRRGYRLINRNSLRDFGNPDLLRNALLRDPEIKTGKVSVASYLKFLDSVQFKSYGDEPLEVLAIVVEQNDKIPKLDKFLSSKTGWLNNVTDNIFNAIKKDYSQLCWVVNENDANLPWYFSKSDGSFAKNGQILFWYGLNIDEASKLIKEFDSSSIGSSLSSSKESGVFTSAQQKRGFHHSTVRRNTNPNPPLSEGKQTERKKVALIGARGYTGQNLIKLIDNHPYLDISYVSSRELEGQKLQGYNKDNIVYSNLQIEDIKRLEENNEVDVWVMALPNGVCKPFVDTIDLVQNPNSKIVDLSADYRFDTTGEWTYGLPELNDRKTIAQAKKISNPGCYATAAQVAIAPLKEYISGTPSIFGVSGYSGAGTKPSPKNDVNLLSNNLIPYSLTDHVHEKEISSQLGLQVAFTPHVAQWFQGITHTINIPIKKGSLTSREIRNIYQDRYQGEKLITISGEAPLVKDISGKHGVVVGGFAVNSNEDRVVIVATIDNLLKGAATQCLQNINLSQEFGEYDGIPTESLIRG

SEQ ID NO: 19832 - protein, 323 aa, Cryptococcus neoformans var. neoformans JEC21
MASTKSLLRSTRAFPCITSSHVRYIATSVPRRESQSTPGQTPPSSKTTHFGFREIPEEQKETLVGGVFSSVASSYDLMNDSMSLGIHRLWKDSFVSSMLPRLPPSFHRNPNDPVTEKPVFKCLDVAGGTGDIALRILDRAKDKFACRDIEVEIVDLNEGMLNEGRKRVAKTMYYNTPQIKFTHGNAQHLPSHIADNSIDLYTIAFGIRNCTSLPAVLSEAYRVLKPGGKIGVLEFGKVTNPLFREIYRQYSFQFIPVMGKILAGDSESYQYLIESIERFPSQPEFAKLVQEAGFKTGQMREGRGGAWTDYTNGIATVWTGVKV

SEQ ID NO: 19833 - protein, 429 aa, Cryptococcus neoformans var. neoformans JEC21
MSHLLPPNLLKLFAPRPQPPFLKPLTRDERIRGPNNLGGVAGLAKRIKEEAEDAEVKQGMGMNPEKALDEQKEENVKMELKQDGEDGEVAEDSGKEKKKKTARDKIAEMGIIGEEAVKMRKELRKKRQEEYKKNAESNYKPQDDAQAIGDPYKTLFISRLSKKANETDLRREFEMYGPIERIRIVRNRKGKSNGYAFIVYERERDMKAAYKDAEGIPIHHKKILVDVERGRTVKGWKPQRLGGGLGGRPKPVAPEASPAPYVAPSNLRGGRGGFRGGGRGGGAGFRGGFQGNRGGFGGGNRGGFGGGDDRGGFAGRGGFRGGFQNRGDRGPGGFGQQQGGFGGPGGPGGYGGQGGGYGGGGGGFGGPGQQNGVQGGQGGGGFGGGGGYKRDYDNAGGPGGYGGGGGGGGGGFGGGGGGYQDRDPKRMRY

SEQ ID NO: 19834 - protein, 164 aa, Halobacterium salinarum
GSHMTDHDERTFVMVKPDGVQRGLIGDIVTRLETKGLKMVGGKFMRIDEELAHEHYAEHEDKPFFDGLVSFITSGPVFAMVWEGADATRQVRQLMGATDAQDAAPGTIRGDYGNDLGHNLIHGSDHEDEGANEREIALFFDDDELVDWDRDASAWVYEDLADHD

SEQ ID NO: 19835 - protein, 424 aa, Bordetella petrii
MSVAVLAFGLNHTSAPVSVRERVSMPVDLVRPALEGLRSAFGGSVREAAILSTCNRTEVYCAAEAQVAEQLPAWLADHNRIEAVALTPHLYRHQQDDAVRHAFRVASGLDSMVLGEPQILGQMKDAVRAAGEAGSLGTLLHQLFQRTFSVAKEVRSQTAIGAHSVSMAAAAVRLAERVFGNLDQARTLFIGAGEMIELCATHFAAQRPRSMVVANRTAERAEALAGRFSAGTMKLADLPERLAEFDVIVSCTASSLPILGLGLVERATRLRRHRPMVMIDLAVPRDIEPEVGRLDDVYLYSVDDLGRLVQSGTDARRAAVVQAEAIIETRVQGFMHWMQSREVVPVIRDLHQAAEDVRAAELERARRLLARGESPEAVLDQLAHGLTQKYLHGPLAALNRSEGDERKQLLAWMPRLFPGRDSRR

SEQ ID NO: 19836 - protein, 307 aa, Nostoc punctiforme PCC 73102
MSKQLVLMDHDGGVDDYLATMLLLTMDRIELLGVVITPADCYIQPAVSATRKILDLMGFSHISVAESTVRGINPFPTLYRRDSFIVDHLPILNQRETITTPLVAETGQDFMIKVLREASDPVTLMVTGPLTTVAVALDKAPDIEAKIHKIVWMGGALNVGGNVEKSLEPGQDGSAEWNVYWDAVSAARVWETKIEIIMCPLDLTNNVPVTSELVQKMGRQRHYPISDLAGQCYALVIPQDYYFWDVLATAYLGHPEFYQLREWETEIITTGVSQGRTKVVSGGRKIYAMDKVDKDAFYTYILQQWAR

SEQ ID NO: 19837 - protein, 484 aa, Staphylococcus aureus subsp. aureus N315
MEDNKMNRSLNSRHISMIAIGGAIGTGLFVATGNIISQAGPGGAILAYLVIGVMLYFLMSSIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHTYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPQFLSKLNKTTKLPLRALLTTYAVVVIVIIYANFNSNAVFNLLEIIGSMIIVVWGSSIWSQIRLRQAIKKQGQDPNKVLPYKAPFYPLGPIIVITTLLFLLFGGSVEYILKDQWLNAFKNFLPLIILALIYFIHKIIHKTKFVKLETINLKPHDYDNQK

SEQ ID NO: 19838 - protein, 333 aa, Trichodesmium erythraeum IMS101
MSQTKPTILVSGGAGYIGSHAVQALQNAGYDIVILDNLVYGHRDIVENVLKVEMIVGDTSDRSLLDKIFATHNIAAVMHFAAYIFVGESVKDPQKYYHNNVVGTLTLLEAMLKASIKKFVFSSTAAIYGKPQTIPIPEDHPKNPINPYGASKRMIEQILADFEIAYDFKSVCFRYFNAAGAHPNGLTGEDHNPETHLIPLVLFAALGKRDSISIFGTNYKTPDGTCIRDYIHVCDLADAHVLGLEYLLNGGESNIFNLGNGNGFSVREVIETVKQVTGREFKVEERDRRPGDPPILVGSSEKARKVLGWSPKYPEVKEIVSHAWQWHQKRHGK

SEQ ID NO: 19839 - protein, 395 aa, Bradyrhizobium japonicum USDA 110
MHDATLRNRLGQWLEPSRRSDVPPFMVMDVMAAAARIEAAGGHVIHMEVGQPAAGAPKTAIAAAHAALEAGRIDYTSALGIPSLRERIARHYRDAHGCDVSAERIVVTTGSSGGFILAFLSMFEPGDRVAVTVPGYPPYRHILTALGCEPVLIETTNETRHALTGEALLAAHRKAPLKGVLVGSPANPTGTMMSREALSGLIAAAEDAKIRFISDEIYHGLDYAFPAVTAAALSDHALVINSFSKYFCMTGWRVGWMVVPELLVRPIERLQQNLSISVPSLSQIAAEAAFDGTAEMGEIKHGYQENRRILIEGLPKAGLTRFLPADGAFYLYADVSDFTSDSFEFAKQMLEQAHVAATPGLDFDPIHGRSFIRFSYARSAAEMREAVDRIAHWLK

SEQ ID NO: 19840 - protein, 206 aa, Fusobacterium nucleatum subsp. nucleatum ATCC 25586
MEIYFVRHGQTIWNVEKRFQGLSDSPLTELGIIQAKLLGEKLKDIKFDKFYSTSLKRANDTANYIKGNRKQEVEIFDDFVEISMGDMEGIKQEDFKKLYPEQVKNFFFNQLEYNPSSFKGESFIEVRERVTKGLEKFIKLNKNYERVLVVSHGATLKTLLHYISGKDISTLSDEAIPKNTSYTIVKYENGKFEITDFSNTTHLEEK

SEQ ID NO: 19841 - protein, 446 aa, Physcomitrella patens subsp. patens
MSLVSLCYFLQSFRSFPWMAMTYWYKDNLKVDPGTMQFLMSTTMLPMVAKPVYGIISDSVYIKGAHRLPYLILAGGLQLFAWTIIATFSGVSSTASMLTAFLTITNLGGAISEVVQDAMVAEAGKNKAGAQQGELQSFVWLAMAFGGVVGNLTAGYAMKMLTPKAMVQIFISLLTIQVFLTFSVSEHSFGLRPAEKGTDDNPKLKQSPAQKDVSSAMWEQLTKLKAALQKPALHRPLLWFLSSFGFIPGLGSSMFFFHTEHLGLNASVLGLARLVGQVGLIFGSMLYNKALKGVPVRRLFTIVQILLSLCMLTDIVIVKRINLELGVPDKWFVLGASAFVEAIGQFKSLPFMVLLAQLCPSGSEASVFAFFTAASCLAGLLNGYLGVALSTYLNISGTDFSGLPLGIFISASCALLPILWIGLIPATTESSKETQTSAVEEPKKEL

SEQ ID NO: 19842 - protein, 174 aa, Triticum aestivum
MAPAVMASSATTVAPFQGLKSTASLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 19843 - protein, 174 aa, Brucella melitensis 16M
MRVSVFAVGRMKSGPERELVERYFDRFAKAGPPLGLEFAGVSEIPESRGQTAQLRKAEEAQRIHEALDNAKSGGAKSGGTSSGGAALILLDERGKTLGSEAFAAIVGRMRDDGKRQLIVAIGGPDGHDPALRSRADLVLALGELTWPHQIARILIAEQLYRAATILAGHPYHRS

SEQ ID NO: 19844 - protein, 281 aa, Coprinopsis cinerea okayama7#130
MAEIYIVQRGSRGRLVAVPLILRRQIRERREYVYLKSLEAQERQTFERKQQLKDALAGGKNLPTELRKDAQKLGKDLAFDEAQTEPTTHIDNEYSRAGIQDPKIVITTSRDPSSKLLQFAKVGLASCRVHKLSLIQLSAQEMRLVFPNSHRVNRGNYVVKELADACRANDVTDLIVLHEHRGVPDAMIVSHFPHGPTVYFTLNNVTLRHDITSYKNSTVSEQYPHLIFENFSSKLGERVRDVLKYLFPVPKEDSKRVMTFANESDFISFSVTGCIDSEGSL

SEQ ID NO: 19845 - protein, 220 aa, Streptococcus pyogenes MGAS315
MSTLKIAPSILAADYANFASELARIEETDAEYVHIDIMDGQFVPNISFGADVVASMRKHSKLVFDCHLMVVDPERYVEAFAQAGADIMTIHTESTRHIHGALQKIKAAGMKAGVVINPGTPATALEPLLDLVDQVLIMTVNPGFGGQAFIPECLEKVATVAKWRDEKGLSFDIEVDGGVDNKTIRACYEAGANVFVAGSYLFKASDLVSQVQTLRTALHD

SEQ ID NO: 19846 - protein, 475 aa, Coprinopsis cinerea okayama7#130
MMLYPTAPEAATRFLKFVNASPTPFHAVQTAALRLERAGFQKIREKDEWEKDVQPGGKYYYTRNQSSLIAFTLPQKWKQGAGLSIVATHVDSPNLKIRPISKRTKAGYLQVGVETYGGGIWHSWLDRDLSIAGRVVVAEKNGGFTSKLIKIDRPILRIPTLAIHLDRGVNDNFKFNQETEFVPILGLVSDQLNGAAKKVEDDKGSILPPKSSASSIQENHHPALLALLGEELSVAPEEIHDFDLSLYDTQPSVLGGLNNEFIFSPRLDNLLSSFCAVEALAESVTADYFATLEGNVNCIALFNHEEIGSVSTTGAESSLIPSLLNRLSPTPAALAQSIARSFLISADMGHAIHPNYTSKHEEKHRPYMNGGIVIKTNAKQRYATDAVSSFIVKQLAERRGGKVQEFEVRNDMPCGSTVGPMLSKLGVRTVDVGNPMLSMHSIRETAGSHDVQSAIDLFHAFFEGFSKLDQGLNVD

SEQ ID NO: 19847 - protein, 92 aa, Zinnia elegans
SFTVWDVGGQDKIRPLWRHYFQNTQGLIFVVDSNDRDRVVEARDELHRMLNEDELRDAVLLVFANKQDLPNAMNAAEITDKLGLHSLRQRHW

SEQ ID NO: 19848 - protein, 897 aa, Frankia sp. CcI3
MARYVYGFHQGNKDMKDLLGGKGANLAEMTNLGLPVPPGFTISTQACREYLAGGEPVGLRAEIDHHLATLETARGRRLGQADDPLLVSVRSGAKFSMPGMMDTILNIGLTDQAVLGLAEQSGSPRFAWDSYRRLLAMFGRTVLGVGEPSFDAALEAAKRAKGTSSDLDLDENDLRALVATYQRIVLERTGRPFPQDPREQLDLAIRAVFDSWNGPRARLYRRTERIPDDLGTAVSVVAMVFGNLGTDSGTGVAFTRDPGSGEPGVYGDYLPNAQGEDVVAGIRNPVPLAELERIDPASFTELREIMTRLEKHYRDLCDIEFTIEHGRLWILQTRVGKRTAAAAFRIAAMLAEGGVIDDDEALCRVSGDQLATLMFPRFDDTARPAPIATGVNAAPGAAVGEAVFDAAEAVRVAAEGRPVILVRRETNPDDLAGMLAARGILTSRGGRTSHAAVVARGLGRTCVCGAEEIEVDPAGRRLTTGRGVVVREGDILSIDGTIGAVYPGSVPLVPSPVVEYFEAGRPDHPRPGGDLVAAVDRLMRHADRSRRLRVRANADTGPDAARARRFGAAGIGLCRTEHMFLGDRRTLVEQMILAGTPAERTEALSRLLPPQREDFVEIFTAMDGLPVTVRLLDPPLHEFLPDLTELSVSIAAADAAGRPVDDADRERLAVLRSMHETNPMLGRRGVRLALTVPGLVELQARAIAEALVRCRRVGGDPRPEIMVPFISTATELDAIRDRVRGVLAEVGTESGLEIDLPIGTMIEVPRAALTADQIARRAEFFSFGTNDLTQLLWGFSRDDVEASLLPRYLDLGILAGSPFASVDRDGVGALMRTAVRAGRGARPDLGLGVCGEHGGDPDSVHFFAELGLDYVSCSPFRVPVARLEAGRAAVLGRSTVG

SEQ ID NO: 19849 - protein, 624 aa, Frankia sp. CcI3
MATPVSESTVGTADLETVRELAQQLRVDSVRSSTSAGSGHPTSSMSAADVLAVLVARHLRYDWDNPADPANDHLIFSKGHASPLIYSIFKAVGVVGDDELINGYRRFGERLQGHPTPVLPWVDVATGSLGQGLPDGVGVALAGKYLDKVPYRVWVICGDSEMAEGSVWEALDKASYYNLSNLIAIVDVNRLGQRGPTELGWDLDTYARRVESFGARAVVVDGHDIAAIDAVLADAEDVTRPTVILARTRKGEGFSETADVEGWHGKPFPADMADRAIAELGGLRDLRVRGPVPPADLPRPAPVERPVITLPTYDLGAKVATRRAYGQALAALGARTDVVALDAEVSNSTYSEDFAKIYPDRFFEIFIAEQQLVAAAVGLSVRGYVPFASTFAAFFSRAYDFIRMAAISQADIRLSGSHAGVEIGADGPSQMALEDIAMMRAVGGSTVLYPSDATSAAKLVEAMADLPGVSYLRTTRGAYPVLYGPDEPFAPGGSKVLRRSNADTVTLIGAGVTLHESLAAADTLVAEGIAARVIDLYSVKPVDAATLADAAQATGGRIVVTEDHYPEGGLASAVLEALSDGGVPLSVRHLAVRSLPGSGTSQELLDAAGISARHIVEAARDLLR

SEQ ID NO: 19850 - protein, 441 aa, Escherichia coli W3110
MNKYQAVIIGFGKAGKTLAVTLAKAGWRVALIEQSNAMYGGTCINIGCIPTKTLVHDAQQHTDFVRAIQRKNEVVNFLRNKNFHNLADMPNIDVIDGQAEFINNHSLRVHRPEGNLEIHGEKIFINTGAQTVVPPIPGITTTPGVYDSTGLLNLKELPGHLGILGGGYIGVEFASMFANFGSKVTILEAASLFLPREDRDIADNIATILRDQGVDIILNAHVERISHHENQVQVHSEHAQLAVDALLIASGRQPATASLHPENAGIAVNERGAIVVDKRLHTTADNIWAMGDVTGGLQFTYISLDDYRIVRDELLGEGKRSTDDRKNVPYSVFMTPPLSRVGMTEEQARESGADIQVVTLPVAAIPRARVMNDTRGVLKAIVDNKTQRMLGASLLCVDSHEMINIVKMVMDAGLPYSILRDQIFTHPSMSESLNDLFSLVK

SEQ ID NO: 19851 - protein, 386 aa, Myxococcus xanthus DK 1622
MRDLLMIPGPVEFEPEVLQALGAPTLGHTDPAFIAVFGRALKRLREVCLAPSAQPFVVSGSGTLAMELAVANLVEPGDAALVVNTGYFSDRMAKILERHGARVTHVRAPPGDVPSLDEVETHLSKGGFKVLSVTHVDTSTGVLAPAEALVRAARKHGVLSVVDGVCATAAETFRQDAWEADVYLTASQKAVGVPPGLALLTVGPRAMEAWRKRKTPVASVYADFAEWLPIMEAYEAGKPAYFATPPVNLVAALDVSLGQILAEGMDARFARHQRMARAFRAAWKAMGLRLLPTSDAVAANALSAVYYPDGVDAALVGGVKGQGVVVAGGLHPDLKTRYFRVGHMNRVGPADVLATVGALERALIAAGHRSEPGAAVAAAQASLIVG

SEQ ID NO: 19852 - protein, 131 aa, Arabidopsis thaliana
MSRSLGIPVKLLHEASGHIVTVELKSGELYRGSMIECEDNWNCQLEDITYTAKDGKVSQLEHVFIRGSKVRFMVIPDILKHAPMFKRLDARIKGKSSSLGVGRGRGAMRGKPAAGPGRGTGGRGAVPPVRR

SEQ ID NO: 19853 - protein, 79 aa, Rhodopseudomonas palustris CGA009
MLAVLLPVRAIGVMGDGRTYDYVVGLRVVTSTNGMTADFYPFDIFLLGANAMRNLNEVKDVNRLVSDIISKPPGKIGWV

SEQ ID NO: 19854 - protein, 349 aa, Frankia sp. CcI3
MPAYPPRYTYLGPEGTFTEAALRTLPDARTHELFPSLSVAEALDAVRNGDASGALVPIENSVEGAVTATLDELATGRPLMICREVLLPISFALLVRPGTTLEDVKTVTGHPVARAQVRRWLAAHLPYAEWESAASNAEGARLVREGRFDCAFAGEFTARRYRLEALVTDIHDVPDATTRFVLLGRPGRATAPTNTDKTSIVVWPAADEPGALLELLQEWAVRGANLMRIESRPTGEGLGRYCFSIDAEGHISDRRVREALMGLHRICRKIRFLGSYPRADEAAPSVPPSMTDHEFVRAADWLARCLDGRGEDWEACGSGRRACLGGVRTGRRADAIRRPLFGAPDEAVP

SEQ ID NO: 19855 - protein, 566 aa, Bacillus licheniformis ATCC 14580
MSYQALYRVFRPQLFEDVVGQEHITKTLQNALLQKKFSHAYLFSGPRGTGKTSAAKLFAKAVNCERAPVSEPCNECSACKGITNGSISDVIEIDAASNNGVDEIRDIRDKVKFAPSAVTYKVYIIDEVHMLSIGAFNALLKTLEEPPEHCIFILATTEPHKIPLTIISRCQRFDFKRITSQAIVGRMKKIVEAEQLKVQDGALDIIASAADGGMRDALSLLDQAVSFSGEELTVDDALLITGAVSQHYIGKLASTLHEKNVSGALETLNELLQQGKDPAKLIEDMIFYFRDMLLYQTAPDLEGVLEKVKVDEEFQTLSRQIPASDLYEMIDILNKSHQEMKWTNHPRIFFEVAVVKLCQGPKAGASAAAQPEVDNLVNKVRQLEQEIERLKTQGVQVSSAPAQAKEASRPQKSIKSAYKAPVGRIHEILKDATRPDLEKLKGCWGQLLAQLKQQNKVSHAALLNDSEPVAASSKAFVLAFKYEIHCKMVAEDNNGVRTNLEQILDGMLGGRIDIVGVPEAQWGKIREEFLQDHQPEDSEANEPKEEDPLVAEAKKLFGAELIEIKE

SEQ ID NO: 19856 - protein, 430 aa, Frankia sp. CcI3
MAAVREFPLPDLGEGLTSAEVVRWLVGVGDVITVDQPVAEVETAKAVVEVPCPYAGVVTSLAGLAGTSVPVGTPLITVAVSEPAAGRTGSGNILVGYGTSTEPPRTRRRRRVGAPGAPPVPALTPTPGPATPLGPSAQTVVKVVSPLVRRFARENSVDLRKLVGTGPDGLILRKDVESAIAPRSAPSRPAETDSTVVPLDPLARRAAETFARSRREVPDATCWVDTDATALLAAKDTLNDTRNAGGAEPRIGLLAILARICVAALVRFPALNSAVVTDADGRATGVRHHAAVHLGFAAQTPRGLVVPVVHHAQGLTTARLAAEIARLTAAARAGTLTPAELTGGTFTLNNYGVFGVDGSTPIIHHPEAAMIGIGRIVPRPWAVDGELAVRRIVQLSFTFDHRVCDGATAGSFLRFVADAVEDPTVLLRHL

SEQ ID NO: 19857 - protein, 638 aa, Vibrio angustum S14
MAIEINVPDIGADEVEVTEILVSVGDKVEEEQSLITVEGDKASMEVPASQAGIVKEIKVAEGDTVSTGSLIMIFEAEGAADAAPAAEVAPVAPAPAAAAELKEVHVPDIGGDEVECTEIMVSVGDTVEEEQSLITVEGDKASMEVPAPFAGTVKEIKIVEGDKVSTGSLIMVFEVAGSAPAAAPVAQAAAPAPAAPAASAAKEVNVPDIGGDEVEVTEIMVSVGDTVEEEQSLITVEGDKASMEVPAPFAGTVKEIKIAEGDKVSTGSLIMVFEVAGAAPAAAPVAQAAAPAPAAAPAAAPAPAAAPAAAPAKAEAPAATGDFVENNEYAHASPVVRRLAREFGVNLAKVKGTGRKNRVLKEDVQNFVKDALKRLESGAAASASGKGDGAALGLLPWPKVDFSKFGETEVKPLSRIKKISGANLHRNWVMIPHVTQWDNADITALEAFRKEQNAIEAKKDSGMKITPLVFIMKAAAKALEAFPSFNSSLSDDGESLILKKYVNIGIAVDTPNGLVVPVFKDVNKKGIYELSEELMAISKKARAGKLTASDMQGGCFTISSLGGLGGTAFTPIVNAPEVGILGVSKSEMKPVWNGKEFEPRLQLPLSLSYDHRVIDGAEGARFITYLNGCLSDIRRLVL

SEQ ID NO: 19858 - protein, 553 aa, Zea mays
MGTTYKCCFIFKRRFHTRDAPPPEDVRALFSVHAGGGPHMGADDLRRYLVATGQEEAEVERLLEQIVQGRARVPRLARPLLSLDDFHRYLFSHDLNPPIRHPQVHHDMTRPLSHYFIYTGHNSYLTGNQLSSDCSDTPIIMALERGVRVIELDMWPNSTIDDINIVHGRTLTTPVSLIKCLRSIKKHAFVASPYPVIITLEDHLPSQLQEKVAKMVVEVFGNILYYPPDDTHELKELPSPEQLKGRVLLSTKPPKEYLETKLGDSTKEGDADLHLGKGTGDDAVWGKEVPDFRTEIQSAEKDDENDDVDDEEEQKLQPHIAPQYKHLITIRAGKPKDSLADALKSDPEKVRRLSLSEQQLAKAAKDHATEIVRFTQRNILRIYPKGTRVTSSNYNPFVGWVHGAQMVAFNMQGYGRALWLMHGFYKANGGCGYVKKPDFFKQTHFDQYSPPDFYTRVGIAGVPADSVMKKTNAIEDNWTPVWEKEFSFPLTVPELALLRVEVHEYDMSEKDDFGGQTVLPVSELRPGIRAVALFDRKGMKYNHVKLLMRFEFA

SEQ ID NO: 19859 - protein, 476 aa, Vibrio angustum S14
MSKEIKAQVVVLGSGPAGYSAAFRCADLGLDTVLIEKFNTLGGVCLNVGCIPSKALLHVAKVIEEAKAMAEHGVVFGEPQTDINKIRLWKDKVITQLTGGLGGMAKMRKVNVVNGYGKFTGPNSIVVEGADGPTTVNFDNAIIAAGSRPIELPFIPHEDPRIWDSTDALELKEVPEKLLVMGGGIIGLEMGTVYHALGSQIDVVEMFDQVIPAADKDIVKVFTKRIAKKFNLMLETKVTAVEAKEDGIYVTMEGKKAPAEPVRYDAVLVAIGRVPNGKLIDAEKAGINVDERGFINVDKQMRTNVAHIHAIGDVVGQPMLAHKGVHEGHVAAEVISGKKHYFDPKVIPSIAYTEPEVAWVGKTEKEAKAEGINYEVATFPWAASGRAIASDCADGMTKMIFDKDTHRVIGGAIVGTNGGELLGEIGLAIEMGCDAEDIALTIHAHPTLHESVGLAAEVFEGSITDLPNAKAVKRKK

SEQ ID NO: 19860 - protein, 341 aa, Physcomitrella patens subsp. patens
MGNGGEFELSQEVLAVLPSDPYEQLDVARRITAMAISTRMSKLESETGKLRQRLAEKEHVILGLQERVAEAQSTLQETNSKITQSMDEQAKLATEKNSLALQVKKLMRDVAKLETFKRTLMQSLQEEDDKHGGEGGNNRGEPQSLALYKATQAETLSKAQIFEDDGRYARASFSANPPQYHDDADSKSATPTSQSARNSPKQIIRGTSSARGTPSLTPRLTPTGSPKPQPKKGSPLPSSYTLDSQHIQIPTSQPTSRSSSPPSSGSGQSRTTRLDGKEFFRQARARLSYEQFSSFLANIKELNAHRQTREETLANAEDIFGPENRDLYAAFEGILSRHLPS

SEQ ID NO: 19861 - protein, 247 aa, Prochlorococcus marinus str. MIT 9303
MLTAIKTDLAIIKERDPAARDLLEILLCYPGFQALTLHRISHRLWRSGLPLLPRLLSQITRALTGIEIHPGAQIGHGVFIDHGMGVVIGETTEIGNRCLLYQGVTLGGTGKEHGKRHPTLAENVVVGAGAKVLGAIHVGANTRIGAGSVVVRDVEADSTVVGIPGRVVHQSGVRINPLAHSALPDSEADVIRNLMERIDQLENQVTALHSFLQELSTDRVPQDLQTGQAQNLKDREIIEFLGDTPRS

SEQ ID NO: 19862 - protein, 408 aa, Vigna unguiculata
FGGGGGGGAGGGFGGGSGGGFGGGAGGGGGAGGGFGGGAGGGVGGGAGGGFGKGGGIGGGAGGGFGKGAGVGGGIGKGGGLGGGGGFGKGGGVGGGIGKGGGLGGGGGFGKGGGVGGGIGKGGGLGGGGGFGKGGGVGGGIGKGGGGGFGKGGGVGGGIGKGGGLGGGGGFGKGGGVGGGIGKGGGGGFGKGGGVGGGIGKGGGLGGGGGFGKGGGVGGGIGKGGGGGFGKGGGVGGGIGKGGGLGGGGGFGKGGGVGGGIGKGGGGGFGKGGGVGGGIGKGGGLGGGGGFGKGGGVGGGIGKGGGLGGGGGFGKGGGVGGGIGKGGGFGGGGGFGKGGGIGGGIGKGGGFGGGIGKGGGIGGGIGKGGGFGGGGGFGGGGGFGGGSGGGGGFGGGGGAGGGGGIGHP

SEQ ID NO: 19863 - protein, 490 aa, Gibberella zeae PH-1
MASPKLSDPSLIKNACYVNGQWVAAKSGKDFSVENPASLEKLGSCPEFDANDTEAAIAAADAAYKTYRKTPARQRARYLRRWYDLMMENADDIARLITLENGKVWSDAKTEAVYAANFFEWFSEEAPRIYGETIEASNPSCRLSTIKQPVGVCGLIAPWNFPAAMITRKAGPALAAGCTVVIKAPAEAPLTALALAELAHRAGIPAGVVNIITALDNTAEVGKVLTTHPKIKKVSFTGSTGVGRLLMNQSSSTVKKLSFELGGNAPFIVFEDADLEKAVKGIITSKFRNSGQTCVCANRIFVHRSIYDKFVQMVLDVVKTFVIGDGFGEKTTHGPLIHGRAVAKTAEHVEDAISKGAKLIHGGERLADLGPNFFGLTMLTDMTPDMKIFSEETFGPVAAFFAFDTEEEVIELANDSEVGLGGYFFSENVNRCYRVAEALEVGMIGVNCGVLSDPAAPFGGIKQSGFGREGSKYGIDEFTVTKMVMTNIDP

SEQ ID NO: 19864 - protein, 336 aa, Streptococcus pyogenes MGAS315
MVVKVGINGFGRIGRLAFRRIQNIEGVEVTRINDLTDPNMLAHLLKYDTTQGRFDGTVEVKEGGFEVNGNFIKVSAERDPENIDWATDGVEIVLEATGFFAKKEAAEKHLHTNGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINAAMKAASNDSFGYTEDPIVSSDIVGVSYGSLFDATQTKVMEVDGSQLVKVVSWYDNEMSYTAQLVRTLEYFAKIAK

SEQ ID NO: 19865 - protein, 459 aa, Fusobacterium nucleatum subsp. nucleatum ATCC 25586
MEKIYDLLVIGWGKAGKTLSAKLGAKGKKVAIIEENPKMYGGTCINVGCLPTKSLVHSAKILAEVKKYGIDGDYSFKNNFFKEAMKKKEEMTIKLRNKNFGLLDTNENVDIYNGRASFVSNNEVKITSSDNKEIVLKADKIVINTGSVSRTLNTEGIDNKNVMTSEGILELKKLPKKLLIIGAGYIGLEFASYFSNFGSEVSVFQFDDAFLAREDEDETKIIKEILENKGVKFFFNTSVKKFEDLGDSVKAICMKDGQEFSEEFNKVLVAVGRKPNTDNLGLENTSIQLGKFGEILVDDYLKTNAPNIWAVGDVKGGAQFTYVSLDDFRIVFPQILGENNRRKLSDRVLIPTSTFIDPPYSRVGINEKEAQRLGINYTKKFALTNTIPKAHVINEIDGFTKILINENDEIIGASICHYESHEMINLLALAINQKIKSKVLKDFIYTHPIFTESLNDILG

SEQ ID NO: 19866 - protein, 431 aa, Escherichia coli
MVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGVRCTVVCMPVPIEEASAFGVMAVDENDKTIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVSKLDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 19867 - protein, 561 aa, Vitis vinifera
MSELSPKLGQNGTIKNIDSSSTVAETEDIDFSKLSERPRPLTMERQRSYDERSFLSELSVGIYSRNIDHLDTVFSPCRRSGFNTPRSAMDFEPHPMFAEAWEGLRRSLVFFRGKPVGTIAALDNSDEELNYDQVFVRDFVPSALAFLMNGEPEIVRNFLVKTLRLQSWEKKVDRFQLGEGVMPASFKVLHDPVRNSDTLIADFGESAIGRVAPVDSGFWWIILLRAYTKSTGDSTLAELPECQKGMRLILTLCLSEGFDTFPTLLCADGCCMIDRRMGVYGYPIEIQALFFMALRCALLLLKQDDQGKEFIERIVKRLHALSYHMRSYFWLDMKQLNDIYRYKTEEYSHTAVNKFNVIPDSIPEWIFDFMPTYGGYFIGNVSPARMDFRWFCLGNCVAILSSLATPEQSTAIMDLIESRWEELVGDMPLKVCYPAIEGHEWRIVTGCDPKNTRWSYHNGGSWPVLLWLLTAACIKTGRPQIARRAIELAESRLVKDSWPEYYDGKLGRFIGKQARKFQTWSVAGYLVAKMMLEDPSHLGMISLEEDKQMKPLIKRSASWTF

SEQ ID NO: 19868 - protein, 711 aa, Xanthomonas oryzae pv. oryzae KACC10331
MKFFASCAKGLEYLLADELLALGASKATATISGVNVEGELRDAQRAVLWSRLASRVLWPLSEFDCPDEDALYAGVAELPWDAHLSVGHTLSVDAHVSGTAITHARYAAQRIKDAVVDTMRRQGLERPSVDVESPDLRLNLSLRKGRATISVDLGGGPLHRRGWRMAQNEAPLKENLAAAVLMRGGWPRAYADGGGLLDPMCGSGTLLIEGALMAADVAPGLQRYGSDLPSRWRGFDRNGWQQLVSEARERDSVGRAALKQVIHGSDMDPHAIRAAKENAQVAGVAEAIWFGVCEVGELQTPPQATGVVVCNPPYDERLAADAALYRRLGDTLQCAVPQWRASLLCGNAELAYATGLRAGKKYQLFNGAIECALIVCDPIAVPRRTPLAAPTALSEGAQMVANRLRKNLQKFKKWRAREGVECFRAYDADLPEYSAAIDVYQQADGDRRIFLHVQEYAAPATIPEADVRRRLNELLAAAREVFEVPAERVALKSRERGKGGSKYGRFEQRNEIVHVREHGALLRVNLFDYLDTGLFLDHRPLRGTMAQQSRGRRFLNLFCYTGVASVEAAVAGAASTTSVDLSGTYLQWCADNLALNGLAGSKHKLVQADALAWLEAERAHFDVIFCDPPTFSNSARAEDFDIQRAHVRLLRAAVARLAPGGVLYFSNNFRRFKLDEEGVAEFAQCEDISPSTIDPDFERHARIHRAWRLTA

SEQ ID NO: 19869 - protein, 503 aa, Triticum aestivum
MVAPAAIPQRQLFIDGDWRAPALGRRLPVINPTTEVTIGEIPAGTSEDVDAAVAAARAALKRNRGRDWSRAPGAVRAKYLRAIAAKMIERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASVTCLELGDVCKEIGLPSGVLNIVTGLGHEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRERCQRLAEEIDAGCIWVNCSQPCFCQAPWGGNKRSGFGRELGEGGIDNYLSIKQVTEYTSDAPWGWYKAPAN

SEQ ID NO: 19870 - protein, 394 aa, Rhodopseudomonas palustris CGA009
MLRPSSKQFFAGEHDLASRSAELFGPLSGARHSALLVTCPSEAADDPTFMLRLAERGVEAVRINCAHDDAAAWQRMINHLHVAEEATGRRMKVLMDIAGPKIRTGDARTPDGRDRIVTGDLVAIVAQGEFERIDLDDEHFAVECTLPDPLTRAAVGARVFVDDGKLCVRIERKTAWGLLGRVTATADTGFRLKPEKGLNFPDTPLDIPALTAKDRADLDFVAAHADGVEFSFVQSVGDVKMLQAALAERRPDDWHKLSLVLKIETPDAVAHLPDILVQAAGRQPTAVMIARGDLAVEIGFARLAEMQEEILWIGEAAHVPVIWATQVLEHLVKKGTPSRGEMTDAAMAARAECVMLNKGPYLFKAITELDTLLGRMADHQHKKTPQLRRLRSWG

SEQ ID NO: 19871 - protein, 567 aa, Corynebacterium glutamicum ATCC 13032
MTPVQTQGYAVATANPIASEAACAVLREGGTAADALVTAQFVLGLTEPQSSGLGGGGYILYYDAEANAVTAIDGRETAPVAADENYLIHVSAEDQTAPVPDARRSGRSIGVPGIVAALGQLHDSFGKTSWQDVLTTPQQLATDGFSISPRMSASIANSAEDLSHDPEAAAYFLDENGDAKAPGTLLQNPDYAETIRLISEGGPDAFYTGEIAADIVERATREVDGFTPSLMSTADLAAYTPETREALCAPYRDKIVCGMPPSSSGGVTVMETLGILNNFDLAQYPPTEVGLDGGLPNAEAVHLISEAERLAYADRDAYIGDPAFVEVPAGGVEELISDVYTGERSELIDPEHSMGQATAGLSQEPVMAALPESGTSHISIIDSYGNAASLTTSVEAAFGSFHFTRGFILNNQLTDFSAEPLDEDGEPVANRVESAKRPRSSMSPMLVFNASGDGEIADLNMVLGSPGGSLIIQYVVKTLVNIIDWDMDPQQAVSAPNFGAMNQPKTGLGSEHPLIANDSAELVSELESKGHEVNVGEQSSGLSALVKNGDTIVGGADPRREGVVLGG

SEQ ID NO: 19872 - protein, 185 aa, Chlamydomonas reinhardtii
PMFVSAAVVDGEITKISLSDYKGKYVCLFFYPKDFTFVCPTEIIAFSDRAKEFAAANCQLIAASTDTEETHLAWIRTPRNRGGLGYMQIPILADTTKDISARYGVLIEKLGVALRGLFIINPQGVVQHVTINDLPIGRSVDEALRTLQAIQYHAEHGEVCPANWKPGSKTMVADAEKSLEYFSEV

SEQ ID NO: 19873 - protein, 479 aa, Salmonella enterica subsp. enterica serovar Paratyphi A str.
MSFLPVIMAGGTGSRLWPLSREYHPKQFLSVEGKLSMLQNTIKRLASLSTEEPVVICNDRHRFLVAEQLREIDKLANNIILEPVGRNTAPAIALAAFCALQNADNADPLLLVLAADHVIQDEIAFTKAVRHAEEYAANGKLVTFGIVPTHAETGYGYIRRGELIGNDAYAVAEFVEKPDIDTASDYFKSGKYYWNSGMFLFRASSYLNELKYLSPEIYKACEKAIGHINPDLDFIRIDKEEFMSCPSDSIDYAVMEHTQHAVVIPMSAGWSDVGSWSSLWDISNKDHQRNVLKGDIFAHACNDNYIYSEDMFISAIGVSNLVIVQTTDALLVANKDTVQDVKKIVDYLKRNDRNEYKQHQEVFRPWGKYNVIDSGKNYLVRCITVKPGEKFVAQMHHHRAEHWIVLSGTARVTKGEQIYMVSENESTFIPPDTIHALENPGMIPLQLIEIQSGTYLGEDDIIRLEQRSGFSKEWTNERS

SEQ ID NO: 19874 - protein, 547 aa, Glycine max
  misc_feature (217)..(217): Xaa can be any naturally occurring amino acid
  misc_feature (223)..(223): Xaa can be any naturally occurring amino acid
MSGPLDRFARPCFEGFSGSDEKKERRSDFENSEDERRTRIGSLKKKALNASSKFKHSLKKKSSRRKSDGRVSSVSIEDVRNFEEQQAVDAFRQALIMEELLPEKHDDYHVMLRFLKARKFDIERAKHMWADMLQWRKEFGTDTIMEDFEFKEIDEVVNYYPHGHHGVDKEGRPVYIERLGKVDPNKLMQVTTMDRYVKYHVQEFEKAFKIKFPACTXAAKRHXDSSTTILDVQGVGLKNFTKSARDLIMRLQKIDGDNYPETLCQMFIINAGPGFRLLWNTVKSFLDPKTTSKIHVLGNKYQSKLLEIIDASELPEFLGGTCTCADQGGCLRSDKGPWKNPEILKMILSGEARRARPVVKVLNSEGKVIAYARPQYPMVKGSDTSTAESGSEAEDIASPKVTKSYSHLRLTPVREEAKVVGKLSSAGGGNLAGYDEYVPMVDKAVDAAWKNQASLQRSQTSKGTPPLPDTTNTPEGIQARIVVALTVFFMTLFTLFRSVPCHVTKKLPAVSSNDDQGTSKPTLDATKTNYENYRPSFTNSSICRGKS

SEQ ID NO: 19875 - protein, 182 aa, Physcomitrella patens subsp. patens
MASVVAASTIVAPAAFAAASASVGSADSTSVKAFSGLKSATLFTSKAQTLSSVQNRSRVQCMQVWNPIGMTKFETFSYLPPLSDDAIAKQVEYMIQQKLIPCLEFDVNANGVSRTNNSSPGYYDGRYWTMWKLPMFGCQDSAQVLREIEECKKTFPGCFVRVLGFDNVKQVQICGFLVARPN

SEQ ID NO: 19876 - protein, 331 aa, Vibrio parahaemolyticus RIMD 2210633
MTIKVGINGFGRIGRFVFRAAQERADIEVVGINDLIDVEYMAYMLKYDSTHGRFNGTVEVEGGNLIVNGKTVRVTAERNPADLKWDEIGVDVVAEATGLFLTDETARKHIEAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELKGVLGYTEDQVVSQDFIGEVQTSVFDAKAGIALTDNFVKVVSWYDNEIGYSNKVLDLIAHISK

SEQ ID NO: 19877 - protein, 463 aa, Triticum aestivum
MEADAGKLFIGGISWDTNEDRLREYFEKYGEVVEAVIMRDRATGRARGFGFIVFTDPAVAERVIMEKHMIDGRMVEAKKAVPRDDQQALSKSGGSAHGSPGPSRTKKIFVGGLASTVTEADFRMYFEQFGTITDVVVMYDHNTQRPRGFGFITYDSEDAVDKALFKTFHELNGKMVEVKRAVPKELSPGPSMRSPAGGINYVMNRANSFLNGYTQGYSPSPVGGYGMRMDARFGLLSGGRSSYPSFGGGYGIGMNFDPGMNPGIGGSSNFNNSVQYGRQINPYYSGNSGRYNSNISYGGVNDNSGSVFNSLARNLWGNSGLNYSSNSANSNSFMSSANGGLGGIGNNNVNWGTPPVPAQGANAGSGYGSGSFGYGSTENNFNLSPGAYGRNTGSGGVNASLNQSSNGYGRNFGDSSAGGGGSIYGDTTWRSGSELDGTSPFGYGLGNAASDVTAKSSAGYMGH

SEQ ID NO: 19878 - protein, 375 aa, Hyphomonas neptunium ATCC 15444
MSSEFTAAISSIEEIIEDARNGRMFILVDAEDRENEGDLIIPATFATPEAVNFMAKHGRGLICLAMTQERGHTLRLDMMTRNNRESMQTAFTVSIEAKEGVTTGISAHDRSRTIAVAIDPTKDDDDIVSPGHIFPLIAKEGGTLVRAGHTEAAVDISRMAGLYPAGVICEIMNDDGSMARLPELVAFAQLHNLKIGTIADLIAWRRQNDRFLERRIETALESDYGSGFRTVCFRNTMDNSEHIAIVHGDITPDATTLVRVHRTDILSDILGEKGPRSGLVARAMRLIAKAPEPGVVVFVNAMQPGSIAERLGLKSGAARDPSAPIREYGIGAQILRELGVRSMIYLSDTQPTRLAGLDGYGLTIEGWRHLSEENT

SEQ ID NO: 19879 - protein, 416 aa, Oryza sativa Japonica Group
MATAVEAGRRRRAAAVVLGDIGRSPRMQYHSLSLANQGGMEVDIVANGGSDPHLLLRENPLIHIHEMKSVQLTGISKISGALSMLLKAAIQFIILIWYLCFKIPRPDVFIVQNPPSVPTLAAVKLASGLRGAKSIVDWHNFGYTLLGLSHGRSHIIVKIYFWFEKHFGRMADGAFCVTKAMKHELDKKWGINAMGNDDCISIGMFSTTLNISSLTPDEDFSILLEAALMYDRRVAATLGEDDSMDEGKLWIDIKNGKQFVYPRLLFIITGKGPDRKKYEEQIKRLKLRRVSFRTMWLASEDYPLLLGSADLGVSLHTSSSGLDLPMKVVDMFGCGLPVCAASFSCIDELVKVNNNGLLFSTSSELADELTMLFKGFPEECDELKSLKVGALNTGSSSKWSTEWERYALPLVNQVIG

SEQ ID NO: 19880 - protein, 610 aa, Burkholderia pseudomallei K96243
MTERERAARGRNDARRGGGDSGGDDEAWRRWLPGIATLRTYRRAWLARDLYAGVALTAVLVPVGMSYAQAAGLPVIAGLNASIAALVGYAIFGPSRILVLGPDSALAALIAGAIAPLAHGEPAHAVALAAALALMSGGFCVLAGLLKLGFVTDLLSKPIQYGYLNGLALTLIASQLPSLLGTVPLGGTFVDQVASLAATVAQGRIDFASLALGGGCLAGIALLRRVAPAWPGMLIAVAGASIVAAWLGAAPDAGGAHAHVAYAHVANAHVALVGSLAGTLPPLGLPSISLADASRLIAGALAIAMVSVADISVLSHVFAQHDCSETDRNQELCALGAANLLAGMLRGCAVSSSASRTPVALAAGARTQLTSLVAAACIALLLVAPTLLARVPLAALAAVVVYSANALVDVRAIVRLYRVRRGECAVSVLCFAGVVLLGVVPGILLAVGLSLLSFVWRAWHPYDAVLGRVEGMHGYHDVSRHPGAALTRGLVAFRWDAPLFHANATIFRDHVRDAIAEADAPVRCVVIAAEPITDVDVTAADMLATLRDELAARRIALVFAEMKGPVKDRLRTYGLFEKIGADHFFPTVTDAIEHFTRMRKDVATARRARR

SEQ ID NO: 19881 - protein, 156 aa, Physcomitrella patens subsp. patens
EILAMASAVASTVVAPVSVTVASSSVAASRESSSVKAFSGLKSATLFTSKSQQLSSVQNGSRVQCMQVWNPIGQPKFETFSYLPPLSDDQIARQVDYMIQQNLIPCIEFDTVGAVSRTNFSGSGSSGYYDGRYWTMWKLPMFGCTDSSQVLREIQE

SEQ ID NO: 19882 - protein, 442 aa, Mycobacterium smegmatis
MVDGQDVVADVHDVLDRMGDFTDRLRSGEWTGATGERITTVVNIGIGGSDLGPVMVYDALRHYADAGISARFVSNVDPADLVAKLDGLEPAKTLFIVASKTFSTLETLTNATAARRWLTDALGDAAVAKHSSRCPPTRSWSTKFGINTDNMFGFWDWVGGRYSVDSAIGLSVMAVIGKERFAEFLAGFHIVDEHFRTAPLHQNAPALLGLIGLWYSNFFGAQSRAVLPYSNDLSRFAAYLQQLTMESNGKSVRADGTPVSTDTGEIFWGEPGTNGQHAFYQLLHQGTRLVPADFIGFSQPTDDLPTADGTGSMHDLLMSNFFAQTQVLAFGKTADAIASEGTPADVVPHKVMPGNRPTTSILATKLTPSVVGQLIALYEHQVFTEGVIWGIDSFDQWGVELGKTQAKALLPVLTGDKSPAAQSDTSTDALVRRYRTERGRPA

SEQ ID NO: 19883 - protein, 146 aa, Arabidopsis thaliana
VTNKPKILDIDESDKDNHLAAVEYVEDMYSFYKEVEKESQPKMYMHIQTEMNEKMRAILVDWLLEVHVKFELNLETLYLTVNIIDRFLSVKAVPKRELQLVGIRALLIASKYEEIWPPQVNDLVYVTDNAYNSKQILVMEKTILGN

SEQ ID NO: 19884 - protein, 538 aa, Frankia sp. EAN1pec
MSTPFDRSSLTADRRARELGELAGGEAVDLLVVGGGVTGAGVALDAASRGLSVALVEAHDLAFGTSRWSSKLVHGGLRYLASGDIGLARESALEREILMRRTAPHLVHPLPIVLPLTEDVPAGSAMLARAGMGLADLLRRGARTPGTVLPPPRRLSAVETLGMVPGLREAGLRGGLLHWDGQLVDDARLVVTIARTAAAFGARVLTRVRVLSVESPGYAPGGAARRGGLPPEPVGVEVVDTLTGTRCTLRARTVVNATGVWTPALAPEVRLRPSRGTHLVLPAAAFGGTPTALSVPIPGERNRYALVLPQGDGRVYVGLTDIPTDEVADVPTPDHQEITQLLNVVSSVLATPVDRADLLGAFAGLRPLLDGPNGRTADLSRRHAVHVGSDGVITVVGGKLTTYRRMAADAVDAAVAQADLDAGPCRTDRLPLVGAASRRVLAAVPAPRRLVARYGTQAPAVLALAERDPELLAPIADGVAVTRAELVFAVRHEGALDADDLLDRRTRVGLVPADRAAALDAAREVLAACAVPAGSPVD

SEQ ID NO: 19885 - protein, 593 aa, Frankia sp. EAN1pec
MTGTARLDPASRAAALRRMRAEPVDVVVIGGGVTGAGVALDAATRGLSVALLEARDLAAGTSSRSSKLIHGGLRYLEQLNGALVREALRERSLLLETIAPHLVRAIPFLLPLTHHGWERAYIGSGVLLYDTLGQGIGRIAPRTGGDGGAPRNGGVPLHRHLTRKAALREFPSLRPDALVGAIQYWDGQVDDARHTMFVARTAARYGALIATSAQVTGLVREGDRVAGVRVRDLENGVDLEVRAAQTINAAGVWTDDIQAMVGGRGRLSVRASKGVHIVVPRDRIHGSTGLILRTEKSVLFVIPWGSHWIVGTTDTEWNLDLAHPAASSADISYLLDTVNRVLRTPLTTEDITGVYAGLRPLLAGESEDTSQLSREHAVVSPVAGLTMVAGGKYTTYRVMAADAVDAATVGMSRAVPPSCTDRVPLLGADGYPALWNAREGLARASGLHVAWVEHLLHRYGTLTEEVLALVADRAELGRPLRGAPKYLAVEAVYAASHEGALHLEDVLTRRTRISIETADRGLEAAPQVAELIAPVLGWSPATVGREIDHYRARVTAELESQRQADDHTADAARLGAPDVRPVVREGRGAAAPA

SEQ ID NO: 19886 - protein, 527 aa, Aspergillus nidulans FGSC A4
MDEKLRLDINPGNKNFTNAAVVIIGAGISVTSILYSYSFEQSTKWSRQFPGQEELLAYLTHVAEKYGLYKYIRFNSEVTEARWSDEEKKWKVSTKVSGDKDNQFTRSYVLSTDFLISAVGQLNFPREPDIPGLNDFRGKMMHSARWDWTYNYENKRIAIIGNGATAAQIVPEVAKVASHLTVYQRTPNWVIPRSDTAISPLEQALLTYLPPLRIRKRSLAMDFRESFHEVIRDSQSQTARLARDITAQRLRTQLANKPELWDKLTPKYAPGCKRLIITDDYYPALSRENVDLETRRILRITETGIAVEGDSQQEYDLIILATGFKTVEFMCPIKIHGSKGRALTEIWKDGASAYYGVTVEDLPNFGMFYGPNTNLGHSSIILMIEAQSRYLNALVARVLQARTQGKTLIIKPTVRALQKFNMELQKALARSSFADANCSSWYKTENGKITNNWSGTVVDYQRSLSQVRWADYEVEGTAKDAVRPGEVTNLGRVHEETYISNRSLVLTIAVEQVEFYKAETEAGLSPD

SEQ ID NO: 19887 - protein, 499 aa, Frankia sp. EAN1pec
MSRSDDADGGTGASEVDVIVIGAGPAGEVVAGRCAAAGLSVTVVEHERVGGECSYWGCIPSKTLLRPGEVVAAARAVPGAAGAVGGARAGVDAAAAFARRDEMVGGYSDEGQLPWLRERGVSVRRGAGRLVGERRVAVLAPDGGEQVLTATRAVVLATGTRATIPPVPGLAEADPWDNRSATGARAVPARLAVLGGGAVGAELAQAFRRLGSAEVTVVEGGPRLLAREEPFAGDEVRAAFEAEGITVHTGRRAVAVRREAPGTPGEPGGPGTPRGPVVVTLDGDGGPEHVAADEILVAVGRTPATGELGLPAVGLPARGFVEVDDRMRATGVTGDWLYAVGDVNGRALLTHMGKYQARVAADAITGRLDPAGRPAADRADPGAVPRVTFTDPQVSAVGRTEATARAAGLDVRAVTVPTASVAGSSVRGTDAVGTSQIVVDTARRVLVGATFVGHDTQEMVHAAAIAIVGAVPLEDLWHAVPSFPTVSEVWLRLLEAYGL

SEQ ID NO: 19888 - protein, 372 aa, Desulfitobacterium hafniense Y51
MKLFEYQAKELFAESGIPIPQNALIGDISELNSALEKLGLPCVLKAQVLQGGRGKAGLVKFVRTKEEAQKEAERILEATGKKLLVEEAVPYEREMYVSITVDAASGLAMVMACLEGGVDIEQIARTTPEKIIKEKVDMSLGLMAYQADNIMYGLGLEQSAAKEGSKILLKLYQLFVKYNAELVEINPLMILRDGTMAAADGKFNLDDNALYKQNRFSLTRDHYKSDFEYEAALDGIPYIAFEGDIGMMVAGAGLANVVLDLIHYYGGTVANYLEFGGPNYHKAQQCMKMMLKAKPKCILIATFGTIARADVMAQGIVEAVKELKPEIPIVAVIRGTGEEDAQKLLRSAGLPSLSDTEEAVRKAVEIVGGAEN

SEQ ID NO: 19889 - protein, 340 aa, Frankia sp. EAN1pec
MQLGMIGLGRMGANLVRRLMRDGHECVVYDVNPETVKSLAAEGAVGVNSLADFAAALSTPRAAWVMVPAGLTGQTVFELAEHFEAGDIIIDGGNSYYRDDVDRAAKLAERGLHYVDVGTSGGVFGLERGYCLMIGGEPEVAARLEPLFETIAPGVDTAPRTPGRTGEIAQAEKGYLYCGPNGAGHFVKMIHNGIEYGMMAAFAEGMGILEKAGIGRSEAALHDAETAPLAHPEYYQYDFDIASVAEVWRRGSVVSSWLLDLTATALAEDPRLSEFGGRVSDSGEGRWTVLAAVEEGVPAHVLTASLYERFSSRGESLFADKLLSAMRKQFGGHAEKKAEG

SEQ ID NO: 19890 - protein, 408 aa, Streptococcus pyogenes MGAS315
MLDAKDIKQDFQILNQQVNDEPLVYLDNAATTQKPALVLEALQSYYQEDNANVHRGVHTLAERATHKYEASRQQVADFIHAKSSKEVLFTRGTTTSLNWVARFAEQVLTPEDEVLISIMEHHANIIPWQQACQKTGARLVYVYLKDGQLDMDDLANKLTTKTRFVSLVHVSNVLGCINPIKEIAKLAHAKGAYLVVDGAQSVPHLAIDVQDLDCDFFAFSAHKMLGPTGLGVLYGKEELLNQVEPLEFGGEMIDFVYEQEATWKELPWKFEAGTPHIAGAIGLSAAISYLQRLGMADIHAHEAELIAYVLPKLEAIEGLTIYGPSQPSARSGLISFNLDDLHPHDLATALDYEGVAVRAGHHCAQPLLSYLGVPATVRASFYIYNTKADCDRLVEAILKAKEFFNGTL

SEQ ID NO: 19891 - protein, 402 aa, Prochlorococcus marinus str. MIT 9211
MTPERLGLLWGITVFAGAGARVLSVISGLPGVVLLLLSGLLIGRSGLGLVEPLDLGQGLETIVGLLVSLVLFDGGLNLRLPGGTIKATVLRISLIRIFISFAAVLVTAHLLAGLSWSVSSVYSAIVLATGPTVVTPLVQQIRLASPLGDVLEAEGLVLEPIGAVLALLLLELLVGDLHGLREVAFGLLARLGGGVIMGLFAGWILAEALQRIKTDASLGIRLQLTLGIVFLLYGFCEWLLPESGLPASVAAGFIVGRRQSIEVDQLDQLIRELAQLAITMLFPLLAADVSWRELSPLGWGGISCVLVLMLIIRPAAVSLATIGLPLDFRQRLFLGWLAPRGIVTAAVASLFSIRLEQAGVLGAGRLQGLVFLTILMTVGIQGLTAKPLAKGLGLLAKQEQTP

SEQ ID NO: 19892 - protein, 490 aa, Clostridium perfringens
MDNKNFQSKTGFNLENTYLTLPNIFFSEQNPKGSKNPKLIKFNTSLAEELGLNEEVLNSDFGLNIFAGNETFPGIVPIAQAYAGHQFGHFTMLGDGRALLLGEHVTKDGKRYDVQLKGSGRTIYSRGGDGKAALAPMLREYIISEGMHGLGIPTTRSLAVVSTGEEVLRERFEQGAILTRIASSHIRVGTFAYAAQWGTLDDLKSLADYTIKRHFPNIAKSENKYILFLEEVINRQAELIVKWQSVGFIHGVMNTDNMVISGETIDYGPCAFMDTYDTNTVFSSIDYAGRYAYGNQPNMALWNLARFSEALLPLLNPNLDEAVNIAKKSISNFSKLYKKYWFNKMRAKLGLFTEKENDELLIEGLLSTMQKYEADFTNTFVSLTLNKFEDEKVFSSDEFKTWYALWQNRLKEENRPQEEVRNLMMNNNPYIIPRNHLVEEALKNAEKGDFTFMDNLLEALKNPYSYSKDLEKYTKLPEKSNTPYVTYCGT

SEQ ID NO: 19893 - protein, 183 aa, Coprinopsis cinerea okayama7#130
MADVDLIKSRLTSHPDFPKKGIVFLDIFPILRDPLVFETLISHIVQHIASHTLALTPTKKIDAIVGLDARGFLLGPIIALRLGAAFVPVRKKGKLPGETTSVTYEKEYGADSFEIQTDAIKPGQTVVIIDDLIATGGSAKAAGELVEKLGGKTLEYIFIIELLFLKASSKLNAPVYSIVQSED

SEQ ID NO: 19894 - protein, 280 aa, Prochlorococcus marinus str. MIT 9211
MSKLFADLLSSGALGKQINQGPRIQQRRGVEIKSSREVAIMRKASQIVATVLREINEMVEPGQSTKDLDKYAETRIREMGAVPSFKGYHGFPASICSSINNEVVHGIPSSKKIIKRGDLLKVDTGAYFDGYHGDSCITICVGDVSDEAKQLSRVAQESLMAGLAQIKPQNTLLDIAGAIEDHVKAHGFSVVEDYTGHGVGRNLHEEPSVFNFRTTELPNIQLRSGMTLAVEPILNAGSKACRTLKDGWTVVTKDNSWSAQWEHTILVTDDGCEILTDRTK

SEQ ID NO: 19895 - protein, 422 aa, Brassica napus
MSTFRSSLFSAATVYTASLSLVAMASATFSVAKPSLQGFSDFSGLRNSSALPFGKKSSSDEFVSFVSFQTSAMGSNGGYRKGVTEAKLKVAINGFGRIGRNFLRCWHGRTDSPLDVIAITDTGGVKQATHLLKYDSTLGIFDADVKPSGDSALSGDGKIIKIVSDRNPSNLPWGELGIDLVIEGTGVFVDREGAGKHIQAGAKKVLITAPGKGDIPTYVVGVNAELYSHEDTIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDAAANELKGILDVCDEPLVSVDFRCSDVSSTIDSSLTMVMGDDMVKVIAWYDNEWGYSQRVVDLADIVANNWK

SEQ ID NO: 19896 - protein, 469 aa, Escherichia coli
MSAEHVLTMLNEHEVKFVDLRFTDTKGKEQHVTIPAHQVNAEFFEEGKMFDGSSIGGWKGINESDMVLMPDASTAVIDPFFADSTLIIRSDILEPGTLQGYDRDPRSMSKRAEDYLRSTGIADTVLFGPEPEFFLFDDIRFGSSISGSHVAIDDIEGAWNSSTQYEGGNKGHRPAVKGGYFPVPPVDSAQDIRSEMSLVMEQMGLVVEAHHHEVATAGQNEVATRFNTMTKKADEIQIYKYVVHNVAHRFGKTATFMPKPMFGDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEAKEIPQVAGSLEEALNELDLDREFLKAGGVFTDEAIDAYIALRREEDDRVRMTPHPVEFELYYSV

SEQ ID NO: 19897 - protein, 369 aa, Escherichia coli
MKSRAAVAFAPGKPLEIVEIDVEPPRKGEVLVKITHTGVCHTDAFTLSGDDPEGVFPAVLGHEGAGVVVEVGEGVTSVKPGDHVIPLYTAECGECLFCKSGKTNLCVSVRATQGKGLMPDGTTRFSYKGQPLFHYMGCSTFSEYTVVAEVSLAKINPQANHEHVCLLGCGVTTGIGAVHNTAKVQPGDTVAIFGLGGIGLAAVQGARQAKAGRIFAIDTNPEKFDLARSFGATDCINPKDYDKPIQDVLIELTGWGVDHTFECIGNVNVMRSALEAAHRGWGQSVVIGVAGAGKEISTRPFQLVTGRVWKGSAFGGVKGRTQLPGMVEDAMKGEIDLAPFVTHTMGLEEINDAFDLMHEGKSIRTVIHY

SEQ ID NO: 19898 - protein, 468 aa, Salmonella enterica subsp. enterica serovar Paratyphi A str.
MSKQQIGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRTDKEGIFHTEWLE

SEQ ID NO: 19899 - protein, 388 aa, Salmonella enterica subsp. enterica serovar Paratyphi A str.
MKITISGTGYVGLSNGLLIAQHHDVVALDIVPARVELLNDRISPIVDKEIQQFLKEDNIRFRATLDKFDAYQNADYVIIATPTDYDPKTNYFNTFSVESVIQDVISINPAAVMIIKSTVPVGFTAAMRQKFTTENIIFSPEFLREGKALYDNLYPSRIVIGEQSERAREFAALLQEGAIKQEIPTLFTDSTEAEAIKLFANTYLAMRVAYFNELDSYAETLGLNTRQIIEGVCLDPRIGNHYNNPSFGYGGYCLPKDTKQLLANYQSVPNNIISAIVEANRTRKDFIADSILARKPKVVGIYRLIMKSGSDNFRASSIQGIMKRIKAKGVEVIIYEPVMQEETFFNSRLERDLHCFKQQADVIISNRMAAELLDVAEKVYTRDLFGSD

SEQ ID NO: 19900 - protein, 306 aa, Cryptococcus neoformans var. neoformans JEC21
MLGRVGGAKEDETWTKTVSMRMFLPLLLEDGGGRRPPRRSGARKVNDVAFANGVPIYTSRRTRSKKYLMVIPSSHCATATQPLSHTTMSLIHALIARGTTVLAEHATGTAELKPAAQITILSKIPPNNSKLTYVWQDRLIHYVSSNGVIYLVMADDSVGRRMPFAFLADLERRFTAQYESDDIVSAGAHSLEEFEPELAKLMHQYTSSPPADPLRQAQSDLNNVKDIMVQNIDSILQRGERLDLLVDKTDTLAGQAYAFRRGARSVRRQQWWKNMRIMALSGVVGLLLLYLFIAQFCGASLGHCRS

SEQ ID NO: 19901 - protein, 441 aa, Geobacter sulfurreducens PCA
MSRIDLSRYLSAVDAMKPIRFHGKVTQVVGLVIEGFCPDAAVGTLCLVHPNDGDPIPAEVVGFRDNKTLLMPLGELRGVGLGSLISVKRKKASLGVGPGLLGRVIDGLGVPIDDKGPLAIREEYPIYANPVNPMKRRPIRQPLDLGIRAINALLTCGEGQRVGIMAGSGVGKSTLLGMIARYTEADVNVIALIGERGRELREFIEKDLQEEGLKKSVVVVATSDQPPLVRMRGAYIATTIAEYFQAQGKKVLLMMDSATRFAMAMREVGLAIGEPPTTKGYTPSVFAALPKLLERTGSFLDGSITGLYTVLVEGDDFNEPISDAMRSILDGHIVLNRELAARAIYPPLDILASASRVMNDVTERSQQQFASRFKELLAAYRQAEDLINIGAYKPGSNPTIDYAIAKMDGMINFIRQGIHDGVSMEQSIAELADIFDEGMAL

SEQ ID NO: 19902 - protein, 298 aa, Vibrio vulnificus CMCP6
MDNSMIDVLASFQQRNNQQLNLWLDKLPHQNQALIQAMRYGLVLGGKRARPFLVYATGEMLGCSQEQLDTPASAIECIHAYSLIHDDLPAMDDDELRRGQPTCHVKFDEATAILTGDALQTLAFTILAEGTLSADGETQRVAMIQALAQASGAQGMCIGQALDLAAENRAVTLEELEEIHRNKTGALIRCAVRLGALAAGEKGLAILPQLEKYSTAIGLAFQVQDDILDIISDTETLGKPQGSDQELNKSTYPSLLGLEGAMEKAHTLLHEALQALEAIPYNTQHLEEFARYVVERKN

SEQ ID NO: 19903 - protein, 330 aa, Oryza sativa
MANSRRPAAAATAPSPSPPASDLEVGFAKLQGEDFEYYMQTYSIVLGRHSRRRNQPVGVGVGVGVGGGGGGGGDAAADDVDVDLGILGGGMNVSRRHARIFYDFPRRRFALEVLGKNGCLVEGVLHEPGGEPVKLDSQDLLQMGDAQFYFLLPTRSVFATDAARRASAAARRAVPPPPSSSSDGDDGEEEREAAVAKRPRNGDAGSLAGRKSEKGSKGYRQSDNLQLLQLEEKDVISSTATVLSDLCGPQEWVPMDRLHEVMFEKYGDLWHHNRVRKYLTSEDWPKSETDGRPWHGLSLLLRKYPEHFVINIRMSGGRSIEFVSLVSLQP

SEQ ID NO: 19904 - protein, 346 aa, Prochlorococcus marinus str. MIT 9303
MTGTNPVHSNEPEVICLGEALVDRLGPLGGDPVVDQPVEDCLGGAPANVACGLARLGSKVAFLGRLGDDSIGARFRELFDTRGVNLAGLQTDLRRPSRIVLVRRDLDGERVFQGFAGDRGDGFADQALSLDELAASWPLLVGKASWLLIGSIPLATPASAQALLWCVEQAQTAGIEIALDVNWRSTFWDPGRSPDSGPDEKALQAIAPLLERASLLKLAREEAVWFFDTDDPAVIARSLPQQPDVVVTDGARPVRWWIGGCVGELAALSPPSVVDTTGAGDAFTAGLLHQLLMDVSSQRDSIKVREMVRFAAACGALVCGGAGGIDPQPSQMQVEEFLGSVAGDVN

SEQ ID NO: 19905 - protein, 113 aa, Brassica napus
KFVGGCRFPKDGFPAKALKFVGSLVPHVHRPLFYGGIFLSPVAKKSPNGKLRVLFEVFPRAFLMDQAGGQALTGKKRALDLVPKKIHERSPIFFGGFDHVKEIKALFAAGENN

SEQ ID NO: 19906 - protein, 121 aa, Oryza sativa
EARHLSTSTATMSSQPEHATLLIPGPIEFDDEVLKSMGHYSESHVGPGFVNTFGETLTLTRKLFQSTDPSAQPYVISGSGTLGWDIVAANLVEAGENALVLSTGYFGDGFADCLRAYGANV

SEQ ID NO: 19907 - protein, 294 aa, Listeria innocua Clip11262
MTKTLQDRMILPGNETIPYIGLGVFQVTEQEFIAGAVEKAIEVGYRLFDTAAVYNNEAIVGQAILDSAVPREELFISSKVWNGDLGYDETLFAFERTLRNLKLDYLDLYLIHWPVAGKYRDSWRAMERLHDEKLIKSIGVANFKQHHLSDLLVAANEKPVLNQVETHPLLPQNDLRKYLAEQNIAHAAWSPLAKGILMQNPVITEIAKKHQASVDQVILQWHLNRNTIIFPKSITSSRIEENSRLSYFQLDASDMEKIDRLETGKRVGPDPDDLEYFLSSIERERAYLTGGEKE

SEQ ID NO: 19908 - protein, 267 aa, Prochlorococcus marinus str. MIT 9211
MTNPIRNVTPGGSGGAATLMLILSFTGILLLTQALFIVPAGQVGVVTTLGKVSGGSRRPGLNFKIPFVQSVYPFDVRTQVQDEKFSSLTKDLQVIDANATVKYALKPSEAGRVFRTITYSDREVYSKIIKPSLLKALKSVFSQYELVTIASQWSDISELVEKTVSEELSKFDYVDVQALDLTNLKIADEYKAAIEQKQIAEQQLLKAQTEVKIAEQEALRYETLTRSLDDQVLFKLFLDKWDGKTQVVPALPGSKAGTPPVIVGGKR

SEQ ID NO: 19909 - protein, 289 aa, Coprinopsis cinerea okayama7#130
MRYAVLVTGPAGAGKSTFSGAFMTHLRNSKRTAHLVNLDPAAAPESFEYEPVIDIKDLISLEDVMNELEYGPNGGLVYCFEYLMENMDWLEEELGGYDDDYLIIDCPGQIELYTHHPFLPTLVQNLQRLNIRTSAVYLIESQFIEDKYKFFSGVLSAMSAMVNLEIPWINIMSKMDLILPNPEDESKGARNGLRRRKDIARYLDPDPLLLATRHDDRTPDSNPRFHALNQALVQLIEDHPLVSFLPLDLTNTDSIETVISHIDYTMQYGEDEEPKEPHDLDEGDFQDLE

SEQ ID NO: 19910 - protein, 321 aa, Vitis vinifera
MAAVTSTSLASQLSTPKATTPSYSYSSATQFSGLRRSFSNLDHSPQPFFSSNLRISSSPRKPCRGIVAMAGSGKFFVGGNWKCNGTKDSISKLVSDLNSAKLEADVDVVVAPPFVYLDQVKNSLTDRIEISAQNSWVGKGGAFTGEISVEQLKDIGCNWVILGHSERRHVIGEDDQFIGKKAAYALSQGLKVIACIGELLQEREAGKTFDVCFQQMKAFAGNWDDVVIAYEPVWAIGTGKVATPLQAQEVHIAVRDWLKKNVSAEVASKTRIIYGGSVNGSNCSELAKQEDIDGFLVGGASLKGPEFAVIVNSVTSKKVAA

SEQ ID NO: 19911 - protein, 383 aa, Listeria innocua Clip11262
MMNNSKIAKKHQQMPVNILADIGTLAKTMPDILDLSIGDPDLITDASIINAAFEDVRAGHTKYTESGGDVELIDAIRGYFSRNYDLSFERSQIRATVGALHGMYLTLQTILDDGDEVIIHEPYFSPYKDQVLNSGGTPIIIPTYEKDGFAINVDILEAAITNKTKALILNSPNNPTGAVFSPETFEKIANLAKKYDFFILSDEVYDGFSFYEDFVPMAKFAPDHTITFGSMSKNFAMTGWRLGYMIAPTYLNEAAKIINEGITYSAPSPSQRAAIYALNHSETLIPLVTETFQKRLEYIAKRVAEIPYLSLHPLKGSIYAFINISKTKMDSVSFTEYVLKETQVLVIPGLAFGESGDNYVRLAATQDISVLEEAFNRLAKLTF

SEQ ID NO: 19912 - protein, 146 aa, Escherichia coli
MGPLCSREKRMLGLMVGALVLWIFGGDYIDAAMVGYSVVALMLLLRIISWDDIVSNKAAWNVFFWLASLITLATGLNNTGFISWFGKLLAGSLSGYSPTMVMVALIVVFYLLRYFFASATAYTSAPAPMMIAARWRCRKSRCRCSA

SEQ ID NO: 19913 - protein, 308 aa, Lactobacillus acidophilus NCFM
MSSKISILGSINLDSTYHVDKIPLPGETIHVNKKTFAAGGKGANQAVAAKRSGATVSFIGAVGNDAAGKYMLNELEKEKINLSNVQIKDTAQTGTATVLLDENGQNSILVYAGANGLIDSSQINKAEDTIANSDYIIAQFETPISAIISAFTIAKKHGVTTILNPAPATTIDNKLLKVTNIIVPNETESAAITGINVTDEESMQRTARYFREKGVKVTIITLGSRGVYYSSPTENRFISAYKVNAVDTTGAGDTFIGAMTSVLTTDLLNISAAIDYGQQASSITVQGIGAQPSIPTKEKIKQVYRMSD

SEQ ID NO: 19914 - protein, 358 aa, Arabidopsis thaliana
MLLWFLFVKVPAPDIFLVQNPPSVPTLIAVKWASSWRRAAFVVDWHNFGYTLLALSLGRNNLLVSLYRWSENHYGKMATGSLCVTKAMQHELDQNWGVRAKVLYDQPPEFFRPALLEERHEVSILENQELNETLFTTKFNADISLKQNRPALVVSSTSWTPDENFGILLEAAVMYDRRVAARSKGSETAEISEEQHHYPNLLFIITGKGPEKEMYEEKIKRLNLRHVAFRTMWLAAEDYPLLLGSADLGVCLHTSSSGLDLPMKVVDMFGCGLPVCSVSYSCIQELVKDGKNGLLFSSSSELADQLLILFKGFPGNCDALMSLKAGAMETGSSGRWATEWEDCAKPLITQVVSQIADS

SEQ ID NO: 19915 - protein, 1212 aa, Oryza sativa Indica Group
MQFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQVYVLGLFWNGNSIIGILKFAPLSQQTCPVICFACLMCLRFFNSHLLATYETEELMGEVNSCKEMKSVCNWFALARQLIILLSVLVSCPGCQDFLSSLKMSHSSDEDSEISDSEIDEYADKFYARLVAGEFKVKDGQSYSCPFCSGKKKKDFNINNLIQHASGVGAASNRQAKDKATHRALAKHLKNGLTKSSGQQSQTAVVEPQPLPNRDEKFVWPWMGVLVNVPTEWKDGRQIGRSGNHLKEQLSRFCPLKIIPLWNFRGHSGNAIVEFGKDWHGFRNALAFEDYFGKEGYGKRDWKEKQNQGSNLFGWVARAEDHTSPGLIGDHLRKNGDLKTINDLENEGARKTDKLVANLANQIEVKNRHLQELEVTYNERTTSLEKMMGQREQLLQKYNEEIRKMQQLAQRHSQKIIDENQKLRSELESKMSELNTRSKELDEIAAKSDYDRRIIDQEKQKNAIKSSHLKLATLEQERADENVLKLVREHKREKEAAVKKILKLEQQVDAKQKLELDIQQLKGKLEVMKHMPGDEDSALKNKIDELSEELQEKMDELDAMESLNQTLVIKERKSNTEMQDARKELENGLLDLLDGQSHIGIKRMGELDLEAFSKACRKMSSEEDAEITAAILCSKWQAEIKNPDWHPFRFVLVDGQEKEIIEDDAKLQELKEEHGEDIYRLVRDALCEINEYNPSGRFPVGELWNFKDKRKATLKETVQFVLRQWRANRRKR

SEQ ID NO: 19916 - protein, 313 aa, Lactobacillus acidophilus NCFM
MTNDEKLTANAVIADTLDKATATDSDLLVVTCDSRGSAGLVPFTNAHPDRTVEMGIAEQNAVTVAAGLAHEGKHPFVFSPAAFLAMRSIEQVKVDVAFNKNNVKLIGISGGNSYTWLGNTHHSLNDVAITRAIPDLEVYQPCDKYQVKALFNYLLKSNKPAYVRIGKRKLDNVYHEDFGFIPGKATIIKPGKDICLISTGETLYFTLKAAEKLASDGIDVEVVDLGSIKPIDTEMIGKLAQEFDQIVTIEEHDVINGIGAAVASEVAKYGHAKLNSLGFPDKPAIQGTQDEVFHYYGLDAEGIEKSVRKILAK

SEQ ID NO: 19917 - protein, 621 aa, Vibrio vulnificus CMCP6
MTLDISKYPTLALAETPDELRLLPKETLPTLCDELRTYLLNSVSQSSGHLASGLGTVELTVALHYVYNTPFDQLIWDVGHQAYPHKILTGRREQMPTIRQKGGLHPFPWREESEYDTLSVGHSSTSISAALGMAICAEKEGQNRKVVSVIGDGAITAGMAFEAMNHAGDVHSDMLVILNDNEMSISENVGALNNHLARVLSGNLYTSIREGGKKVLSGVPPIKELVRRTEEHLKGMVVPGTLFEELGFNYIGPIDGHDVVELVKTLKNMRELKGPQFLHIMTKKGKGYEPAEKDPIGYHGVPKFDPAHNSLPKSSGGKPSFSNIFGDFLCDMAAQDPKLMAITPAMREGSGMVRFSKEYPEQYFDVAIAEQHAVTLATGMAIGGYNPIVAIYSTFLQRGYDQLIHDVAIMNLPVMFAIDRAGLVGADGQTHQGAFDLSYMRCIPNMVIMAPSDENECRQMLYTGHKHQGPSAVRYPRGNGMGTPIESEFTALEIGKGRLVRQGEKVAILSFGTFLANALEAAEALNATVADMRFVKPLDEALLRQLANEHDVLITIEENAIAGGAGAGVIEFMMQEKIMKPVLNLGLPDKFIHQGTQEELHEELGLDAKGIEQAIRHYLAK

SEQ ID NO: 19918 - protein, 156 aa, Vibrio vulnificus CMCP6
MKVIEGGFPAPNAKIAIVISRFNSFINESLLSGAIDTLKRHGQVSEDNITVVRCPGAVELPLVAQRVAKTGKFDAIVSLGSVIRGGTPHFDYVCSEMNKGLAQVSLEFSIPVAFGVLTVDTIDQAIERAGTKAGNKGAEAALSALEMINVLSEIDS

SEQ ID NO: 19919 - protein, 369 aa, Vibrio vulnificus CMCP6
MPISTPQEIIEDIRLGKMVILMDDEDRENEGDLIMAAEHITPEAINFMAKYGRGLICLTMTKERCQRLGLPPMVQDNNAQYTTNFTVSIEAAEGVTTGISAADRARTVQAAVAKEAKAADLVQPGHIFPLAAQDGGVLTRAGHTEAGCDLARLAGFEPASVIVEILNDDGTMARRPDLEVFAEQHGLKLGTIADLIEYRNNTETTIERVAECKLPTEFGEFDLVTYRDTIDNQIHFALRKGTMGDQTPLVRVHLQDTFTDLLRSDRNAERSWTLDKAMKRIGQEGGVLVILGNEESPELLIHRVKMFEAQDKEEAPKLAKKQGTSRRVGVGSQILADLGVHDMRLLSSSNKKYHALGGFGLNVVEYVCE

SEQ ID NO: 19920 - protein, 306 aa, Vibrio angustum S14
MKPTAALLNEVLDEVRPLIGQGKVADYIPALANVPASKLGIAVCYNDGEVIQAGDSQEGFSIQSISKVLSLTLAMTLYEPEELWSRVGKEPSGHAFNSMIQLELEKGIPRNPFINPGAIVVSDLLHSRLCAPQYRMLELVRELSCNPHIVYDKVVASSEMQHSDRNASIAYLMRSFGNFDNEVMPVLTNYFSYCALKMSCVDLARTFSYLANKGLPLGAKKRIISQTQSKHINALLATCGLYDGAGEFAYRVGMPGKSGVGGGIVAIVPGEMTIAVWSPELDQSGNSVAGTAALEKLSERIGRSIF

SEQ ID NO: 19921 - protein, 490 aa, Corynebacterium glutamicum ATCC 13032
MTINVSELLAKVPTGLLIGDSWVEASDGGTFDVENPATGETIATLASATSEDALAALDAACAVQAEWARMPARERSNILRRGFELVAERAEEFATLMTLEMGKPLAEARGEVTYGNEFLRWFSEEAVRLYGRYGTTPEGNLRMLTALKPVGPCLLITPWNFPLAMATRKVAPAIAAGCVMVLKPARLTPLTSQYFAQTMLDAGLPAGVLNVVSGASASAISNPIMEDDRLRKVSFTGSTPVGQQLLKKAADKVLRTSMELGGNAPFIVFEDADLDLAIEGAMGAKMRNIGEACTAANRFLVHESVADEFGRRFAARLEEQVLGNGLDEGVTVGPLVEEKARDSVASLVDAAVAEGATVLTGGKAGTGAGYFYEPTVLTGVSTDAAILNEEIFGPVAPIVTFQTEEEALRLANSTEYGLASYVFTQDTSRIFRVSDGLEFGLVGVNSGVISNAAAPFGGVKQSGMGREGGLEGIEEYTSVQYIGIRDPYAG

SEQ ID NO: 19922 - protein, 366 aa, Corynebacterium glutamicum
MQTLAAIVRATKQPFEIATIDLDAPRPDEVQIRVIAAGVCHTDAIVRDQIYPTFLPAVFGHEGAGVVVAVGSAVTSVKPDDKVVLGFNSCGQCLKCLGGKPAYCEKFYDRNFACTRDDGSTAFSEDGEQVGSHFFGQSTFANYTNVSARSVVKVDDDVPLELLGPLGCGLSTGAGAILNSLGVRAGDTVAVFGTGAVGSAAIMAAAATGSTTIIAVDIHNSRLEMARELGATHTINSKDEDPVEKIKQLTGDGVQFALDTTGVLAVTRQAADSLAINGTVGLVGAPAPGTEATFEVGASLVRGWKFQTIIEGDAVPQEFIPRLVHLWRQGKLPIEKLVRTYPLEQINDAFADSASGEVIKPIITFP

SEQ ID NO: 19923 - protein, 186 aa, Halobacterium sp. NRC-1
MSSLADTIHIENVVASSDLGQELALDQLATDLDGAEYNPEDFPGVVYRLQEPKSATLIFRSGKVVCTGAKSVDAVHDALEIVFDDLRELGIDVDSTPPVKVQNIVSSASLEQSLNLNAIAIGLGLEQIEYEPEQFPGLVYRLDDPDVVVLLFGSGKLVITGAAESADAQHALAHVNDRLTELGLLE

SEQ ID NO: 19924 - protein, 312 aa, Zea mays
NSARGQTPVFPRILGHEAGGIVESVGEGVTECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNINAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 19925 - protein, 181 aa, Vibrio parahaemolyticus RIMD 2210633
MTTETISLIKSSIKSIQDYPKPGILFRDVTSLLEDAKAYQATIGLLVERYKDMGFTKVVGTEARGFLFGAPLALELGVGFVPVRKPGKLPRPTIAQSYELEYGIDTLEIHTDAIVEGDKVLVVDDLLATGGTIEATTKLIRQLGGEVEHAAFVINLPEIGGDKRLEALGLNVFSICDFEGH

SEQ ID NO: 19926 - protein, 581 aa, Oryza sativa Japonica Group
MRLSSLLFLVCFFTVAMSQCAAAAKARHFRWEVSNMFWSPDCEEKVVIGINGQFPGPTIRAKAGDTIVVHLKNGLHTEGVVIHWHGIRQIGTPWADGTASISQCAINPEETFTYRFVVDKPGTYFYHGHYGMQRAAGLYGSLIVDVADGDEEPFKYDGEINLLLSDWYHESIYTQMVGLSSNPFRWIGEPQSLLINGRGQFNCSLAAAHTPGAKQCAAAGNRHCAPVILPVLPNKTYRLRVASTTSLASLNLAVGNHKLTVVEADGNYVEPFAVDDIDIYSGDSYSVLLTTDQDTSANYWVSVGVRGRQPRTAPALAVLNYRPNRASRLPAAAPPATPAWDDFARSKAFTYRILGRAGVTPPPPATSDRRIELLNTQNRMGGGHVKWSINNVSMVLPATPYLGSLKMGLRSALPSAARPSDTFGRGYDVMRPPANPNTTVGDNVYVLAHNATVDVVLQNANALARNVSEVHPWHLHGHDFWVLGYGDGAFRGDAGDAAALNLRNPPLRNTAVIFPYGWTAIRFVADNPGVWAFHCHIEPHLHMGMGVIFAEAVDRVSELPKAAVSCGATATALMAGAGGHV

SEQ ID NO: 19927 - protein, 153 aa, Streptococcus pneumoniae
EHFIRGQYRSGKIDGMKYISYRSEPNVNPESTTETFTSGAFFVNSDRFRSVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 19928 - protein, 280 aa, Methanosarcina acetivorans C2A
MTDKVQPLESLSKKPEEPKIVVNLRRIKRKIMVMSGKGGVGKSTIAANLAVGLALRGYRVGLLDCDIHGPTIPTIFGLESARPEVSEEGILPIQVLPNLSIMSIGFLLENKDSPIIWRGPAKMGAIKQFLEEVYWGALDFLIIDLPPGTGDEPLSVAQLIPNCDGSVLVTTPQDVALISVRKSITFSEKLNVPVIGLVDNMHGLICPHCDKPIDVFGSGGVEKASEDFNIPILARLPIEPKVAEMEDKGTIIQDQLKHGTEWQKSFEKVVDAVQETLKEE

SEQ ID NO: 19929 - protein, 195 aa, Prochlorococcus marinus str. MIT 9211
MANLDQAPKRLMPNLLHVLPAFANEKELRLNTIVELNSNTINKYELITETGHLKLDRVGYSSLSYPFAYGCIPRTWDEDGDPLDIEIVQVTEPLIPGSIVEARIIGIMTFDDGGEVDDKVIAVIADDKRLDHIKSFEQLGEHWLKETKYYWEHYKDLKKPGTCRVNGFFGVEKAIEIIKSCETRYLSQIDPTLVD

SEQ ID NO: 19930 - protein, 387 aa, Fusobacterium nucleatum subsp. nucleatum ATCC 25586
MIRSYMAIIYLGDSKKNISPLTKVRALASIPVGGSYRIIDFSLSNVVNAGIRNVGLFCGNEELNSLTDHIGMGAEWDLARKKDGIFIFKRMLDDNFSLNQARISKNMEYFFRSTQQNIVVLNAHMVYNLDVSDLIEKHEASGKEITMVYKKVKKANEHFNHCSSVKIDENNRVIGIGQNLFFKEEENISLDAFVLSKELMLKLLVDSIQEGKYNVLSELIARNLPSLNINAYEFKGYLQCINSTREYFNFNMNLLNQKIRDDVFGIKSGRKIFTKVKDTPPTLFKETADVENSLVSNGCIIEGTVKNSILSRGAIIEKDVVLEECVILQDCHIKKGAHLKNVIVDKNNIIHENEKLSASKEYPLVIEKSMKWDTKQYQDLMDYIRNK

SEQ ID NO: 19931 - protein, 122 aa, Linum usitatissimum
DVGGGTGAVLSMILSKHPSIKGINFDLPHVIEDAPALPGVQHVGGDMFASVPTGDAIFMKWICHDWSDQHCLKFLKNCFDALPANGKVIVCECIMPVAPDTSLATRNVVHIDCIMLAHNPGG

SEQ ID NO: 19932 - protein, 209 aa, Magnaporthe grisea 70-15
MANFLASIFGTEQDKVNCSFYFKIGACRHGDRCSRKHVKPTYSQTILMPNMYQNPAYDPKNNMNASQLQNHFDAFYEDLWCELCKYGELEELVVCDNNNDHLIGNVYARFKYEDSAQKACDELNSRWYAARPIYCELSPVTDFREACCRLNSGEGCTRGGFCNFIHRKNPSEELDRELVLATKKWLKMRGRDERSVSRSPTPEPSRRRF

SEQ ID NO: 19933 - protein, 403 aa, Dehalococcoides sp. BAV1
MPNARVEEAIADIKAGRFVIVVDDYDRENEGDLVMASEKVTPDAINFMAKNARGLICVSLIAERLEQLKIPMMVTENTSPYSTGFTVTVEARKKVTTGISAADRAVTVQVLIDPAATREDIAMPGHMFPLRAREGGVLVRAGHTEASMDLARMSGLYPSGVLCEIMNDDGTMARLPQLEQKAAEWGIKIISIKDIISYRRRTEKMVKKVTEAELPTSHGQFKAVAYKSQFDADEHIALVMGDISGPEPVLVRVHSECITGDVFGSKRCDCGEQLDMALNQIAQAGRGVLLYMRQEGRGIGLHNKLCAYALQDKGLDTVEANLELGFAPDLREYGIGAQILVDLGLSKIRMLTNNPKKVVGLEGYGIKVVETVPIIVEPNSFNRHYLETKQRKMGHILNVDKAN

SEQ ID NO: 19934 - protein, 330 aa, Shigella flexneri
MPEKTDVHWSGRFSVAPMLDWTDRHCRYFLRLLSRNTLLYTEMVTTGAIIHGKGDYLAYSEEEHPVALQLGGSDPAALAQCAKLAEARGYDEINLNVGCPSDRVQNGMFGACLMGNAQLVADCVKAMRDVVSIPVTVKTRIGIDDQDSYEFLCDFINTVSGKGECEMFIIHARKAWLSGLSPKENREIPPLDYPRVYQLKRDFPHLTMSINGGIKSLEEAKAHLQHMDGVMVGREAYQNPGILAAVDREIFGSSDTDADPVAVVRAMYPYIEHELSQGTYLGHIIRHMLGLFQGIPGARQWRRYLSENAHKAGADINVLEHALKLVADKR

SEQ ID NO: 19935 - protein, 393 aa, Coprinopsis cinerea okayama7#130
MFSFLTQSLWPALEVFTRLSYPTDPPANPDSFPNAPYYSTGQQDIFFIITCIAVMAILRDALRLGVFEPFARWKLMRDLRKRNIASVPGSPVKEKPSTNGHLNGNGHVANGNGHAANGNGKTHHGNGHAANGNGHIIGSGYSSPASLAGKPTTKQLKQVNRSVLRFAEQGWSVVYYTFSWSYGLYVHYHLPTKVLQPSAVWKNYPHIPLALPVKFYYLVQTAFYLHQILILNAEARRKDFWQMMAHHIITVGLLVLSYFTNFTRVGCIILLLMDTCDIFLPLAKMIRYLEVSQLATDVIFGWFMVSWFVTRHFLFILVIWSAAYDATKYIPFVVDPSRGFYLTRTAYLAFVGMLIALQILQCIWFWMICRVAYRVVTGSGAEDTRSDDEIEAE

SEQ ID NO: 19936 - protein, 310 aa, Oryza sativa Indica Group
MKLKRKQCIKRRHDAERNLRKPSSCLVRKPPGIPCVARNKKVKYSSLCVGLVMDLHGIRGKVALNPVLKLPQGELVVFTDQFEPGIGRRTSAGLQHFLQELLRLKMQGITKALRFHGKQLKLTVLQHMNKGIFSWATLISRIQTESPTVIIPHIGLENIRVREILNAKGEAKAGAVYWCCTSHFVHEAIKHMTAHNVGALVVLKSGDEKQLAGIVTERDFARKILLPGRPSEETRVGDIMTEEDKLITVSSNTNILQAMELMTERHIRHVPVFDEKVVGMITIGDVVKTIVDQQHQEVKQLKKYIRGDYY

SEQ ID NO: 19937 - protein, 272 aa, Vibrio angustum S14
MEQRSIAFIGAGNMARSIIAGLVASGYDAKKITATAPSDARREPLARDFGIHTTSDNLNAAKNADVVVLAVKPQLMEEVCKPLQDINFAGKLVISIAAGINCERLCEMLGQQVELVRVMPNTPSLIGKGMSGLYANPQLTETDRFFATQLLQAVGEICWVQEESGINGIIAAAGSAPAYFFLFMEAMQQEAMNQGFDADTARLLVQQAALGAAELVKANPDTSLSTLRDQVTSKGGTTAEAINTFNQHQLSDIVAKAMQAAVSRAKEMEQLF

SEQ ID NO: 19938 - protein, 312 aa, Oryza sativa Indica Group
MASFTAGAAGANNNPNKSLEVNPAPGDSVSSLSFSPKANHLVATSWDNQWNPEIAVGILQVLCSAWKDDGTTVFSGGCDKQIKMWPLLSGGQPMVLSGHEAPVKELAWIPQMNLLVSGSWDKTLRYWDVRQPQPAHVQQLPERCYALSLSYPLMVVGTADRNVIVFNMQNPQFYQVTFRESSKFCVQISVFITVTLDTLNVICKLQLTLPMLQQAEFKRIVSPLKLQTRCLAAFPDQQGFLQVGSIEGRVGVHHVDDGQQGKNFTFKCHRDGNDIYAVNALNFHPVHHTFATSGSDGGFNFWDKDSKQRLKT

SEQ ID NO: 19939 - protein, 402 aa, Medicago truncatula
MPLSRFAAEAFGVVTVCLVAILILLGLICIAYSFYFRSRIHNQGFVQLNYFSGPWIIRIAFILFVIWWGLGEIIRLTLLRRALHLKWKETVCKCYIVSNMGFAEPCLFLTLVFLLRAPLQRLETGIMSRKWNLRTSAHIILYCLPMFLLQLFVILVGPQLDKNKGSEKKLPHYFTSTAGSSSVARGNDDIALCTYPLLSTVLLGLFAIILTSYLFWLGSRILKLVINKGLQKRVYTLLFSVLCFLPLRVLFLGLSVLSGPEHFMFEAFVFLAFLALVCCSGLCMCTLVYRPVADCLALGNLQDLEARTRRFNDDQNDTVSLITSQSHLEDNVEENARLSPGRYSDESTKRGSISFRTMEKGVASTGTFVELSLFSPSRSATPPGSPSLPGWPMQSPTQVIGP

SEQ ID NO: 19940 - protein, 464 aa, Pseudomonas syringae pv. tomato str. DC3000
MKISVFGSGYVGLVQATVLAEVGHDVVCMDIDRAKIDQLRLGQVHIYEPGLANLVRENLDHKRLLFTTDEQLAVEHADVLFIAVGTPSREDGSADLSGFFAVGESIARHRCEPLIIVEKSTVPVGSGDALRGHIDKALRQAGRLLQFDVVSNPEFLKEGSAVNDCRRPDRIVIGCDNEAVRKVMRELYAPFNRNHDRIMFMDLRSAELTKYAANCMLATKISFINQIAELAEHLGADVESVRLGIGADSRIGYDFIYPGCGYGGSCFGKDIRALIHSAKEANCSNDLLSVVEAINERQKNKLFERVNAFYQGDLRGKTFALWGLAFKPNTDDMRDAPSRVLMEALWDAGATIRAFDPEAMQETQRIYGHRKDLVLMGTPESTLNDADALIICTEWQQFKAPDFELIQQRLGAPVIFDGRNLYDTERLAKHGFHYFPIGRGESCDLPIPQKQWMPYKPQVSSQVV

SEQ ID NO: 19941 - protein, 236 aa, Vibrio angustum S14
MTSIKQNIAEVINQITLATEKCGRAADSVQLLAVSKTKPVEAIEEAIAAGQYAFGENYVQEGVDKVNHFSSHPEKNLLVWHFIGPIQSNKTRLVAEHFDWVHSIDRIKTAKRLSDQRPTSMAPLQVLLQVNSSAEATKSGITLAEVPALAAEIAAMPNIELRGLMSIPQPATDYDSQFATFKALAVTLEQLKLTYPNVDTLSMGMSGDMEAAIAAGSTIVRIGTAIFGARDYGNKE

SEQ ID NO: 19942 - protein, 366 aa, Triticum aestivum
  misc_feature (271)..(271): Xaa can be any naturally occurring amino acid
MPPPPPHPNGGKVTPNLAMDAEGTRLLNLTVLQRLDPAVEDILITAAHVTLYDFNIDLNQWSRKDVEGSLFVVKRIVNSQPRFQFIVMNRRNTDNLVEDLLSDFEYELQPPYLLYRNATQEVNGIWFYNQQECEAVASLFGRILNAYAKVPPKPKVPSIKSEFEELEAVPTSSAIDGPLEPPPSSTAVVSDTPDESFASYFSGVANVGNVPTAPMTGRAHPPAESVASSHVPMIISSAAPTHQMSASSAPPLPLHTNAHAGRSTDLVTPAXFFVPPSSSSTSLVQPASSLMPTAPPLHPTSTSSQRPPYGTPLLQPFPPPTPPASLTPAHNDGPIISRDKVKVALQRLVQSDEFIDLIYRELLNAS

SEQ ID NO: 19943 - protein, 407 aa, Thermoanaerobacter tengcongensis MB4
MMDVKKIREDFPIFNVKPHGKRLVYLDNAATTQKPESVIKAMEEYYEKMNANVYRSPHYLSVLSTEAYEKARDKVKKFVNAKSEESIIFTRNTTESINFIAYTWGMKHIKEGDEIVLTIAEHHSNILPWQMVAEAKGAKLKYVYLDENFRLSMKDFEEKMSDRVKLVAVQHMSNVLGIINPVEEITQIAHKYGAKVLVDGAQSVPHMKVDLKKINCDFFAFSGHKMLGPMGIGVLYIKEDLLDEVPPFLRGGEMIDEVYEEYSTFAPPPLKFEAGTPNVEGAYVLISAIDYLERIGLENIYEHEAKLLEYGLEKINALEYVKTYGPMDSKDRGGIISFNVEGVHPHDVATILDEEGIAVRSGHHCCQPLMRYLGVPATVRASFYLYNDFDDIDALVEALKKVRKWFK

SEQ ID NO: 19944 - protein, 469 aa, Oryza sativa
VAAESTRAALVVASISSFGINHEFTPMVYPLLVSSVGIIACLITTLFATDFFEIKAVSEIEPALKKQLIISTAFMTVGIALVSWLGLPYTFTIFNFGAQKTVQSWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTTKPDYATCVKISTDASIKEMIPPGALVMLTPLIVGILFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGILFKLF

SEQ ID NO: 19945 - protein, 483 aa, Dunaliella salina
MATPPVKKIACIGAGYVGGPTMAVIALNSPDIEVVVVDINEERIKAWNSETLPIYEPGLDEVVKAARGRNLFFSTDTKKHVGEADIVFVSVNTPTKTTGIGAGKAADLTYWEGAARLIASVSTSSKIVVEKSTVPVKTAEAIGKVLKRNCSDPSVNFEILSNPEFLAEGTAIEDLQKPDRVLIGGVDTPSGQAAVAALKWVYNHWIPVERILTANLWSAELAKLTANAFLAQRISSINSISALCEASGANVQQVAHAIGTDTRIGNKFLSASVGFGGSCFQKDILNLCYVCETLGLREVADYWHAVVTMNDYQKQRFVERVIGSMFNTVSNKKIAIFGFAFKKDTGDTRETPAIDVCKGLVRDNAKVAVYDPKVTSEQIFRDMSTPKFEWDRPDYSRSHTRLLDNVQVCATPESAAEGAHAICVLTEWDCFKHYDYAAIYEKMTKPAFIFDGRNVLDHDKLREIGFITYALGKPLDPFLQKVY

SEQ ID NO: 19946 - protein, 498 aa, Bordetella bronchiseptica RB50
MTLHDSAYWRAQAAALAPEGRAYIDGAYCDAADGATFAAHSPIDGRKLADVAACGAADVDRAVAAARRAFEAGVWSGLAPRERKHRLLRLAALITKHQEELALLETLDMGKPIRDALAFDLPETARCYAWYGEAIDKRYDEIAPTGADALATITREPLGVVAAVVPWNYPLMMAAWKVAPALAVGNSVILKPAEQASLSALRLAALAEQAGIPPGVFSVVPGLGAQAGQALGLHPDVDCIAFTGSTATGKRFMTYSGQSNLKRVWLECGGKSPHIVFADCPDLDRAAQVAALAIFSNQGEVCIAGSRLYVQHGIYDAFMEKVAAFAATLRPGNPLDPDSALGAMVDERQTQAVMARIAAGAQEGARLRLGGRQVLTNSGGYYIEPTIFDCPGQDNSLVREEIFGPVLAAQGFADEDEAVALANDSIYGLGAGLWTADLGRAHRLSRRLRAGLVWVNCYADGDITVPFGGVKQSGFGRDKSLHAMDKYSDLKTTWISLR

SEQ ID NO: 19947 - protein, 269 aa, Brassica napus
VDPRVRETHDVFTEGDTFLNHIIDDHQSKNFTQDRPDFIDYLLEMIPKQEQNESFKLTIDHLKGIIQGIYLAGVDTSSITMIWTMAELVRNPRVMKKVQDEIHSCIGIKHKERITEEDLDKLQYLKLVVQESLRLHPPVPLLLPRKTMSQIKIQGYDIPPKTILVVNAWSIGRDPKHWKDPEEFVPERFITCPVDYKGHGFEMLPFGSGRRMCPGMASGIATVELGLLNLLYYFDWGLPEEGKDMDMEEAGVLTVVKKVPLELLPILRQ

SEQ ID NO: 19948 - protein, 342 aa, Pseudomonas syringae pv. tomato str. DC3000
MILVTGGAGYIGAHITLQLLESGRDVVVLDNLCNSSRDALGRVERLGGRRLNFIHGDVRSKATLHRLFTRYPVEAVVHCAGLKAVGESVREPLRYFDTNVSGSVNLCQAMAEAGVFDLLFSSSATVYGDCERMPLDENCPLGLPTNPYGHSKLMAEHVMKSVAHSDPRWSIGLLRYFNPIGAHPSGLLGEVPCNTPNNLLPLLLQVANRLRPALHIFGNDYPTPDGTGVRDYLHVMDLADGHLKALDRIHSERGASVWNLGTGQGYSVLEVVRAFERISGKAVPLIYEPRRPGDVAACWSDPAKALRELQWSARLDLDSMLADAWRWQCMNPQGYAPTALVS

SEQ ID NO: 19949 - protein, 284 aa, Gluconacetobacter xylinus
MIKPLKKAVLPVAGLGTRFLPATKCVPKEMLTVVDRPLIQYAIDEAREAGIEEFCLVSSRGKDSLIDYFDISYELEDTLKARKKTSALKALEATRVIPGTMLSVPPAGTAGPWHAIWCAREFIGNDPFAILLPDDVVQSKKSCIGQLVEVYNKTGGNVLAVTEVPREQTGSYGILDVGKDDGKTVEVKGLVEKPDPKDAPSTLSVIGRYVLTADVLKHLAKLEKGAGGEVQLTDAMAKTIGHVPFHGYRYEGKRFDCGSKIASWKPRSPLRWSVRNWLPACVNS

SEQ ID NO: 19950 - protein, 172 aa, Rickettsia prowazekii str. Madrid E
MFIKKIKAKANNNEINVIIEIPMNSGPIKYEFDKESGALFVDRFMQTTMSYPCNYGFIPDTLSNDGDPVDVLVVAHHPVVPGSVIKCRAIGVLMMEDESGLDEKIIAVPTSKLDITFDHIKELDDLCEMLKKRIVHFFEHYKDLEKGKWVKVTGWGDKVKAETLIKEGIDRN

SEQ ID NO: 19951 - protein, 415 aa, Bradyrhizobium japonicum USDA 110
MSTHPAVRNGSYDVARVRQDFPALAMQVYGKPLVYLDNAASAQKPQVVLDRMTQAYTSEYANVHRGLHYLANAATEAYEGGRTKVAQFINAGRTEEVIFTRNATEAINLVASSWGGPNIKEGDEIVISIMEHHSNIVPWHFLRERQGAVIKWSPVDDEGNFLIEEFEKLLTAKTKLVAITQMSNALGTIVPIKDVVKIAHARGIPVLVDGSQGAVHMPVDVQDLGCDFYVFTGHKVYGPTGIGVLWAKYDHLVAMRPYNGGGEMIREVSRDVVTYGDPPHKFEAGTPAIVEAVGLGAAIDYVNSIGKERIAAHEHDLVTYAQEKLREINSLRLIGTARGKGPVISFELKGAHAHDVATVIDRQGIAVRAGTHCVMPLLERFNVTATCRASFGMYNTREEVDHLAQALLKARDLFA

SEQ ID NO: 19952 - protein, 384 aa, Fusobacterium nucleatum subsp. nucleatum ATCC 25586
MVMKKKRIIAMILAGGQGTRLKELTEDLAKPAVAFGGKYRIIDFTLTNCSNSGIDTVGVLTQYEPRILNNHIGRGSPWDLDRMDGGVTVLQPHTRKNDEKGWYKGTANAIYQNIKFIEEYDPEYVLILSGDHIYKMNYDKMLQFHIQKDADATIGVFKVPLVDAPSFGIMNTKDDMSIYEFEEKPKEPKSDLASMGIYIFNWKLLKKYLDEDEKDPNSSNDFGKNIIPNMLNDGKKMFAYPFKGYWRDVGTIQSFWDAHMDLLSEDNELDLFDKSWRVNTRQGIYTPSYFTKESKIKNTLIDKGCIVEGEIEHSVIFSGVKIGKNSKIIDSIIMADTEIGDNVTIQKAIIANDVKIVDNIVIGDGKKIAVVGEKKIIDSQSLVK

SEQ ID NO: 19953 - protein, 300 aa, Prochlorococcus marinus str. MIT 9211
MDQSFSSHQFEHNHSEKDSTRVSVLSEALPYIQKFVGRRIVIKYGGAAMSSETLKKAVFRDIALLTSVGAQPVIVHGGGPQINQWLERFGIKSKFRDGLRVTDEQTMDIVEMVLAGRVNKQIIKGLNQLGAKSVGLSGIDGGLIEGRQLDNGSHGLVGEVAKVHTEVIEPLLSKGYIPVISSVAASKQGDSLNINADTVAGEIAAALGAEKLILLTDILGILRDKSDQTSLIRHIRLQEARELIEKGIVNGGMMPKIGCCIRALAQGVAAAHIIDGRIPHALLLEIFTDAGIGTMITGRG

SEQ ID NO: 19954 - protein, 500 aa, Bradyrhizobium japonicum USDA 110
MSFSNLGLSEKVLAAVAATGYTTPTPIQEQAIPHVLARKDVLGIAQTGTGKTAAFVLPMLTILEKGRARARMPRTLILEPTRELAAQVKENFDRYGAGQKLNVALLIGGVSFGDQDAKLTRGVDVLIATPGRLLDHTERGGLLLTGVELLVIDEADRMLDMGFIPDIERICKLVPFTRQTLFFTATMPPEIRRITETFLHNPQKVEVSKPATTAVTVTQSQVPAGKKAHEKRELLRRLLREAKDLKNAIIFCNRKREVAIVHKSLQKHGFSVGALHGDMDQPARMAALEQFRKGELPLLVASDVAARGLDIPEVSHVFNFDVPHHPDDYVHRVGRTGRAGRSGTAISIVTPLDQKSMVAIEKLIGQSIPRAEGDYEVHAEAGDATDRPREQRGRERSRGGRGKPQRGRDRERSHEPREARPSAEARPAPEARPAREPRPPREARPSPEPRHGSRPQANASHVPSIGRPEPRRQREADTEPGDHSHLPAFLLRPVRSPAGA

SEQ ID NO: 19955 - protein, 61 aa, Escherichia coli
METKDLIVIGGGINGAGIAADAAGRGLSVLMLEAQDLACATSSASSKLIHGGLRYLEHYEF

SEQ ID NO: 19956 - protein, 504 aa, Arabidopsis thaliana
MVVINSLRRLARTTQVHLHSKYATCMSGNSTSRRIFTTEAAPEKKNTVGSKGHDMLAPFTAGWQSADLDPLVIAKSEGSYVYDDTGKKYLDSLAGLWCTALGGNEPRLVSAAVEQLNTLPFYHSFWNRTTKPSLDLAKVLLEMFTANKMAKAFFTSGGSDANDTQVKLVWYYNNALGRPEKKKFIARKKSYHGSTLISASLSGLPPLHQNFDLPAPFVLHTDCPHYWRFHLPGETEEEFSTRLAKNLEDLIIKEGPETIGAFIAEPVMGAGGVIPPPATYFEKVQAVVKKYDILFIADEVICAFGRLGTMFGCDKYNIKPDLVTLAKALSSAYMPIGAILMSQEVADVINSHSSKLGVFSHGFTYSGHPVSCAVAIEALKIYKERNIPEYVAKVAPRFQDGVKAFASGSPIIGETRGTGLILGTEFVDNKSPNEPFPPEWGVGAFFGAECQKHGMLVRVAGDGILMSPPLIISPEEIDELISIYGKALKATEEKVKELKAQHKK

SEQ ID NO: 19957 - protein, 188 aa, Thermococcus kodakarensis KOD1
MIVIMDNGGQYVHRIWRTLRYLGVEAKIIPNTTPLEEIKAMKPKGIIFSGGPDINKTGNCSAILEHYDEFNVPILGICLGHQLIAKHFGGKVGRGEKAEYSLVEIEILDENDIFRGLPRKLRVWESHMDEVKELPPGFKLLARSETCPVEAMKHESLPIYGVQFHPEVAHTEHGADIYRNFAELCGEL

SEQ ID NO: 19958 - protein, 213 aa, Zea mays
SESRNPIPLPPLRLRRRRRTEPEPGALTNPRRQAAAGMVYYALLVGAELDGLTNLQPRHGCDDPNFPYYLKLKCENCGEVTAKSTYVTLSEQVDLPKGHGAAHLVQKCKLCGRDGTIVMIPGQGTPLTIEQSQKEEKTCLMVFDCRGYEPVEFSFGTGWKAESVHGTPFEIDCSEGEFSEYDEKGECPVELGKLQSTFKVVKKHERGGKTRFV

SEQ ID NO: 19959 - protein, 307 aa, Thermococcus kodakarensis KOD1
MWENFIEEKVKEIRETVGDGKAIIALSGGVDSSTAAVLAHRAIGDRLHAVFVNTGFMRKGEPEFVVKTFRDEFGLNLHYVDASERFFRELKGVTDPEEKRKIIGRVFIEVFEEVAKEINADFLIQGTIAPDWIESHGKIKSHHNVGGLPERLNLKLIEPLRDLYKDEVRELAKELGLPEKIYNRMPFPGPGLAVRVLGEVTPERVAIVREANAIVEEEIEKAGLKPWQAFAVLLGVKTVGVQGDIRAYKETVAVRVVESLDGMTANAMNVPWEVLQRIAFRITSEIPEVGRVLYDITNKPPATIEFE

SEQ ID NO: 19960 - protein, 628 aa, Exiguobacterium sibiricum 255-15
MKLTEIQDPSFLKRMSVSELELFAGDIRRFLIEELATTGGHLAPNLGVVELTLALHREFDSPNDKFVWDVGHQAYVHKILTGRAGQFDTLRQHKGLCGFPKRNESVHDVWETGHSSTSLSAAMGIAVSNELKGNDDRAIAIIGDGALTGGMALEALNHIGAEQQNVIVILNDNEMSIAPNVGAMHQMLGRIRSSRKVRYAQDELETLIKKIPLIGGKLEKGGEKLKEAVKGALVPGMFFEELGFNYYGPVDGHDLTDLIEQLNYVKKEEGPVLLHVITKKGKGYRPAEYDGIGTWHGLGPYKIESGEVIKGKSKAPSYSFTVADTLTKMAREDDKLTLITPAMSVGSKLDCFEKEFPERMFDVGIAEQHAVTFAAGQATQGMKPVVSIYSTFFQRAYDQLVHDVARQNLDVTFTIDRSGLVGADGETHQGVFDIAFMRHVPNIRIVMAKDENELQHLLYSAVKYEGPIAVRFPRGEGIGVPMDETLHEISLDTWDVEREGTDVAIMAFGPQVQDALKIAELLEGDVSVRVINARTIKPLDEKMLNALYAEGIPLVTLEEAVLKGGFGSAVLEHANEQEAFPRVKRFGIPDWYIEHGGVNELLEEIGLLPGQIAEEVRSFVNQGKKQSV

SEQ ID NO: 19961 - protein, 144 aa, Prochlorococcus marinus str. MIT 9211
MFSNFHQLKERLMRAAWAICLGLLLLVLPFGQTAQAAKSSMSGDFVEDTVSVAQTLKETIAIPDDSENRSEAKDEALELITQYISRYRNRPQFNGTNSFTTMQTALNAMAGHYKTFANRPLPEKLKERLKKELSRAEKIVVKEI

SEQ ID NO: 19962 - protein, 289 aa, Exiguobacterium sibiricum 255-15
MIVLTEWKTQVEQALETFMNRLEAPDRLREAMLYSLDAGGKRVRPALIYAVLDAYGVDRKTGDATAAALEMIHTYSLIHDDLPAMDDDDMRRGRPTNHIEFDEATAILAGDALLTNAFTCLLETMAAAEVKVKLLERLAAAAGAAGMVGGQLDDMLGERGGISDAEELESIHRRKTGALLIFAVEAGGILAGVADEDLEQLKRYGRHLGIAFQIQDDILDVTGDADKIGKPVGSDEGNDKATYPKLLGLDGAKRALAAQVTAANEAIEALSVEATPLKDLLDFVVKRDH

SEQ ID NO: 19963 - protein, 144 aa, Linum usitatissimum
GFKMHCHGWRSVYCIPKRPAFKGSAPINLSDRLHQVLRWALGSVEIFFSKHCPIWYGYGGGLKWLERFSYINSVVYPWTSIPLLVYCTLPAICLLTGKFIVPEISNYASLVFMALFISIAATSILEMQWGKVGLDDMWRNEEFW

SEQ ID NO: 19964 - protein, 477 aa, Pseudomonas aeruginosa UCBPP-PA14
MTADKKAKILATLGPATRSRDDIRALVEAGANLFRLNFSHGDYADHAQRFAWVREVEAELNYPIGVLMDLQGPKLRVGRFAAGAVQLQRGQTFTLDLSDAPGDERRVNLPHPEIIHALEPGMSLLLDDGKIRLEVVNGHSDAIETRVAVGGELSDRKGVNVPEAVLQLSPLTDKDRRDLAFGLELGVDWVALSFVQRPEDIDEARGLIGDKAFLMAKIEKPSAVSAIEAIAERADAIMVARGDLGVEVPAESVPGIQKRIVQVCRQLGKPVVVATQMLESMRFSPAPTRAEVTDVATAVGAGADAVMLSAETASGQYPREAVEMMAKIVRQVEAEPDYHVQLEVNRPQPDATVSDAISCAIRRVSRILPVAVLVNYTESGNSTLRAARERPKAPILSLTPNLRTARRLTVAWGVYSVVNEQLAHVDEICSTALDIALAQRMARRGDTVVVTAGVPFGRPGSTNMLRIETVAPPLGDL

SEQ ID NO: 19965 - protein, 498 aa, Aegilops crassa
MRTNPTTSPPGVSTIEEKSTGRIDQIIGPVLDVTFPPGKLPYIYNALVVQSRDTADKQINVTCEVQQLLGNNRVRAVAMSATDGLMRGMEVIDTGAPLSVPVGGATLGRIFNVLGEPVDNLGPVDSSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLSTEMGSLQERIASTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSPGKYVALAETIRGFQLILSGELDGLPEQAFYLVGNIDEASTKAITLEEENKSKK

SEQ ID NO: 19966 - protein, 620 aa, Corynebacterium glutamicum ATCC 13032
MRVLIIDNYDSFTFNLATYVEEVTGQAPVVVPNDQEIDEMLFDAVILSPGPGHAGVAADFGICAGVIERARVPILGVCLGHQGIALAYGGDVDLAPRPVHGEVSQITHDGSGLFAGIPETFEAVRYHSMVATRLPESLKATATSDDGLIMALAHEVLPQWGVQFHPESIGGQFGHQIIKNFLNLARTYRWQLTEKTIPLSVDSAAVFETFFAHSSHAFWLDDAQGTSYLGDASGPLARTKTHNVGEGDFFTWLKEDLAANSVAPGQGFRLGWVGYVGYELKAEAGARAAHTSSLPDAHLIFADRAIAVESDQVRLLALGEQDEWFEETIKKLHNLVAPRIPASGHLALQVRDSKDEYLDKIRRAQELITRGESYEICLTTKLQGTTDVAPLAAYLALRGANPTAYGAYLQLGDTSILSSSPERFITIDSAGYVESKPIKGTRPRGRTAQEDQEIIAELRSNPKDRAENLMIVDLVRNDLARGALPTTVKTSKLFDVETYATVHQLVSTVSAELGPRSPIECVRAAFPGGSMTGAPKLRTMEIIDELEAAPRGIYSGGLGYFSLDGAVDLSMVIRTLVIQNNHVEYGVGGALLALSDPEAEWEEIRVKSRPLLNLFGVEFP

SEQ ID NO: 19967 - protein, 380 aa, Aspergillus nidulans FGSC A4
MPTAKAIVAREPRFTALNWALEDVCVSNEPGDDEVLVEMVASGVCHTDIVLSAVPSGQLGIGYPKVIGHEGSGYARRIGKNVTTVQEGDPVLLSFYSCGSCGQCQERHPAYCDSFAVENYVGRRGHVTTANSANGKGDNGEQVHSRFFGQSSFARYSIVDKSCIVNAKDLIRSEDELTLFAPLGCGFQTGMGAIENVAKPDENSVLVVLGLGSTALIRPHSAIVGVDRLPGRLELAKELGATHTIDTSPPGFNLQKTLLEMFPSGVHHIVDTTGAPVLIEDGLRSLRQRGKIVLIGVPPMQYELGIGVVQHINTGRAVVGCIEGDCVPGEAVPKLVQWYREGRFPIEKLITYFEAGDFRQALAGLDDGSVIKAVLKWKDE

SEQ ID NO: 19968 - protein, 394 aa, Zea mays
MAPLLLLPLPLRPIPAENSISRLAPRPRFPRPFSRRRLRLPALLQVQCLAATGPAAPAPRWHAALSAAAGLYPAYVAAGASVAFTRPEAFRWFVALAPGSYTATLGFIMLAMGLTLQLSDFAALLRDRPLAILFGCAAQYTIMPVFGAIISHALGLPPSLSAGLILLGCCPGGTASNVVTLVAQGDVPLSVVMTVCSTLAAVFLTPLLTKILAGAYIPVDAVKLSLSTLQVVVAPILLGSLIQTAFPSVAQFLSPFAPLMAVLASSLLASSVFSENFVRLRSTIADASPVNGMFFGDVGTVIFSVFLLHFAGFFVGYAAAAIGGFKEKQRRAISIEVGMQNSSLGVVLATAHFSSPLVALPPAVSAVVMNMMGSTLGLVWQYTSTSVSENETSA

SEQ ID NO: 19969 - protein, 348 aa, Vibrio angustum S14
MTLKVAINGFGRIGRSVLRALYESDKHHQINVVAVNELAEPEAMVHLLQYDSSHGRFKNPVSHDQEHLFIAHENGRQDQIRILHQPDLKLLPWHDLDVDIVLDCTGKFGSRADGLAHIASGAKKVLFSHPASKDIDCTVIYGVNHQDLTPQHRIVSNGSCTTNCIVPIIKILDDQFGIESGTITTIHSAMNDQQVIDAYHPDLRRTRAASQSIIPVDTKLHLGIGRIFPKFSDKFEAISVRVPTINVTAMDLSVTVKTNVKVNDVNQSLKNTSRCTLSGIVDYTEAPLVSIDFNHDPHSAIVDGSQTRVSNQHLIKLLVWCDNEWGFANRMLDTALAMYATEHTDAEK

SEQ ID NO: 19970 - protein, 148 aa, Thermoanaerobacter tengcongensis MB4
MKIQIIAVGTIKENYIKDGIKFYLDKLKKIYDIEIVEIKEEEDPGTPASREKVLETEGERILYKIDRESFVIALAIEGKEVSTEEFASLVKKAFGMGYKKVVFVIGGSLGIWGKVKERADVNISFSKMTFPHQLTRLLLLEQIYYALL

SEQ ID NO: 19971 - protein, 344 aa, Ralstonia solanacearum GMI1000
MSAERSTPNPRRLSVAPMMDWTDRHCRYFHRQISRHTWLYTEMVTTGALLHGDVPRHLDFDEAEHPVALQLGGSEPDDLAQSARLGERWGYREINLNCGCPSERVQRGAFGACLMAEPKLVADGVKAMRDAVSIPVTVKHRIGIDAIETYDFVRDFVGAIAEAGCETFIVHARNAILKGLSPKENREIPPLRYEVVYQLKRDFPRLEILLNGGVQTLEQIDTHLAHVDGVMIGREAYHHPHLMAGFDARYYGADAVAPTRAEVEDAMIDYIGRWVARGGYAGAAVRHMLGLYRGVAGARGWRRVLSDAKALGRVKTPDDARALFETARAHLRRGAEADEEAVAP

SEQ ID NO: 19972 - protein, 387 aa, Vibrio angustum S14
MSVIKMTDLDLAGKRVFIRADLNVPVKDGKVTSDARIIASLPTIKRCLEAGAKVMVTSHLGRPTEGEYAEEFSLQPVVNYLNDALDCDVKLAKDYLNGLELNAGELVVLENVRFNKGEKKNEDELSKQYAALCDVFVMDAFGTAHRAQASTYGVGMFAPVACAGPLLAGELEALGKAMDNPARPMVAIVGGSKVSTKLTVLESLSKIADQIVVGGGIANTFIAAEGNDVGKSLYEADLIPTAKELMASTDIPVATDVVCAKEFSDTAEATVKSASDIAADDMVLDLGPDSAQALADIIMNAKTILWNGPVGVFEIEQFGKGTEVVANAIAESAGFSVAGGGDTLAAIDKYGIKDKVSYISTGGGAFLEFVEGKKLPAVEMLESRAKA

SEQ ID NO: 19973 - protein, 756 aa, Cytophaga hutchinsonii ATCC 33406
MIAQEELIFESEELESESKKGWTLSGILNPSATSAVLKTSLQKDLLAAFVVSLIALPLCMGIAIASGFPAVSGIYTALIGGLIITFISGTHVDIKGPASGLCIIILGAVHAFGENGQNPFPYVLACFFVAGIVQMIFALLRFGALGDSFPASAVLGMMASFGIMIAIKQFSVLIGAHPHGKTALSLLTEIPESVAHMHIPVAIIGIISLAIMIGMGFLKGAWTAYVPAPLVVIIVAVPLGLLFDIGALTNTETGVNEYLVSLPNNLFEGIMFPDFTQLISLTSLQYIIMIALAGSLESLLSSKAIEMADTKSRKSRLNKDLFAIGMGNSLLALIGGLPMISDAKRSLINVSYGAQSAWSNFFHAGFLLLIVVVGGPLIRLVPQAALAGILMYIAYKLASPKQLSAAYKIGPEQLIVFLTTMIICLFTNLLWGILAGIILELIIHMYFGVPLKSLFGTKADLKQDAEQNYTLHIYDAAVFSNYMGIKKYLLTLPEYSNVTFDFSEAKVVDHTFLEHLYYYEENIRKKGGQIVLAGLDHHKHLSDHPLASRRIVDSDMLTERQEQMQLFAAKNGYAFDHRIVSNLSKLEGFLETKHIQIKLQRNVLSGNYYSINFELSDLMLTHNAGGRSHSINMTNALFSIPGMNIPEFILEPDGFTDDFKDNSDFKDIDFTQHAVFSYYYLLKGPNQNAISDFFTASLIRFFEKNKGFRLESKHNMIFVYKKARRIKPENLTMLIDFTKALLYELYVQKNLSIRTP

SEQ ID NO: 19974 - protein, 369 aa, Zymomonas mobilis subsp. mobilis ZM4
MKTRAAVAFAEKQPLEIVELDLEGPKDGEVLVEIMATGICHTDAYTLGGFDSEGIFPVVLGHEGAGIVREVGKGVTSVKAGDHVIPLYTPECRQCKSCLSGKTNLCTAIRETQGRGVMPDGTTRFSYKGQPIYHYMGCSTFSNFTVLPEIAVAKIREDAPFKAACYCGCGVSTGVGAVINTAKVEAGANVVVFGLGGIGLNVIQAARMVGADKIIGVDTNDSKAEWGRRFGMTDFVNPNKIDEDIVPHLLRLTEGGADYTFDCTGNTDVMRQALEACHRGWGVSVVIGVAEAGKEISTRPFQLVTGRVWKGSAFGGVKGRTGVPKIVDWYMKGKIEIDPMITHILSLEEINKAFDLMHEGKSIRSVVLF

SEQ ID NO: 19975 - protein, 346 aa, Brassica napus
  misc_feature (202)..(202): Xaa can be any naturally occurring amino acid
QAFEKKPGVNADNVGDNVGDIAGMGSDLFGLYAESSCAALVVASISSFGINHDFTAMLFPLLISSVGILVCLITTLYATDISEIKAVKEIEPALKNQLIISTVIMTAGIALVSWIGLPSSFTIFNFGTQKVVKNWELFLCVAVGLWAGLIIGFVTEYYTSNAYSPVQDVADSCRTGAATNVIFGLALGYKSVIIPIFAIAVXIFVSFSFAAMYGVAVAALGMLSTIATGLAIDAYGPISDNAGGIAEMAGMSHRIRERTDALDAAGNTTAAIGKGFAIGSAALVSLALFGAFVSRAGVQTVDVLTPKVVIGLLVGAMLPYWFSAMTMKSVGSAALKMVEEVRRQVN

SEQ ID NO: 19976 - protein, 606 aa, Desulfovibrio desulfuricans G20
MHASTLVLIILCAGLASQWLAWRLRLPAVVVLITTGIMLGPASGIIDPGLSQAELTELIGLGVAIILFEGGMDLKLGEIRRVGHGVGRLTILGPPLAWIFGALAARFVAGLSWPVSWVLGAILVVTGPTVILPLLRQAHLNKRSAALLKWEGIANDPVGVLLAVLTFQYFTLTDGGWTQVLAGLASAAAMAGLLGGLGGWLIGWLYRRGVVPTRLKAPLLMVLVLAAYWASNLIQHEAGLLTVTVMGVVIGNMQLVEREPLRHFKENLTIVLLSALFIVIPSQLHLEQVNLLNWPVAAFVLVTLLVVRPLSIVLATVGAPMRGEDKLLLAWIAPRGIVAAATAGIFGPALVAAGYQDAEALLPIVFLIIFTTVLAHGFTLGPLARKLGLAAEEENGLLIVGASPWSRTLAQALKKLDADVVVADGSYQRLRPFRMDGIKVYYGEILSEHAEHELDDEHLSYLLCATDNHYYNALVCKAQGHEFGHHRTFQLAPCQEAGHEQKRLLLQQRGYFAFEPPTDFCTLHQLLSDGWTVQSTRLSDTFNIGRLKDRLGAPGADWILIGGVSPQGKLQIYSNEQAFKPAKGWTLLYFAPEKKEAAQARSDTEQ

SEQ ID NO: 19977 - protein, 195 aa, Arabidopsis thaliana
MTAMLAMTQHRRKKVPIILHNESVKAKTWSHVFSEETRKQSIPVIAAWQLNERMYGELQGLNKKETAERYGTQQVHEWRRSYEIPPPKGESLEMCAERAVAYFEDNIKPELASGNNVMIAAHGNSLRSIIMYLDDLTSQEVTTLDLSTGVPLLYIFKEGKFMKRGSPVGSTEAGVYAYTKRLAQYREKLDAAATI

SEQ ID NO: 19978 - protein, 457 aa, Bordetella bronchiseptica RB50
MSKSPEQMTPYDQFNIEVPEDHFPVEGMSARAAQALVLSDEWTDTNPMLNMSSFVTTFAEPEAVRIAEKNMYKNYIDHDMYPQLFAMEQRMVRWLHQLWNGPKDAEPYGTATVGSSEACMLAGLAHKWNWRQRREREGKDATRPNMVTGGNVQIVWKKFLRYFDVEPRIVPLKPGQYCLTAEDLDKYVDENTIAVVAIAGQTFTGEDDDIQGIHDWLDAYEKKTGVSVPMHIDGASGGFVNPFLYPDYKWDFRLPRVQSINASGHKYGLTPPGLGWVIFRERKVFNEDLVFYVNYLGGEMPTATLNFSRNSFQVAVQYYQFLRLGFDGFKRVMQRTLDNAIALRQHLVDSGYFTIMNDTQRIPVVAVTLDPKVKKFNEFDVSNKVRERGWVISAYTMPPDAESVRSLRVVVRPHINRNVALLLAEDIVKACKYLEQHGGTATPPALHDTHKSSPAKC

SEQ ID NO: 19979 - protein, 1373 aa, Burkholderia pseudomallei K96243
MSKHRQAPGPRGGLVMGNLAAYKRNPITMLLRLHQQYGDVARNRLGPFVTHALAHPDHIQYVLQENHRNYVRGRFYDNFKMFFGDGLLTTDGEFWRRHRRVVQPLFHKKQVDAHTAAVGDAALALAHRWSALPPGKALDVVEEMMHLSLRMLGLMVFNTDVSSHAEAVGPAVRFGIEAMMPQGNLNDFIPRWAPTRFNRRIAHARRAIDTIVAKIIADHREARCEPSDVISLLLNARDPDTGAPMTQQEVHDEVMTVFLAGHETTGAGLAWALYALAQHPAVLRQLRDELDARLGGRAPTVQDFEQLPYLSQVVDEVLRVYPPIWGFTRDLVEDDEIGGYRIPARSSVFMSPYVTHRHPAFWRNPDAFDPENFASDAPARHRFVYFPFGGGMRKCIGFQTALLQMRVLVAVVAQHFDLNALPGHPIELGATISLRPVHGIRLIVKPRERQQSHLARVREHESARALRPLGDTATTAGAACPMTAAREPGASAAALAAVEAGALDAAHRGGAAAAAAGEPCPPRDPAEAAPLPLAASPAPASPAVDADASARGVPAWRFTWRPVPVDPVPDEPSPALSGRRIALVNGRGGTAERVAAALARTCAKVSVFAPAASADHAEAARVFVNEAGPLDGIVDLGLEAPFALDDAGAWEAPMRRTVELLKACYGDWAAEDDTSRLFYVALTWMDGQMGYGETAGAQPLGGLWAGLAKTLPQELPNCNVRVLDIAPDETGRVDRLVVNELYRWGLFEVGYRGGVRYTLHAKRNELPPHAVDARTTLGAGDTVLFSGGARGIGLLCARALAERHGCTVIVTGRETPPDGGEPWMALDEPGFKHYGLEQLRAATPEHPPKAIRAALQRLKRRRELKTALDEMAALGLPVHYRVCDVTDRAAVRALCDELGDSLRMVIHNAGVDRPVRLIQKRAEDFADTVRTKVLGFANLCDAVRARPRLVQFCNVGSLTGRWGGMTGETDYAAANEALARLGLWAARHAFSPACGVKTLVWPTWEGVGMITNFAVTQRYVSPMNVDEGVRHWLRELATPGSGEVMFMGAVGRAPTPVQIKGFVPIRELPNIGELVTRRHHVGEPVRFRPFKRFESRYAIDPAVAPYAHAFRFNGRAVLPASLVLEHACAVGDWVMPPTGEPRELSEMTNVVLRLDALPDVPAGGAPVELASEAAGYMIGDVWCVDVRCSDARTQAELLSMTLVYRPQPEQIGAAFARAPDTTPEPAPLTSAPHAAWNGELLPAGDWSVPDDASAGIVRIGRVPPAAVLSLWALPFPLELRLPVNHVEHVLRVLLAEWGAARADAPAVWRIGGAKLARLPAASADGVVEYAAGRFAVLDARGYVLLRIDDARVDGEPAQAALPETGALADPLTA

SEQ ID NO: 19980 - protein, 459 aa, Methylococcus capsulatus str. Bath
MSIPRLGFLLMALPLAAPAAPPQVHEFTLANGLRVLVQEDHRAPVAVSQVWYKVGSSYEYGGITGVSHMLEHMMFKGTKKHPPGEFSRIIAANGGSENAFTGQDYTAYFQTLERSRLPVSLELEADRMRNLRLLQDEFVKEQQVVIEERRLRTEDQPHARMEEHFHAVAFTDSPYRNPVIGWPEDVAGLTLDDLSAWYQRWYAPNNATLVVVGDVAPGEVFELARKHFGPLKPAKLPALKPQGEVPQLGLRRMVVKVPAKLPHLEMGYKVPSLKTAAAEWEAYALEVAAGILDGGNSARLTSRLVRGRQIAAGVGAGYDLYARLSPLFSLEGTPAQGKTVAELEAALLEEVRRLREEPVAEDELARVKAQVLASNVYQRDSVFYQAMQLGMAETVGLGWRKVEEYVDKINAVTAEQVREVARKYLIDDGLTIAHLEPQPIPEGAKIQEGPEGMGGGHVR

SEQ ID NO: 19981 - protein, 326 aa, Neptuniibacter caesariensis
MGLLVEGVWHDQWYDTKTSKGEFVRSEAQFRNWITADGSAGQTGDAGFQAEAGRYHLYVSLACPWAHRTLIVRELKGLTDMISVDVVDPLMLEQGWALSGDFAAATGDSLFGYSYLHQIYTRDQPDYTGRVTVPVLWDKKLNRIVSNESSEIIRMFNTAFDHLGAREGSFYPQALQTDIDSVNSWIYDKVNNGVYRAGFATSQEAYTKAVTSLFDSLDRIEAILSSNRYLIGEHFTEADIRLFTTLVRFDPVYVTHFKCDLRRISDYPAISGYLREIYQMEGIAETVNMEHIRHHYYRSHSMINPTGVISIGAEFDLTAAHGRDSL

SEQ ID NO: 19982 - protein, 256 aa, Bradyrhizobium japonicum USDA 110
MTSSRFDLRGKVAIVTGGNGGIGLGLAHGLADAGADIAVVGRNETKSAAAVADLRQRGVKAIAVTTDVTDQAAVAAMIDRVVKEFGRIDILINNAGMSIRKPPHELELDEWNKVIDTNLTSAFVCSKLAYPALKASGNGKVINIGSMMSIFGASFATAYAASKGGIVQYTRACANAWAPDNIQVNAILPGWIDTDLTRGARQQVSGLHERVLARTPAGRWGEIDDFAGIAVFLASPASNFVTGTAIPVDGGFSVMA

SEQ ID NO: 19983 - protein, 1042 aa, Colwellia psychrerythraea 34H
MHFKKSLVRSLITLAITATASTTVLANEVSGDISKFKSVGNEVNTKQKATGYIVQLKGKTAIAQAQEIGELLPTNQLVANTGNRYNAHTPAMEAYTKALENKQKQVASSIDSINILHSFKHTYNGFTAKLNAKQKAQLESHPDVIGVYEDKLETVNTANTPEFLGLTGAGGQHAMNIKGEGVIIGVIDTGVWPENPSFADDGSYSDPADLGWLGSCDTGTDEEFACNNKLIGAKYFDSSFSSQYDIQYDLGEFDSPRDADGHGSHTASTAGGNESVAAMLSGTPVGTVSGMAPRARIAAYKVCWNSDYKNPEGGDEAGCFGGDTMAAIDAAVTDGVDVINYSIGGSRTDLTVPATAAMLNATAAGVFVAVSAGNDGPDKETVGTPAPWVTSVAASTYNGTSAIVGKALDITSGTLAGSSILSVPSGFSPATVGLSGELALAEPVQACNDAPLTNGEDLAGKIALIARGSCAFTEKFLNAQNAGAVGAIIYTTEGTSPFSMGGTDPAVTITGSMISFADGQSLTASIEDGSTSVAFTDNTAAGEAVEVGNTMADFSSRGPNLNTYDIIKPDITAPGVKILAATTSAPMFGTQGETFKYLQGTSMSSPHIAGLAALFKESNSSWSPAQIKSAMMTTARQNLTKEDGTTQADPYDFGSGHVAPVSALDPGLLFDTNLADYLAFLCGQDKEAFVSGYDTSCADLATAGFSTDASQLNLASIAIAELLEPETIFRTVSNATPIASSYTATVEAPAGFDISVQTFDAAGEETEASTLDVAAEGGKASFAITVSQTETTEIEAWKFGAITWTDGAGHSVRLPLAIKAIPSVQIEVPELISGDLNRGRFRFPVKMLYSGRTSIKHAGLVAPFGTAGTVEADPAQEFEFLGAGTNYHLFHIPEGTQVARFSLSDALVTEEGSDLDLYVYRCDKWSCAQVANSLNGGSNEDVVLTNPEPRADVDVGDVYVTMIHGYSTGAATETDYTMVGWIADQAERTTRVISSRRAINGRFNYTSILTRGLPTGTTYMGAVTYFNAEGEAEGTTVLELKN

SEQ ID NO: 19984 - protein, 342 aa, Methanosarcina acetivorans C2A
MTKTAAVIKGDGVGPELVEAMLKVANAAGTDVEFVMCEAGAGWWEEHGGNSLVPDETWQILDSSDACFKGPTTTPGGIGSPRSVAVSIRRKYDLYANVRPIKTFPNSNAPLGDVEMVCVREGTEGLYIGEEIQLTDDVSIAIRKITRTASGKIARYAFEEAKRRGYDTVVPIHKSNILKLTCGSFLEEVEKVAQDYPNIEVWPYHIDNIAQQLIKNPQIFNKKVLLSTNLFMDVISEECSALVGSIGLIYSANLGDNFAMFEPAHGSAPKYAGLDKVNPVATVLAGAWMLDYLGEKEKSEAIFKATERVISEGKYVTYDVGGNAKLSQMADEIAKYTAEILK

SEQ ID NO: 19985 - protein, 621 aa, Agrobacterium tumefaciens str. C58
MESFYLLLLVATVLVLVAAFSSLIAFRFGAPLLLLFLVIGLAAGVDGLGIEFTNNPLAYMLGSLILAVILFDSGFGTSLQSFRLSAAPAVALATVGVILTSVFFAGAAALLLGLSWLEGLLLGAIVASTDAAAVFFLLRIGGIHIRDQVRSTLEVESGTNDPMAIFLTVALVEIVAKGQGLAGIDSGFLLLFIEEMGLGVIFGLLGGLMIATVVNRFAADRGLAPIFVLALALLVFSFTGAIGGSGFLAVYVAGIVAGNRRIFAKETIRRFHEGLTWLAQIIMFLMLGLLATPSQFPAIAIPAVLLALFLIFVARPLAVWLSLMPFNYTQQETSFVAWVGLRGAVSILLAIMPILGGLDDAQIYFNAAFIIVLVSLLVQGWTIKPVATRLGLIVPPRMGEVDKLEVDLPGTANHELISYRVAKGSAIMQGERIPRWAMPSLVVRDGKSIRYQYAGRLRENDLVYLFIAPNYTRLIDRLFASALPVADDDADFFGIFTISPSRPAKEMEAAYGPGLISPAEHAMTIAELIETRLAGKAGYADRVRLGPLVLIVRALDEQEAITGVGISLEPVEPAIGLPIFISFSDILRRARTHLAQRRQLRSADAGEGVSAPAKTVTENEA

SEQ ID NO: 19986 - protein, 365 aa, Rickettsia prowazekii str. Madrid E
MTLKLGIVGLPNVGKSTLFNALTASQIADAANYPFCTIEPNSSKVLVPDERLQRLVSLVGSNKMIPSYIEFVDIAGLVKGASKGDGLGNKFLSHIREVDAILHVLRCFEDEDIMHVHNKIDPLYDIEVIETELILTDIASLEKHFIKSEKRLKSGDKKMVEQIALLKEIYKVLAEGKPARILNEVLGADNLKQLQLITSKPILYVCNVFEQDAAIGNKFTQLVAKRAETEKTKSLVISSKIESEIALLESVEEKEEFLKYIGLNKTGLSKVIKEGYNLLNLKSFFTIGPKEAHSWTFKDGTLAPAAAGIIHTDFEKGFIRAEVISYEDYINLGSEAKAKEVGKMRLEGKDYKMQDGDIVHFRFNI

SEQ ID NO: 19987 - protein, 158 aa, Leifsonia xyli subsp. xyli str. CTCB07
MSGAGAPGAAERIDGTGLRVVIVAGAWHEEIANGLIAGAERTLEAAGASWSIARVPGSFELPVASKAALEAGADAVVALGVIIRGGTPHFEYVSAAATDGLTRVALNTGKPVGFGVLTLDDEAQGLDRAGLPGSTEDKGAEAAHAALATAVALRALRG

SEQ ID NO: 19988 - protein, 122 aa, Triticum aestivum
  misc_feature (54)..(54): Xaa can be any naturally occurring amino acid
  misc_feature (66)..(66): Xaa can be any naturally occurring amino acid
NSARGIAFPHGPFSSSRDSSRLASPPSAQTWTLAGARVESSNCLLQSKRLSKLXMLLGLLKRQGLXADFQRKLTETSGDSGANVKRLEQETNVKIEQLKQQAANISPEVIQMLLRHVTTVKN

SEQ ID NO: 19989 - protein, 400 aa, Agrobacterium tumefaciens str. C58
MPAFKTIDDLNDIAGKRVLVRVDLNVPVADGKVTDATRIERVAPTILELSSKGAKVILLAHFGRPKGEPVAEMSLSQIVPTVEDVLDHAISFATDCIGAPAADAVAKMNDGDILLLENTRFHKGEEKNDPAFVEELAANGDIYVNDAFSAAHRAHASTEGLARHLPAYAGRTMQAELEALEKGLGQPVRPVVAIVGGAKVSSKIDLLMNLVKKVDALVIGGGMANTFLAARGTNVGKSLCEHDLAETAKQIMIEAATSGCAIVLPEDGVVAREFTAGAANEIVDINAIPADAMVLDVGPKSVESIKAWISRAETLVWNGPLGAFEIEPFDAATVAAAKHAAECTKAGKLVSVAGGGDTVAALNHAGVSDDFTYISTAGGAFLEWMEGKELPGVAILTTAK

SEQ ID NO: 19990 - protein, 425 aa, Leifsonia xyli subsp. xyli str. CTCB07
MSLATIPEALAELRAGRPIIVVDNESRENEGDVVLAAELASQEWIAWTVKNSSGFLCAPMTNEIADRLELPVMVATNEDTRGTNYTVSVDAADRLSTGISAGDRAHTLRVLAGLDSTPSSLHRPGHILPLRAAEGGVRERDGHTEATVDLLKLAGMTPVGAIAEIVSGDGEMMRLPGLIELGEREGILVITIEALIAYLQEFHCDRRLESPTPVPESSRVIFEVETTVPTPNGPFRMRAYRDRMTGADHVAIVAGSPDPTGTLVRVHSECLTGEAFGSLKCECGPQLDAALETVQREGGVVVYLRGHEGRGIGLINKLRAYKLQEDGLDTLDANLALGLPIDARDYGAATAILQDLGMRSVRLLTNNPEKVRQLEEHGIEVEERVALVVGVGAFNEGYLETKRDRMGHAIGEIYQTASAAERTTQ

SEQ ID NO: 19991 - protein, 364 aa, Dehalococcoides sp. BAV1
MTNTAYMVLEDGTVFTGKSFGAETEAIGEVVFNTSMNGYQEMLTDPSYTGQIIVPTYPLIGNYGINPFDNESACIRATAFAVHQECRQPSHYQSTQTVHSFLEKAGIPGISGLDTRAITRKLRLAGVMRGMVTSTKTPEEALKIIRNTPDYGQIDFVRKISTPSPYEWQKEKPSFAGFHVAVLNCGLKYSILNQLKSHGCKVTVLPCTTSPKEIDTLNPDGIVLSPGPGNPELLDYLITTVRHVCEKYPVMGICLGNQLIGRAFGAKTFKLKFGHRGGNHPVKDLESGRVYITSQNHGYSIDPVTLKNDLKVSHLNLNDGTVEGLRHRELPVFSIQYHSEASPGPMDSTYLFKQFVEMIKQTKK

SEQ ID NO: 19992 - protein, 175 aa, Prochlorococcus marinus str. MIT 9211
MDLSPIPPSPSKGLVNLVVEIPAGSRNKYEYFSEAGVMALDRVLHSSVRYPFDYGFIPNTLAEDGAPLDAMVIMEEPTFAGCLIQARPIGVLDMHDSGAYDGKLLCIPTADPRQKDINSIRQIAPNQLEDVAEFFRTYKSLEGRVVLIDGWRDFDAVDDLLQTCIEAKNNAESNN

SEQ ID NO: 19993 - protein, 145 aa, Linum usitatissimum
GFKMHCRGWRSIYCMPKRPAFKGSAPINLSDRLNQVLRWALGSVEIFFSRHSPLLYGYKDGKLKWLERFAYVNTTVYPFTSLPLLAYCTLPAICLLTDKFIMPEISTFASLFFIALFLSIFTTGILELRWSGVSIEGWWRNEEFW

SEQ ID NO: 19994 - protein, 611 aa, Arabidopsis thaliana
MASLSGLYSSSPSLKPAKNHSFKALPAQSRDSFSFPHTSKPTNLPLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKPPSSPEGRFTQILSVGIGGSALGPQFVAEALAPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAALQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHAYIQQLRDGVHNFFATFIEVLRDRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEIEMIYKIIAHMSANDRVLIAEGNCGSPRSIKVYLGECNVDDLYA

SEQ ID NO: 19995 - protein, 355 aa, Kluyveromyces lactis NRRL Y-1140
MAGIKHRRDSAESINTDIITLSRFILDQQHLSAKNATGEFSMLLNSLQFAFKFISQTIRRAELVNLIGLAGASNSTGDQQKKLDVLGDEIFINAMKASGNVKVLVSEEQEDLIVFRNSPGKYAVCCDPIDGSSNLDAGVSVGTIVSLFKIHENQNGNSGEEDSEGTINDVARCGREMVAACYTMYGASTHLVLTTGAGVNGFTLDNNLGEFILTYPELRLPEQKSIYSINEGNTCYWEPTIADFIAKLKENSEENNGKPYSARYIGSMVADVHRTLLYGGLFSYPGDKKNPNGKLRLLYEAFPMAFLVEQAGGKAVNDRGERILDLVPQHIHDKSSIWLGSSGDVDKYLKHIGKL

SEQ ID NO: 19996 - protein, 348 aa, Dehalococcoides sp. BAV1
MKQGVIEHYWKYLPVTDKTPPLTLGEGDTPLVRCPKLEKELGVGELYFKLEGCNPTGSFKDRGMVMAVAKAIEDGFKAVVCASTGNTSASATAYAAASGLESIIIIPSGKIALGKLAQAIVYGAKIIQIKGNFDQALQIVFRLTEKHKVALVNSVNPYRIEGQKTAAFEIVDALGKAPDYLFIPVGNAGNITAYWKGFKEYHQLGKAASLPKMMGFQAEGAAPIVRGHAIAEPETLATAIRIGNPASWKKAEEARDESGGLIDMVSDAEIMAAYHKMASAGIFGEPASAAPLAGLIKRIKGGQDFSASQIVCVVTGNGLKDSDIAIKGAGGFSETEASLGAVEKVLGW

SEQ ID NO: 19997 - protein, 405 aa, Zea mays
ELLSDEQNCTHIDLDSEDERLRFHSKLTLKQEIAWASHVSLQACVLPAPKRSFCGNYARVVNQVLQSAHASAHAAGLPLEKSEPMDDDLDKIKNNSHTSEIVDSWELWNSFRLLCDHSSQLCVALDILSTLPSINSLARWFGEPVRAAILQTEAFLTNAKGYPCLSKRHQSLLTGFFKHSVQVIISGRSNHNVFPVSEGVLSGDESYTEDSHVRHALTPYLEYIAYLYRKMDPLPEQERIEINYRDFLQSPLQPLMDNLEAQTYETFEKDVVKYTQYRRAVAKALVDRVADDAVSTTRTVLMVVGAGRGPLVRASLQAAEETGRKLKVYAVEKNPNAVITLHSLIKLEGWESLVTVISSDMRCWDAPEKADVLVSELLGSFGDNELSPECLDGAQRFLKPEGFPF

SEQ ID NO: 19998 - protein, 144 aa, Linum usitatissimum
GFKMHCHGWRSVYCIPKRPAFKGSAPINLSDRLHQVLRWALGSVEIFFSRHCPIWYGYGGGLKWLERFSYINSVVYPWTSIPLLVYCTLPAICLLTGKFIVPEISNYASLVFMALFISIAATSILEMQWGKVGLDDVWRNEEFW

SEQ ID NO: 19999 - protein, 375 aa, Zea mays
  misc_feature (285)..(285): Xaa can be any naturally occurring amino acid
MQPQHNRLAFPSPPAPVSLSLSLSLSRSRVHLAAASKRDQMAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGXKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 20000 - protein, 443 aa, Prochlorococcus marinus str. MIT 9211
MTLRLLLIRHGLSSFNLQNRIQGRNDLSTLTDQGVAQAQRAGQALSAIPIQTVYSSPLKRAAETTKELLRYNSKKIKPIYDQDLLEVDLASWSGLTNEEVQSQFPDEYFTWKKSPNKLVLKRENGSEYNPIEELMHQADKFLGRLLAHHSLDSDENILIVAHNAILRCIVLSLLNKPQNGFRRIRLDNASISVIKLNSCSNQTKEVQIESLNSTAHLDPPLPKKSSGARLILVRHGETNWNKEGRFQGQIDIPLNENGKEQAMAASNFLRKVSFNKAFSSSMSRPFETAKIILNNHPNLRIECLRGLVEIGHGQWEGKLETEIRETWGKLLDKWKTSPETVQMPNGENIQEVWTRATNCWEQISETLSQNETALVVAHDAVNKTILCHLLGLTPKNIWMIKQGNGGITVVDIPTDPSQLPVVTCLNITSHLGGVIDDTAQGAL

SEQ ID NO: 20001 - protein, 511 aa, Aspergillus nidulans FGSC A4
MLSPTLFSAYVLVGAIVAVLVNVIRQIFFRNKNEPPMVFHWVPFVGSTISYGMNPYKFFFSCREKYGDIYTFVMLGKKMTVYMGVKGNDFILNGKLKDLNAEEVYSPLTTPVFGSDVVYDCPNSKLMEQKKFIKFGLSQSALESHVPLIEKEVLDYIKTSPRFKGDSGVLDAPAAMAELTIYTAGSALQGKEVRKKLTAEFADLFHDLEMGFTPINFILPWAPLPQNRKRDIAHARMRETYMEIINQRRKNPDAQDHDMIWNLMHSTYKNGNPVPDKEIAHIMITLLMAGQHSSSSISAWILLRLASEPQILEELYQEQLANLKRDPRTGAFEPLQYKDLDLLPLHQNVIKETLRVHLSIHSILRKVKNPIPVPDTPYIIPTSHTLLASPGATALSDEYFPNANMWDPHRWENQRPDKEDEEGELIDYGYGAVSKRMSSPYLPFGGGRHRCIGEKFAYVNLGVIVATIVRNLKLYNVDGKTGVPATDYSSMFMGPMKPAVVGWERRFPARS

SEQ ID NO: 20002 - protein, 549 aa, Vitis vinifera
MGFHLSPASSSRKWLGFVTAVWVQSISGNNYTFSNYSDALKSLMALTQLQLNNLSVAKDVGKAFGLLSGLASDRLSTPMMLLIGSIEGLVGYGVQWLVVSRKIQPLPYWQMCIFLCMGGNSTTWMNTAVLVTCIRNFRTNRGPVSGILKGYVGLSTAIFTDLCTALFADDPAIFLLMLAIIPLLVCLSAILFLREVPSSSTAAGEKEETKFFNLFNIVAVVLAVYLLTFDVTGSHSRILSQAFAVVLLFLLACPLSIPLYFMLQDFNRSGSKPSSDIEGLITETLLSQNSQPEMAAPASEEKVEPVVEIKRPRPSIGEDHTIIEAISTTDFWILFASFLCGVGTGLAVMNNMGQMGLALGYVDVSIFVSLTSIWGFFGRILSGSVSEYFIGKAGTPRPFWNAASQILMAVGYVVMAMALPGSLYIGSVVVGICYGVRLAVTVPIASELFGLKYYGLIYNILILNLPLGSFLFSGLLAGLLYDAHATRTAGGGTTCIGPHCYRLVFVVMALSCIIGFGLDVLLAIRTKNVYSKIRASKRSKKPAAPSNSR

SEQ ID NO: 20003 - protein, 300 aa, Pseudomonas syringae pv. tomato str. DC3000
MTLQYQTIADCVGNTPLVRLQRMMGTTSNTILLKLEGNNPAGSVKDRPALSMITRAELRGQIVPGDTLIEATSGNTGIALAMAAAIKGYRMILIMPDNSSAERKAAMTAYGAELILVSKDEGMEGARDLADRMQAEGRGKVLDQFANGDNPEAHYTSTGPEIWQQTAGTVTHFVSSMGTTGTIMGTSRYLKEQNPDVQIVGLQPMEGASIPGIRRWPYEYLPKIYQSDRVDRIIDMGQTEAEETMRRLAREEGIFCGVSSGGSVAGALRIAREVENATIVAIICDRGDRYLSTGIYDMPN

SEQ ID NO: 20004 - protein, 403 aa, Zymomonas mobilis subsp. mobilis ZM4
MSEPFYRIRRLPPYVIAEVNAMRAAARAAGEDIIDLGMGNPDQPPPSHVIDKLAEVANKPDAHGYSASRGIPGLRKAQAAYYQRRFGVDVDPESEVVVTLGSKEGLANLAQAITAPGDVILAPNPSYPIHMFGFIIAGATIRSIPTTPDENFFKDLERAINFTVPKPSAMVIGYPSNPTAEVADLAFYERVVDFARRHNIWVLSDLAYSEIYFDGNPPPSILQIPGAKDVAVEFTSLSKTYSMAGWRIGFAVGNKKLIAALTRVKSYLDYGAFTPIQAAAVAAINGPQDIIEKNRELYKRRRDVMVESFTRVGWPIPAPKASMFAWAPLPKELAHLGSLEFSKQLLTHAKVAVAPGVGYGEKGEGYVRLAFVENEHRIRQAARNIKRYFTSLGIQGNDSIAAE

SEQ ID NO: 20005 - protein, 367 aa, Ralstonia solanacearum GMI1000
MLANRTPALAPAFFIWRESAAGGYNAPRHNFLLVAPMSSLPTIAILATGGTIAGSADDSASAARYRAGAVPIDQLLAASKLGLERIANVRAEQVAQIDSKDLTFDVWERLVARIRHWIDVERVDGVVITHGTDTLEETAMLLHLVLQTDMPIVMTAAMRPSTSLSADGPLNLLNAVRAAASPASRGRGVLVALNQRVHAARDVQKGHTYAVEAFVSPDVGPLGFVLDAAVQYQRAAQLPAAADGLPMPAVGQWPWVEVLSSYAQPDARLVDALVEAGVRGLVIAATGAGSIHVNLEAALQQAVKQGVIVLRSTRTGAGVVPAHPDGQGWASSGTLNPYKARVLLMLLIAAGHAQAETASLQQVIDRY

SEQ ID NO: 20006 - protein, 372 aa, Brassica napus
MAFARFFSLLTVITLSLFLLASNASSRSLSTPHKTTVLNVVSSLQQTQHILSIDPTRSSLTTTTRPEFESKSIPFFLNSSSPLTLELHSRDTLLAPHHKDYKSLVLSRLERDSSRVAGITAKIRFAVEGIDRSDLKPVYNDETLYQPEDLTTPVVSGASQGSGEYFSRIGVGTPAKEMFMVLDTGSDINWIQCQPCSDCYQQSDPVFDPASSSTFKSLSCSAPQCGSLEVSACRSDKCLYQVSYGDGSFTVGDYATDTVTFGTNGKVNDVALGCGHDNEGLFMGAAGLLGLGGGALSMTNQINATSFSYCLVDRDSGNSSSLDFNSVQISDGDATAPLSRNKKIDTFYYVVLESYNNLSTCTSYDMRPNYTT

SEQ ID NO: 20007 - protein, 257 aa, Zymomonas mobilis subsp. mobilis ZM4
MFNSFFSYLESIKMRDPAPRSRWEILLYPGVWALVLHRLAHWLYQGELYFLARIVNHFSRFLTSIDIHPGAKIGRNFFVDHGFVVIGETACIGDNVTLYQCSTLGGTDPSNGIGGKRHPTLCDGVIVGSGAQILGPIEIGENARVGANAVVTRDVEKNAVMVGIPARSIHEDAAASKVEKPKTEFVPYGTPCDDCQDPNLQDLQALHTEIDALKERIASFMMSQKAGLSENSDKNLPMVNPDQIRLDKKDGKGSSAE

SEQ ID NO: 20008 - protein, 424 aa, Rhodopseudomonas palustris CGA009
MTNSELLTRRQTAVVRGVSQATPVFAERALNSEIWDVEGKRYVDFAGGIAVLNTGHCHPRIVAAIREQLDRFTHTCFQVAPYEGYIRLAERLNQLAPINGPLKSILLSTGAEATENAVKIARAATGRSGVIAFTGGFHGRTAFASAMTGKVIPYKKALGPPLPGVWHVPFPVAGSDVSVEDALRCVQFVFKADIDASQVAAIIIEPVQGEGGFHQAPPELMRGLRRLCDENGIVLIADEVQTGFGRTGKMFAMEHYDVQADIVCVAKSLAGGLPLSGVIGRAAIMDAAEPGGLGGTYAGNPLACAAALAVLDVFEEENLIARANQIGERLRSAIDRFALSNTLVPTSVARGPGAMVAFDILKQRGSNEPDAEATKRVTRLAHENGLILLSCGTAANTIRILVPLTASDAIVDEGLAILERCLAA

SEQ ID NO: 20009 - protein, 483 aa, Rhodopseudomonas palustris CGA009
MLMPSDPGLLAERCLIGGKWCGEPVDAVFNPATGERIGAVPRFGTDEAEEAVRAAEIAFRQWSKLLAKQRATMLRAWFDQIIANRDDLALLLTREQGKPLAEALGEIDYAASFVEFYAEEARRIYGETIPSHRADARTMVIRQPVGVVAAITPWNFPAAMITRKVAPALAAGCTVVIKPAPETPLTALALGVLAQRAGFPPGVLNIITGDAPAIGKAWTEHPTVRAISFTGSTEVGKILMRQAASTVKKVALELGGNAPFIVFDDADLDAAVEGVIASKFRNMGQTCVCANRIYAQDGIYDAFVEKLTAKVATLQVGNGVDAGVTQGPLITTEAIAKVERHVSDAVAKGAKVVLGGKRHKLGRTFFEPTVLAGVTTAMLITREETFGPVAPVYRFTDEADVIAQANDSPFGLASYFYARDLGRVFRVAEALESGMVGVNSALLGADVVPFGGVKQSGLGREGSRHGIEEYVETKYILLGGLDR

SEQ ID NO: 20010 - protein, 180 aa, Zymomonas mobilis subsp. mobilis ZM4
MLTVGDKFPALKLPVQQGVSALPNGETIDLGETNGKWKVVFFWPMDFTFVCPTEIVGYNDIKEDLSLRDAVLIGGSCDTAFVHYAWRKSDERLENADFPWIADNSKKLASALGIVNEEAGVAYRATFIVDPNNVIQHVTVNSLNVGRNPAEALRVLDALQTDDLCPCNWHKGEEVLDPKA

SEQ ID NO: 20011 - protein, 448 aa, Burkholderia pseudomallei K96243
MTTVFHRAPRASLPIAVAGDGIEIVDSTGTRYIDACGGAAVSCLGHSNQRVIDAIKRQAQQLPYAHTSFFTTQPAEALADRLVAAAPAGLEHVYFVSGGSEAIEAALKLARQYFVEKGEPARRHFIARRQSYHGNTLGALAIGGNAWRREPFVPLLIEAHHVSPCYAYREQRADETEEAFAQRLADELESRILALGPDTVAAFVAETVVGATAGAVPPVREYFRKIRAVCDKYGVLLILDEIMSGMGRTGYLFACEEDGVAPDLLTIAKGLGAGYQPIGATLVSDAIYRTIVDGSGFFQHGHTYVGHASACAAALEVQRVIDEERLLENVKARGEQLRASLAVRSAEQPHIGDVRGRGLFVGVELVRDRDTKAPFDPRLKLNALVKREAMQRGLMVYPMGGTVDGHLGDHVLLAPPFICTAPQIDTIVERLGDAIDAALASIGAAALR

SEQ ID NO: 20012 - protein, 480 aa, Cytophaga hutchinsonii ATCC 33406
MFSSLFKTKSIQSILKEEKGELKKTLTATSLVLLGIGAIIGAGIFSLTGIAAAENAGPAVTISFVVAGLGCAFAGLCYAEFASMLPIAGSAYTYSYATLGEFIAWIIGWDLVLEYAVGAATVAISWSRYLIKLLEKLGVDHIPYQWMMSPFETHRVNGTELHGIVNIPAIFITCLMSLVLIRGMKESAKLNNVIVALKITVVIAFIILGWSYMDPINHADYVPDNTGVFEHFGWTGVMTGAAVVFFSFIGFDAVSTAAQEAKNPQRDMPIGILGSLVICTILYVLFSYVMTGLENYQNFKGEAAPVALAIAATPYAFFQELIIIAILAGYTSVIMVLLMGQSRVFFSMSKDGLVPAIFSEVHPKYQTPWKSNILFAILVSLFAGLVPVSVVGEMTSIGTLFAFVLVCIGVLVLRKKQPDAPRAFRTPWVPFVPIMGIVVCLYLMYALPIDTWIRLIVWMAIGIAIYFLYSRHHSKIRNSN

SEQ ID NO: 20013 - protein, 131 aa, Catharanthus roseus
RLHFHDCFVESCDASLLLDSTRRVLSEKETDRSFGMRNFRYLEDIKEALERERPGVVSCADILVLSARDGIVSLGGPFIPLKTGRRDGRRSRAEILEQHLPDHNESLTVVLERFGSIGINTPGLVAFSGAH

SEQ ID NO: 20014 - protein, 153 aa, Streptococcus oralis
EQFIRGQYRSGKIDGMKYISYRSEPNVDPESTTETFASGAFFVDSDRFRGVPFFFRTGKRLTEKGTHVNIVFKQMDSIFGEPLAPNILTIYIQPTEGFSLSLNGKQVGEEFNLAPSSLDYRTDATATGASPDPYEKLIYDVLNNNSTNFSHWD

SEQ ID NO: 20015 - protein, 799 aa, Pseudoalteromonas tunicata D2
MISNSTTLSQEYILWYQDLGMHDVPRVGGKNASLGEMISNLANAGVQVPGGFATTSVAFNDFLEQSGLNARIYDVLDQLDVDDVNKLAQVGSNIRQWIIDTPFQPQLNQAIEQAYNQLHGDSHADVSFAVRSSATAEDMPDASFAGQQETFLNVRGLDAVMIAIKHVFASLFNDRAISYRVHQGYDHRGVALSAGIQRMVRSDKAASGVMFSIDTESGFEDVVFITSSYGLGEMVVQGAVNPDEFYVHKPTLAKNVPAVVRRNIGSKAIEMIYSTDLSHGKQVEIVNIEAARSNKFSITDAEVMELAKQAVIIEKHYGRPMDIEWAKDGNDGKLYIVQARPETVRSNEDTNVMERYQLNETSNVIVEGRAIGHKIGSGVVRVLNSISEMDKVQVGDVLVTDMTDPDWEPIMKRAAAIVTNRGGRTCHAAIIARELGIPAVVGCGNATDLIKNGQLVTVSCAEGDTGFIYEGQLKHEVITSRVDEMPKLPMKIMMNVGNPERAFDFARLPHAGVGLARLEFIINRMIGVHPKALINFDKQPDAIKAEINDMIAGYESPVEFYIAKLVEGIATLGCAFAPERVIVRMSDFKSNEYANLVGGRQYEPEEENPMIGFRGAARYISDDFRECFALECEAIKRVRNQMDMQNVEIMIPFVRTLEEGKRVIELLEEHGLKRGENGLKVIMMCELPSNALLADEFLEYFDGFSIGSNDLTQLTLGLDRDSGLIAHLFDERNPAIKKLLSMAIQSAKAKGKYVGICGQGPSDHADFAAWLVEQGIDSVSLNPDTVLETWLYLAKQLKH

SEQ ID NO: 20016 - protein, 703 aa, Vibrio parahaemolyticus RIMD 2210633
MSEQKAFSLNVDEQNIAWLAIDVPNEKMNTLQAAFADEMKEIFAQLKDSSGIKGMIIHSLKPDNFVAGADVRMLEACTTANEAQALAKQGQELFQQLSDLPYPVVAAIHGPCLGGGLELALACDYRVCTDFDKTRLGLPEVQLGLLPGSGGTQRLPRLIGLLPSLDLILTGKQLRAKKAKKLGVVDACVPDTILLDVAKQFIDKGKNKGKKKQSTKEKLMSGSGLGRKLVFEQAAKKTNQKTRGNYPATVAILEVIQHGLEKGFAQGQELEAKRFGELVMSSESKALRSIFFATTEMKKEHGTDAQPAAVKKVGVLGGGLMGAGISHVTVAKAKVPVRIKDVSNDGVLNALNYNYKLFEKQRKRRILSKADLQAKMLQLSGGVDFTSYNHIDVVIEAVFEDLDLKQQMVADIEANAKSETIFATNTSSLPIHKIAEKAERPENIVGLHYFSPVEKMPLVEVIPHETTSDETISTVVALAKKQGKTPIVVKDKAGFYVNRILAPYMNEAAHILLANEPIEKLDGALLDFGFPVGPITLLDEVGVDIGAKIMPILVNELGERFKGPDVFDILLNDGRKGRKSGKGFYTYKGKKKEVDKSIYKLLKLTPESKLSDNDIALRCVLPMLNEAVRCLDDGIIRSPRDGDIGAIFGIGFPPFLGGPFRYMDQFGLKELVEKMNEFASKYGDRYAPCDGLLTRAGEGRTFY

SEQ ID NO: 20017 - protein, 268 aa, Hyphomonas neptunium ATCC 15444
MKPAASLTLVGAGRMGSALLHGWLKGPEREISVIEPSPRPEIRALAEEGRIQLNPAPSESSIIVLAVKPQQFAAVSEQAKAFVGPKSVAISIMAGVRLAQLSRRLGTERVIRSMPNTPGAIGQGVTVFTAPEGAKRTDLSAARELLAPLGEVHGPVDEAMMSAVTALSGSGPAYIFLLAEVMAEAGVAQGLPRDLALSLARRTVEGAAALMGESGDSPEALRKAVTSPGGTTQAALDILMDTGGMPALFRNALSAAANRDRQLSQEAD

SEQ ID NO: 20018 - protein, 131 aa, Catharanthus roseus
RLHFHDCFVESCDASLLLDSTRRVLSEKETDRSFGMRNFRYLEDIKEALERECPGVVSCADILVLSARDGIVSLGGPFIPLKTGRRDGRRSRAEILEQHLPDHNESLTVVLERFGSIGINTPGLVALSGAH

SEQ ID NO: 20019 - protein, 168 aa, Triticum aestivum
  misc_feature (167)..(167): Xaa can be any naturally occurring amino acid
MNALAATSRNFRQAARLLGLDSKLEKSLLIPFREIKVECTIPKDDGTLASFVGFRVQHDNARGPMKGGIRYHPEVDPDEVNALAQLMTWKTAVAAVPYGGAKGGIGCSPGDLSRSELERLTRVFTQKIHDLIGTHTDIPAPDMGTNSQTMAWIFDEYSKFHGHSPAXV

SEQ ID NO: 20020 - protein, 208 aa, Zea mays
  misc_feature (97)..(97): Xaa can be any naturally occurring amino acid
  misc_feature (174)..(174): Xaa can be any naturally occurring amino acid
STARPARYYEAGARFAKWRAVLKIGPNEPSQLAIDLNAQGLARYAIICQENGLVPIVEPEILVDGPHDIDRCAYVTETVLAACYKALNEHHVLLEGXTLLKPNMVTPGSDSKKVTPEVIAQYTVRTLQRTVPAAVPAVVFLSGGQSEEEATLNLNAMNKLSTKKPWALSFSFGXFLARCKANSEATLGTYKGDAAADTESLHVKDYKY

SEQ ID NO: 20021 - protein, 413 aa, Bradyrhizobium japonicum USDA 110
MPGAQRAMEEFYRIRRLPPYVFEQVNRAKAAARNAGADIIDLGMGNPDLPAPPHVLEKLKETLGKPRTDRYSASRGIPGLRRAQAGYYARRFGVKLNPDTQVVATLGSKEGFANVAQAITAPGDVILCPNPSYPIHAFGFLMAGGVIRSVPSEPTPQFFEAVERAIVHSIPKPLALVVCYPSNPTAYVASLDFYKDLVAFAKKHEILILSDLAYAEVYFDENNPPPSVLQVPGAMDVTVEFTSMSKTYSMAGWRMGFAVGNERVIAALARVKSYLDYGAFTPVQVAATAALNGPDDCIKEMRDTYRKRRDALVESFGRAGWEIPPPEASMFAWVPLPEAFRSVGSMQFATLMVEKSGVAVSPGVGFGEHGEGYVRIAMVENEQRIRQAARGVRRFLESGIETLHNVVPLANRR

SEQ ID NO: 20022 - protein, 153 aa, Streptococcus oralis
EHFIRGQYRSGKIDGKKYISYRSEPNVNPESTTETFASGAFFVDSDRFRGVPFFFRTGKRLTEKGTHVNIVFKQMDSIFGEPLAPNILTIYIQPTEGFSLSLNGKQVGEEFNLAPSSLDYRTDATATGASPDPYEKLIYDVLNNNSTNFSHWD

SEQ ID NO: 20023 - protein, 266 aa, Kluyveromyces lactis NRRL Y-1140
MSFSQEIRRRGSYAPIDFTPEVSQACRKQVEFYFSEYNLPYDKFLRSLCEQNDGWIPITTLASFNRMKKYRPVDKVVDCLKDSTILEVSADGENVRRKSPLETVDFKDRNERVLVFMNFKKIENEDKDKFLELQEELEKFFNGFTTVNQVRLKKDHKKYFNGVVEVEFKTKEECVKFFEEHKTDFSYQGQPLEVVTKKQYSLAKNATRSKNFGGSGQKTRSLTGYRKNIPKTNDETPEASSESKLSEGDANAPTEKKSEESATETA

SEQ ID NO: 20024 - protein, 499 aa, Arabidopsis thaliana
MARKMLVDGEIDKVAADEANATHYDFDLFVIGAGSGGVRAARFSANHGAKVGICELPFHPISSEEIGGVGGTCVIRGCVPKKILVYGATYGGELEDAKNYGWEINEKVDFTWKKLLQKKTDEILRLNNIYKRLLANAAVKLYEGEGRVVGPNEVEVRQIDGAKISYTAKHILIATGSRAQKPNIPGHELAITSDEALSLEEFPKRAIVLGGGYIAVEFASIWRGMGATVDLFFRKELPLRGFDDEMRALVARNLEGRGVNLHPQTSLTQLTKTDQGIKVISSHGEEFVADVVLFATGRSPNTKRLNLEAVGVELDQAGAVKVDEYSRTNIPSIWAVGDATNRINLTPVALMEATCFANTAFGGKPTKAEYSNVACAVFCIPPLAVVGLSEEEAVEQATGDILVFTSGFNPMKNTISGRQEKTLMKLIVDEKSDKVIGASMCGPDAAEIMQGIAIALKCGATKAQFDSTVGIHPSSAEEFVTMRSVTRRIAHKPKPKTNL

SEQ ID NO: 20025 - protein, 514 aa, Rickettsia prowazekii str. Madrid E
MNQSNIISPELLDERKNIARQGGGEARINAQHQKGKLTARERIEVLLDPNSFTETGMFVSHRCDNFGMQNKKFLGDGVVTGYGTINGRLVFIYSQDFTVLGGSLGEYHAKKICDIIDQAIATGAPVIGINDSGGARIQEGVDALAGYGELFQRNVLASGVIPQITLIMGPCAGGAVYSPALTDFIFMVKNSSYMFVTGPDVVKTVTGEEVTQEKLGGARMHTTKSGVADLAFNNDIEALLEIRKFFNFLPSSNRSTLPVRPTVDPADRVDMSLSTLIPNTPNKPYDMKELVERIVDEGEFFELQPDFAKNIIIGFGYMEGYPVGFIANQPLHLAGCLDINASRKAARFIRFCDAFNISIVSLVDVPGFLPGTSQEHEGIIKHGAKLLYAYAEATVPKITVITRKAYGGAYIVMNSKHLRGDINYAWFNSEIAVMGAEGAAEIIFKEECKDNEAKKQKIDEYRKVVTSPFVAASRGYLDDIIRPQNTRWRICKALNFLRTKKVSLPWKKHDNLPL

SEQ ID NO: 20026 - protein, 387 aa, Desulfococcus oleovorans Hxd3
MKLEDIKKIAVIGSGAMGHGIAQVCIMAGYTVVMVDVKQEFLDNGMKKVKESMDFLVGKGKLSAEDKDRMMGQLSTSLDNKAAVADVQVVIEAVPEIMDLKKKVFADVSSAAPAEALLASNTSTMSITEIATAVTKPERFLGMHFFNPVNRMKLVEVIFGEKTSAENVDLLCELSKKIGKIPVKVLKDSPGFIVNRIGAPNQALISAILDEGAIKPDEIDAIMKQMGMPMGPFELADYVGIDVFYHTLKYYSETLSKDFTPGKTLQALLDKGDLGMKTGKGIYEWEGGKAKIDTSKTSTEITPMEFLAIQVNEAVRVYKEGIAESVEDIDQGMVHGMRAFAGPFTLAAGTDPKQLTDTLNKLHAKYGLDIFKPEPEIQDGSFKTMGK

SEQ ID NO: 20027 - protein, 149 aa, Brassica napus
  misc_feature (115)..(115): Xaa can be any naturally occurring amino acid
  misc_feature (138)..(138): Xaa can be any naturally occurring amino acid
MEQTFIMIKPDGVQRGLVGEIICKFEKKGFTLKGLKLITVDRPFAEKHYQDLSAKPFFNSLVDYIISGPVVAMIWEGKNVVLTGRKIIGATNPAASEPGTIRGDFAIDIGRNVIXHGATPVESANKEAALWFPDGPVXWQSSLHSWIYE

SEQ ID NO: 20028 - protein, 593 aa, Triticum aestivum
  misc_feature (25)..(25): Xaa can be any naturally occurring amino acid
  misc_feature (150)..(150): Xaa can be any naturally occurring amino acid
KLDQEWGSLKKKAIDASSKLRHSLXKKNRREPASRVLSVSIEDVRDLGELEEVEAFRQALILDELLPTRHDDYHMLLRFLKARKFDIEKAKQMWTDMLQWRKEYGTDTIVEDFDYTELDTVLEYYPHGYHGVDKEGRPVYIERLGKVDPXNKLMNVTTMDRYVRYHVKEFERSFLIKFPACSLAAKRHINSSTTILDVQGVGLKNFSKTARELIMRLQKVDNDNYPETLHQMFIVNAGPGFRMLWSTVKSFLDPKTTSKIHVLGNKCQSKLLEIIDASELPEFLGGTCTCPEYGGCLKAEKGPWKDANILKKVLNGEAQCARQIVTVSNGTETIISYPKSKYQTVRGSDTSTAESGSEAEDVTSPKALRSYISHPKLTPVREEVKMIRATSFSTRMPEYDVPVVDKAVDATWKRELPWKVPVPPKDSSLATTTKASNRSLDQIIPALMAFVIAIVTLLRSVKDVATKRLADKNESDEQSSAVYQDCIPKEEFRPPSPGPGFAESDLFSLVLQRLAELEAKVHALEEKPSEMPCEKEELLNAAVRRVDALEAELIVTKKALHEALIRQEELLAYVDRKTIAKAQKKKKKPMSCY

SEQ ID NO: 20029 - protein, 359 aa, Vitis vinifera
MMNCLQSWPEPIVRVQSLSDSGIHVLPDRYIRHPSDRPSFTPISTHANIPVIDLHSLLAARDARLRQATLDRISGACREWGFFQVVNHGVRPELMKSIRQLWRDFFHLPLEAKQVYANSPATYEGYGSRLGVEKGAKLDWSDYFFLNYLPESARDENKWPTTPESCRELVHEYSKAVVELCGILMKILSVNLGLEGDHLQNAFGGDDVGACLRVNYYPKCPQPDLTLGISPHSDPGGMTILLPDDDVSGLQVRKGEHWVTVEPIPDALIVNLGDQIQVISNAIYKSVEHRVIVNSIKERVSLAYFYNPKGDLLIEPAKKLVSKDRPASYSAMTFDQYRLFIRQSGLWGKSQVESLKCSQ

SEQ ID NO: 20030 - protein, 397 aa, Pseudoalteromonas tunicata D2
MEYQVLFFVACSAFIYSVAVRQFAHAEITGPMFFVFVGLAIHYFVFETSVDLSNVQPIFQIFVELTLASVIFIDASNSNLKTLRTNWLIPTLLLLVALPLTFLLAAVIAQFIFPSLPIMYAALIAIIVTPTDAALCKGFIVNKFVPEKLREGINFESGLNDGLCVPIFLLIMLMINQPQESKNIGLVLHLFLHQIGIAVSLATVSMFITLKIISYCEQRHLFAKTTSPFLMTSLAICIYALTQYFGGSGFIAAFVAGLFFDWFYKGNVKQKLLSDSEQLSDFMSSLIWCVFGFLAGILLFTHLNFKIIFFSVLALTLVRMLPVFIVLNVTALSIKDRIILAWFGPRGMASIVFTLMVYQSDIPYKNEIVEVSFSVILLSVLLHGISTRPLINLFKKA

SEQ ID NO: 20031 - protein, 131 aa, Catharanthus roseus
RLHFHDCFVESCDASLLLDSTRRVLSEKETDRSFGMRNFRYLEDIQEALERECPGVVSCADILVLSARDGIVSLGGPFIPLKTGRRDGRRSRAEILEQHLPDHNESLTVVLERFGSIGINTPGLVALPGAH

SEQ ID NO: 20032 - protein, 153 aa, Streptococcus oralis
EQFIRGQYRSGKIDGMKYISYRSEPNVDPESTTETFASGAFFVDSDRFRGVPFFFRTGKRLTEKGTHVNIVFKQMDSIFGEPLAPNILTIYIQPTEGFSLSLNGKRVGEEFNLAPSSLDYRTDATATGASPDPYEKLIYDVLNNNSTNFSHWD

SEQ ID NO: 20033 - protein, 383 aa, Spinacia oleracea
MGLLCSKHQHSTKPDAENAQATGIERRIERETIAEKHIQKLLLLGAGESGKSTIFKQIKLLFQMGFDDAELNSYTPVIHANVYQTIKLLIDGSKELAQNETDSSKYSLSPDNKEIGDKLSEIGGRLDYPQLTKELSEEIEKIWNDPAIQETHARSSELQLPDCANYFMEHLDRLSDVNYIPTKEDVLYARVRTTGVVEIQFSPVGENKKSGEVYRLFDVGGQRNERRKWIHLFEGVTAVIFCAAISDYDQMLYEDENKNRMVETKELFEWVLKQRCFERTSIMLFLNKFDIFEKKVQKVPLSTCEWFKDYQPVSSGQQEIEHTYEFVKKKFEELYYQCTAPDRVDRVFKIYRTTALDQKLVKKTFKLLDETLRRRNLVEAGLL

SEQ ID NO: 20034 - protein, 153 aa, Streptococcus oralis
KQFIRGQYRSGKIDGMKYISYRSEPNVDPESTTETFASGAFFVDSDRFRGVPFFFRTGKRLTEKGTHVNIVFKQMDSIFGEPLAPNILTIYIQPTEGFSLSLNGKQVGEEFNLAPSSLDYRTDATATGASPDPYEKLIYDVLNNNSTNFSHWD

SEQ ID NO: 20035 - protein, 382 aa, Leifsonia xyli subsp. xyli str. CTCB07
MSRAARYSFAMTTSPLDRFYGVIPAGGIGSRLWPLSRADAPKFLHDLTGSGQTLLRDTWDRLAPLAGEQRIMVVTGRAHRAAVEAQLPALTDPNIVLESEPRDSTAAIGLAAAILEQREPGVIVGSFAADHVIQNEPLFAAAVREAAAAADAGHIATIGIKPTEAAVGFGYIQTGAALAVPGAPSALTVDSFVEKPDHATAERYLAGGRHLWNAGMFIARASRLLEEIGRSRPQLLAGLQELAAAWDNPATRGPAVDRIWPALEKIAIDYSVAEPAAAGGRLAVIPGSFDWDDVGDFASLAKLNSGGRKSDLAILGEDARVLSDASSGIVVSQSKRVISLIGVKDIVVVDTPDALLVTTSENAQRVKAVVDALKLTGSTDVL

SEQ ID NO: 20036 - protein, 324 aa, Populus alba
MSQKVVLMFLLVAMAGTATVQGQGTRVGFYATTCRRAESIVRATVQSHFTSDSSIAPGLLRMHFHDCFVNGCDASILIDGANTEKTAGPNLLLRGYDVIADAKTQLEAECPGVVSCADILALAARDSVVLTKGLTWPVPTGRRDGRVSLASDTSNLPGFTDSVDVQKQKFAAFGLNAQDLVTLVGGHTIGTTACQFFRYRLYNFTTTGNGADPSINPSFVSQLQTLCPQNGDGSRRIALDTGSQNSFDSSFFANLRSGQGILESDQKLWTDATTRTFVQRFLGVRGLAGLTFGVEFGRSMVKMSNIGVKTGTTGEIRRVCSAIN

SEQ ID NO: 20037 - protein, 271 aa, Bradyrhizobium japonicum USDA 110
MNMAGQVEGKVALVTGGASGIGEAIVELFAREGATVIATDVDELRGPELAKRITKAGGKAIFLEQDVSSEERWIEIVAEIAKRYGRLDIMVSNAGIGIAVPSIVDMTLGDWRKQNAINLDGVFLSVKHCLPLMRKTGGGSIVMMSSLAGLRGAPGLSAYSATKGGVRLFAKSIAMECAAVGDGIRVNSVHPGIIDTPIWGKIPTGATGNQGNAPIDPEERARVVTPLARAGQAAEIASGVLYLASDASRYVTGSELVIDGGMNAGGVPRRQ

SEQ ID NO: 20038 - protein, 413 aa, Thermococcus kodakarensis KOD1
MIKKAVIPIGGDATRLRPLTIETSKGLVRLLNKPILEHSILSLAKDGIEEVYLGVRGYVNYTTLFDYFREGYWLQKKYGLEKEIRIRYMPRYESTTNGDAVWYTMEYYGIKEPVVVIQGDNIYQLNIQDMYKWHRKKNAFMTIALQPVEDVTGFGVAKIDDDYRIEYFVEKPRPEQAPSNLANTGIYILSENFWEFLNEGWAKEMKETRRLDFGGDIIPALIEHGYEVYGYPMEGYWFDVGTPERYLNAAMYLLRHLSPEDMEAVEITHDVYMQGKSEMSEDLRRKFREMIKTGKLIVEGKVLLGRHISIGKGTALEDAVIDNYTIVGRNCEILHSVVMDRVKLGDNVRIVNSIIGRHVEIGNNVRIVNSVIGDNAVIEDNVRMYNVKIWPHEFVERGATLEHYTVRTGVPRR

SEQ ID NO: 20039 - protein, 346 aa, Prochlorococcus marinus str. MIT 9211
MFGLIGHSTSFDDAKKKAMDLGYDHIAQGDLDVWCSAPPQLVEHVNIVSAIGKNIEGAYIDSCFVPEMLGRFKTARRKVLNAMELAQKKGINITALGGFTSIIFENFNLLQNKQVRNTTLEWERFTTGNTHTAWVICRQLELNAPLLGIDLKKARVAVVGATGDIGSAVCRWLSERTGVQELLLVARQQQPLIELQKSLGGGKILGLEDALPEADVVIWVASLPKTLEIDKAKLRKPCLMIDGGYPKNLDEKFNGSGVHVLKGGIVEFFTDIGWSMMELAAMEKPRREMFACFAEAMLLEFEGCHTNFSWGRNNITLEKMDFIGQASEKHGFSVIGLNPKLQAAIA

SEQ ID NO: 20040 - protein, 518 aa, Solanum lycopersicum
MDALCAGTAQSVAICNQESTFWGQKISGRRLINKGFGVRWCKSFTTQQRGRGVTSAVLTRDINKEMLPFENSMFEEQPTADPKAVASVILGGGVGTRLFPLTSRRAKPAVPIGGCYRLIDVPMSNCINSGIRKIFILTQFNSFSLNRHLARTYNFGNGVGFGDGFVEVLAATQTPGDAGKMWFQGTADAVRQFIWVFENQKNKNVEHIIILSGDHLYRMNYMDFVQKHIDANADITVSCVPMDDGRASDFGLMKIDETGRIIQFAEKPKGPALKVMQVDTSILGLSEQEASNFPYIASMGVYVFKTDVLLKLLKSAYPSCNDFGSEIIPSAVKDHNVQAYLFNDYWEDIGTVKSFFDANLALTKQPPKFDFNDPKTPFYTSARFLPPTKVDKSRIVDAIISHGGFLRECNIQHSIVGVRSRLDYGVEFKDTMMMGADYYQTESEIASLLAEGKVPIGVGPNTKIQKCIIDKNAKIGKDVVILNKQGVEEADRSAEGFYIRSGITVIMKNATIKDGTVI

SEQ ID NO: 20041 - protein, 516 aa, Solanum lycopersicum
MSVATDVRFALLRNNPAALTGTNLKIVKFCNGELMGKKLKYTKFQLRSNVVKPHICMSLTTDIAGEAKLKDLEAKKEDARTVVAIILGGGGGTRLFPLTKRRAKPAVPIGGAYRLIDVPMSNCINSGINKVYILTQFNSASLNRHIARAYNFGNGVTFGDGYVEVLAATQTPGELGKRWFQGTADAVRQFHWLFEDARSKDIEDVLILSGDHLYRMDYLHFVQSHRQSGADITISSLPIDDSRASDFGLMKIDDTGRVMSFSEKPKGDDLKAMAVDTTVLGLSPEEAKEKPYIASMGVYVFKKDILLNLLRWRFPTVNDFGSEIIPASTKEFCVKAYYLFNDYWEDIGTIRSFFEANLALTEHPPRFSFYDATKPIYTSRRNLPPSAIDNSKIVDSIVSHGSFLTNCFVEHSVVGIRSRIGTNVHLKDTVMLGADYYETDAEIASQLAEGKVPLGIGENTRIKECIIDKNARIGKNVVIANSEGVQEADRSSEGFYIRSGITVILKNSTIPDGTVI

SEQ ID NO: 20042 - protein, 144 aa, Coprinopsis cinerea okayama7#130
MISSRRSVFRPCIDLHNGQVKQIVGGTLSDSSPDALRTNFVAEQSAGQFAELYKLHDLTGGHVIKLGPGNDAAAKEALATWPKGLQIGGGINETNAQEWLDAGASKVIVTSYLFPNGNFSLERLQRLSQSIGKENLVVDLSPTG

SEQ ID NO: 20043 - protein, 515 aa, Aspergillus nidulans FGSC A4
MVHLASIKKDDDFEPVVNRVDSIKLDTIEEDDYSATVYGTRFATQQLPHAEMPDREMPREVAYRMIKDELSLDGNPMLNLASFVTTYMEDEAEKLMAESFSKNFIDYEEYPQSAEIQNRCVNMIARLFNAPTDSDTDHPMGTSTVGSSEAIMLGTLAMKKRWQNKRKAEGKDYSRPNIVMNSAVQVCWEKAARYFDVEERYVYCTEERYVIDPQQAVDLVDENTIGICAILGTTYTGEYEDVKAINDLLVERGLDCPIHVDAASGGFVAPFIHPTLQWDFRLEKVVSINVSGHKYGLVYPGVGWVVWRSPEFLPKELIFNINYLGAEQASFTLNFSKGASHVIGQYYQMIRLGKRGYRSVMVNITRIADYLADQLEQLGFIIMSQRRGRGLPLVAFRLPADRADETFDEFAIAHQLRERGWIVPAYTMAPHSNNLKLMRVVVREDFSMSRCDQLLSDIKLALKSLREMDQAMLERYTQHVRSHTTKSHRAKHTHPHYKNETHSLQGRTGKTHGVC

SEQ ID NO: 20044 - protein, 298 aa, Oryza sativa
PAGTCGPAGHMRGTVRPSIQAAAPGPRWLRLAATLRPISPATAAVRYPLFPLACGHQVSAVTMAKEVDRFVELVVVRHGETSWNSSRIVQGQMDPELNEIGKQQAVVVARRLARKARPAAIYSSDLKRAAETVKIIAKVCDVSNLVLIEALRERHMGYLQGLTWDDAMNKSPGVFKGFANFEVKNGLDFDDRNHEFPDGGESLNQLSERCISYLNKVAQNHIGERVIVVGHGAAILELCRHTDPPNRSIRRKIPNTSLNIFRISGVTGRWILERCGDVGHLSENGFLENAFGGDGASA

SEQ ID NO: 20045 - protein, 413 aa, Ralstonia solanacearum GMI1000
MKTIQKSAKLNNVCYDIRGPVLEKAKQMEEEGHQIIKLNIGNLAPFGFDAPEEIQQDMIRNLPNSAGYSDSKGIFAARKAVMHYTQQQGIKNVTLDDIYLGNGASELIALATNALLDAGDELLLPAPDYPLWTAMTSLSGGTPVHYLCDESNGWMPDLDDIRAKITPNTKGIVVINPNNPTGALYSDALLHDIIAIAREHGLVIFADEVYDKVLFDDNRHTAMASLSEDVLTVTFNSLSKSYRSCGYRAGWMVVSGDKRPAKDYIEGLNMLSSMRLCANVPGQWAIQTALGGYQSINDLVAPGGRMRRQRDLAYELITAIPGVSCVKPKAALYMFPRLDPSVYPIDDDQTFIRQLLEEERVLLVQGTGFNWHSPDHFRIVFLPHEDDLREAIGRIARFLERYRQRHGTGIRAA

SEQ ID NO: 20046 - protein, 159 aa, Zea mays
MYQAIPYSSARAWLMPAAAAEAGVAAVKPEPVATVAEPAAEEERARPDAAAGDDDDGGRAEVGRAVAERPVLVVGRRGCCLSHVVKRLLQGLGVNPAVHEVADESALAGLVPAGAGAAAGALPAVFVGGRLLGGLDRLMAVHISGELVPILKKAGALWL

SEQ ID NO: 20047 - protein, 180 aa, Triticum aestivum
  misc_feature (54)..(54): Xaa can be any naturally occurring amino acid
  misc_feature (73)..(73): Xaa can be any naturally occurring amino acid
  misc_feature (92)..(92): Xaa can be any naturally occurring amino acid
  misc_feature (96)..(96): Xaa can be any naturally occurring amino acid
  misc_feature (108)..(108): Xaa can be any naturally occurring amino acid
  misc_feature (116)..(116): Xaa can be any naturally occurring amino acid
  misc_feature (120)..(120): Xaa can be any naturally occurring amino acid
  misc_feature (126)..(126): Xaa can be any naturally occurring amino acid
  misc_feature (129)..(129): Xaa can be any naturally occurring amino acid
  misc_feature (137)..(137): Xaa can be any naturally occurring amino acid
  misc_feature (143)..(143): Xaa can be any naturally occurring amino acid
  misc_feature (150)..(150): Xaa can be any naturally occurring amino acid
MAPTVMASSATSVAPFQGLKSTAGLPVSRRSNGASLGSVSNGGRIRCMQVWPIXEGIKNSETLSYLPPLSTEXLLKQVDYLDPSKWVPCLRXSKVXSSSVEHNASPGXYYDGRYWXTMWXLPISGXTDXTQVINEVXKRSRRXPDAYSAXRFDNMRKCMRNSSPTTGSRIRKANSHHTGN

SEQ ID NO: 20048 - protein, 782 aa, Burkholderia sp. 383
MDRAGTGLAPVPGSENMKQTETQQQAAFDYHEFPTPGKISVVASKPLVTQRDLALAYTPGVAGVCEAIAADPLQAHRFTSRGNLVGVITNGTAVLGLGNIGPLASKPVMEGKAVLFKKFAGIDVFDIEINETDPDKLVDIIAGLEPTFGGINLEDIKAPECFTVEQKLRDRMKIPVFHDDQHGTAITVSAAFINGLKVVGKSISEVKVVTSGAGAAALACLDLLVDLGLPVENVWVTDIEGVVYRGRTALMDPAKSRFAQETDARKLAEVIGGADVFLGLSVGGILTADMLKAMAPRPLILALANPTPEIFPELAHATRDDVVIATGRSDYPNQVNNVLCFPYIFRGALDVGATTITREMEIAAVHAIAGLAEEEQNEVVAAAYGAYDVAFGAQYLIPKPFDPRLIVRIAPAVAKAAMEGGVAKRPLTDLDAYVEQLQQFVYHSGAFMKPLFATARRLVRDGGKARIVFTEGEDERVLRAVQVIVDEKLARPILVGRPEVLLARIERFGLRIRLGQDVEVTNPEYDERFPQYWTTYWELRCRDGISKEMARVEMRRRLTLIGAMMVRLGDADGMICGTVGEYHNHLRFVDEVIGKKPGASTYAAMNILLLDQRTVALVDTHVNDNPDAEQIAEFTIAAARQMEWLNLTPKAALLSRSNFGSGSAASGVKMRRALEIVREQAPDIEADGEMHGDCALDEGLRSRLLPMSPLKGAANLLVCPNVDAGNIAYNLLKTEAGSNVAVGPFLLGVNAPVNILTSSATVRRIVNMAALTVIEANRNASA

SEQ ID NO: 20049 - protein, 403 aa, Oryza sativa Japonica Group
MAAREGASSSSGSSSSHHEAGGRRSPLELSLLLTAAAGAAVAAAATPRDAHAASGGVMGGRRSSSPSSYCRRTSSSSSSSSSSSSSSSSPSSREDESVISVIVAGAVVVAYGVACVGAYVACGVVYIAAHLLRPRSATTVVKLQVAFRGLTKIIQRDLNGIARKVDTSNRSWDKFMLTETICSLNRHKDICISSSLSADLQKRLLFWGDCWEKHFDKISIEERSKFDEETLYNVQGIKMKKKYLKPGLGKENEYLVLTILLAAEGKLEFPIVRSASDLTTVLGILNSIHANKIEGIQVLWTPQKIGDILPEERLLKDYPYLKPLLKESDSLGVASVTEIEQSNQRSITEGQDSFAVSSVTETMQSNQGSVMQDQYFIEVANVTDVKQSNQESTKEDQDSKQSN

SEQ ID NO: 20050 - protein, 2421 aa, Oryza sativa Japonica Group
MAFERSWPLVIFVSVQEKDTNVSMQTEDVEGPSNAGDVVGPSMQNEENQPREEQAMGMADEGERVGIIVDEMEREDSDNEQAEDDASSDEEGDVMATDWANEDFSGLVISEGDHVPWEYKEYEVIEGARYAHKDEMKEAVKHWAVSLQREFRVVKSTNYVYEVRCMKEDCPWRVHAYKGKWNDYWKVSIVTEHKCYLQGVEKYHRNITSAFVASEMYSSVVGNIGFEPKSIIRHIENKFKYTISYAKAWRAKQKIIEMRYGTFEASYDNLPRLLATIAQRNNNTYYDLHTFTSVEDRTKSVLQRAFFSLGACINAFVHCRPVLCIDGTFMTGKYRGQILTAIGCDGNNQVLPMAFAFVESENTESWYWFLERVHIAVVRMRPNVCLIHDRHAGMLRAIDYLQNGWDEKGLPAKWPDVRSRWCMRHMGANFYKQFKNKHLMELFKRLCAQNQEKKFNELWDKLDELTTKQTDEQSRRPQVEGDEPPIPLGALHDDPPTMRRRSGSAIRNFSQWIENEPKEKWALLFDTDGSRYGIMTTNLAEVYNWVMRGVRVLPLVAIVEFILHGTQAYFRDRYKKIGPSMADNNIVFGNVVTKYMEDKIKKARRHRVVAQGTQVHRYEIMCVDRSRRGIYRKQAVQECVLKADGGCTCSCMKPKLHHLPCSHVLAAAGDCGISPNVYVSNYFRKEAIFHTWSEEIYGFGISGSYTTLSAQVFYIPDPSKFRVKKGRRQTRRIRNDMDESEAGGRTLRCSKCDLRGHTYKTCPKNAEVPSGADASLSGQASDGMAYDTPALLNRGIDRNHRSFLSAVEGAQLGTFRPRTSREWLRVDPRHVPWLRAAGLLPLCRLVEAAADDRDPAKRWDADRSLLAALVDRWRPETHTFHLPCGEMAPTLQDVSYLLGLPLAGAPVGPIDGVFGWKEDITARFEQVMRLPHLGPTTTLPPYSTVGPSKAWLLQFTADLLHPDADDYSVRRSLEAYLLWLFGWVMFTSTHGHAVDFRLVHYARSIADAQPQDVPQWSWGSAVLAATYRALCEACTKTDAGAIIAGCPMLLQLWAAERFAIGRPVVDSAPYGVGRSAQWPEDGPTMGTYWCRRGRRYAHVQVRRGYPDFVFEFDRLQPSDVIWEPYTEEAVAARAPLGLSSLCTRDQAYWLTILPMVFDIFVEPHWPQRVMRQFGLRQVFPGNVQPTVPPADHSLTRRGQLAGALWAPRVQQYVDDWVLATEEVINELFPHTEENYRDYLRWYLPRTRARVTFTPDAPEPHVAAVTDAYPTHRDRDYFVAADAARDISADITAVQVRLNRGLHLTDVEQRSTFDRMQEKMRAVMRVFSCRSAVDVVPPAGPVHPRPRGPTVGAGPRLSSSAPSFGAVRPTAPVSHGPRMPSSAFAGTTGASASSAGAFATSSGAFASSSSHGASIPRPHAGFAAGIFGTGASSSHAGRTGPTSQFYDDDLHGADHQDVLGSSQLGGAPEAHTQEQPEVTPVQAGRVGRAVPPDRLTYSQGHIRAQGRRDRELVGYNFTSLLCFRERPGGTGGQAARRGVAARRRGGAGKAADLAYWESAARMIADSSRSSKVVVEKSTVPVKTAEAIEKILAHNAHVVEFQALKDVYAQWVPVDRIITTNLWSAELSKLAVNAFLVQRVSSVNAISALCEATGTDVMEVATGAAQRLGAGSTAAADATSCAATASVGTARRRCGAPGEWRQLKRLQDLACMCVHEIDGEEDDVVAASLRCAFQSAVGTTAFQRLPVAPEFEPGLGALLMGAGEVVLAGAVEEHAGAGLGGGAVEAEILPDGEQENNAVELEIAAEQEIEETSSATAKKPIRARVPNPRYSGPMWAKGIDKTWYQSLLSHPILDPAAKGFRLGIGDRLLQLKSAKRNRGSGSRCVKLEKPRYQTKQAFKIMENEAKLDLILKKLTETDSKLVDLEKNSRADMLNLKTSVDSWKPQLEKKVTDLATTVGNLQLQFDQLQLLNKAEPKPDLTAQLGARNAAEIRAEVLGSHPQSPPPANGTNSILFSTPAPYFHDPAMRTAFTGSAVGTSTGLPPMPCPQFDGDNPQMWRENCEAYFDTYGVSPAHWVRIATLNFSGNASFWLQSVRSQLIGVTWVELCEKVCAKFSRDRHQQLIRQYIHIRQTGSVTEYVDKFDSLMHQLIAYDSELKPVYFVTKFVEGLKDAIHTVIMVQRPQDLDTACSLALLQEEAMLGTRRLEFSTPVKSNFRNTAQVSLTPLPVRPVVNEDKKTPEAAKITPRDDRLSSLKAYRKSKGLCFTCGERWGRDHKCASTVQLHVMEELLEALQEDDDPVGDDIVAEAEGTLMAVSSQAIAGVESSKSIRVRGWVQGLELLMLVDSGSTHSFIDEQVARKLAGIQTLSHPVQIKIADGGTMQCDRSIPNCNWWIQGCSFRTEFRVLLSRALIPRVAGPWLRSS

SEQ ID NO: 20051 - protein, 308 aa, Yersinia pestis CO92
METGKLVVLGSINADHILNIEQFPRPGETVIGQQYNVAFGGKGANQAVAAGRSGADIAFIACVGDDDIGERVRQQLTADKIDTQPIEAIKGATTGVALIFVNSDGENVIGINAGANSAVTPEYLRRYQQQVIDADALLMQLESPLDTVIAAAKLAKQHQTQVILNPAPARKLPDELLTLVDMITPNETEAERLTGIHIEQDDDAAKAAQILHDKGIATVIITLGSRGVWLSEQGKGKLVAGFKVNAVDTIAAGDTFNGALLTALLEGQSMDVAVRFAHAAAAIAVTRPGAQPSIPWRAEIDSFLQERV

SEQ ID NO: 20052 - protein, 510 aa, Bordetella bronchiseptica RB50
MAFETLIEELAQREARARAMGGEEKLARRRAEGVLNARERIDRLVDADSFLESGLLAVSVRSEVRDRTPADGKIAGYAQVDGRDIALVANDFTVMGASSSSVNTSKIGHMVKNATRRGLPMVFLGESTGARMPDTMGARGIGSGDRPTQYRRTRETPWASAVLGHCYGSSSWYAVLADFAVMRKGAIMAVSSVKLTSMAITEAVDPEELGGWEMLTSGSGLVDMAVDSDEEALDAVRRFLSYLPSHHMEAPPVRPVPAGSGEQGHRILDILPESRTKVYDVRKILSLIVDNDSLFELKARYGRSVVTALARIDGHTVGIIASNPQAKGGAIDVDACNKATSFMVLCDSYNIPLVFMADQPGFLIGVEGERRGAVGRVMNWMNALSLVSVPKISIIMRKTYGQAVLNMGGAGNADEVIAWATAEVNFMDPRSGVTIVHGLTAQSDPDAYAARLAEMERDTSAWEMGGAYSAHHVINPADTRDTLIRLLRVHRLRLTNGVGEHLMRTWPTSY

SEQ ID NO: 20053 - protein, 153 aa, Streptococcus oralis
EQFIRGQYRSGKIDGMKYISYRSEPNVDPESTTETFASGAFFVDSDRFRGVPFFFRTGKRLTEKGTHVNIVFKQMDSIFGEPLVPNILTIYIQPTEGFSLSLNGKQVGEEFNLAPSSLDYRTDATATGASPDPYEKLIYDVLNNNSTNFSHWD

SEQ ID NO: 20054 - protein, 516 aa, Mesembryanthemum crystallinum
MGSGEWHVEKRSSLKSELSKDIGESESSQECGSLSIIVLGASGDLAKKKTFPALFNLYRQGFLPPSEVHIFGYARSKMTDDDLRDRIRGHLIPRNVTAEISEDVLNFLHLIKYVSGSYDTEDGFHLLDDEISKYECQKNSQEHSKRLFYLALPPSVYPSVCRMIKLCCMNKSDLGWTRIVVEKPFGRDLESAEQLSAQIGELFDESQIYRIDHYLGKELVQNLLVMRFANRLFLPLWNRDNIANVQIVFREDFGTQGRGGYFDQYGIIRDIIQNHLLQVLCLVAMEKPVSIKPEHIRDEKVKVLQAVNLIKDEEVVLGQYEGYKDDPTVPEDSNTPTFATMVLRIHNERWEGVPFILKAGKALNSRKAEIRVQFKDVPGDIFKCNKQGRNEFVIRLQPSEALYMKLTVKQPGLEMSTIQSELDLSYGQRYQGVVIPEAYERLILDTIKGDQQHFVRRDELKAAWEIFTPLLHRIDKGEFKPISYKPGTRGPAEADELLAKAGYVQTHGYIWIPPTL

SEQ ID NO: 20055 - protein, 916 aa, Arabidopsis thaliana
MSMFLGLLFLFPLFFILFKNLLPPRKKLPPGPTGLPLIGNLHQLGRLLHSSLHKLSLEHGPVMLVRWGVVPMAVFSSNEAAKEVLKTHDLETCNRPKLVANGLFTHGYKDIGFTQYGEEWREMKKFVGLELFSPKKHKSFRYIREEEGDLLVKKISNYAQTQTLVDLRKSLFSYTASIIFREAFGQNFRECDYINMDKLEELVQETETNVCSLAFTDFFPRGLGWLVDRISGQHSRMNIAFSKLTTFFEDVIDELLKTKQLDDHSDLVTAMLDVINRPRKFGSLKITYDHLIAMMSDVVLAGVNAGTVTMIWTMTELTRHPRVMKKLQEEIRATLGPNKERITEEDLEKVEYLNLVIKESFRLHPPAPLLLPRETMSDIEIQGYHIPKNAHVKINTYAIGRDPKRWTNPEEFNPERFLNTSINYKGQHYELLPFGAGRRNCPGMTLGITILELGLLNILYYFDWSLPSGMTIKDIDMEEDGALNIAKKVPLQLENGSVLYSHYYDCDLGTMIRLMKSPMMLLRFGVVPVVVFSSKEAAKEVLKTHDLDTCTRPKLVANGLFSRNFKDIGFTQYGEDWREMKKLVGLELFSPKKHKSFRYIREEEGDLLVKKISNSAQTQTLIDLRKASFSFTAGTIFRLAFGQNFHQCDFMDMDRLEELVLEAETNGCILALTDFLPTGLGWLVDRISGRHSRMNKAFSKLTNLFQHVIHEQLKIGQLQDHSNLVSAMLDMIIRPSKFSSFNITSNHLIAMMSDVVLAGVNAGTITMYLNMVIKETFRLHPPSPLLLPRETMSDIEIQGYHIPKNALIRINTYTIGRDLKCWSNPERFLNTSINYKGQDYKLLPFGAGRRSCPGMNLGITILELGLLNILYFFDWSFPNGMTIEDIDMEENGALNKTLELIPTLPSALSDGSSGWR

SEQ ID NO: 20056 - protein, 352 aa, Physcomitrella patens subsp. patens
MEADEIRLVLERASELHAKISEAIERALKSEFMRTTCSRMFDSSLSSVSDAGEKDGYGRFGGDCGKASTGGDQNVEARALGLIRDALETLEDQLEALQSTQSHQRVEKDAILAELEENRHLLLHRLKNHKGREWEVVHEALAFAGEPMEEKDDLLLPPYSKPVLDAAIEVDDQSSKHLSQLISLPQDRADKMLTLSRGNEVDKKDDGCKGVPLDRNGKQDSQEPVLSSDHKVVAVRGIDFAGGFMKGLRGRVGHALAHAAKAVLVVASVVAFLAFTEHDHRQVEQKPLLVPPTVKPVLLPENHPRPLSSPKCSCGKKLAVLEEGNAECAVMERFELPFPREVRDPNVLYGRG

SEQ ID NO: 20057 - protein, 506 aa, Azoarcus sp. BH72
MIYEMPGKAGAKVQFKSRYDNFIGGKWVAPVRGQYMDNITPITGKPFCQVARSTEEDINLALDAAHAAADKWGRTSVIERANTLCRIADRLEQNLELIAYAETVDNGKPIRETMAADIPLAIDHFRYFAGCIRAQEGSLAELDENTVAYHFHEPLGVVGQIIPWNFPILMAAWKLAPALAAGNVVVLKPAESTPVGILVIAELIADLLPAGVLNIVNGLGREAGVPLATSSRIAKIAFTGSTTTGRLIMQAASQNIIPVTLELGGKSPNIFFQDVAAADDEFFDKAVEGFVLFALNQGEVCTCPSRALIHESIYDRFMDRALARVKAIKQGNPLDTETMIGAQASTEQMKKILSYIELGKEEGAQLLAGGGEAKFGGELAEGYYVQPTVFKGHNKMRIFQEEIFGPVLSVTTFKDEAEALSIANDTLYGLGAGVWSRDGSTAYRMGRNIKAGRVWTNCYHLYPAHAAFGGYKQSGIGRETHKMMLDHYQQTKNLLVSYSPKALGFF

SEQ ID NO: 20058 - protein, 478 aa, Leifsonia xyli subsp. xyli str. CTCB07
MAYEFERKQRIAVLGGGPGGYEAAIAGAQLGADVTLIERSGVGGSAVITDVVPSKSLIATAEATNSIAEAADLGVQFFSRDASGKPVRPEIAVNLAAVNKRLMGLARQQSEDMRAELVRSGVRIVSGEGRLDGPGAVIVSTVRGDSGTDFDSVDADTIVVAVGARPRILSSAEPDGERILTWTQLYDLGAIPEHLVVVGSGVTGAEFASAYTALGSKVTLISSRDQVLPGEDADAASVIENVFKRNGMQVLSTSRAESVVRAGDGVVATLSDGRTVEGSHCLMAVGSIPNTAGIGMQEAGVQLTPSGHIRVNRVARTSIPNIYAAGDCSDLLPLASVASMQGRTAVFHAMGDAVNPIELRNVTSNIFTQPEIATVGWNQKQIEEGIAQGDIYKLPLKSNPRAKMLGIRDGFVKLFARTGSGTVIGGVIVAPRASELIFPLALAVEHRLTVDQVARAFTVYPSLSGSISDAARAMHIVL

SEQ ID NO: 20059 - protein, 175 aa, Rickettsia prowazekii str. Madrid E
MSKVKKNEEALSEVLVDVNRVTKVVKGGRRFAFSAYVVVGDKAGRVGAGHGKAKEVNEARGKAKQAAKKRMMKVPLYQNRTIHHDVVGKSGAAKVILRRAKAGTGVIAGGSMRAIFDSLGVHDIVAKSIGSTNVYAMISATFDALNKLASPKSIAIRRDKKVHEISIKSYIQVNE

SEQ ID NO: 20060 - protein, 692 aa, Mycobacterium smegmatis str. MC2 155
MPEGEAATAIYIASPEGDTGKSTIALGILHRLAATVPKVGVFRPITRLGEDRDYILELLLAGTTAGLPYEDCVGVSYQQVHEDPDAAIAEIVDRYHRVADQCDAVLIVGSDYTDIATPSELSMNARIAVNLGAPVVLAVKAADRTPDEVVHVVEVCLAELAGQHAHTSAVVANRCDPAQLTAVSEALRPLGPPAYVLPEEPLLVAPSVAELQKAVDGTVVAGDPALLSREALGVLVAGMTAEHVLERLTEGVAVVTPGDRSDVVLAVVSAHAAEGFPSLSTIILNGGLDLHPAIAKLVDGLGLKLPIIATPYGTFETASRVASARGRVTSTSQRKIDTALQIMERHVDIDDLLARLRLPIPEVTTPQMFTYQLLDRARADRKRIVLPEGDDDRILKAAGRLLRRGVADLTILGEENQIRSRGAELGVDLSAATVLDPRTSDLCEAFAQQYAELRKHKGITLDQAREIIVDVSYFGTMLVHNDMVDGMVSGAAHTTAHTVRPAFEIIKTLPDVSTVSSIFLMCLEDRVLAYGDCAIVPDPTAEQLADIAISSARTAAQFGIEPRVAMLSYSTGTSGTGADVEKVKAATDLVRERDKTLLVEGPIQYDAAVEPSVAKTKMPDSEVAGRATVLIFPDLNTGNNTYKAVQRSAGAIAIGPVLQGLNKPVNDLSRGALVEDIVNTVAITAIQAQGRS

SEQ ID NO: 20061 - protein, 238 aa, Desulfococcus oleovorans Hxd3
MSIADLTLDGTVAVITMDNGENRQNLAFAQAMGKAIDGALANESVTAMIITSTGEKIFSAGVDLEWMMDRFANNALDDMRAFMYGMNDVFKKCLLAPVPVIAAINGHAFGNGAILSCACDFRFMKSDRGFFCFPEVDVRIPFLPGMVAFVKKAIPYYKFNEMKLTGKRVAAPELEEHHIIEKACVDKDDLMAQALAFARTFNKQRGIFGEHKRRLHKHIVDIIDNEDPEYIEPLNLMM

SEQ ID NO: 20062 - protein, 415 aa, Kluyveromyces lactis NRRL Y-1140
MINITDKSRNGTFVNGDRLIRKDYVLKNGDKIVFGKSCSYLFKYATLTENGLSQTTATQISQTTQNSDYDGVFRKPLFSSQNTTKKLSRTREQPRSFFDKYLAGKELGTGHYAIVKEARNKETGETVAVKIFHPQQNDDDKRTKKFTEETKILLSIQHPNIVKLIDRFVEPVSKTQIQTYLVLEKINDGELFERIVRKNNLREDETKALFRQLLNGLKYLHSRNIIHRDIKPENILLSISKRRSPEEIALGPWDDDELDIQVKIADFGLAKFTGEMKFTNTLCGTPSYVAPEVLVKTGYTSRVDMWSAGVLLYVCLCGFPPFSEQLAPPSMKEQILQGKFAFYSPYWDNIDDSVLHLISNLLVVNPASRFSVNDALTHPWFTSNNAEVTMGNERRSQLEPGRLPKTFSELSNLQK

SEQ ID NO: 20063 - protein, 216 aa, Brassica napus
MSEETYEETMETSQSPRPAPKLNERILSTLSRRSVAAHPWHDLEIGPEAPLVFNVVVEITKGSKVKYELDKKTGLIKVDRILYSSVVYPHNYGFIPRTLCEDNDPLDVLVLMQEPVLPGCFLRARAIGLMPMIDQGEMDDKIIAVCADDPEYKHFTDIKQLAPHRLSEIRRFFEDYKKNEHKEVAVNDFLPSEKAHEAIQYSMDLYAEYILHTLRR

SEQ ID NO: 20064 - protein, 295 aa, Pseudomonas aeruginosa UCBPP-PA14
MKSFENKVAAITGAGSGIGRALAVELGRQGCHLALADVNAAALEETRQLLASSGVRVSTAVVDVADREQVQAWADKAASEHGRVNLIFNNAGVAHAGTVEGSDYSEYEWIMNINFWGVVNGTKAFLPHLKASGNGHVVNVSSVFGLFAQPGMSAYNATKYAVRGFTESLRQELDMEDSGVSASCVHPGGIKTNIAKTARMNESMAKVTGQAADKARQQFNDQLLRTTPEKAAQVILRGVQRDSRRILIGADAHAIDVMLRLAPVLYQRVVTASMRLAARFAPRPKSPQGAREASE

SEQ ID NO: 20065 - protein, 279 aa, Vitis vinifera
MSKEVSEEGQSHGKDYVDPPPAPLIDIAEIKLWSFYRAVIAEFIATLLFLYITVATVIGYKKQSDPCGGVGLLGIAWAFGGMIFILVYCTAGISGGHINPAVTFGLFLARKVSLIRALAYMVAQCLGAICGVGLVKAFMKSFYNSLGGGANSVAAGYNKGTALGAEIIGTFVLVYTVFSATDPKRSARDSHVPVLAPLPIGFAVFMVHLATIPITGTGINPARSFGAAVIYNNEKVWDDQWIFWVGPFVGALAAAAYHQYILRAAAIKALGSFRSNPTN

SEQ ID NO: 20066 - protein, 858 aa, Coprinopsis cinerea okayama7#130
MSAEILKSEAPKDTSGVPHPTDDASPFSIPDIVLNGTEMTKISKKGKKRVVFRIDPDEGRLLYKSKKGGLVPIEAIKEMRSGEDARYYCNQFEQPEEAESRWITVIYILGGAYKTLHILADTRDAFHAWDTTLRKLHSVRQGLTTGLGNMETREEVWERQYWKGADEEGDQVLDFDDVDRLCKRLHANIPTPRLQQLFKEADTENKGHLDYPAFQRFVKKLKRRPDVEQIYGQIAGQSGGKFDFAAFEKFIKEVQKSPLSTDELRAVFDKYATSADSTSPNEPSGALTLDAFTKFLTSPDNAAFAEEGKPIWQDMTKPISEYFISSSHNTYLVGNQLTGVSTIEGYIRALLHSCRSVELDIYDGDDEPVIFHGKTLTSKVPLRDVCVAIMKYGFTTSPYPLLVSAEVHCGLAQQEKMVDVMTEVWGDALIQAPVNGRPQLTHLPSPEDLKHKILLKAKNLYVVEQLAKAKAKRAEEKAAVLEADPSSESTNESTDDDAGESKPGALGALKSRWRKMRGKDPKPAKPKVKMSFRLASLLVYTIGVKCHGLNDEVQYAPEHIFSLSEYSANKLLKVGMWDLIRHTQGHLVRIYPKGTRVNSTNFEPHRYWASGAQVVAINWQTFDLGYVMNQAMFQRNGRSGYILKPEALRSLDKDLFSKRTKHFLDITSHELIELIIAFMTYLLTNHLPPLNQIISAQQLPPLRDSKGNEVFGKSIPDPFVEVSLLIPDWTNSPFLPESAKAEGAEYHSPSEGNTTTATSARTVKMKTQVVTDNGFNPTWNEQLHLPFDCVGGMMDLIFVNVAVRQEGKEDEDDEPLAMYCIPLGSLNQGYRHLPLHDAQMNQHLFSTLFVNVAIRDAD

SEQ ID NO: 20067 - protein, 308 aa, Hyphomonas neptunium ATCC 15444
MTIRHFLDIWPLESAELRAILDQAHAMKKARAGWPKGKIDAGAPLDGHTLAMIFEKSSTRTRFSFDMAMRQLGGSSITATSNDMQLGRGETVEDTAKVLSRFVDAVMIRANDHADVEAFADAASVPVINGLTDRSHPCQIMADLMTLEEHGLTLRGARLAWVGDGNNVCASFIHAAPKFGFSLAVGTPKRFAPDEDDLEIAAELQGRIDLYETAEEAVAGADVVIADTFVSMGDVDAERRLEILDPYAVTEELMELAAGGAKFLHCLPAHRGEEVDAEVIDGPASLVFDEAENRLHAQKAILRWCLGK

SEQ ID NO: 20068 - protein, 254 aa, Glycine max
MAGKGGSTPATYSPSPTTDKKKPSLFNEDLARPDGRSFHQCRPAFFRTGAVNAASGSAYAEVGNTKVIVSVFGPRESKKAMMYSDIGRLNCNVSFTTFATPIRGQGSDHKEYCAMLHKALEGAIILETFPKTTVDVFALVLESSGSDLPVVISCASLALADAGIMMYDIVASVSVSCFNKNLVIDPILEEEIGQDGSLMITCMPSRYEITQLTVTGEWSTTKINEGMQLCLDACAKLAKIMRSCLKEVASDSQE

SEQ ID NO: 20069 - protein, 153 aa, Streptococcus oralis
EHFIRGQYRSGKVDGMKYISYRSEPNVNPESMTETFASGAFFVNSDRFRDVPFFFRTGKRLTEKGTHVNIVFKQMDSIFGDPLAPNVLTIYIQPTEGFSLSLNGKEVGEEFKLAHNSLDYRTDATATGASPDPYEKLIYDVLNNDSTNFSHWE

SEQ ID NO: 20070 - protein, 450 aa, Geobacter sulfurreducens PCA
MTFAELKLAPHILKAVAACGYTEPTPVQAAAVPRALENVDLLATAQTGTGKTAAFVLPALQRLSSPPQGPGRGPRVLVLTPTRELAQQVTDAVRTYGAFMRVRSGAILGGMPYHAQLRLLSAPVDFIVATPGRLVDLLDRRSLDLSRLELLVLDEADRMLDMGFSDDVDRIAAASPATRQTLLFTATMDSAMARLAGRLLREPERIDIAGTKTTHEHIEQRLHVADDLHHKNRLLRHLITDESLRRAIIFSATKRDAENLALELKAQGHSAAALHGDMPQNARNRTIAAMKQGRIRLLVATDVAARGLDVTGISHVINFDLPKFAEDYVHRIGRTGRAGASGIAISFASLNEVNYLARIERYIGQTLPEHHIPGLEPSRPLRRVSAGSGRKPGMGAGPARKGSSNRPSGAAPGRSGKSSDRTSWGSRRSKDPVVEYRTGRHGAGQPRRSS

SEQ ID NO: 20071 - protein, 233 aa, Zea mays
MAGEGDIKLLGMVVSPFVVRVRMALHMKGVSYEYIEQDLFNKSELLLRSNPVNKKVPVLIHGGKPIYESLVIMQYADEVWSGKGASILPADPHERAVARFWAAYVDDKMFPAYIGIMKAATEEARAEKAKEALVVLANLEEAFAQCSKGKPFFAGDSVGYLDLAVGCNLFWLEAIRKMFGVTFFDVGKTPLLAAWAERFAGTEMAREVVPDADTAVVFAKKLQARFGSQTSAK

SEQ ID NO: 20072 - protein, 216 aa, Yersinia pestis CO92
MTIRNYNYHMTHFVISAPDIRHLPRDEGIEVAFAGRSNAGKSSALNTLTNQKGLARTSKTPGRTQLINLFEVVDGVRLVDLPGYGYAEVPEEMKLKWQRALGEYLQKRNCLKGLVVLMDIRHPLKDLDQQMITWAVAVGTPVLLLLTKADKLASGARKAQLNLVREAIIPFMGDIQVEAFSSLKKIGVDKLREKLDTWFSEIPPEVMAEEFDGEGE

SEQ ID NO: 20073 - protein, 153 aa, Streptococcus oralis
EHFIRGQYRSGKIDGMKYISYRSEPNVDPESTTETFASGAFFVDSDRFRGVPFFFRTGKRLTEKGTHVNIVFKQMDSIFGEPLAPNILTIYIQPTEGFSLSLNGKQVGEEFNLAPSSLDYRTDATATGASPDPYEKLIYDVLNNNSTNFSHWD

SEQ ID NO: 20074 - protein, 297 aa, Triticum aestivum
  misc_feature (236)..(236): Xaa can be any naturally occurring amino acid
MLLSWCSRSLTTTRQARIRSALRDTDDEDEEDDDDDSDRELEDMIRRRRRRGSSLVRLLQTLRDDLRGLDGIGRDRVRDRDSERDRERERERRDRERRERERARRERERARERDRGGERTESLILINSNNEAIILQGTFGPSDNQENSSNTSTGVSLGDYFLGPGLDMLLQRLADSDLNRSGTPPAKKESVAALPTVNIQEVLGCTVCLEEFEMGTEAKEMPCQHKFHSNCILPWXLELHSSCPICRFQLPTEESKNPCESGSGGGTVSADGDHAESSNSDIEGANHDGGSLLDGSQ

SEQ ID NO: 20075 - protein, 132 aa, Glycine max
NFQNGALIGGKKLNSSIPLSEQEDLIVWMRTAALPTFRKLYGRIYVDLKANDTITVRLSNNYNTYSFGGKKKLVLSTATWLGGKNDFLGFAYLIVGGLCIFLAFAFTLLYLIKPRKLGDHNYLSWNRHPAGR

SEQ ID NO: 20076 - protein, 540 aa, Leifsonia xyli subsp. xyli str. CTCB07
MTDTEARQPTGIAPAPDLATTAGKLADLKERFHEAVTASGQAAIEKQHAKGKLTARERIDLLLDQGSFVEFDEFVRHRTQAFGMDGKRPYGDAVVTGVGTIHGRSVAVFSQDFTIFGGSLGEVAGEKIIKVMDHALKMGVPMIGILDSGGARIQEGVVALGKYGEIFRRNTAASGVIPQISIVMGPAAGGAVYSPALTDFVIMVDKSSHMFVTGPDVIKTVTGEDVGFEELGGALTHNRVSGVSHYLASDEEDALDYARALLSYLPQNNLAELPVFEAEPELETTDADRKLNTIIPDSPNQPYDVTTIIAGIVDDGEFLEVQPLFAPNIVIGFARVEGSSVGIVANQPSAMAGTLNIDAGEKASRFVRFCDAFSIPILTFVDVPGYLPGTDQEWTGVIRRGAKLLYAYAEATVPLVTIITRKAYGGAYIVMGSKQLGADINLAWPTAEIAVMGGQGAVNILYRGELKRAEDAGEDVAAVRAKLATEYTYNVASPFLAAERGELDGVIEPAATRVSVVKALRALRTKRASLPPKKHGNIPL

SEQ ID NO: 20077 - protein, 469 aa, Yersinia pestis CO92
MSAEHVLTMLNEHEVKFVDLRFTDTKGKEQHITIPAHQVNADFFEEGKMFDGSSIGGWKGINESDMVLMPDASTAVMDPFFADSTLIIRCDILEPGTMQGYDRDPRSISKRAEDFLKSSGIADTVLFGPEPEFFLFDDIRFGSSINGSHVSIDDVEGAWNSSTKYEGGNKGHRPAVKGGYFPVPPVDSAQDLRSAMCLTMEEMGLVVEAHHHEVATAGQNEVATRFNTMTKKADEIQIYKYVVHNVAHAFGKTATFMPKPMFGDNGSGMHCHMSLSKNGNNLFAGDKYGGLSEIALFYIGGIIKHAKAINALANPTTNSYKRLVPGYEAPVMLAYSARNRSASIRIPVVASPKARRIEARFPDPAANPYLCFAALLMAGLDGIINKIHPGDAMDKNLYDLPPEEEAEIPKVAGSLDEAMAALNEDREFLTRGGVFTDDAIDAYIELRREEMDRVRMTPHPVEFELYYSV

SEQ ID NO: 20078 - protein, 158 aa, Lactobacillus delbrueckii subsp. bulgaricus
GTFCQTYMEPEAVELMKDTLAKNAIDKSEYPRTAEIENRCVNIIANLWHAPDDEHFTGTSTIGSSEACMLGGLAMKFAWRKRAQAAGLDLNAHRPNLVISAGYQVCWEKFCVYWDVDMHVVPMDEQHMALDVNHVLDYVDEYTIGIVGIMGITYTGSI

SEQ ID NO: 20079 - protein, 398 aa, Streptococcus agalactiae NEM316
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGAKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAKFDEALTGAKTVVWNGPMGVFENPDFQAGTIGVMDAIVKQLGVKSIIGGGDSAAAAINLGRADKFSWISTGGGASMELLEGKVLPGLAALTEK

SEQ ID NO: 20080 - protein, 208 aa, Dehalococcoides sp. BAV1
MKSTKALILATLFPVTLFAGSCGGDAVPEVTPMSWTTAPAMQIDPAKQYYATIETTLGSFKIELFASESPKTVNNFVFLAKQNYYNGVIFHRIIKEFMIQTGDQTGTGRGGPGYRFADELPVKHSYDPGIVAMANAGPNTNGSQFFVCTGAQAKNLNYQPNYTQFGRVIEGMDVITKLASVSVVGNSYGEVSTPSNPPKIIKIIITEG

SEQ ID NO: 20081 - protein, 539 aa, Glycine max
GQRFEPVKEGYNSSVESYNQYDANVTVTGGTEKGTPVVEKSEEHKSGGKVEKVGDKGLASAEDKKDAITKHQTDGSLKSTRSTEGSLSNLESEAVVNDECISNSKGDDSHSVQNQHQSQSLSTKAKTFIGNEMFDGKMVNVVDGLKLYEDLFDSTEIANLVSLVNDLRVSGKKGQLQGSQAYIVSRRPMKGHGREMIQLGVPIADAPAEGENMTGASKDMNVEPIPSLFQDIIERMVSSQVMTVKPDCCIVDFYNEGDHSQPHSWPSWYGRPVYILFLTECEMTFGRVIASEHPGDYRGGIKLSLVPGSLLVMEGKSSDFAKHALPSVRKQRILVTFTKSQPRKSLSSDAQRLASTATSSHWGPLPSRSPNHVRHHVGSKHYATLPTTGVLPSPPIRPQMAAPVGMQPLFVTAPVVPPMPFPAPVAFPPGSTGWTGAPPPRHPPPRVPAPGTGVFLPPPGSGNSSQQLPAGTLAEVNPSTETPTMLEKENGKTNHNSTSASPKGKVQKQECNGHAADGTQVEPALETRQDSNDKAAPCH

SEQ ID NO: 20082 - protein, 295 aa, Vitis vinifera
MAGERRVHPDCINASNPYHECVEYCFRKIAEAKAQMDKKESGVPDQDKNTHDEGTDPEERSDDDNDQPVEEIEEVDFTQLTGRQKKLFELRLKMNEARKANQTAMVAEKKKMEAPPESRGISKQKWIEERKKKIGKLLDVNGLDMKKAYMLDTQEMAETKYKKWEKDPAPFGWDVFNQKTLYNAYKKRTKNIEVDIDEYNKMKEADPEFYREASSLQYGKAPKCSEDKIDKMVKELKDRDEKRQSFSRRRKFHEEKDIDSINDRNEHFNKKIERAFGKYTLEIKNNLERGTALPD

SEQ ID NO: 20083 - protein, 124 aa, Dehalococcoides sp. BAV1
MKYNELSPQEEAVIVRKGTEPAFSGEYVNLFKDGTYVCRRCDAPLYRAKDKFHSGCGWPSFDEELSGAVKRQPDPDGRRTEILCAACGGHLGHVFEGESFTPKDTRHCVNSLSIKLVPDNGVNK

SEQ ID NO: 20084 - protein, 287 aa, Pichia angusta
MEVCITTQSIDNGVGAASMFACLFTHPLDLAKVRLQTAKVPGDSLVSLAYKIVKTEGVLAAYAGLSASLLRQATYSTARFGVYEKLKGIMTDPTKGQASTFQLLAASMIAGAVGGVVGNPADVVNIRMQNDNSLPESQRRHYKHALDGLLKITREENITALFRGLGPNLARGILMTASQVVSYDVAKKLLVENLSMDPKTKATHFSASLIAGLVATTVCSPADVLKTRIMNSSGTGQSSFGILKDAISREGLGFMFRGWTPAFIRLGPHTILTFIALEELRRLKIGL

SEQ ID NO: 20085 - protein, 375 aa, Burkholderia sp. 383
MPGLLPDVDREGLLEYSVVYTDRSVNHMSQRFQGVMRDISGTLKKVYNAKSVVIVPGSGTFGMEAVARQFATNKKCLVIRNGWFSFRWSQIFDMGSIPSETTVLKARPVEAGRQAAYAPAPIDEVVAAIKEHKPDLVFAPHVETASGMMLPDGYLRAVSDAVHAVGGMFVLDCIASGTVWVDMQASGVDILISAPQKGWSASPCCAMVMLSELARERIDGTTSTSFACDLRKWLQIMEAYEGGGFAYHATMPTDSLTTLRDVMKETEAYGFDKVKAEQLELGKRIRVLLAEKGFRSVAAEGFEAPGVVVSYTDDDGIRTGKKFADVGLQIAAGVPLQCDEGDDFKTFRLGLFGLDKLHDVDGAVARFADALERVL

SEQ ID NO: 20086 - protein, 743 aa, Bordetella bronchiseptica RB50
MYRDPGGSHHSWLRRPFCIPAGAFARRSVNQRAVPGARNWLYNPPMTYLVLARKWRPRSFDTLIGQDHVVRALTHALDTQRLHHAWLFTGTRGVGKTTLSRILAKSLNCENGITSKPCGQCRACTEIDAGRFVDYLELDAASNRGVEEMTQLLEQAVYAPGAGRFKVYMIDEVHMLTGHAFNAMLKTLEEPPPHVKFILATTDPQKIPVTVLSRCLQFNLKQMPPDAIVGHLQAVLGEEQIGFEVPALRLIGQAAGGSMRDALSLTDQAIAYSAGNLSEEAVRGMLGTIDQRHLVRLLDALASGDAAGVLAVADELAVRGLSYAGALADLAVLLSRVAIEQRVRGALPQDDPLTEDITRLAAALHPDAVQLFYSVAVHSRGELTLSPDEYAGFVMACLRMLALNGEAGPATAVQAPRADTTPRAAAPAAAAPAETRPEPTPALAPQAAAAPRAVARSESKPQPAPEPEPEPEPEPEPASRPAATPVAATPPAVAEPEPVAAPAVQARAAEPAPVPPWEDLPEAVAAPAPAQPAAAPAPVVADDDGPPAWVDEAIPDEAGGGFAPEHSFTADPDDEFETLAPAPAPAAMPAPRAPTPRRESGGRGRAARSRLADMSPAGWPELAARLPVTGLAAELARQSEWAGVQGDAVLLRVAVRTLAESESRVRLQTVLCEHFGQGLRLEIEVGVTGDGTAHAVAQIERAARQQAAEDAVAVDPFVQALVADFGGRVVPGSIRHVDNPPAA

SEQ ID NO: 20087 - protein, 433 aa, Chlamydophila pneumoniae AR39
MNHLNKEKLHIHNWQPYRACGLLSKVSGNLIEVDGLSACLGELCKISSTKDPNLLAEVIGFHNHTTLLMSLSPLHSVALGTEVLPLRRPPSLHLSDHLLGRVLDAFGNPIDKKEDLPKTHRKPLLSLPPSPMMRQPIDQIFPTGIKAIDAFLTLGKGQRIGVFSEPGSGKSSLLSAIALGSKSTINVIALIGERGREVREHIEKHSNALKQQRTIIIAAPAHETAPTKVIAGRAAMTIAEYFREQGHEVLFIMDSLSRWIAALQEVALARGETLSAHQYAASVFHHVSEFTERAGNNDKGSITALYAILYYPKHPDIFTDYLKSLLDGHFFLTSQGKALASPPIDILSSLSRSAQALALPHHYAAAERLRSLLKVYNEALDIIHLGAYTPGQDEELDKAVKLLPSIKAFLAQPLSSYCYLDNTLKQLEALADS

SEQ ID NO: 20088 - protein, 350 aa, Zea mays
  misc_feature (21)..(21): Xaa can be any naturally occurring amino acid
MSSSFDSITAVVGDNDELPPXAPFDTAVDGTAAEYGGEQQGFGMRRGHRFAASYSSFGTAVSEDDLGGAGGEGGGGYGGFGIPPYSNGGPAYGYADNDANGVEHVMGAQDVMDGAAHAAGDISGGRLDEDLFSGAADDDDGAVLPPPEAMREEGILRREWRRQNALMLEEKERKERERRNEIIAEAEEFKRSFLDKRRLNCETNRTQNRDREKLSQANQERFHKEAYQQYYWKAIAELVPREIPGLEKRGKRKEQERKPGIVVVQGPKPGKATDLSRMRQVLLKLKDKPPSHMVPPPPQAKEEKEKDGDKDAKKDGNKQEEKKDGKQQAAGPAEKKTDGPEMASAAGSPP

SEQ ID NO: 20089 - protein, 288 aa, Zymomonas mobilis subsp. mobilis ZM4
MKPVRKAIFPVAGQGTRFLPATKAMPKEMLPVVDRPLIQYAVDEARAAGIEELIFVTGRGKQAIEDYFDIAYELEASLTAKGKTGMLDLLEGTRVAPGRACFIRQQEPLGLGHAVWCARDLIGDEPFAVLLPDELLWNPKRPSLVQLVETYNQKGGNVVTVMEVPEEHTHRYGIVDPGKTDGEVTEVKGLVEKPEKAPSRLAMTGRYILQPDIMPLLAQDNRGVGGEIQLTDSMAQLIGKQPFHACRFGGIRHDCGDKAGFIQANVALALERPDIGPAVRDYLHRQNF

SEQ ID NO: 20090 - protein, 511 aa, Populus trichocarpa x Populus deltoides
MAMASIARRKACFLTRNLSNSSSADAFKFSYSLTKFSRGFATSGSEENDVVVIGGGPGGYVAAIKAAQLGLKTTCIEKRGTLGGTCLNVGCIPSKALLHSSHMFHEAQHSFASHGVKFSSVEVDLPAMMAQKDKAVSTLTRGIEGLLKKNKVNYVKGYGKFISPSEVSVDTIDGANTVVKGKNIIIATGSDVKSLPGITIDEEKIVSSTGALALKKIPKKLVVIGAGYIGLEMGSVWRRLGSEVTVVEFAPDIVPSMDGEVRKQFQRMLEKQKMKFMLKTKVVGVDTSGDGVKLTLEPASGGDQTTLEADVVLVSAGRTPFTAGLGLDKIGVETDKVGRIPVDERFATNVSGVYAIGDVIPGPMLAHKAEEDGVACVEFIAGKHGHVDYDKVPGVVYTHPEVASVGKTEEQVKALGVEYCVGKFPLLANSRAKAIDDAEGLVKIIAEKETDKILGVHIMAPNAGELIHEAALALTYDASSEDIARVCHAHPTMSEALKEAAMATHDKAIHI

SEQ ID NO: 20091 - protein, 275 aa, Bacillus cereus ATCC 10987
MHIPTTTLHNGVKMPMIGLGVYKAKEGDEVKQAVKTALEVGYRSIDTATVYENESGVGEAVRESGIPREEIFITTKVWNDDQGYEETLEAFEKSLKKLQMDYVDLYLIHWPIRGKYVDTYRALEKLYEEGKVRAIGVSNFHKHHLELLLPNCKVKPMVNQVELHPMLTQFELRNFCQGEQIQMEAWSPLMRGGEVFQHPIIQAIATKYEKTPAQVILRWDIQSGVVTIPKSVTPSRIQENFSIFDFSLTEEEMTQINTLNRNLHVGTNPDKYDTL

SEQ ID NO: 20092 - protein, 863 aa, Saccharomyces cerevisiae
MPSASLLVSTKRLNASKFQKFVSSLNKSTIAGFASVPLRAPPSVAFTRKKVGYSKRYVSSTNGFSATRSTVIQLLNNISTKREVEQYLKYFTSVSQQQFAVIKVGGAIISDNLHELASCLAFLYHVGLYPIVLHGTGPQVNGRLEAQGIEPDYIDGIRITDEHTMAVVRKCFLEQNLKLVTALEQLGVRARPITSGVFTADYLDKDKYKLVGNIKSVTKEPIEASIKAGALPILTSLAETASGQMLNVNADVAAGELARVFEPLKIVYLNEKGGIINGSTGEKISMINLDEEYDDLMKQSWVKYGTKLKIREIKELLDYLPRSSSVAIINVQDLQKELFTDSGAGTMIRRGYKLVKRSSIGEFPSADALRKALQRDAGISSGKESVASYLRYLENSDFVSYADEPLEAVAIVKKDTNVPTLDKFVCSDAAWLNNVTDNVFNVLRRDFPALQWVVSENDANIAWHFDKSQGSYLKGGKVLFWYGIDDINTISELVENFVKSCDTASTLNSSASSGVFANKKSARSYSTRSTPRPEGVNTNPGRVALIGARGYTGKNLVSLINGHPYLEVAHVSSRELKGQKLQDYTKSEIIYESLQIQDIRKLEEQNAVDFWVMALPNKVCEPFVETIQSVHGKSKIIDLSADHRFVSESDWAYGLPELNDRAKIANAAKIANPGCYATGSQLTISPLTKYINGLPTVFGVSGYSGAGTKPSPKNDPKFLNNNLIPYALSDHIHEREISARIGHNVAFMPHVGQWFQGISLTVSIPIKKGSLSIDEIRKLYRNFYEDEKLVHVIDDIPLVKDIEGTHGVVIGGFKLNDAEDRVVVCATIDNLLKGAATQCLQNINLAMGYGEYAGIPENKIIGV

SEQ ID NO: 20093 - protein, 186 aa, Corynebacterium glutamicum ATCC 13032
MTPQPLILPFGDKVPRIHESAWIAPNATIIGDVEIGPDASIFYGVVLRGDVNKITIGARTNVQDNCVLHVDGDAPCTLGDDVTVGHMALVHGATVGNGTLVGMKSALLSGSHVGAGALIAAGAVVLEGHEIPAKALAAGVPAKVRRLLDDAQSQSFIPHAGRYVETSKAQASIAEALSLDEVRVRE

SEQ ID NO: 20094 - protein, 168 aa, Methylococcus capsulatus str. Bath
MTIRVGDRLPAGSLTECTEFDPATACPMNPRAVDVGEQARGKKLVIFGVPGAFTPTCSVKHLPGFVANHDRLRAKGVDEIWCMAVNDGFVMAAWGREQKAGGKVRMMADGSAEYAKKLGLERDLTANGMGIRCHRFAMIVDDGVVKYLGVEASGKFEVSNAEAVLAHL

SEQ ID NO: 20095 - protein, 520 aa, Saccharomyces cerevisiae
MLSRTRAAAPNSRIFTRSLLRLYSQAPLRVPITLPNGFTYEQPTGLFINGEFVASKQKKTFDVINPSNEEKITTVYKAMEDDVDEAVAAAKKAFETKWSIVEPEVRAKALFNLADLVEKHQETLAAIESMDNGKSLFCARGDVALVSKYLRSCGGWADKIYGNVIDTGKNHFTYSIKEPLGVCGQIIPWNFPLLMWSWKIGPALATGNTVVLKPAETTPLSALFASQLCQEAGIPAGVVNILPGSGRVVGERLSAHPDVKKIAFTGSTATGRHIMKVAADTVKKVTLELGGKSPNIVFADADLDKAVKNIAFGIFYNSGEVCCAGSRIYIQDTVYEEVLQKLKDYTESLKVGDPFDEEVFQGAQTSDKQLHKILDYVDVAKSEGARLVTGGARHGSKGYFVKPTVFADVKGDMRIVKEEVFGPIVTVSKFSTVDEVIAMANDSQYGLAAGIHTNDINKAVDVSKRVKAGTVWINTYNNFHQNVPFGGFGQSGIGREMGEAALSNYTQTKSVRIAIDKPIR

SEQ ID NO: 20096 - protein, 570 aa, Burkholderia thailandensis E264
MDLRSKHIDAPPQQAAHFASLDKPPAPRGRRAVLDALAGLSIAGLLIPEAVAYAGLASLPPQAGLIALVVGLVVYAIAGSSRFAIVSATSSSAVVLAATVMSEAGPGAAAQLMLAAALVATTGILFVFAGAARLGGMSDFIARPVLRGFTFGLALTIVIKQVPKVLDVRIHHGDTLRVVLDLLLGIPDCNVYSTALGATALAILFTLGRRTRVPATLVVIVLGIAAGYWIDWHRYGIAVVGAIDLQNLAFGMPVLGRSGWMQTAEFGFALMLILYAESYGSIRNFALKHGDTISPNRDLVALGCANLVSGLLHGMPVGAGYSATSANEAAGAQTRMAGLFAAAVIALIVWLLLPQLARIPEPVLAAIVIFAVSHSLHPEVFRPYWAWHRDRIVVVAALAAVIVLGVLHGLLAAIGVSLLLTLRQLSEPNVSVLGRLRESHDFVDVSMHEDAKPIPGVLIVRPEAQLFFANAERVLTMARRLARDAQPPVHTVMLSLEESPDVDGTTIEALKTFGAECDARGWRLVLVRLKPNVLRVLQRAADGALRANALSELSVDESLQSLAAGEPQRA

SEQ ID NO: 20097 - protein, 672 aa, Physcomitrella patens subsp. patens
MQQTLSQTRRSIDTRKCGIYPSKDPDKVPDRICRSLCIWAGMGGFAGPAVCGVVDGGAGALAMSLPSTSALWKGGEGSAGGFSSGGVMRSCYVRIEDESSVRVAFSVHGFRDCWNRLAVSLSGHGLRFEGNFLPRFLACLKRFAGQPVEQSGVVRRSQGWQVNVAADHSGSKPEAHKRRGKWGYHPLEELTKHEREAMQAGNGRPSDADIARTITEVNWKAVIYASVVTIEDVVFGTEVQFLVDQHGDFYFEMNDDNEFLSKLSDSQTFTVMIGFGAMDEVQVSEMADDGSDAMDDDEDDDDILIEFSEDSDDEFNPEDVPPQFWEELAGAAGSLHDGLSPESMGSLGGWGGPETLAWVHPLEFAIKLSQAVATDHTEEMNKPQKRLTITGVVRRVTEEEEPYVQCLWYDRFWWDEEVDGEEEEILTGEEEVINETEKDKSVRNRLKVVNGGPSSSKLGEGKSPPSGGTRRTMSNSVRGSTGVSSSTDAGTQVGSVTEGSEVNQVGEMLEGVSVEGGESEWVEDRSSWHVGTTFYKLEMLSMQLDLNSGLQKSIEIQDFCNGQPDILAHSAAAIMERVNQGGSKTERALKALCRRELGLEVEEAKVIGVDFLGIDLRVSAGIEVQTLRFQFNRKATCEKVADQLIDQLLFPRPGLKRPRKSQQPRTPRRFQT

SEQ ID NO: 20098 - protein, 493 aa, Pseudomonas syringae pv. phaseolicola 1448A
MSLTRFQMCIDGQWVDALSGKTFDSLNPALAEPWAQLPDADEADVERAVQSAQKAFEGPAWRGLTATARGKLLRKLGDLIAENKENLAQLESRDNGKLIRETRGQVSYLPEFFHYTAGLADKLEGGTLPLDKPDLFAYTVHEPMGVVAGIIPWNSPLYLTAIKLAPALAAGNTIVLKPSEHASATVLELARLALEAGIPPGVVNVITGYGPTTGAALTRHPLVRKIAFTGGAATARQVVCSSAENFAKLSLELGGKSPNIIFADADLDSAINGAVAGIYAASGQSCVSGSRLLVQDEIYDEFIERLAERASRIRIGNPQDETTEMGPMATAQQLAVVEGLVADALAEGARLRLGGKRPRLDSKGWFYEPTLFECDRNSMKIMQEEVFGPVASVIRFKDEAEALAIANDSQFGLAAGIWTRDLGRAHRLARDIRSGIIWVNTYRAVSAMAPIGGFKNSGYGRESGIDSVLAYTELKTVWINLSQAPMPDPFVMR

SEQ ID NO: 20099 - protein, 153 aa, Streptococcus oralis
EHFIRGQYRSGKIDGMKYISYRSEPNVNPESTTETFASGAFFVNSDRFHGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 20100 - protein, 199 aa, Pseudomonas syringae pv. phaseolicola 1448A
MLLMIDNYDSFTYNVVQYLGELGADVKVIRNDELTIEQIEALNPERIVVSPGPCTPNEAGVSLEVIKHFAGKLPILGVCLGHQSIGQAFGGDVVRARQVMHGKTSPVVHQDGGVFEGLNHPLVVTRYHSLVVKSDTLPECLEVTAWTALEDGSVDEIMGLRHKTLNVEGVQFHPESILTEQGHELFANFLKQSGGHRQG

SEQ ID NO: 20101 - protein, 433 aa, Lophopyrum elongatum
MQCFRFASWEKEREEELQGPARSQSALSNSSMSTDRDARRSGSECCSLTVSSEISVDSFGRYRQLSLPHRPNNDLRIFTFQELKSATRSFSRALMIGEGGFGCVYRGTIQSTLEPRRSLDVAIKQLGRKGLQGHKEWVTEVNFLGVVDHPNLVKLIGYCAEDDERGIQLLLVYEFMPHGSLADHLSTRSPKPASWAMRLRVALDTARGLKYLHEDSEFKIIFRDLKPSNILLDENWNAKLSDFGLARLGPQEGSHVSTAVVGTIGYAAPEYIHTGRLSSKNDIWSYGVVLYELLTGRRPLDRNRPRGEQNLVEWVKPYSSDTKKFETIMDPRLEGNYNLKSAARIASLANKCLVRHARYRPKMSEVLEMVQKIVDSSDLGTPERPLISHSKKLASDEKKRKGLNLKRRIADIKAGDGRWFRWHKWTPKLVRTQ

SEQ ID NO: 20102 - protein, 262 aa, Pyrococcus abyssi
MRGSHHHHHHGMASMIVVFVGTAGSGKTTLTGEFGRYLEDNYKVAYVNLDTGVKELPYEPSIDVREFVTVEEIMREGYGPNGAIVESYDRLMEKFNEYLNKILRLEKENDYVLIDTPGQMETFLFHEFGVRLMENLPYPLVVYISDPEILKKPNDYCFVRFFALLIDLRLGATTIPALNKVDLLSEEEKERHRKYFEDIDYLTARLKLDPSMQGLMAYKMCSMMTEVLPPVRVLYLSAKTREGFEDLETLAYEHYCTCGDLT

SEQ ID NO: 20103 - protein, 220 aa, Streptococcus agalactiae NEM316
MSTNKIAPSILAADYANFANELKRIEETTAEYVHIDIMDGQFVPNISFGADVVSSMRKHSKLVFDCHLMVVDPERYIEDFAQAGADIMTIHVEATKHIHGALQKIKEAGMKAGVVINPGTPVESLIPILDLVDQILIMTVNPGFGGQAFIPEMMSKVKTVAAWRKEYGHHYDIEVDGGIDNTTIKAAAEAGANVFVAGSYLFKASDLPAQVETLRVALDD

SEQ ID NO: 20104 - protein, 590 aa, Corynebacterium efficiens YS-314
MTIPHPASPGPTPADPASPDASDTTVHTPDPRRNRRNRRAQTGQWRSLLPSTDDYALLRSTWRGDITAGITVGIVALPLALAFGVSSGVGAEAGLITAIVAGLIAAIFGGSNVQVSGPTGAMVVVLAPIVMAHGVAAVALVSLMAGVIVLLAGVFKLGRTVSFIPWPVIEGFTLGIGVIIFMQQVPAAVGYAGSLPPNTVAAAWHALTHATWPEGFLPLAVVAAVIIVMLLLGRFAPKAPASFLAIIVVTVAVLVLRLPVADIGEIPRSLPAPTLPEINPELVGALVGPAFAVAALAAIESLLSARVAASMADTGPYHADRELVGQGLASIGAGFFGGMPATGAIARTSVNVRSGGRTRVSAIVHALVLLAVVYLAAGVVSVIPLAALSGVLMVTAGRMVNLEVASRVLRSTRSDGVVFVITAIITITVDLVVAVGIGIAAAAFFILRRMSLDTGLFRETLPGRAMPGDERIALFRIEGSLFFGAAERILDQILEHKATNDIDVVILRLSQIQMIDATGANQLTELVTSLERRGVTVIIKGVRKEHIHVLGVLGAIRSLRDPNHLVDDLDTAVTHARSHVTGVSGESVSR

SEQ ID NO: 20105 - protein, 153 aa, Glycine max
AVGKTAQEVVNEVRRQFIERPGIMDYKEKPDYGRCVAIVASASLREMIKPGALAIISPMAVGVVFRILGHSTGQPLLGAKVVASMLMFATVAGILMALFLNTAGGAWDNAKKYIETGALGGKGSESHKAAVTGDTVGDPFKDTAGPSLHVLIK

SEQ ID NO: 20106 - protein, 636 aa, Mycobacterium smegmatis str. MC2 155
MLIASGCSDGAERPRRPAPGPCEIVSNGTPVPKTPESPPPPPGAPAGRDIATQPEVATGYRTDMTAVRTATYAVATANPLATEAACKVLRDGGTAADALITAQAVLGLVEPQASGLGGGGFLLYHDAATGAVRAFDGRETAPAAATENYLRWISEADRTEPRPDARASGRSIGVPGIVRLLDVVHREYGKKAWRELFDPAVNLADRGFDISPRLAAALLDAAPQLRLDPEASAYFLNQDGTPKRVGTRLTNPAYAKTLGAIATDGADAFYTGDIARAIVAAAADTSGGRTPSLLTENDLATYTVKTRDPLCTTYRGREICGMPPPSSGGIAVAATLGILEHFAMKQHRPTDLDRNGGHPTVMGVHLISEAERLAYADRDRYVADTDFVALPGGSPNTLLDSAYLTGRAALISEDRTMGTAQPGSFGPPVTAAPVREHGTSQVSIIDSFGNAAALTTTVESAFGSFHMVDGFLLNNQLTDFSAEPVSPEGTPIPNRVEPGKRPRSTMAPTLIFDHDGGERGPLYAVLGSPGGSVIIQFVVKTVVGLLDWGLDPQQAVSMVDFGAANTPKTNVGGEHPNVDTSDNGDHDPLVRGLRRLGHDVNLDDQSSGLSAIARTESGWIGGADPRREGLVMGDPG

SEQ ID NO: 20107 - protein, 322 aa, Kluyveromyces lactis NRRL Y-1140
MDQLTIKTPLLPFREPLNGGPTFLLKYENLQPGGSFKSRGISHLIKTTMDSISDPENELAVYSSSGGNAGLAAARACATLKVPCTVIVPKSTKPRMIKKIESAGAKVVIFGDHWKEADTYLREYVMRQSSYSNTLYVHPFDNPIIWDGHSTMIDEIIEQLAESHTDINDVKGIVCSVGGGGLYNGVVNGLERHGLAGSIPVFAMETDGCDVLSKSLIAGEPVVLDRISSIATSLGSTEICADSFQKAIKFSSKSIVLDDKNVVDTCLRFFDETSILVEPACGASLHTCYRPELLGPLGPDDIVVVILCGGSCNTYDDLKSFH

SEQ ID NO: 20108 - protein, 58 aa, Oryza sativa
RFITCLLKISGNRSGANEEKVETMEQLLSCCRQAADQINDFGASVYPPQDLSEMKSLR

SEQ ID NO: 20109 - protein, 152 aa, Zea mays
  misc_feature (18)..(19): Xaa can be any naturally occurring amino acid
  misc_feature (24)..(24): Xaa can be any naturally occurring amino acid
  misc_feature (28)..(28): Xaa can be any naturally occurring amino acid
VVGVVYNPIMDEMFTGVXXKGAFXWQPXKVSTQSELVTALLLAEAGTKRDKATLDDATNRINSLLTKVRSLRMGGSCALDLCGVACGRGDIFYEIGFGGPWDIAAGIVIVREAGGLIFDPSGKELDITSQRIAASNASLKELFVEALRLTNV

SEQ ID NO: 20110 - protein, 334 aa, Halobacterium sp. NRC-1
MRATPPHRRMKATARAHPIQGLVKYHGMRDESLRMPYHDSISVCTAPSNTTTTVEFDPDRDADQYVVDGDTVTGHGADRIRSVVDAVRDRAGFDHRVRLESQNSFPTNIGLGSSSSGFAAAALACVRAAGLDLDLPTVSTVARRGSASAARAVTGGFSDLHAGLNDADCRSERLDAPAEFASDLRIVVGEVPAYKETESAHAEAADSHMFDARLAHVQGQLAEMRDAVRAGDFQRVFETAEHDSLSLAATTMTGPSGWVYWKPETLSIFETVRELRADGVPTYFSTDTGATVYVNTTASHADEVEAAVADCGVDTAVWEVGGPAHELDERDAIF

SEQ ID NO: 20111 - protein, 511 aa, Oryza sativa Japonica Group
MANIDMGKILAGLENDDARVPKTKLVCTLGPASRSVPMLEKLLRAGMNVARFNFSHGTHEYHQETLDNLRQAMHNTGVLCAVMLDTKGPEIRTGFLKDGKPIKLTKGQELTVTTDYEIKGDENMITMSYKKLPVDVKPGNVILCADGTISLTVLSCDPKAGTVRCRCENTAMLGERKNCNLPGIVVDLPTLTEKDKEDILGWGVPNDIDMIALSFVRKGSDLVTVRQLLGQHAKRIKLMSKVENQEGVVNFDEILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNEAVFKEMIRSAPLPMSPLESLASSAVRTANKAKAALIVVLTRGGTTAKLVAKYRPRVPILSVVVPVLTTDSFDWTISSEGPARHSLIYRGLVPLLAEGSAKATDSESTEVILDAALKSAVQKQLCKPGDAVVALHRIGVASVIKICIVK

SEQ ID NO: 20112 - protein, 397 aa, Bacillus cereus ATCC 10987
MFHRIEEALEDLKQGKVVIVCDDENRENEGDFIALAEYITPETINFMITHGRGLVCVPITEGYAERLQLEPMVAHNTDSHHTAFTVSIDHVSTTTGISAHERATTIREMLNPASKGADFNRPGHIFPLIAKEGGVLRRAGHTEAAVDLAQLCGAEPAGVICEIINEDGTMARVPDLLQCAKQFDIKMITIEDLIAYRRHHETLVTREVEITLPTDFGTFHAIGYSNSLDTKEHIALVKGDISTGEPVLVRVHSECLTGDVFGSCRCDCGPQLHAALAQIEREGKGVLLYMRQEGRGIGLLNKLRAYKLQEEGFDTVEANEKLGFPADLRDYGIGAQILKDLGLQHLRLLTNNPRKIAGLQGYDLEVIERVPLQMPAKEENKTYLQTKVNKLGHLLNL

SEQ ID NO: 20113 - protein, 182 aa, Idiomarina loihiensis L2TR
MAELGTDGIAILAEDAYYRDQSHMTMEQRVLTNYDQPAAFEHDLLMQHLRQLKAGEAVDMPQYSHTTHTRLEKSIRVAPAKVVMVEGILLLTDEKLREQFDISVFMDTPLDICLLRRIKRDIEERGRTLQSVTEQYEQYVRPAFFDFIFPSKQFADLVVTRGGQNEIAIDIIKTKIRQLLAE

SEQ ID NO: 20114 - protein, 153 aa, Bacillus cereus ATCC 10987
MVFEGHLVGTGLKVGVVVGRFNEFITSKLLGGALDGLKRHGVEEADIDVAWVPGAFEIPLIAKKMANSGKYDAVITLGTVIRGATTHYDYVCNEVAKGVASLSLQTDIPVIFGVLTTETIEQAIERAGTKAGNKGYESAVAAIEMAHLSKQWA

SEQ ID NO: 20115 - protein, 290 aa, Bordetella parapertussis 12822
MAPMNSQPSVIAPACEADAERRFGGLARLYGPDAPAALRGAHVAVAGLGGVGSWTAEALARCGVGALTLIDLDHIAESNVNRQIHALSDTLGQAKIEAMAQRIGQINPACAVTRVDEFVAPDNVMQVLGGPYAAIVDCTDQAAAKIAMILHARQRGVPLLLCGGAGGKTDPLALRAGDLSEAVNDALLAKLRNKLRREHGFPRASDANGKVRKRVPRMGVRALWFDQPAILPDAWTRAVEGEDDMGAAGTRAAPQGLSCAGYGSVVTVTAAMGLAAANEVLGWVVGKPGA

SEQ ID NO: 20116 - protein, 168 aa, Brassica napus
MGMSLDFDVDLEKGILDCQNVYTKSPEKPLIPMCPDSKPVETGLLENDASPVQCAVSKPEWGRSERKEKRKKSASKPPRPPRGPSLDAADEKLIREIAELAMLKRARVERMRALKKSREAKAASASSASSLGNVFATILTAIFFFVLVFQGVIYFQILAFAFCIVIFD

SEQ ID NO: 20117 - protein, 213 aa, Zea mays
MELRNTDIGWPFSTAFFAGCCRIWKIFTVYFIGVLLIHTAPEDLLDGEDGGQGSYYSLHTMLGSGGGSGSCSKDMAVELGDEPHVLVVDDSLIDRKLVERLLKNSSCKVTTAENALRAVEYLRLGNDTLEGTVSEVNMIITDYCMPGMTGYELLKKIKESSVLKEVPVIIMSSENIPTRISQCLEEGAKMFMLKPLKRSDVKQLKWHLMKCRN

SEQ ID NO: 20118 - protein, 396 aa, Bacillus licheniformis ATCC 14580
MKFEHSDVLKQLPEQFFASLVKKVNEKIAAGHDVINLGQGNPDQPTPEHIVDTMAQAVRNPENHRYSSFRGSRSLKEAAAAFYQREYGVELDPEREVAVLFGGKAGLVELPQCLLNPGDTVLVPDPGYPDYWSGVELARANMETMPLTADNQFLPDYSRIPKEVKEKAKLMYLNYPNNPTGAQATSAFFEETVRFAKSNGICVVHDFAYGAIGYDGKRPVSFLETAGAKDAGIEIYTLSKTYNMAGWRVGFAVGNASVIEALNLYQDHMYVSLFKAVQDAAAAALLSDQACVQEQNERYEKRRNAWIRAVRDIGWHADAPQGSFFAWMPVPDGYTSEAFSDLLLEKANVVTAPGIGFGKHGEGYVRVGLLTSEERLREAASRIAELNIFKKTGHSH

SEQ ID NO: 20119 - protein, 140 aa, Zea mays
MSTEPEVVHSGGCHCRRVRWQVEAPASVVAWICNCSDCSMRGNTHFVVPKDKFALQAGAGDFLTTYTFGTHTAKHTFCKVCGITSFYIPRSNPDGVAVTAACVGAGTLAHVEYRKADGRNWEQWIEASGISEFSKPKAAE

SEQ ID NO: 20120 - protein, 812 aa, Oryza sativa
  misc_feature (184)..(184): Xaa can be any naturally occurring amino acid
MPSLYIFLGLLLFSLQAPPCPAATDTLKAGQVLSAGDKLVSRNGKFALGFFNPSANISKSSDNISSSWYIGIWFNKIPVFTVVWVANRERSIAEPDFKLTQLKISQDGNLAIVNHANESIIWSTRIVNRTEASMNTSVLLHDSGNLVIQSTSNAVLWQSFDYPTDVALPNAKIGWNKVTGLNRXVSKKSLIDMGTGSYSVQLYTNGTRRVTLEHRNPSIEYWYWSPDESGMKIPALKQLLYMNPQTRGLVTPAYVNSSEEEYYSYNSSDESSSTFLLLDINGQIKFNVWSQDKHSWQSLYTQPVDPCRSYDTCGPFTICNGNSQPFCDCMENFTRKSPRDWDLGDRTGGCSRNSPLDCTRNTSSTDIFHPLIHVTLPRNPQTIQEATTQSECAQACLSSCSCTAYSYQNTSTCSIWHDELFSVNQDDGIEIHSQDVLYLRLAAKDLQSLRNNKRKPNVAVVIAASVIGFVLLMVGMFLLIWRNRFEWCGAPLHDGEDSSGIKAFRYNDLVHATKNFSEKLGAGGFGSVFKGMLIDLTTIAVKRLDGDRQGEKQFRAEVSSIGLIQHINLVKLIGFCCEGRKRLLVYEHMLNGSLDAHLFQSNAGTLNWSIRYHIALGVARGLGYLHQSCHACIIHCDIKPQNILLDASFTPKIADFGMAAFVGRDFSRILTTFRGTVGYLAPEWISGVAVTPKVDVYSFGMVLLEIISGRRNSPNEYTSDNYHVSYFPVQAIDKLHEGDVRNLVDPQLCDDFSLEEAERVCKVACWCIQDDEHDRPTMSEVVRVLEGMQELEMPPMPRLLAALTKCSDVGSI

SEQ ID NO: 20121 - protein, 337 aa, Physcomitrella patens subsp. patens
MEAGEARELWKAAAEGNVERVQSLLESGADICEGNDEGLTPLMMAAQNGHAEVVRALLRAGAPWNALNPAGKCAGDFAMEAGHQEAFDVLLDAGMQAELILGIVARQTKRAEDGEKPYLQQRVEYSEGKLTDEENKGVMMAWENPLMAAHAKAICANGGHVLNVGFGMGLVDTSIQSHNPASHTIIEAHPEVYKRMLETGWGEKRNVRILFGRWQDVLPQLDSYDGIFFDTYGEFYDDLKEFHEHLPKILKKGGIYSYFNGLCATNAFFHVVYCQLVALELARLGLTTQFIPLPVKDCLDEETWLGVYHKYWQLDTYFLPVCQAEEDENEEDTVNAS

SEQ ID NO: 20122 - protein, 292 aa, Triticum aestivum
  misc_feature (207)..(207): Xaa can be any naturally occurring amino acid
MGGGSMGIRAAARAAFIGGYRSASNARRSALPSSSAAAADTRPVSTATTFDDWYIPDREVFGPVPSHEEAMAATLDLRDAFEIAKIDSHGGRLDISKTHISHDGLDDPTKVAQETFQDHLHSEASKHEEKHDSLSVASGSSARVIEAFTMLHESPEAQDVVASLASDKNVWEAVMKNKKLVEFYKTNLSESSSVNWTKLSRATPESXQSSNGVVSPADAFSDYIQMMKAFVSEMVTNLSSIMQDLVATSDEGQSKGRLKTLIINSKKDFTNGPSSFVLLAIASILVVLLKRA

SEQ ID NO: 20123 - protein, 537 aa, Mesorhizobium loti MAFF303099
MSMAVLETQISPSSDTFRANAERMRALVTDIADKAATVERGGSEEARERHISRGKLLPRERLAQLLDTGSPFLEIGQFAAWSMYGEEICSAGMIAGVGRVEGTEVMVVVNDATVKGGTYYPLTVKKHLRAQEIALQNNLPCIYLVDSGGANLPNQDEVFPDREHFGRIFYNQANMSAAGIPQIACVMGSCTAGGAYVPAMSDETIMVRNQATIFLGGPPLVKAATGEDVSAEDLGGADVHTRLSGVADHYAMDDEHALAICRRIVKNLNRNKTVSLSLQRSIPPLHPADELYGVVPTDLRQPYDVREVIARLVDGSEFDEFKQNYGTTLITGFAHLHGMPVGLIANNGVLFSESALKGAHFIELCCQRRIPLVFLQNITGFMVGRKYEAGGIAKDGAKLVMAVATARVPKVTVIIGGSFGAGNYGMCGRAYSPRFLWMWPNARISVMGGEQAATVLAMVKREGIERKGGEWSAEEEAKFKKPILMKYEHEGHPLYSSARLWDDGIIDPAKTREVLALSLSASLNAEIEDTRFGVFRM

SEQ ID NO: 20124 - protein, 380 aa, Physcomitrella patens subsp. patens
MSTEGQVITCKAAIAWEAKKPLSIEDVQVAPPQAGEVRIKITHTALCHTDAYTLDGHDPEGLFPCILGHEAAGIVESVGEGVTEVKAGDHVIPCYQAECKECKFCLSGKTNLCGKVRSATGVGLMLSDRKSRFSKDGKVIYHFMGTSTFSEYTVVHAVSVAKVNPAAPLDKICLLGCGIPTGLGAVWNTAKVEKGANVAIFGLGTVGLAVAEGAKAAGAARIIGVDIDPSKFDRAKDFGVTETLNPKDHKKPTQEVIVEMTDGGVDYSFDCTGNVHVMRSALECCHKGWGTSVIIGVAASGQEISTRPFQLVTGRVWKGTAFGGFKSRSQVPELVEKYLKKEIKVDEYITHNMKLDDINEAFDLLHSGKCLRCVLQLSSL

SEQ ID NO: 20125 - protein, 90 aa, Prosthecochloris aestuarii DSM 271
MNIYIGNLDYGVTEEDLREAFGEFGDVSSANIITDKFTGRSKGFGFVEMSSSDDANEAIESLNDTDLNGRTIKVNEAKPRAERPARRYQY

SEQ ID NO: 20126 - protein, 655 aa, Magnaporthe grisea 70-15
MAQSQARDGAGVFNPPSPHSSNGAVESCKHDGTPDTRLTAFSPEESSTRSAKLMATIASGSSDGGSTNYSTNQAVPYRSDQSPVERDPFVSTDTPARKQEQKLSATASAFRPYGSPLIAQGSGDAASEFSPGKASSIQQTIPSIPTTLSTEGLLSRCIVVSSSSQLVGQNDLELLLSKLGQLGSPCQGTRRIIVKGPAAYVRFSNIRDSCMVHRNILLGGPSWVAGFVPPVEFVQGDVFALQKTPSPERCVYKAVLEYADTAVAFGVISKYNGITVNDIAITTSFHQSEGLSLGPEILGGMATPISTPVATPVRSSTFQGYEQDIFSGLSMTKMQQSAVPLNTPGYPSTPRVNLPLSPQYPLYRPMVFQHFSVPTTYTLNRIPAQSPPSSSIQGYPCVTPIYSSPQSPVVLSPQQDFTSPRQLQGFSRPDNRRQNATRVHRSSYYNVAGHHNHVDVNRIREGTDVRTTIMLRNIPNKVDQAMLKRIVDESSWGKYDFMYLRIDFANDCNVGYAFINFVDFVNARGNQRWNCFKSDKVAEISYATIQGKDCLVQKFRNSSVMLEAAHYRPKLFFTSNGPMPELAGQEEPFPDPDNQSKMKRSCENAEHVGLFTPNAGQHFRDEQRRRRSQYDRGTRLAALEEYDYETAIQHLYVGQ

SEQ ID NO: 20127 - protein, 417 aa, Malus micromalus
MAAKESNSAAAAASSDGKIKRMLTHGGRYAQYNVFGNLFEVSSKYVPPIRPIGRGAYGIVCAAVNAEAREEVAIKKIGNAFDNRIDAKRTLREIKLLRHMDHENVIATKDIIRPPQKENFNDVYIVYELMDTDLHQIIRSNQPLNDDHCRYFLYQLLRGLKYVHSAGVLHRDLKPSNLFMNANCDLKIGDFGLARTTSETDFMTEYVVTRWYRAPELLLNCSEYTAAIDIWSVCCILGEIMTRKPLFPGKDYVHQLRLITELLGSPDDSSLGFLRSDNARRYVRELPQYPKRSFSLGFPNMSPSSIDLLEKMLIFDPNRRITVDEALSHPYLAPLHDINEEPVCPMPFNFDFEQPSFTEENIKELIWRESVRFNPESHFSMDHDIICCILLQTNLKTDCNDMFVDTVIVECVKGVDS

SEQ ID NO: 20128 - protein, 423 aa, Physcomitrella patens subsp. patens
MFKNPEHLETQTCTITSKKDESQPMRVVEFHGKMDMKVKIRPKPLITNPADVILRVTTTAICGSDLHMYMGAMPGMKSGDIVGHEFMGVVEAVGPEVKDIKEGDRVVAAFDIACGQCSACKLENYSGCDSTNPSWEQDVMYKDRTCGMFGYSHLTGGWDGGQAEFVRVPFADRNCLKVPAELDDEHVILLSDILPTAWHANELGRVGKGDNVAIWGCGPVGILAAQCAFQRGASRVVIIDEQPFRLDFAKKKVPGLETINFKEKKTVEELRNLFSHGPDVAIEAVGVHYVSNPLHKLEVMIGLETDSTEVINECIYAVRKGGRIGVVGAYAGYANHFNLGAFMEKGLSMAGGQTPVQKYWPTLLPLVQSGELDPTTVITHILGLGEAPEAYKHFNAKDEGWIKVLDIKTNKSSVDAFTLLFCT

SEQ ID NO: 20129 - protein, 375 aa, Bacillus anthracis str. Ames
MLFYFELVVILLCTKLAGDISVRLGQPSVLGKLIVGIIIGPAVLGIINSSELIDELSEIGVLLLMFMAGLETDLEELNRNLKSSFAVAAGGIIFPFIGGYVTGLLFGLIQSHAIFLGLLLCATSVSITVQTLRDLGKMNTRESTTILGAAVFDDVIVVILLAFVMSFLGTQDVNITLVIVKKIIFFVSIVFIAWKVVPWIMKMLVPLRVTEALISAALIICFSFSYYSEMMGIAGIIGAFAAGIAISQTEYKHEVEHKIEPIAYAIFVPVFFVSIGMEITFQGIGSQLWFIIIMTLIAIFTKLIGSGLGARLTGFNLQSSISIGAGMVSRGEVALIIAANGLAANLLAKENFTAIVIVVILTTIITPPLLKKYFV

SEQ ID NO: 20130 - protein, 364 aa, Thermococcus kodakarensis KOD1
MFNVYEFFNRINEVRPESRLDAGQPDIPVRREIIEEAVESLRRGETGYTSTGGIRELRERIAEFEGVSADEVIVAPGAKILIAAEIASAKKVAVVSPRWNAYSLIARQFWREVEVIKTTLDERWIPRVEEIKADLIIINYPNNPTGRVLSGKEIRGLLDVAEENGVKVLSDEVYAELSFTRFTPARELYENVVTVKGFSKLYSMTGFRLGYAIGERNEIRRIQRFIESTVTCVPPFVQRAGVKALELRDELIKEVRRAYLERVRMASKMLRGFDFVEPEGAFYIFLRTPQDGMAFAERLLSRGVAVFPGMAFGDYPNFIRISLSGKGLERGLRVIREELECALESRATEGWEGSSRGVSAEGSR

SEQ ID NO: 20131 - protein, 408 aa, Xanthomonas campestris pv. vesicatoria str. 85-10
MSTAADSPLSLAHYYLPVYRPRQVVLERGQGSRVWDDAGREYLDLSSGIAVSGLGHNDPDLVAALTEQAGKLWHTSNVFFSAPPLKLAEELVSASRFAHKVFLCNSGTEANEAAIKLVRKWASSQGRPADKRVIVTFRGSFHGRTLASVTATAQPKYQEGYEPLPGGFRYVDFNDVAALEAAMAGGDVAAVMVEPIQGEGGVMPAAPGFLSRVRALCDQHDALLVLDEIQCGMGRTGTLFAHWQEQVTPDIVTLAKALGGGFPIGAMLAGPKVAETMQFGAHGTTFGGNPLAAAVARVALRKLASPQIADNVVRQSAALRAGLEALNADFGLFAQIRGRGLMLGAVLAPAHAGQAGAILDLAATHGLLLLQAGPDVLRFVPALNLTDAELADGLARLRLAIAEYVAQA

SEQ ID NO: 20132 - protein, 280 aa, Zea mays
  misc_feature (274)..(274): Xaa can be any naturally occurring amino acid
MAAGSGPAPPAEAQPPPPIHHLPPDALHNVLLRLQLRDAVVCRPVSRLFHETLSPQLLALLPSLRLLLLRHPRPDGGGCLHAFDPARRTWLRLPFAHFLPYHSFSPVASSTSLLYLWVETSSSTSPLALPPSTSSASSASPVHPPKSLAVCNPFAGTYRLLPQLGSAWARHGTVLAGPAGTVLVLTELAALSYTPSGSAKWMKHPLSLPSKPRSPILASDAVFALCDVGTPWRSQWKLFSCPLAMLTGGWAPVERAAWGDVFEVLKRPRLLAGXAAAFFF

SEQ ID NO: 20133 - protein, 351 aa, Corynebacterium efficiens YS-314
MQLVPQLLFALAHGLKDIPYFRWGTGFGQTPAGRVVSMSLSIKEHVNAVKTVVVPAAGMGTRFLPATKTVPKELLPVVDTPGIELIAEEAAKLGATRLAVITAPNKAGVLAHFERFTELEATLEERGKTDQLQKVRRAAGLIDAVPVTQEHPLGLGHAVGLAESVLDADEDVVAVMLPDDLVLPFGVMERMAQVRAEFGGSVLCAVEVADDEVSNYGIFRVENADDNGADQDVKRVTGMVEKPAVEDAPSNLAATGRYLLDRSIFDALRRITPGAGGELQLTDAIALLIDDGHPVHIVVHRGKRHDLGNPGGYIPACVDFGLDHPVYGPQLRRALAQIMVDHGVVDASAIR

SEQ ID NO: 20134 - protein, 348 aa, Coccidioides immitis RS
MAFWPGSAMRAARTSVARCSYGIENSHAAPVARQLANRCQVRPSSSSTSALAYKALHRRSPLPLPVAENSPTWSAPAAVSSILYETPVPSTKPPKRHVLNCLVQNEPGVLSRISGILAARGFNIDSLVVCNTEVEDLSRMTIVLRGLDGVVEQARRQLDDLVPVWAVLDYTEAALVQRELLLAKVSILGPEFFEELLQHHREMTSTEGAMPLESESASNAEGSADKDAQRREVEKVNGNLSRAADYHPNSLAASEALRHKHEHLEAITHLTHQFGGKVLDISSNNCIVELSAKPFRIDSFLKLIAPFGILESTRTGLMALPRSPIGPTAEEMEKEAAEVVDASTLPPG

SEQ ID NO: 20135 - protein, 318 aa, Lactobacillus plantarum WCFS1
MAKRKMILDLDTGIDDAMAIAYAVGAPDVDLIGIISSYGNCLVDQAAINSLQILELLGATDVPVFLGEPHSSTTEHFDVMPISQQIHGMNGIGDVNLPEPKRAVEKQSGVDFLIDAVHQYGADLTLVPTGPLTNLAEALEKAPDIASTIGNVTLMGGALTVPGNVSHYAEANINQDAEAANAVFTSTMPLTMVGLDVTLRTLLTKTETQQWRDLKTTAGEKFADIVDYYIAAYDITSPDLHGCALHDPLAVGVSLDPSFVTTLDLNMYVQASGEDYGRTIGDPARLNDPTNVTVALTVDKDRYLKTFMNYLTTLFKAH

SEQ ID NO: 20136 - protein, 574 aa, Triticum aestivum
MRGLRRSSLARIASTTRAASARQCSSSILGGARAAPYCTMAGRSGEEADAAMAGVATGGVEDAYGEDRATEDQPVTPWAVCIASGHSLLRDPRHNKGLSFTEKERDAHYLRGLLPPVVLSQELQEKRLLQNVRQLDVPLQRYMFLMDLQERNERLFYKLMIDNVEELLPVVYTPTVGEACQKYGSIFRRSQGLYISLKDKGRVLEVLRNWPEKSIQVIVVTDGERILGLGDLGCQGMGIPVGKLALYTALGGVRPSACLPITIDVGTNNEELLNDEFYIGLRQKRATGQEYTELLDEFMVAVKQNYGQKVLVQFEDFANHNAFTLLEKYKATHLVFNDDIQGTAAVVLAGLMAGLKFAGGTLADHTFLFFGAGEAGTGIAELVALEISMQSKTSQEEARKNIWLVDSKGLIVSSRKDSIQPFKKLYAHEHEPVKDLLSAIKDIKPTALIGSAGVGQSFTKEVIEAMSSINKRPIILALSNPTSKSECTAEQAYSWSQGRAIFGSGSPFDPVKYNDKLFVPAQANNAYIFPGFGLGVVTSGAIRVKDDMVLAAQKKKKKSLSIPSAGPGNPISPL

SEQ ID NO: 20137 - protein, 324 aa, Xanthobacter autotrophicus Py2
MVHAVRVHQTGGPEVLAYEAVEVPPPGRGEVQIRQTAIGLNFIDVYFRTGLYKAASLPFIPGNEGAGVVEAVGPDVNDFHPGDRVAYASAIGAYAEVRNVPAAVLLHLPASIDDQTAAAMMLKGMTAQYLVRRTHHIKPGDVILVQAAAGGVGLILCQWAKHLGATVIGTVGSKDKAELALSHGCDEVILYRDEDFVHRVKEITAGKLCDVVYDGVGQATYPASLDCLKPLGLWVSFGNASGAIKNFDLLQLSQKGSLFATRPTLATFVAKRHDLIATANDLFEAVLTGAVKIPVHQTYALKDVQKAHKDLESRKTTGSTLLLP

SEQ ID NO: 20138 - protein, 576 aa, Saccharomyces cerevisiae
MSATLLKQPLCTVVRQGKQSKVSGLNLLRLKAHLHRQHLSPSLIKLHSELKLDELQTDNTPDYVRLVLRSSVYDVINESPISQGVGLSSRLNTNVILKREDLLPVFSFKLRGAYNMIAKLDDSQRNQGVIACSAGNHAQGVAFAAKHLKIPATIVMPVCTPSIKYQNVSRLGSQVVLYGNDFDEAKAECAKLAEERGLTNIPPFDHPYVIAGQGTVAMEILRQVRTANKIGAVFVPVGGGGLIAGIGAYLKRVAPHIKIIGVETYDAATLHNSLQRNQRTPLPVVGTFADGTSVRMIGEETFRVAQQVVDEVVLVNTDEICAAVKDIFEDTRSIVEPSGALSVAGMKKYISTVHPEIDHTKNTYVPILSGANMNFDRLRFVSERAVLGEGKEVFMLVTLPDVPGAFKKMQKIIHPRSVTEFSYRYNEHRHESSSEVPKAYIYTSFSVVDREKEIKQVMQQLNALGFEAVDISDNELAKSHGRYLVGGASKVPNERIISFEFPERPGALTRFLGGLSDSWNLTLFHYRNHGADIGKVLAGISVPPRENLTFQKFLEDLGYTYHDETDNTVYQKFLKY

SEQ ID NO: 20139 - protein, 380 aa, Vitis vinifera
MLSVKPKKWLNRFNWSTGCARPIEDRLREAKKFLSLPVASSSRSRLNLNRLRSSQDLSRSGCRLRPNGMSQNSNYNSGSGPDFNITDDILAVIPTDPYDQLDLARKITSMAIASRVSKLESEVGRLRQMMYEKDRVAFDLEEKVSQLERAYQESESRLKMVIDENTRLSKERDSLAMTAKKMGRDLAKQTETVDIGTCDQSIPKAYPDIDDGTNGYVVNQPLSGFTEYRNSTDEASRLAVQRFSVTPYITPRFTPSGTPKIFSTGGSPRGYSAVASPNKTSGATSPTKSQYDGRGALSSWYPSSQQSSAANSPPRARPLPGSEKSRLSYEQFSAFLANIKELNAQKQSREETLRKAEEIFGTDNKDLYLSFQGLLNRNPH

SEQ ID NO: 20140 - protein, 586 aa, Vitis vinifera
MDTHGSSSFSSFTAYARALAQTPSRLARRACSVSTSFEEMSRVRARSGSDMQRNLRWFDLVGFGLGGMVGAGVFVTTGRASRLYAGPAVVLSYAIAGICALLSAFCYTEFAVDMPVAGGAFSYLRVTFGEFAAFLTGANLVMDYVLSNAAVARSFTAYLGTAIGFPTTKWRFTVSGLPKGFNEIDLVAVAVVLIITLIICYSTRESSVVNMVLTAMHILFIAFVIVVGFWRGDWKNFTEPADPRRHQGGFFPFGASGVFNGAAMVYLSYIGYDAVSTLAEEVRNPVKDIPIGVSGSVMLVTILYCLMAASMSKLLPYDAIDPEAPFSAAFRGQSNGWKWVSNVIGAGASFGILTSLMVAMLGQARYMCVIGRSKVVPSWFARVHHKTCTPVNASAFLGIFTAAIAVFTDLNVLLNLVSIGTLFVFYMVANAVIYRRYVSVGATNPWPTLSFLVSFSLTSIIFTLIWHFAAPGHPKEVMLGACTVVAVAILQMFHCMVPQVRKPEHWGVPLMPWIPSISIFLNIFLLGSLDRPSYVRFGYFSALAVLVYVLYSVHASFDAQEDGYYIQKNAEIPKDSEASVDAITMV

SEQ ID NO: 20141 - protein, 274 aa, Halobacterium sp. NRC-1
MIEQMLASGELPEGGTIIEPTAGNTGVGFAVAASQLGIDAVFVVPERFSLEKQQLMRALGADVVNTPTDDGMGGAIQRAHDLAAEREDAIVPQQFSNPLNAEAHYETTGPEIYHALDGAVGAFVAGCGTAGTLMGTSRFLRDQISALHVTAVEPEGSMYASAAGADVSEGEYKTEGIGTHDPSTSELFDPEFVDDVTQIPDEDTHAEMQRLAAEEAQLVASSAAANSLAAIDVAERAAAGHIDLPHDCVVTVFPDSSERYLSKGLYGDYEEWEG

SEQ ID NO: 20142 - protein, 486 aa, Oryza sativa Japonica Group
MASYDKAIESYKRAVTTAASLAASAMLVRGVVNELVPYEVRDLLFSGVGYLRSRMSSQHMVIIEETEGWTNNQLYDAVRTYLATRINTDMQRLRVSRVDETKSMMFSMEEGEEMADVHEGSEFRWRLVCRDNSSSSNGNGNGRGGNGNYRLEVRSFEMSFHKKHKDKALNSYLPHILATAKKIKDQDRTLKIYMNEGESWFAIDLHHPSTFTTLAMDHKQKQSVMDDLERFIKRKEYYKKIGKAWKRGYLLYGPPGTGKSSLIAAMANYLKFDVYDLELTEVNWNSTLRRLLIGMTNRSILVIEDIDCTLELQQREEGQESSKSNPSEDKVTLSGLLNFVDGLWSTSGEERIIVFTTNYKERLDPALLRPGRMDMHVHMGYCCPESFRILASNYHSIDNHATYPEIEELIKEVMVTPAEVAEVLMRNDDTDVALEGLIQFLKRKKDVGKEGKAENVEQVVKAEETEKGMMKKNDVPENQDPQDASK

SEQ ID NO: 20143 - protein, 462 aa, Bacillus cereus ATCC 10987
MTFSKSTTDKPSYTYEELSEKNKAYVWHPFTQMKDYLEEDPVIIERGEGRKLYDVNGNEYWDGVSSIWLNVHGHQVPELDEAIREQLNKISHSTMLGLANVPSILLAEKIIEVVPEGLKKVFYSDSGSSAVEIAIKMAFQYWQHKGKPKKQRFVTLKEAYHGDTIGAVSVGAIDLFHQVYSSLLFEAIKMPYPYTYRSPYGNNKEEIVKKHLEEMEELLKDKHEEIAAIIVEPLMQGAGGMITMPKGYLKGLRNLCTKYNVLFITDEVATGFGRTGKMFACEHENVTPDILTAGKGLTGGYLPVAITVTTDEIYNAFLGGYEEQKTFFHGHSYTGNPLGCAVAIANLELYEKTNLIEEVARKTEYVATQLEDLFAYKHVGDIRQCGLMVGIELVKNKETKEAFEWTERVGVQVCKRSRELGMILRPLGNTIVFMPPLASTIDEIDDMLRILYKAISDVTEGE

SEQ ID NO: 20144 - protein, 495 aa, Prosthecochloris aestuarii DSM 271
MNYDYDVTVIGGGAAGLTAAGVAASLGAKTALVEEKKLGGDCTWYGCIPSKTLLKAAKAAHTIRHAARFGIETHGEISINFETVMRRVHEVQQQIYQEADAPEIYEKMGVTVLYGKAAFVDEHTITIETGQSGISTLQSKNVIIATGSRPITPPIPGLEKVSYVTNEQLFSLKKQPRQLLILGAGPIGIEMGQAFCRLGSKVHVFDAEEHILPKDHPELTAILQKVLEQEGMTFHLQYRVTQVDEMDGIITVTAEEETTGRTIQLTGDALLVAAGRAANTENLNLEAAGVTTHKRGITVNQYCQTSRSHIYACGDVAGGMQFTHIAEHMAKIAAGTMLTHLPLQTDDRHIPWCSYTEPEIAHVGETEAELHARHAGHEVYRFPFNRIDRAITEDATEGWIRIYAAEFDGKIFGADILGAHAGELISEIGLAMRNGITLRQLSDTIHPYPSYALGNRRAADQWYVRKQSGTIVGLLQFFFGYQGQKPDTSDPDRIV

SEQ ID NO: 20145 - protein, 382 aa, Pseudomonas syringae pv. phaseolicola 1448A
MIDSKLPNVGTTIFTVMSQLAAETGAINLSQGFPDFDGPQALRDAVCRHVTQGHNQYSPMTGLPALRQQVAAKIARSYGREVNPDSEITITPGATQAIFCAIHSVIRTGDEVIIFDPCYDSYEPAVELAGGRCVHVQLGLDDFSIDWQKLSDALSPRTRMIVINSPHNPSGALISRAELDRLAALIADRDIYLLSDEVYEHLVFDGARNVSVLDHEALYQRAFVVSSFGKTYHVTGWKTGYVVAPPALTSELRKVHQYVSFCGVTPLQYALADFMAEHPEHVDELPGFYQAKRDFFCGHLAESRFSFRPVGGTYFQLVDYSQIRPDLNDVDMALWMTREHGVASIPISVFYQSPPAGQRLIRLCFAKQEDTLRQAAEKLCAI

SEQ ID NO: 20146 - protein, 527 aa, Oryza sativa Japonica Group
MHSTNLLLEEPIRMASILEPSKPSFFPAMTKIVGTLGPKSRSVDTISSCLKAGMSVARFDFSWGDAEYHQETLENLKVAIKSTKKLCAVMLDTVGPELQVVNKSEASISLEENGTVILTPDQGQEASSQVLPINFAGLAKAVKPGDTIFVGQYLFTGSETTSVWLEVSQIKGDDVVCVIKNTATLAGSLFTLHCSQIHIDLPTLSDEDKEVIRKWGAPNKIDFLSLSYTRHVEDVRQAREFLSKLGDLSQTQIFAKIENVEGLNNFDEILQEADGIILSRGNLGIDLPPEKVFLFQKSALHKCNMAGKPAVVTRVVDSMTDNLRPTRAEATDVANAVLDGSDAILLGAETLRGLYPVETISIVGKICAEAEKVFNQDLYFKRTVKHVGEPMTHLESIASSAVRAAIKVKASVIICFTSSGRAARLIAKYRPTMPVLSVVIPRLKTNQLRWSFTGAFEARQSLIVRGLFPMLADPRHPAESTNATNESVLKVALDHGKVSGVIKSHDRVVVCQKVGDSSVVKIIELDD

SEQ ID NO: 20147 - protein, 273 aa, Bacillus licheniformis ATCC 14580
MNIGFIGTGNMGTILIEALIESRAVIPSSLTITNRTIDKALNIKKRFPDIQVAERPEEVITESDAVFICVKPLDIYPLLKRLSPVFTRDQTVVTITSPVQVEQLETIVSCQAARVIPSITNRALSGVSLLTFGESCTAEAKEKLTALVSKISIPLEIESEITRVASDIVSCGPAFVSYLVQEFIQAAVEETSVSKEDAILMTKEMLVGLGRLLETGLYTLPALQEKVCVKGGVTGEGIKALESGVQDMFRQMFRNTHLKYEEDIALVKKQFSV

SEQ ID NO: 20148 - protein, 478 aa, Magnaporthe grisea 70-15
MFGFGSKRKTEEDSSPANVEDQLVSQVDDADLDITQSQPFWTAILPVIACGAGLFSDGYRKRIYRPRKRVWFCVQRLTGQKSRQRHCICRNPAGSYWHGEATGMFTMLAVWRFFVGIGIGGEYPAGSVGCAESTGELKAGTRNMFFILFTNSMIDWGFVFGAFVPFVVAAAAQNQYMSTIWRTSLGIGVVFPLVLLVMRFRLKEPVEFSKNSFRHAKTPYRLVLRFYGWRLLIVSLIWFIYDFLTYAFGIYSSTILANIFPEGQALTIVFGWNTVINLFYIPGTMLGAPLSDKIGPRYALAAGVSAQAVIGFIMAALYPHLAQASNVAAFAVVYGIFLSMGELGPGNNIGLLAAKTCATGVRGQYYGIAAAIGKIGAFVGTYVYPYIEAAGGENAVASAQYPFYVSSSLCVVSAALAIFCLPHIGQDTITLEDKRFREFLEANGYDTRQMGLNKGESLEDSEAGAAEKGGAAAAAAEA

SEQ ID NO: 20149 - protein, 153 aa, Nicotiana clevelandii
MKMIVLRSSDGETFEVEESVALESQTIKHMIEDDCADTSIPLPNVTSKILAKVIEYCKRHVDAASKTEDKAVEDDLKAFDADFVKVDQSTLFDLILAANYLNIKSLLDLTCQTVADMIKGKTPEEIRKTFNIKNDFTPEEEEEVRRENAWAFE

SEQ ID NO: 20150 - protein, 410 aa, Sinorhizobium meliloti
MTINATVKEAGFRPASRISSIGVSEILKIGARAAAMKREGKPVIILGAGEPDFDTPDHVKQAASDAIHRGETKYTALDGTPELKKAIREKFQRENGLAYELDEITVATGAKQILFNAMMASLDPGDEVVIPTPYWTSYSDIVQICEGKPILIACDASSGFRLTAQKLEAAITPRTRWVLLNSPSNPSGAAYSAADYRPLLDVLLKHPHVWLLVDDMYEHIVYDAFRFVTPARLEPGLKDRTLTVNGVSKAYAMTGWRIGYAGGPRALIKAMAVVQSQATSCPSSVSQAASVAALNGPQDFLKERTESFQRRRNLVVNGLNAIEGLDCRVPEGAFYTFSGCAGVARRVTPSGKRIESDTDFCAYLLEDSHVAVVPGSAFGLSPYFRISYATSEAELKEALERISAACKRLS

SEQ ID NO: 20151 - protein, 336 aa, Magnaporthe grisea 70-15
MSNSIKQAAEAVRSRTSEVMGGAGKGSGGETAAVANDFLHTPFMRAALPFLNGGAAGMPTSAICLLSDMIKVRLQLAGEGMAGGVKPTPLSVTRDILASGRALDLYTGLSAGLLRQAVYTTARLGFFDTFMGTLTAKAKENGSAIGFKERAAAGLSAGGLAAMIGNPADLALIRMQSDGLKPKESRQNYKSVIDALARITKNEGIAALWSGATPTVVRAMALNFGQLAFFSEAKAQLKSRTDLNPRVQTLTASAVAGFFASFFSLPFDFVKTRLQKQQRGPDGKLPYRNMIDCFGQVAKQEGALRFYRGFWTYYVRIAPHAMVTLIVADYLGWITK

SEQ ID NO: 20152 - protein, 349 aa, Coccidioides immitis RS
MAKNQWRPYTNGSHAPSTPRHLLSIADLTPTEFATLVRNASSYKKTIKSDSMPERLTGALSGKTVAMMFSKRSTRTRVSTEGAVVKMGGHPMFLGKDDIQLGVNESLYDTSVVISSMVSCIVARVGPHSDIANLAKHSSVPVINALCDTFHPLQAIADFLTIHESFASQSATHGTHPSSLGLEGLKIAWVGDANNVLFDLAIAATKMGVNVAVATPRGYEIPSHIVELIQKAREGVQSPGNLTQTTVPEVAVKDADVIVTDTWISMGQETEKIKRLEAFKDFKVTSELAKRGGAKENWKFMHCLPRHPEEVSDEVFYSERSLVFPEAENRLWAAISALEAFVVNKGKIA

SEQ ID NO: 20153 - protein, 467 aa, Legionella pneumophila subsp. pneumophila str. Philadelphia 1
MELMAEYLTLHQQHKNNPYPSLSERKKLLIAIKKILQTEAYTLAEAINKDFTHRSVEETLFLEVFPTIKAINFCLKNMKKWMRKRRRNVSWLFIPAKAYVIPQPLGVVGIMVPWNYPVYLALVPAIYALAAGNRVMIKMSELSPHIGDTLLKLMHAAGLNHSIRVINGDIELSKQFASLPFGHLMFTGSTNVGKMVMKAASDNLIPVTLELGGKSPAILSPTMNPAYFKRLFMGKLFNAAQTCIAPDYLLIPKGWEDRVEREFRKFINAFYPDLMSNEQYSSIISERHKKRLLDLVEDARSKGARVVEFGHSIPNCSKLPVFLLFDITNDMLVMKEEIFGPILPVLTYNSINDAVDYINSSPNPLALYYFGEDKSEIKIIQTKTLSGALTINETLMHIAIDDLPFGGVGHSGMGHYHGKEGFDTFSKLKPVLVQRFISTVSWLYPPYGALMRMFLAWVGGIKLKEKS

SEQ ID NO: 20154 - protein, 319 aa, Triticum aestivum
NLSPGVSIDEKKIVSSTGALALTEIPKKLVVIGAGYIGLEMGSVWNRLGSEVTVVEFAPDIVPSMDGEIRKQFQRMLEKQKFKFMLKTKVVGVDTSGSGVKLTVEPAAGGEQTVIEADVVLVSAGRVPYTAGIGLDAIGVETDKGGRVLVDNRFMTNVKGVYAIGDAIPGPMLAHKAEEDGVACVEFIAGKEGHVDYDTVPGVVYTHPEVASVGKTEEQVKASGVAYQVGKFPLLANSRAKAIDDAEGMVKVISEKETDRILGVHIMSPGAGEIIHEAVLALQYGASSEDIARTCHAHPTVSEALKEACMNTYDKAIHM

SEQ ID NO: 20155 - protein, 676 aa, Ralstonia solanacearum GMI1000
MRCTTPDRPSTTGSCKAARYNRILVLIPLAQFFVIRFDDLVLQRGTKVLFDHASATLNPGERAGLVGVNGSGKSTLFALLRGELHADGGEVAIPPTWQIAHVAQETPAVERSALDYTLDGDTRLRDIERRLADAEARHDGHAQAEAHAAFADADGYTAPARAQALLLGLGFTMAQTQQPVASFSGGWRMRLNLAQALMCPSDLLLLDEPTNHLDLDAVVWLEDWLARYPGTLVMISHDREFLDAVCNVTLHIEHCKLKRYGGNYTQFETQRLQQMALQESAYARQQKQIAHLESFITRFKAKASKAKQAQSRVKALERMERLAPVHAAAGFAFEFREPDAAPNPMLTFEGVDCGYPGAETPITILERLTFSIQTGQRIGLLGANGQGKSTLVKTLADTLAPLDGSIRRGKGLQIGYFAQHQLETLDDHASPLLHLARLAPDVREQELRDFLGSFNFRGDMATAPIAPFSGGEKARLALALIVWQRPNLLLLDEPTNHLDLDTREALTMALAQFDGTLILVSHDRHLLRATTDQFLLVGQGTVAPFDGDLDDYRDWLLRQAAAKRAAASTPAAAGTGDAAPAVNRRDQKREEAEQRQRLAARRKPLQKDVDTVEKRMAPLQQEKTALEAFLADGAAYEDTNKARLMESLRRQAEVNTELDQLEARWLALQEQLEQIG

SEQ ID NO: 20156 - protein, 289 aa, Oryza sativa Japonica Group
MAPMAGGGGVPWGDRARVVGAQIRSRFRVGVAPVDRRWLWRRGDGRVASEAVRQWTERVRSLWQREKSTDQISSSPGTSQVAAAAKPSSSALRFYRKKVGKEVDGIEDSVIFRSLQALAVPLIGNACHIFMHGLNSVQIYGAEKLQQALQERPKGKPLLTVSNHVAAMDDPFVIASILPPSVMLEAQKLRWTLCASDRCFTNPILSTFFRSVKVLPVSRGDGIYQKGMDMALSKLNNGGWVHIFPEGSRSKDGGKTVAPAKRGVGRNAGYNACRKTYSKSRQKGDCGCW

SEQ ID NO: 20157 - protein, 279 aa, Zymomonas mobilis subsp. mobilis ZM4
MEYDFQQVDVFTSGKFKGNPVAVVASADHLSTEEMQSFARWMNLSETTFLLKPTSPDADYRLRIFTPRAELPFAGHPTLGSCHAWLQAGGRPKKSIIIQECQAGLVPIRHENDRLAFAAPPLIRSGDLDKDLLEKIAAGLRIPLSSIQASAWVDNGPGWAGIMLKSREEVLALEPDYASMPDLRFGVIGAWDREKDGTDAEFEVRAFAMGLGVNEDPVCGSLNASMAQWLIGSGLAPKNYIVSQGSLLGRDGRIYVDQIGDSIWIGGATTSNIVGKLRL

SEQ ID NO: 20158 - protein, 186 aa, Glycine max
  misc_feature (30)..(30): Xaa can be any naturally occurring amino acid
TRLRKRVATRLKDSQNTFAMLTTFNEVDMXAVNALQHQPIVNAVIDGDDIIYRDYIDISIAVGTPKGLVVPVIRNADTMNFADIEKQINTFAKKANDGSLSIDEMAGGTLTISNGGVYGSLLSTPIINPPQSAILGMHSIVSRPTVVGGNIVPRPMMYVALTYDHRIIDGREAVFFLRRIKDIVED

SEQ ID NO: 20159 - protein, 354 aa, Glycine max
MASAAAVAAEDDAVNGFTRSEMYSENLAGTVDAYDRHVFLCYKSYVSWPARIEASDADPFPKRVAATFKARKNDLPLKTKITVCEAREEAGFADGDVLIFPDMIKYRGLEESNVDGFFEDVLVNGKPWTAGVPEVFSGSHVYVCAHGSRDVRCGVCGPVLIKKLHEEIELRGLKDQISVTACSHIGGHKYAGNVIIYSPRADGKIMGHWYGYVTPNDVPDLLDQHIAKGEVIQRLLRGQMGPSVADGKEADDQKVANGEETGKVKKNNHVESDNLSSKENVGGCCQGVNGVSCCRSASLEQNKEIEETPETHKKGSKICSNWPQLQQRDIRTAVGVLGAVAVVVVAYKLYRRAA

SEQ ID NO: 20160 - protein, 316 aa, Bacillus cereus ATCC 10987
MSTVQVPKLNTKDLLTLEELTKEEIISLIEFAIYLKKNKQEPLLQGKILGLIFDKHSTRTRVSFEAGMVQLGGHGMFLSGKEMQMGRGETVSDTAKVLSQYIDGIMIRTFSHADVEELAKESSIPVINGLTDDHHPCQALADLMTIYEEINTFKGIKLAYVGDGNNVCHSLLLASAKVGMHMTVATPIGYEPNEKIVKKALAIAEETGAEIEILHNPELAVSEADFIYTDVWMSMGQEGEEEKYTLFQPYQINKELVKHAKQTYRFLHCLPAHREEEVTGEIIDGPKSIVFEQAGNRLHAQKALLVSLFKNVEELS

SEQ ID NO: 20161 - protein, 591 aa, Halobacterium sp. NRC-1
MIMKVRIGVGATDAEASAVAAALAAHVSDDVAVYLGDADEPAAVHEPEPPADDSADADDLGPTEREEVLREEIADILDGGPEKYKQRLPEQDKLFVRDRLALWFGDDDDGDDDLLFEDGRFAHFDGWHPNSPDVDEADDGTRVPADGLITGAADFDGRDLHFMANDFTVKAGSMAERGVEKFLRMQQRALKTGKPVLYLMDSSGGRIDQQSGFFANREGIGKYYFNHSRLSGRVPQICVLYGPCIAGAAYTPVFADFTIMVEGMSAMAIASPRMVEMVTGEQIEMQDLGGPQVHAEQSGSADLVARDEDHARELVADLVQYLPDNSDEKPPSQPAKPPAKPPKGIDGLIPEAPNRAYDMHDLIGRVVDQDSFFELRPEYGAEILTGYARIDGRTVGIVANQPAQRAGAIFPDAAEKAAEFVWKSDAYNIPLLYLCDTPGFMPGSSVEKDAILEKGKKMIYATSEATVPKQSVVVRKAYGAGIYAMSGPAYDPESTIALPSGEIGIMGPEAAINAVYANKLDAIDDPEERKQREQELREAYREDIDAHRMASETVIDEIVPPSELRTELSNRFSFYEDVEKDRPSKKHGTIL

SEQ ID NO: 20162 - protein, 386 aa, Bacillus cereus ATCC 10987
MTSHLFQTYGRRKSEFVKGKGTKVIDHNGKQYLDFTSGIGVCNLGHCHPTVMKAVQEQLHEIWHISNLFTNSLQEEVASLLTENIALDYAFFCNSGAEANEAALKLARKHTGKSLVVTCEQSFHGRTFGTMSATGQNKVKEGFGPLLPSFLHTPFNDIKALEEVMNEEVAAVMIEVVQGEGGVILADLSFLKAIEALCKKFGSLFIIDEVQTGIGRTGTLFAYEQMGIKPDIVTVAKALGNGIPVGAMIGRKELGTSFTAGSHGSTFGGNYVAMAAAKEVLQVSKRPSFLKEVKEKGDYVLQKLQEELRHVECIQNIRGKGLMVGIECKHEVASFIEQLEEEGLLVLQAGPTVIRLLPPLIVTNEELEQAVYMIKKVVCTKNVSII

SEQ ID NO: 20163 - protein, 426 aa, Pseudomonas syringae pv. phaseolicola 1448A
MSKTNESLMQRRHAAVPRGVGQIHPIFAASAKNATVTDVEGREFIDFAGGIAVLNTGHLHPKIIAAVQEQLTKLSHTCFQVLAYEPYVELCEKINAKVPGDFDKKTLLVTTGSEAVENAVKIARAATGRAGVIAFTGAYHGRTMMTLGLTGKVVPYSAGMGLMPGGIFRALYPCELHGVSVDDSIASIERIFKNDAEPKDIAAIIIEPVQGEGGFYVAPKAFMLRLRELCDKHGILLIADEVQTGAGRTGTFFAMEQMGVAADLTTFAKSIAGGFPLAGVCGKAEYMDAIAPGGLGGTYAGSPVACAAALAVLDIFEEEHLLDRCKAVGERLVTALKGIQAKYPVIGEVRALGAMIAVELFEDGDSHKPNAAAVVQVVAKARDKGLILLSCGTYGNVLRVLVPLTAEDELLTRGLAILEECFAEIA

SEQ ID NO: 20164 - protein, 318 aa, Saccharomyces cerevisiae
MSTNSIKLLAGNSHPGLAELISQRLGVPLSKVGVYQYSNKETSVTIGESIRDEDVYIIQTGYGEHEINDFLMELLILIHACKTASVRRITAVIPNFPYARQDKKDKSRAPITAKLIANLLETAGCDHVITMDLHASQIQGFFHIPVDNLYGEPSVLNYIRTKTDFNNAILVSPDAGGAKRVASLADKLDMNFALIHKERQKANEVSRMLLVGDVAGKSCLLIDDMADTCGTLVKACDTLMDHGAKEVIAIVTHGIFSGSAREKLINSRLSRIVCTNTVPVDLDLDIVDQVDISPTIAEAIRRLHNGESVSYLFTHAPV

SEQ ID NO: 20165 - protein, 255 aa, Bacillus cereus ATCC 10987
MSDYIVVKCGGSMLDQLHDVFFDCIKKLQQKYKVVIVHGGGPEIDAKLKDCNINVEKKDGLRVTPKEVMDIVQMVLCGSTNKKLVMNLQKHNLRAVGCSGCDGKLLQVQPVSEEIGYVGEVRYVETALLKGLINMNYIPVIAPVGINDNEIYNINADTAAAGIAAALSAKELIFITDVDGVLHEGKLLKKTDEFEIVNLIEKGVITGGMIPKVQAALASLKMGVQKVSIVNGTKDFTEVTGECIGTTVTRGVSIA

SEQ ID NO: 20166 - protein, 372 aa, Halobacterium sp. NRC-1
MDDGTIETFKAFRSQFNGDRGPYKGGIRYHPGVTRDEVKALSGWMVYKTAVADIPYGGGKGGIILDPEEYSDSELERITRAFATELRPFIGEDKDVPAPDVNTGQREMNWIKDTYETLEDTTAPGVITGKALENGGSEGRVNATGRSTMFAAREVFDYLDRDLSDATVAVQGYGNAGSVAAKLIADQGADVVAVSDSSGAVHNPDGLDTRAVKAFKTETGSVSGYEGATEELSNEALLTMDVDLLVPAALENAIDEDLAHDVDADVVVEAANGPLTPDADDVLTERGVTVVPDILANAGGVTVSYFEWVQNRQRFQWTEDRVNEELEAIITDAFDAMTDAHEDAGTPNLRTAAYVVAVQRVVDAYEGSGSWP

SEQ ID NO: 20167 - protein, 923 aa, Candida albicans SC5314
MSNTPIQGSSSKPNVAAEDYSRSSSRTNISSVRNRSATRMKKNSRPNLKRLGSVSHPQGLVYSVDDDINENDKDDSTKESEPKSDRDYLEGYNDALRALSNRKGRTSSGHLSIAGTPLRSPEEIATIESKLAKDLTDAEEQMRLLEDLDSGPTPNVTDEFVEPEDNNEDAGSIKSTSTVESLNLKERQNAINSTHPFGIKIWKPSLYKKKRSVATRAEEDIHDFDPRKPTARIYWGVKLTNIVWSLTAGLLICLICLLGAAFVFIFSGFAIERKSRPYVKALLKLGHYWLYPFGKFVLLNREQNYLDEDQLEGRTINEFHQWRLQEEGRLFFAPPRRYTGSESTRPLLKDHRGRPLRDAYSSLDDGIQEEEDEQDNDANDIKVRFFGRGDWSFGRIAFYVYFYGIIQPISFFIGILCWLIVFTIPMAKITNTMNDHMRRHPLALDYELEKDYYKRVERTPRKKNQVILLCTYRCCGFHYYKYTIDGTNIFFINLLSVVIFAILDYYFLKETMHWDSWITESNFIFCLSLFSIIPLAYFIGQAVASISAQSSMGVGAVINAFFSTIVEIFLYCVALNQAKGKLVEGSMIGSILGAVLLLPGLSMCGGAFKRKTQRYNPRSAGVSSTMLSYAMVVMFAPSIFYQMYGSYEMKCKDCTSPGVCGRCRFIQPTFVLDSLYSTVIKPFSLIVTVALFAAYVCGLFFTLRTHASLIWATTSHEPKRDDYFRSNSVVSMSTPTQTPKPTTPLPAKPEEDQGGGHDAPNWSRSKSTIILLGATILYAIIAEILVDNVDSILADFPINPKFLGLTVFALVPNTTEFLNAISFAVGGNVALSLEIGSAYALQVVLIQIPCLVLYSIYQNFENVEQTFTLIFPSWDIIATLISIYLFTYIYAEGKSNYFKGVILILIYVVVLSGFWFNDIIDSI

SEQ ID NO: 20168 - protein, 380 aa, Halobacterium sp. NRC-1
MNFSTRVTSVEPSATLAVSTLASELEADGVDVVDLSVGEPDFDTPESIVDAGKAAMDAGHTGYAPSNGVPELRDAIAEKLQGDGLDYEAGNVIVTPGAKQALYETFQAVVDEGDEVALLDPAWVSYEAMAKLAGGELNRVDLAPHDFQLEPALDDLADAVSDDTELLVVNSPSNPTGAVYSRAAMEGVRDLAVDHDITVISDEIYQRVNYGPAHVSLAGLDGMFERTVTINGFSKAYSMTGWRLGYLAGPEALVDQAGKVQSHSVSSAANFIQRAGVEAIRHTDDAIDEMVAAFESRRDLLVDLFAEHGTDVSTPDGAFYLMLPVADDDQAWCQDALKDAHVATVPGSAFGAPGYARLSYAASTDRLEAAVDRLAAEGYL

SEQ ID NO: 20169 - protein, 133 aa, Halobacterium sp. NRC-1
MTRLGLVVAEFNRSVTERMEAAAREAAADADAAITDTVHVPGAYDSPLAADRLARRDDIDAVAVVGAIVTGDTDHDHVIASATADTLTDVSLERDTPVTFGVSGPGMSGAEARERVEKGAAAVESAVSLTQEL

SEQ ID NO: 20170 - protein, 297 aa, Azoarcus sp. BH72
MAASAAPPRSRASLRRVHTIKPLSMKHPIFESLGDNYPFHLEAQFDRILVKMEQLWDTPQIHDYFSDLLIDKRGGRKGFPLEVLNEIIFLREYREVATFRAAERKEQAIHELARRGIALKSEDFLHAVREGDPEIIDLFVRSNFGVNLPDEDGTPPLLIALKSGYTIVAKILLDAGADPNAKDRLGLTPLLVACGSTTQGYQLIAERLIKKGAFVNVRDALGNTPLLLALAGGAPDVAKLLIEHGADVGARTRKGETALSLAGQIAAEAQRAEILALLASKGVKADAAAAASPPKPQ

SEQ ID NO: 20171 - protein, 667 aa, Lactobacillus plantarum WCFS1
MQTVFLVLLLVAAVVVANAVYARFNQIPVAFLQIGAGLILSLIPLYRNFELEPEIFLFVIISILMFNDGQNTNIRKLSHQFGTTLSLSVVLAIVTILIVGTVTHLLIPEFSLALAFALGAIITPTDAVAVSSITTKVAIPGEVMTTLENESLFNDASGIVAFNLAIAAIVTGKFSVWHGVTNFLYVFAGGIFVGLIIGYIIVAVRIMLIRMRVDTPSVIVPYTLLTPFVVYFLAESLGVSGILAVVATGLIHGVQSDQLRLTTSRLQIVMTTTWSIVASILNGIVFVLLGVSLPSVINHLQQRDTSSVAVLVGLGILLYLIMTFARFLWTRFDLARIRAWDNHEKTRNAFVMGLSGVHGTITLAMAFSLPLTLNGSAFPYRNDIIFVAAVVILTSLMVPTLLLPLTLPKQVVKVTEDELATAKADMVTHAIDLMQARHGNNAGTSKVIAILSGQRVLDGRPKRSQLASLFDATFKVEQTTIDEMVANNEITPQAAEKYMRVASQTRLQNQQTFFERLKLFFRFTLSKWSLSKKARARRKMFRQYRPHGGQSRAELMTRNRQMWQQMRQIEQKPYEAVLAYLADTITADNQQAIGIVRRAYDERHRRLSGERDFQETQNELLIEAFQLEYNFIQTQLANKTFSSELGNQLYEQISTDQLVYLQSINTD

SEQ ID NO: 20172 - protein, 173 aa, Arabidopsis thaliana
MEMLLLSHNSHCLLHSPINSNYLNHLMRHGFGQNMCLDNITNNNNFQHPGVSNTQEYSPFLSVQASAVNNYGLNNHLMQRQDQLHGFDQNMCMMSEIINKNNVLQYPNLSNTVPHEFSSGFNQNTYGNAVGNTSFSQDMFSSYDPSSLLHTSSLPPLHNNSNSYCFSDNSRLL

SEQ ID NO: 20173 - protein, 517 aa, Magnaporthe grisea 70-15
MTLLEFSPWAPAILVPVALIVLYTFLAAPRLKRNGIPLKTPRDSLPFVGNGIVFLQPRQKLFAWFHQREREFGLETYQITVPTLPPGVVISDPVCLEYVFKNETLFNKGAFFKERSDDLFGHGIINVDGEPWRAQRKAGLNFLNTTNLRVLTDVALPRYLNENIGWLKNKADGETVADLQEVFHRITSQLMGKMAYNMEMHAGDDFSVAFDYASGATAERFQNPLWFITEFFTGSRLRRSLAIVKEHGRKIVANATCDRKAAEKLSATLPGVDADSEHDGLEEISGSLIQSLLDCIGDEKLVADAALNYLSAGRDTVAQALTWTSYLLMQHPEAIERIRAETAELISPMDGSAGNHTTLLKPPSAPYTMAVFYETMRFYPPIPFEIKQCVRETTLPDGTFLPASSVVVWCPWAMNRSKAIWGSDVDEFRPERWLSLDGKSFASRSAAEYPVFNGGARMCLGKKMADIIAVQVLPSIVTNFDFRPAYEKQQERVSKSSLTLPMQDGLPVFVKRRDVAR

SEQ ID NO: 20174 - protein, 583 aa, Lactobacillus plantarum WCFS1
METPILARIDQPADLKQLSLPELTQLASELRHVLLNKVSQTGGHVGPNLGVVELTIAFHTIFNSPVDKVVWDVSHQSYTHKILTGRKQAWLDPAHYNDVSGYTTPEESPHDYFNIGHTSTSIALATGMAVARDLEGKTGNVMAVIGDGSLSGGLALEGLNIAATLKSNLIILVNDNGMAIAEDHGGIYQNLRELRETNGTSSHNLFKDFGLDYRYVDDGNDLETMLTTFKEIKDVDHPIVLHVHTEKGHGYQPAITNKEAFHWHVPFDLATGQTLHPNTKETYTDVIHATLADELAAKTPITAITAAVPGTYDLKRFARQYPDRYFDVGIAEQESITFAAGQAQQGLRPIVFHSGTFLQRAYDQLSHDLGINKLPVTIMVAGGRINAGDPTHQGIFDVAMLSNIPNLTYLAPTTKEELQAMMHWALHQNNGPVAIRVPSNDVQSVPLAPDFDATKMHTLHAGQQVALLGVGSLLPLATAVQQQLAEQHIDATLIDPRDISDPDTMTLANLKADHQLVVTVEEASLSGGFGEKVSRYYGNSAMRVLNFGAAKRFNDRETTNELRHEFKLTPDQIVTAITDQLAE

SEQ ID NO: 20175 - protein, 140 aa, Brassica napus
  misc_feature (11)..(11): Xaa can be any naturally occurring amino acid
TEAALSQTCFXVSRNRLVSRSDDETERVELRKQSENEMKRCLTWWDLVWFGFGSVVGAGIFVLTGQEAREEAGPAIVLSYVVSGFSAMLSVFCYTEFSVEVPVAGGSFAYLRIELGDFAAFITAGNILLEGVVGTAAVGR

SEQ ID NO: 20176 - protein, 281 aa, Halobacterium sp. NRC-1
MLLSGSSSQSLAAALAAATGERLGDVTYDSFPDGEQLVTVPPAVDGERAVIVASTPTSDAHIEVLQLQDAARDAGASEIITVLPYMGYARQDDAFDPGQPVSARAVARAISTGTDRVLTVNPHEDGVLECFDVPAAGVDAAPQLAAPLPADLTDPVFLSPDHGATDLATSVRDAYGTGVTDHFQKVRHSGSDVTVEPSEIQTAGRDVVVTDDIVATGTTMSEAITALDDPARVFVATVHPLLAGSARLKLARAGVEAVYGTDTIECAVSEVSAAPAIADAL

SEQ ID NO: 20177 - protein, 675 aa, Xanthomonas campestris pv. vesicatoria str. 85-10
MLEHYGLWLALGCAVLAIVYGIVSARWVVAQPSGNARMQEIAAAIQEGARAYLNRQYLTISVAGAVLFVLVGLFLSWYTAIGFALGAVLSGLAGYIGMNVSVRANVRTAEAARHGIGRAMDVAFRGGAITGMLVVGLGLLGVAGYFAVLQGMGLPLEQNLHALVGLAFGSSLISIFARLGGGIFTKGADVGADLVGKVEAGIPEDDPRNPAVIADNVGDNVGDCAGMAADLFETYAVTVIATMLLGSLTLAETGPYAVLYPLVLGGVSIIASIVGAAFVKVKGGGSIMGALYKGVIVSGVLAALAYWPITQSLMRDNTHGAAALYACALIGLVLTGLIVWITEYYTGTQYTPVQHVASASTTGHGTNIIAGLGISMKSTALPVIAVCAAIWGAFHFGGLYGIAIAATAMLSMAGMIVALDAYGPITDNAGGIAEMAELPPEVRNITDPLDAVGNTTKAVTKGYAIGSAALAALVLFADYTHNLQAANPDQVYAFDLSDHTVIIGLLIGGLIPYLFGAMAMEAVGRAAGAVVEEVRRQFRELPGIMAGTAKPQYDRAVDMLTRSAIGEMIVPSLLPVVVPIIVGLLLGPRALGGLLIGTIVTGLFLAISMTTGGGAWDNAKKYIEDGHFGGKGSEAHKAAITGDTVGDPYKDTAGPAINPLIKIINIVALLLVPLL

SEQ ID NO: 20178 - protein, 197 aa, Proteus sp. LE138
MSIYAFEGVIPVVHPTAYIHPSAVLIGDVIIGAGVYIGPLASLRGDYGRLIVEAGANLQDGCVMHGYTDMDTIVQENGHIGHGAILHSCIIGRDSLVGMNSVIMDGAIIGEESIVAAMSFVKAGFQGQARQMLMGSPAKHVRDISDQDMQWKRMNTREYQDLTVRCRQGLVETTPLTAPEANRPRLRGTTEVKPKGQ

SEQ ID NO: 20179 - protein, 502 aa, Oryza sativa
MRRCPRFAHHLRLRSQLLRLRAEASSWRLPVAAVSSSNLHPEYAKKIGGSDFSHDRQSGKELQNFKVSPQEASRASNFMRASKYGMPITANGGNIARWVKKEGDKVSPGEVLCEVETDKATVEMECMEEGYLAKIIHGDGAKEIKVGEIIAVTVEEEEDIGKFKDYKAPSSAESAAPAESKPQSEPTEPKKEKEQPKAPEPKATKTEESFLSEDRTFSSPIARKLAEDNNVPLSSIKGTGPDGRILKADIEDYLASVAKGAKKETAAAPGLGYVDLPNTQIRKVTANRLLHSKQTIPHYYLTVDTRVDKLIKLRSELNPLQDTSGGKKISINDLVIKAAALALRNVPECNSSWMNDFIRQYHNVNINVAVQTEDGLFVPVIRDADKKGLATIADEVKQLAQRARDNSLKPEDYEGGTFTVSNLGGPFGIKQFCAIVNPPQSAILAIGSAEKRVIPGAEGQFEVGSFMSATLSCDHRVIDGAIGAEWMKAFKGYIENPTTMLL

SEQ ID NO: 20180 - protein, 479 aa, Bacillus anthracis str. Ames
MTTSNTYKFYLNGEWRESSSGETIEIPSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPQGLVNVATGRGSVIGDYLVEHEGINMVSFTGGTNTGKHLAKKASMIPLVLELGGKDPGIVREDADLQDAANHIVSGAFSYSGQRCTAIKRVLVHENVADELVSLVKEQVAKLSVGSPEQDSTIVPLIDDKSADLVQGLVDDAVEKGATIVIGNKRERNLIYPTLIDHVTEEMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNLV

SEQ ID NO: 20181 - protein, 331 aa, Erythrobacter sp. SD-21
MTDPRYDVVAIGNAIVDVMAPCSDELIEELGLAKGGMTLVDTERAKELYDAMGRATEISGGSAANTLAGMAALGAQCAFVGQVAKDQLGDIFAHDIRAVGIDFDTAPRDAEPPTARCLIFVTPDGERTMNTFLGASQFLPPAALDEELIASGGVLYLEGYLWDPEEPRSAMRRAIDVARDAGRKVAFTASESFVIDRHGDDFRALIEEGKIDILFVNEHELASLTGKQDFEAGLDALKGKVPTVVATRSAKGAVAIQDGTRVEVAAEPIDKVVDTTGAGDLFAAGFLTGHTRGEGLETCLRMGAICAGEIISHIGARSEKDLKALVAEKLA

SEQ ID NO: 20182 - protein, 82 aa, Legionella pneumophila subsp. pneumophila str. Philadelphia 1
MSTVEERVRKIVVEQLGVKEEELKNDASFVDDLGADSLDTVELVMALEEEFETEIPDEKAEKITTIQEAIDYIESNLNKEEA

SEQ ID NO: 20183 - protein, 447 aa, Saccharomyces cerevisiae
MVEKDTWKLITATALFTVAVTTITDYAWTSWQAQKQVIAQPKNKNKGGQTKSDTDKYHQYDEQFIRQSLKNNVEFLGEDTIEKLSNQYVVVVGAGGVGSWVVNSLVRSGCRKIRVVDFDQVSLSSLNRHSCAILNDVGTPKVECLRRHMREIAPWCEIDPINELWTLQNGERLTLGNGTPDFIVDCIDNIDTKVDLLEFAYNHGIKVISSMGASAKSDPTKLNVGDLATTEEDPLARVVRRKLKKRGILSGIPVVFSAEKPDPKKAKLLPLPDEEYERGKVDELSALKDFRVRILPVLGTMPSLFGLTITTWILSNISDKPLEPVEGKNRIKVYDGIYQSLAGQMSRVGIPSQRIPLALKDVSYLVEEVFKGKSPISGISTRLTLTKWDPSKPISLQNVVVLTKNEQKVHEDRVLKGKESLQDVYDAKVLKLVSQRFREEAYYSQFR

SEQ ID NO: 20184 - protein, 63 aa, Pfiesteria piscicida
MRGILVDWLVEVHLKYKLKAETLYLTVNLIDRYLEVQQVVHGELQLVGVTAMLIASKYEEIYP

SEQ ID NO: 20185 - protein, 566 aa, Spinacia oleracea
MAPSTLICDTDSWQNLKTHVAEIKKTHLRDLMSDADRCKSMMVEFDGLLLDYSRQNATHDTMSKLFQLAEASHLKDKINQMFNGEHINSTENRSVLHVALRASRDAVINGDGKNVVPDVWQVLDKIRDFSEKIRSGSWVGVTGKPLTNVVAVGIGGSFLGPLFVHTALQTESEAAECAKGRQLRFLANVDPIDVAKNISGLNPETTLVVVVSKTFTTAETMLNARTLREWISSALGPAAVAKHMVAVSTNLTLVEKFGIDPKNAFAFWDWVGGRYSVCSAVGVLPLSLQYGFPIVEKFLKGASSIDQHFHSAPLEKNLPVLLGLLSLWNVSFLGHPARAILPYCQALEKFAPHIQQVSMESNGKGVSIDGVVLPFEAGEIDFGEPGTNGQHSFYQLIHQGRVIPCDFIGIAKSQQPVYLKGEVVSNHDELMSNFFAQPDALAYGKTQEELQKENISPHLVPHKTFTGNRPSLSLLLPSLTAYNVGQLLAIYEHRVAVEGFVWGINSFDQWGVELGKSLANQVRKQLHASRTNGEAVKGFNFSTTTVMAKYLQETSDVPAELPTKLP

SEQ ID NO: 20186 - protein, 279 aa, Bacillus cereus ATCC 10987
MSIQNISFLGAGSIAEAIIGGLLHANVVKGEQITVSNRSNETRLQELHNKYGVKGTHNKKELLTNTNILFLAMKPKDVAEALTPFKEDIHNNLLIISLLAGVSTHSIRSLLQKDVPIIRAMPNTSAAILKSATAISPSKHATKEHIQTAIALFETIGLVSVVEEEDMHAVTALSGSGPAYIYYVVEAMEEAATKIGLKEDVAKSLILQTMIGAAEMLKASEKHPSILRKEITSPGGTTEAGIEVLQEHQFQQALISCITQAAQRSHNLGKTLEQLTKEK

SEQ ID NO: 20187 - protein, 63 aa, Cryptoperidiniopsis brodyi
MRGILADWLVEVHLKFKLVPETLYLTVNIIDRFLQIHKVSRPKLQLVGVTSLLIASKYEEIYP

SEQ ID NO: 20188 - protein, 365 aa, Saccharomyces cerevisiae
MSFFNRSNTTSALGTSTAMANEKDLANDIVINSPAEDSISDIAFSPQQDFMFSASSWDGKVRIWDVQNGVPQGRAQHESSSPVLCTRWSNDGTKVASGGCDNALKLYDIASGQTQQIGMHSAPIKVLRFVQCGPSNTECIVTGSWDKTIKYWDMRQPQPVSTVMMPERVYSMDNKQSLLVVATAERHIAIINLANPTTIFKATTSPLKWQTRCVACYNEADGYAIGSVEGRCSIRYIDDGMQKKSGFSFKCHRQTNPNRAPGSNGQSLVYPVNSIAFHPLYGTFVTAGGDGTFNFWDKNQRHRLKGYPTLQASIPVCSFNRNGSVFAYALSYDWHQGHMGNRPDYPNVIRLHATTDEEVKEKKKR

SEQ ID NO: 20189 - protein, 398 aa, Oryza sativa
  misc_feature (293)..(293): Xaa can be any naturally occurring amino acid
  misc_feature (306)..(306): Xaa can be any naturally occurring amino acid
MAHWSQYREELIQTARTIASPGRGILAADESTGTIGKRFQGIGVENNEANRAAYRELLFTAPNLSEHISGVILFEETLYQKAKDGTPFVDILKKAGIVIGIKVDKGVQNIPGTDGETFTMGLDGLLERCKKYYADGARFAKWRAVLKIGNGCPSDRSILANAEGLAQYAAICQEAGLVPIVEPEILMDGDHDIEVAAAVTEKVLANVYKILETNGLLLEGTLLKPNMVCPGTGCTKKYTPGDIAYYTVRTLARTVPAAVPGITFLSGGQSEEEASLNLSAMNKLDYQNPWNLXLYGRALQASTLKXWKRSPDNVAAAQKFCWNVLKPRANPTWSIEGKKWEGPNLVELFFGGHFQKLKTHLKNFKKIKRGGGVYYFLFLGGWGGFSYLFFFFFVGPLF

SEQ ID NO: 20190 - protein, 523 aa, Glycine max
MTSHIDDNLWIIALTSKCTQENLAWVLLIMGSLWLTMTFYYWSHPGGPAWGKYYTYSPPLSIIPGPKGFPLIGSMGLMTSLAHHRIAAAAATCRAKRLMAFSLGDTRVIVTCHPDVAKEILNSSVFADRPVKESAYSLMFNRAIGFASYGVYWRSLRRIASNHLFCPRQIKASELQRSQIAAQMVHILNNKRHRSLRVRQVLKKASLSNMMCSVFGQEYKLHDPNSGMEDLGILVDQGYDLLGLFNWADHLPFLAHFDAQNIRFRCSNLVPMVNRFVGTIIAEHRASKTETNRDFVDVLLSLPEPDQLSDSDMIAVLWEMIFRGTDTVAVLIEWILARMALHPHVQSKVQEELDAVVGKARAVAEDDVAVMTYLPAVVKEVLRLHPPGPLLSWARLSINDTTIDGYHVPAGTTAMVNTWAICRDPHVWKDPLEFMPERFVTAGGDAEFSILGSDPRLAPFGSGRRACPGKTLGWATVNFWVASLLHEFEWVPSDEKGVDLTEVLKLSSEMANPLTVKVRPRRG

SEQ ID NO: 20191 - protein, 250 aa, Brassica napus
KVYAVEKNPNAVVTLHNLVKMEGWEGMVTIISCDMRFWTAPEKADILVSELLGSFGDNELSPECLDGAQRFLKPDGISIPSSYTSFIQPVTASKLYNDVKAHKDLAHFETPYVVKLHSVARLAPSQPVFTFAHPNFSTKANNQRYKKLRFNLPSDAGSALVHGFAGYFDSVLYKDVHLGIEPTTETPNMFSWFPIFFPLRKPVEVHPNSPFEVHFWRCCGSTKVWYEWSVSSPAPSPMHNTNGRSHWVGL

SEQ ID NO: 20192 - protein, 342 aa, Pseudomonas syringae pv. phaseolicola 1448A
MILVTGGAGYIGAHVALELLEDGHDVVVLDNLCNSSRETLSRVETLSGRQVDFIHGDVRSKATLNRLFARHPVNAVVHCAGLKAVGESVREPLRYFETNVSGSVNLCQAMAQAGVFNLLFSSSATVYGDCEQMPLDENCPLGLPTNPYGHSKMMAEHVMKSVARSDPRWSIGLLRYFNPIGAHSSGLLGESPCNTPNNLLPFLLQVANRRRPALHIFGTDYPTPDGTGVRDYLHVVDLAEGHLKALDRIRSEQGVSVWNLGTGQGYSVLEVVHAFERISGKTVPLIFEPRRAGDIAVCWSDPGKALRELDWRARFNLDSMLTDAWRWQCMNPQGYMPTALVS

SEQ ID NO: 20193 - protein, 535 aa, Pseudomonas syringae pv. phaseolicola 1448A
MTILQTRINARSPEFALNRTTLLKQVEELRMLLSIVRQGGGPKAQERHTSRGKLLPRERINRLLDSGSPFLEIGQLAAHQVYGEEVPAAGVIAGIGRVEGVECMIIANDATVKGGSYYPLTVKKHLRAQTIAQQNRLPCIYLVDSGGANLPRQDEVFPDREHFGRIFFNQANMSAQGIPQIAVVMGSCTAGGAYVPAMADEAIMVRQQATIFLAGPPLVKAATGEIVSAEDLGGADVHCRTSGVADHYADSDEHALALARRSIANLNWRKRGQLNTVTPIAPLYASDDLYGIIPADTKQPFDVREVIARLVDGSLLDEFKALFGTTLVCGFARLHGYPIAILANNGILFAEAAQKGAHFIELACQRGIPLLFLQNITGFMVGQKYEAGGIAKHGAKLVTAVACAKVPKFTVIIGGSFGAGNYGMCGRAYDPRFLWMWPNARIGVMGGEQAAGVLVQVKCEQAERAGQAFSAEQQAELKQPILDQYEHQGHPYYSSARLWDDGVIDPAQTRDILALALSASLNAPIEPTTFGLFRM

SEQ ID NO: 20194 - protein, 192 aa, Synechococcus sp. CC9311
MIQMKSFDQVPDVVFHTRVRDESVGGTNPFVWKDRSSAEIFHNKKVVLFSLPGAFTPTCSSNHLPRYEELYDEFRSQGVDQVICLSVNDAFVMFQWGKHIGVKNIFLLPDGNGEFTRKMGMLVSKDNLGFGMRSWRYSMLVDNGTIEKIFIEPGFADCCPDDPFEVSDADTMIAYLKGSTSSGIAKPNDFVG

SEQ ID NO: 20195 - protein, 515 aa, Idiomarina baltica OS145
MSKDFILPDIGEGIVECEIVEWLVAEGDTVKEDQPVVEVMTDKAMVEIPAKDDGVVEKLYYQKGDIAKVHEPLFRINAEGDASDDAAPASDDAAPASSDDAETTDFILPDIGEGIVECEIVEWLVSEGDEVKEDQPVVEVMTDKATVEIPAKEDGKVVKLYHKKGDIAEVHKPLFALQPAGGVEPSKQTKDSAQAQQKNTPSQSADGGAEPAQPARQGKAVASPAVRRLARENSINIADVPGSGKKGRVLKQDIKDFVAGDKSASQASTQQQTTTPAQQSGGTRTEAIRGVKAAMAKQMMNSVSTIPHFTYSDEFDLTNLIALREKLKEQYKEQGVRLTVMPFFIKALSLALKEFPIMNAQVNDDCTEVTYFDDHNIGMAVDTKIGLLVPNVKQVQNKSIIDVANEVTRLTQAAREGKVPQADMKGGTISISNIGVIGGTVATPIINKPEAAIVALGKVQELPRFDANGQVVARKMMTVSWSGDHRIIDGGTIARFNKRWQEFLEDPTSMLVNMV

SEQ ID NO: 20196 - protein, 135 aa, Burkholderia thailandensis E264
MSYSNKVLDHYENPRNVGSFAKDDDAVGTGMVGAPACGDVMKLQIRVGENGVIEDAKFKTYGCGSAIASSSLVTEWVKGKTLDEALAIKNTQIAEELALPPVKIHCSILAEDAIKAAVADYKKRHETAEDGKAAA

SEQ ID NO: 20197 - protein, 315 aa, Synechococcus sp. CC9311
MDKGVAAVLTSLSGRDYLSSADVSAEETQALLDLARQLKSGDRRIDLGNRVLGLIFTKASTRTRVSFQVAMARLGGQTVDLNPQVTQLGRGEPLEDTARVLSRFCDALAVRTFAQQELVDYAYWASIPVINALTDLEHPCQALADFLTMQEAFGDLQGQTLAYVGDGNNVAHSLMLCGALLGVNVRIGCPDGFEPLPGVLDQARALAVSGAQIEVTSNPVAAVQGAQALYTDVWASMGQEQEQAEREQAFKGFCLDEALLAEADPKAIVLHCLPAHRDEEISAGVMESASSRIFDQAENRLHAQQALLAVLLGGL

SEQ ID NO: 20198 - protein, 367 aa, Bacillus licheniformis ATCC 14580
MEQYQCHSCRTKYNVSEQVWKCQCGGVLDLVKEKVEWSDSKVLKDIPSMWRYIEAMPFDRDSAIWSGITMGEGYTPLIVLDSGEPNTLVKVDYMMPTLSFKDRGAAVLIAKAKELGVKHVIADSSGNAGTSIAAYAKRAEIACDIFLRKGTSPKKIAQAKAHGANVREIEGTREDVAEAAQKAVDIEKKFYASHVFNPYFYEGTKTYAFEIWEQMNGAPDTLIIPVGNGTLLLGVYYGFKELLENKCIDKMPRLVAIQAENCAPLAKAFINNQKAAEPVKSSGTLAEGIAIAKPARSAQILETIRATNGQIITTNEEEILKARTALASKGFYVEPTTAANYAGYLKYSHSSDEKIVIPLCGAGIKSN

SEQ ID NO: 20199 - protein, 239 aa, Idiomarina baltica OS145
MLLSMIDIIVLLFFFVCWIGYSLFARKRAKTTHCLSSILCELRIDWMRNVMHKDNQIADASLIGNVERTVTFFASSTILVLAGVITVLAHADQLVNVLNELPLTPTAHVNMVQFKLAVLALIFIYAFFKFTWAIRQFGFVSVLLGVSVNYQQNQRPEEEREEFARHAAKVLDQSGHEYNKGLRTYYFALAYMSWFLHPVMLVISSAIVVWVLYRREYKSRVLRDLLATKGFVPGKKVKE

SEQ ID NO: 20200 - protein, 409 aa, Erythrobacter sp. SD-21
MSEIATLSHVSAQKADFPGLVTPEGEVWHYLDTAASAQKPQSVVDAMSRALGRDYATVHRGVYGRSAQMTLGYEAARRRVAEFIGATSDHEVVFVRGATEAINLVAATWGMTRLGEGDRIILSTLEHHSNIVPWQMLAERTGAQIEVCPLTPDGQIDLGGLEALLTPRTKLVSLAHISNVLGSVLDARKAANLAHSVGAKILLDGCQAAPRMALDMAELDCDFYAFSGHKLYGPTGIGVLWAREELLEHMPPYQGGGAMIETVAFGGTTYAPPPQRFEAGTPMITEAIALHAAIDYVDALGPDKLFAHEAGLARTLRDELRKLNAVTLFGPEESAGIVSFALDGVHPHDLGTILDEEHVAIRAGHHCAQPLMAHLGIPATARASFGLYSDESDIDALLRGIERTRRIFG

SEQ ID NO: 20201 - protein, 444 aa, Coccidioides immitis RS
MSHLPIEPEFEQAYKELAFSLENSTLFEKHPEYRKALQVASIPERTIQFRVTWENDKGESRKSLINFPFFLGGWEQQLEVNRGYRVQFNSALVNMGGGKGGADFDPKGKSDNEIRKFCSAFMMELSKHIGADIDVPAGDIGVGGREIGFLFGAYKRQRHIWEGVLTGKGLSWGGSLIRPEATGYGLVYYVQHMIEYATNGQESFKGKRVAISGSGNVAQYAALKVIEFGGTVISLSDSKGALVIRNEGDSITPQEIYEIQQLKDQRKQLSALADAPHFKDRCVYIEGARPWLHVGQVDVALPCATQNEVSGPEALGLIQSGCKYIAEGSNMGCTLAAIEHFEAHRQLHKKGGAVWYAPGKAANAGGVAVSGLEMAQNSQRLTWTAEEVDQKLKNIMKVCFETGVRTSETYTALSEGQLPSLVIGSNIAGFIKVAEAMRDHGDWF

SEQ ID NO: 20202 - protein, 569 aa, Xanthomonas campestris pv. vesicatoria str. 85-10
MRRVPVLLVSALALLAPPLGAADRVTGQPFATRSEVIAPHAMAATSQPLATQIALDVMKDGGSAVDAAIAANAALGLMEPTGNGVGGDLFAIVWDPKTHKLYGYNGSGRSPKSLTLAEFQRRGLKDIPPTGPLPVSVPGAVDGWFALHARFGRKPMAQNLAPAIRYAREGHPVAETIAYYWDRSVPRLSQYPGFKEQFTIDGHAPRKGELWKNPNLANTLQQIADGGRDAFYEGEIARTIGAYFKANGGYLSYEDLASHTGEWVEPVSTNYRGVDVWELPPNSQGIAALQMLNILEGYDFSKIPFGSAEHVHLFTEAKKLAFADRARFYADPAFQPAPLARLISKDYANQRRALISMDKALKEVQPGTPRQLEEGDTIYMTVADADGMMVSLIQSNYRGMGSGMAPPGLGFILQDRGEMFVLKKDHPNGYAPGKRPFQTIIPAFVTKDGKPWLSFGVMGGAMQPQGHVQIVMNLVDFHMNLQEAGDAPRIQHEDSTEPTGQATAMRDGGEVNLETGFSYDTIRALMRKGHRVIFADGPYGGYQAIARDAASGVYYGASESRKDGQAAGY

SEQ ID NO: 20203 - protein, 219 aa, Corynebacterium efficiens YS-314
MVKVDKDIDLLILGPLACGITTGAGAVFNTAQPQPGESIVIIGAGAVGLGAIMAARNTPAAKIIAMDLQDSRLELARDLGATHTVNTGDRDIVDAVTEICGGPADYVLDCTGSIRVIEQAADAVGLMGTFILVGGAPAEARFSLDHMRTLFDKTVVGTLGGSSNSLTLIPALIDLYKQGRFPFDRLITTYSFDEIDTAIHDAHEGGTIKAVLEVSPTHG

SEQ ID NO: 20204 - protein, 209 aa, delta proteobacterium MLMS-1
RGRNTLELRFPEIYQQLLSISRHLVYDKRWNAQEIEFTFEGPRTEDLYLLQTRDMITIKKKESFNVFADADTAEAAVTAHGVGVSGSAISGLVVFNAEDIARLRAERPEAQLILIRQDTVPDDIKEIAAADGLLTARGGQTSHAAVVATRLEKTCVVGCSQLKVFETEQRCEINGFTFQCGDHLSIDGRKGLVLQGDHPTRKEMQILPL

SEQ ID NO: 20205 - protein, 581 aa, Nicotiana tabacum
MGNTCVGPSISKNGLFQSVSAAMWRTRAPDDSGSTTNGDSARGETTESGKDPDLVVQNKPPEQITMPKSEQKEEEPAKKEEGPVKPKKPVEMKRVGSAGLRTDSVLQKKTGNLKEFFSIGKKLGQGQFGTTFKCVEKATGKEYACKSIAKRKLLTDDDVEDVRREVQIMHHLAGHPNVISIKGAYEDAVAVHVVMEYCAGGELFDRIIQRGHYTERKAAELTRTIVGVLETCHSLGVMHRDLKPENFLFVNQKEDSLLKTIDFGLSIFFKPGDRFNDVVGSPYYVAPEVLKKRYGPEADVWSAGVIVYILLSGVPPFWAENEQGIFEEVLHGDLDFSSDPWPSISEDAKDLVRRMLVRDPKKRLTAHEVLCHRWVQVDGVAPDKPLDSAVLSRMKQFSAMNKLKKMALRVIAESLSEEEIAGLKEMFRMIDTDNSGQITFEELKVGLKRVGANLKESEIYDLMQAADVDNSGTIDYGEFIAATLHFNKIEREDHLFAAFSYFDKDGSGYITADELQQACEEFGIGDVHLEDMIRDADQDNDGRIDYNEFVAMMQKGNPVIGGGKKGLEHSFSTGFREALRL

SEQ ID NO: 20206 - protein, 517 aa, Mycosphaerella graminicola
MGLLQEVLAQFDAQFGQTSLWKLVGLGFLAFSTLAILLNVLSQLLFRGKSSDPPLVFHWVPFIGSTITYGIDPYKFFFSCREKYGDVFTFILLGKKTTVCLGTKGNDFILNGKLKDVNAEEIYSPLTTPVFGKDVVYDCPNSKLMEQKKFVKYGLTTSALQSYVTLIAAETRQFFDRNNPHKKFASTSGTIDLPPALAELTIYTASRSLQGKEVREGFDSSFADLYHYLDMGFTPINFMLPWAPLPQNRRRDYAQKKMSETYMSIIQKRRESKTGEHEEDMIHNLMQCKYKDGNAIPDKEIAHMMIALLMAGQHSSSATESWITLRLASRPDIQDELLQEQKDMLGVNADGSIKELTYANLSKLTLLNQVVKETLRIHAPIHSILRKVKSPMPIEGTAYVIPTTHTLLAAPGTTSRMDEHFPDCLHWEPHRWDESPSEKYKHLSPTTALGSIAEEKEDYGYGLVSKGAASPYLPFGAGRHRCIGEQFAYVQLQTITATMVRDFKFYNVDGSDNVVGT

SEQ ID NO: 20207 - protein, 287 aa, Vitis vinifera
  misc_feature (33)..(34): Xaa can be any naturally occurring amino acid
  misc_feature (79)..(79): Xaa can be any naturally occurring amino acid
  misc_feature (137)..(137): Xaa can be any naturally occurring amino acid
MEGKEEDVKLGANKFTERQPLGTAAQTDKDYKXXPPAPLFEPGELKSWSFYRAGIAEFMATFLFLYITILTVMGVKKSXTMCASVGIQGIAWAFGGMIFALVYCTAGISGGHINPAVTFGLLLARKLSLTRAIFYIXMQCLGAICGAGVVKGFEGSQSYEVLGGGANVVNSGYTKGDGLGAEIVGTFVLVYTVFSATDAKRNARDSHVPILAPLPIGFAVFLVHLATIPITGTGINPARSLGAAIIFNREHAWDDMWIFWVGPFIGAALAAMYQQIVIRAIPFKSRA

SEQ ID NO: 20208 - protein, 372 aa, Xanthomonas campestris pv. vesicatoria str. 85-10
MPDSGRPSAQEPEVGDVAVSVADVLAAQARLRKYLSPTPLHYAERFGVWLKLENLQRTGSYKVRGALNALLAGLERGDERPVICASAGNHAQGVAWSAYRLGVQAITVMPYGAPQTKIAGVAHWGATVRQHGNSYDEAFAFARELADQNGYRFLSAFDDPDVIAGQGTVGIELAAHAPDVVIVPIGGGGLASGVALALKSQGVRVVGAQVEGVDSMARAVRGDLREITPVPTLADGVKVKIPGLLTRRLCSSLLDDVVIVREAELRETLVRLALEEHVIAEGAGALALAAGRRVSGKRKCAVVSGGNIDATVLATLLSEVRPRPPRKPRRRNTERLRNERSANPPPATHVHSRPSAVASTPVTAIAVEESSW

SEQ ID NO: 20209 - protein, 373 aa, Arabidopsis thaliana
MTLQSSPMSVLTEDLVEDILSRVPATSLVRLRSTCKQWNAILNDRRFIKKHFDTAEKEYLDMLLRSLRVSSMSVNLHGLHDNIDPSIELKRELNLKGLLCNSGKVESFEVFHCNGLLLFTNTSTIVVWNPCTGQTKWIQTESANTRYHKYALGYENKNLCRDYKILRFLDDGTNFELEIYEFNSSSWRVLDSVEIDFELDIGSQGMSVKGNTYWIVIDDHEVDGELVNCFLTSFDFTRERFGPHVCLPFQTSWYSDVISLSSVREERLSVLFHEEDSLTMEIWVTNDITDTIVTSWSKFLRVDLYTHRFYNGVTFFIDEENKAAVFSEDVPDDSDDIHSIVYIIGQDRLRIVDLEDGPFWPQMFCYVPSLVQI

SEQ ID NO: 20210 - protein, 182 aa, Populus trichocarpa x Populus deltoides
MASSSMISSAAVATVHRTPAQANMVAPFNGLKSTAAFPVSTRKANDITSIASNGGRVQCMQVWPPTGLKKFETLSYLPDLTEEELAKEIDYLLRSKWVPCLEFELEKGWVHREHHSSPGYYDGRYWTMWKLPMFGCTEASQVLVELGEAKKAYPNAFIRIIGFDNTRQVQCISFIAAKPKGV

SEQ ID NO: 20211 - protein, 397 aa, Glycine max
MACPAMANGNDSLNLKPSETKGKTITCKAAVAYGPGEPFVVENILVHPPQKMEVRIKILYTSICHTDLSAWRGVSEAQRAYPRILGHEASGIVESVGEGVSEVKEGDIVVPIFNGECGECTLCKCEKTNKCEIYGVNPMKKVMEGDGTSRFSTVHGKPIFHFLNTSTFSEYTVVDSACVVKFVSTDHSLSIKNLTLLSCGVSTGVGAAWNTANVHSGSTVAVFGLGAVGLAVAEGARARGASKIIGVDINPDKFIKAMGVTNFINPKDEEKPVYERIREMTDGGVHYSFECTGNVDVLRDAFLSAHEGWGLTVVLGIHASPTLLPIHPMELFDGRNIVGSVFGGFKGRSHLPHFAKQCGQGVVKLDNFITHELPLEEIDKAFDLLITGKSLRCLLHF

SEQ ID NO: 20212 - protein, 1036 aa, Coprinopsis cinerea okayama7#130
MANVEDPLSSGRILRRAPNLHDGTLVKELESTHRPSHRRQTSIRASIRRRFEEVRDGVLSRSRSLNGRSIRPAGQHDSTPANAEETPRKVHSRSLSELNCAPPQPVSIVSVSPRATDDFTAHQRTLSTVSERSFMTSTAAPAPPRPNTHPDSKESGDMVVPHLLQLGTPMTKVSAKKHKKFVFRLDPDLGQIVWESKKHKIIPIENIKEIRSGRDARYYREQFQLAQEYEDRWLTIVYILDGNYKTIHLIVATRDVFRMWDSTLRQLHAIRQELMSGLGNLEVRQALWEKQYWKGADEEQDQRLTFEEVEKLCKRLNINSSQEDLRRLFQQADVRGRGFLEFDDFRKFVKLLKTRPEIRRLYNKLKGRTLDVFDFSTFEIFMREKQQSELTTDELKGLFSKYTGSQPAMSLDSFTTFLLSPDNSAFLDQHLKIYHDMTRPLPEYFISSSHNTYLVGHQLVGDSTIEGYIRALLHSCRSVEVDIYDGDVEPMIFHGKTLTSKVPLRTVCEAIKKYGFVASPYPIIISAEVHCSVPMQDMIAEIMIEVFGDSLIREPLEGRTKIDVLPSPEELKGKILMKTKNLMLTFNDTSDGDSSSTDPSASSASASETEFFDHIYSVPAEKKVGVHDKHESKGPLAKVGSNVLQRVKSIAKPSTSGPKPLRMHSAPEVPLNSPVVSPTASNQTHRRHSEYDRPKPKMSFALVALLVYTVGVKWRGLNKKEEYAPEHMFSLSENTANKLLKMGMMDLIKHTRTHLVRIYPKGTRVTSTNFLPHRFWASGAQLVAINWQTFDLGYMINHAMFQRNGRSGYVLKPAALRSPNKDELTKKTHHVFQVSIISAQQLPRPKNALGHEMPRSHLNPYVEVSLYVPDWPTLSTPGSTNGGVSRGNSTRLAAAITSPRKKRSGTFSPVAAAFPNPADAIAPLSPIPPVPSSIPGKTISRKTGVVKNNGFNPIWEEKLQLPFECVGDMMDLVFVRFVVKCQDAKEGDEPLAVYCASLGSLGRGYRHLPLHDSQLSQFLFSTLFVRINVLDISPSP

SEQ ID NO: 20213 - protein, 187 aa, Yersinia pseudotuberculosis IP 32953
MTVSASKTAQQLKYIKDSIKTIPDYPKAGILFRDVTSLLENPKAYSASIELLSEHYSESGVTKVVGTEARGFLFGAPVALALGVGFVPVRKPGKLPRETISESYELEYGTDTLEIHTDSIQPGDKVLVVDDLLATGGTIEATVKLIRRLGGEVVHAAFIINLPELGGEARLTQQGIHCYSLVSFDGH

SEQ ID NO: 20214 - protein, 151 aa, Glycine max
  misc_feature (16)..(16): Xaa can be any naturally occurring amino acid
  misc_feature (84)..(84): Xaa can be any naturally occurring amino acid
TASGGALVAKGDLGAXLPFEEGPLLQEEIINLCRNMGKGVIGATNILKSIIVHPTSTRAKVLDFAIAVPEGSDGIMLSGETAYXKFPLKAVKVMHTVTLPTETSIPSGQMPPYIGPMLKNHISEMFAYHATIMSNTFGTLTVVFTKTGFMA

SEQ ID NO: 20215 - protein, 326 aa, Streptomyces coelicolor A3(2)
MTWLITGGAGYIGAHVVRAMTEAGEKAVVYDDLSTGIAERVPDGVPLVVGSVLDGERVARALADHSVTGVVHLAAKKQVGESVDLPLHYYRQNVEGLRVLLDAVTAAGVPSFVFSSSAAVYGMPDVDLVTEETPCVPMSPYGETKLAGEWLVRATGRATGLATASLRYFNVAGAASPDLVDTGVYNLVPMVFEKLTESAAPRIFGDDYATPDGTCVRDYIHVVDLAEAHVAAARALQSSPGTALTLNIGRGEGVSVREMIDRINAVTGCDQPPTVTPRRPGDPARVVASADRAAVELGWKAKYDVEDMITSAWAGWVRLHPEAARD

SEQ ID NO: 20216 - protein, 334 aa, Physcomitrella patens subsp. patens
MDAIRKRASQFRESVAKQQQAVLKTFSGYGSQGDNLIVDEAELQRHQQLEKLYISTKSAKNFQREIVRGVEGIISSGLKQLEVVNKLAEDCRKYAVEGPSSSGSLARAAMHFGTARTQMERERDNMHRSIGTQVLRVKSKEGNPEQDQKLQVAEQKMGELLSAMAILGKEAAAAMTSVEAQQQRQTLQRLISMVQAERAYHQRATEILEQLQEKMISERQRSESTTPASSDTQTPPPSYDDVKVNGGSQHASADVGSKEAKSLYFLAEVMHPFEAEHGGELSLAVGDYVVVRQVSPSGWSEGECRGKAGWFPSSYVEKRGAIPASKVTDAGLAI

SEQ ID NO: 20217 - protein, 329 aa, Yersinia pseudotuberculosis IP 32953
MSLNVKLHPSGIIFTSDGTSTILDAALDSNIHIEYSCKDGTCGSCKAILISGEVDSAENTFLTEEDVAKGAILTCCSKAKSDIELDVNYYPELSHIQKKTYPCKLDSIEFVGEDIAILSLRLPPTAKIQYLAGQYIDLIINGQRRSYSIANAPGGNGNIELHVRKVVNGVFSNIIFNELKLQQLLRIEGPQGTFFVREDNLPIVFLAGGTGFAPVKSMVEALINKNDQRQVHIYWGMPAGHNFYSDIANEWAIKHPNIHYVPVVSGDDSTWTGATGFVHQAVLEDIPDLSLFNVYACGSLAMITAARNDFINHGLAENKFFSDAFVPSK

SEQ ID NO: 20218 - protein, 330 aa, Lactococcus lactis
MEVLMTVLVLGGAGYVGSHAVDMLLKRGYDVAVVDNLVTGHRESVPANVRFYEGDVRDHAFLASVFEKENIEGIMHFCAYSLVGESMQKPLMYFNNNVGGAQVILETMEEFGVKHIVFSSTAATFGIPEKSPISEKTPQKPINPYGESKLIMEKMMKWQSQATDMTYVALRYFNVAGAKDDGSIGEAHKNETHLIPIILQTALGQREFITIYGDDYHTPDGTCIRDYIDMEDLIEAHIKALEYLKAGGQSDQFNLGSSKGYSNLEVLETARKVTGKEIPSQMGERRAGDPDELVADSTKAGEILGWKAQNDLEHIITNAWKWHQSHPKGY

SEQ ID NO: 20219 - protein, 429 aa, Mycobacterium tuberculosis CDC1551
MVAGEFRLLSHLCSRGSKVGELAQDTRTSLKTSWYLLGPAFVAAIAYVDPGNVAANVSSGAQFGYLLLWVIVAANVMAALVQYLSAKLGLVTGRSLPEAIGKRMGRPARLAYWAQAEIVAMATDVAEVIGGAIALRIMFNLPLPIGGIITGVVSLLLLTIQDRRGQRLFERVITALLLVIAIGFTASFFVVTPPPNAVLGGLAPRFQGTESVLLAAAIMGATVMPHAVYLHSGLARDRHGHPDPGPQRRRLLRVTRWDVGLAMLIAGGVNAAMLLVAALNMRGRGDTASIEGAYHAVHDTLGATIAVLFAVGLLASGLASSSVGAYAGAMIMQGLLHWSVPMLVRRLITLGPALAILTLGFDPTRTLVLSQVVLSFGIPFAVLPLVKLTGSPAVMGGDTNHRATTWVGWVVAVMVSLLNVMLIYLTVTG

SEQ ID NO: 20220 - protein, 445 aa, Rhizobium leguminosarum bv. viciae 3841
MAISPFDTLLQKIETRAARAGIIGLGYVGLPLAMAVARSGFAVTGFDIDASKMVALDARRSYIDAVSDEALSAEIDAGRFKATTDFAGLGECDVIIICVPTPLTKHRDPDLSFVEATSRSIAAHLRPGQLVVLESTTYPGTTDDVVKVILEGTGLKSRSDFFVGFSPEREDPGNQHYHTATIPKVVAGDGPEALALMKAFYGAAVSSVVPVSSNATAEAVKLTENIFRSVNIALVNELKTVYAAMGIDVWEVIDAAKTKPFGYMPFYPGPGLGGHCIPIDPFYLTWKSREYELPTRFIELAGEINSAMPRYVVGKLAEALDIRAGKALSRSRVLVLGLAYKKNVADIRESPSLRLIEIIEERGGHADYHDPFVAEIPPTREYQALKGRKSVALTPDAIAGYDAVLVATDHDRVDYAALAKSATLIVDTRNVFNRLGLSADHVIKA

SEQ ID NO: 20221 - protein, 402 aa, Pseudomonas syringae pv. phaseolicola 1448A
MADQGSPRRFARIDRLPPYVFNITAELKMAARRRGEDIIDLSMGNPDGATPPHIVEKLITVAQREDTHGYSTSRGIPRLRRAISNWYKKRYEVDIDPESEAIVTIGSKEGLAHLMLATLDQGDTVLVPNPSYPIHIYGAVIAGAQVRSVPLVPGVDFFDELEKAIRGSIPKPKMMILGFPSNPTAQCVELDFFERVVALAKQYDVLVVHDLAYADIVYDGWKAPSIMQVPGAKDIAVEFFTLSKSYNMAGWRIGFMVGNPELVNALARIKSYHDYGTFTPLQVAAIAALEGDQQCVLDIAEQYRQRRNVLVKGLHELGWMVENPKASMYVWAKIPEAYAHLGSLEFAKKLLAEAKVCVSPGIGFGEYGDDHVRFALIENQDRIRQAVRGIRSMFRADDKLKS

SEQ ID NO: 20222 - protein, 97 aa, Arabidopsis lyrata subsp. lyrata
NKVGLVADGVIRRIVTVLRVGSPDCKAIAATLLTSLAVVEVNKATIGSYPDAISALVSLLRVGNDRERKESATALYALCSFPDNRKRVVDCGSVPIL

SEQ ID NO: 20223 - protein, 97 aa, Arabidopsis lyrata subsp. petraea
NKVGLVADGVIRRIVAVLRVGSPDCKAIAATLLTSLAVVEVNKATIGSYPDAISALVYLLRVGNDRERKESATALYALCSFPDNRKRVVDCGSVPIL

SEQ ID NO: 20224 - protein, 242 aa, Brassica napus
KVSDGTSSLAKTSGSRLDFMESGKSSIYRGSTSSDISDESSCSSLSSTVNKPHKANDLSWEAIQAVRARDGVLGLSHFRLLKRLGCGDIGSDYLSELKGTKCYFAMKVMDKTSLASRKKLLRAQTEREILQSLVHPFLPTLYTHFETEKFSCLVMEFCPGGDLHTLRQRQPGKHFSEQAVKFYIAESLLAIEYLHMLGIVYRDLKPENVLVREDGHIMLSDFDLSLRCLVSPTLVKSTAIES

SEQ ID NO: 20225 - protein, 478 aa, Halobacterium sp. NRC-1
MAREFTLPDVGEGVAEGELVRWLVDEGDTVTEDQPVAEVETDKAQVEVPAPVDGTVQELHWAEGDVVPVGDLFVTFDVDGEASATADDGDESGDEAASATSEASGRTFAPPSVRTLARELGVDLDSVEGSGPSGRITDGDVRAAAEGGEDTTEPATEATSATERVDEDDTAASAGSQEPAGREKTLAAPATRGVARELGVDINDVPAVEQRDGEAFVTAEAVQAYAEGGQAAQGEAGGAATREFVAGGETTEPYRGIRRTIGEQMAESKYTAPHVTHHDTAVIDSLVETRSKLKARAEAEDVKLTYMPFVMKAVVAALKEFPVLNSELREDDEEIALKQDYNIGVAVATDAGLMVPVVEHVDQKSMLEISTEMNDLVEQARERSIAPADMDGGTFTITNFGAIGGEYATPIINYPETAILGLGAIDERPVAEDGDVRAAQTLPLSLSIDHRVIDGAEAAQFTNRVMEYLTDPELLLLE

SEQ ID NO: 20226 - protein, 474 aa, Halobacterium sp. NRC-1
MVVGDISTGTDVAVVGAGPGGYVAAIRAGQLGLDVTLVEKDAYGGTCLNYGCIPSKAMITASGVAHEAGHAEEMGVYADPDVDVAEMVDWKDGVVDQLTGGVEKLCKANGVNLIEGRAEFAGSDKLRVVHGGDGQGSETIEYEHAIVSTGSRPIEVPGFDFGDDPVLDSRQALAMAELPSSMVIVGGGYIGMELSTVFAKLGVDVTVVEMLDGILPQYGDDIARPVRQRAEELGIDFHFGLAADSWTDTDDGIVVTAADEDGEETEFETEKVLVAVGRQPVTDTLNLDAVGLEPNDDGRLETDHEARTDVENVFAIGDVAPGPMLAHKASKEGEVAAEVIAGEPAALDYQAVPAAVFTDPEIGTVGLTEDDAAAQGFDPVVGTFPFNASGRALTTGHDDGFVEVVADEESGFLLGAQIVGPEASELVAELGLAIEMGATLEDVASTIHTHPTLSEATMEAAEHALGHAVHTLNR

SEQ ID NO: 20227 - protein, 270 aa, Halobacterium sp. NRC-1
MDTVTLGPAGTYSHRAASAVSAGDVSFMESVRDIVDAVAVGDADRGVVPIENSIQGSVTETLDALADTDGLAVVREVVTPIRHALLAQDDGFDAVASHAQALAQCREYLDATHPAVDRRAVASTARGVEVARNDETTAAIAHPDSADGTELDVHGSGIQDRASNETRFFVVGPASERTPAGGKSSIIVYPNANHPGLLLELLEPFADRNINLSRVESRPSGERLGDYVFHVDIASGCYEERTRNAVADVAEIAAAGWVRRLGSYDTEHVA

SEQ ID NO: 20228 - protein, 578 aa, Nicotiana tabacum
MGNTCVGPSISKNGIFQSVSAAMWRSRSPDDTASTTNGESARIETPISVKEPDSPLPVQEPPEQMTMPKSEKKEEEKEQPKKPKKPAEMKRVSSAGLRTDSVLQKKTGNLKEFFSIGKKLGQGQFGTTFKCVEKATGKEYACKSIAKRKLLTDDDVEDVRREVQIMHHLAGHPHVISIKGAYEDAVAVHVVMEFCAGGELFDRIIQRGHYTERKAAELTRTIVGVVEACHSLGVMHRDLKPENFLFVDQKEDSLLKAIDFGLSIFFKPGDRFTDVVGSPYYVAPEVLRKRYGPEADVWSAGVIIYILLSGVPPFWAENEQGIFEQVLHGDLDFTSDPWPSISEDAKDLMRRMLVRDPRRRLTAHEVLCHPWVQVDGVAPDKPLDSAVLSRMKQFSAMNKLKKMALRVIAESLSEEEIAGLKEMFKMIDTDNSGQITFEELKDGLKRFGSNLKESEIYDLMQAADVDNSGTIDYGEFIAATLHMNKIERQDHLFAAFCYFDKDGSGYITADELQQACEEFGIGDVRMEEMIREADQDNDGRIDYNEFVAMMQKGNPVLGGGKKGLEHSFSIGFREAVKL

SEQ ID NO: 20229 - protein, 357 aa, Xanthomonas campestris pv. vesicatoria str. 85-10
MSKQILILPGDGIGPEIMAEAVKVLKRIDAQHGLGFELVYDELGGAAYDKYGSPLADETLERARAADAVLLGAVGGPQWDTIDPSLRPERGLLKIRSQLGLFANLRPALLYPQLADASTLKPEVVAGLDLLILRELTGGIYFGQPRGNRTLDNGERQAYDTLPYSESEIRRIAKAGFEMARLRGKKLCSVDKANVLASSQLWRAVVEEVAKDYPDIALSHMYVDNAAMQLVRAPKQFDVIVTDNMFGDILSDQASMLTGSIGMLPSASLDANSKGMYEPCHGSAPDIAGKGIANPLATILSVAMMLRYTFAQADAADAIERAVGKVLDQGLRTADIWSEGTTKVGTVAMGDAVVAAL

SEQ ID NO: 20230 - protein, 569 aa, Erythrobacter sp. SD-21
MLRALPLSLAALALPGCISYTQAGPAAEASAFTGAVSAADPRAEAAGEEILRRGGSATDAAIAVMLALTVVEPQSSGIGGGGFLVRGQADGAATTFDGRETAPAGATPDWFLDEAGEVLPYMESVRSGLSVGVPGNIALAAKAHAAHGRLEWATLFEPAVRLAREGFRINPRLNNSLESAKNRAAFSAEGRALFFDAEGAALPVGTLVRNEALARTFEALAARGPEAFYAGEAARLLATTIAADTPRDGAMTYADIASYDAKERDAVCTPYRAYRICSMGPPTSGGIAVQQILGQLERFDLAALGADNPVTWHLFLESQRLAYADREIYLADSDFVSVPVAGLLDPTYLAERSALISPDRSLADPQAGSPRGAPLALADGDEPVENGTSHFAVADSAGTMVSYTSTIEGAFGSGLMVGGFYLNNELTDFSRSPQVDGRLVANRVEGGKRPRSSMSPTVVYDPEGRPFMVVGAAGGSTIPVTTARAIIGAIDFGLSAEGSLGLPFTMAFGSRVLLEEGTWLESSAEAFRALGHEELIIRAAPIKGGALLHKAGEWQSARDPRLEGQLELP

SEQ ID NO: 20231 - protein, 436 aa, Haemophilus influenzae R2866
MAKIVKVIGREIIDSRGNPTVEAEVHLEGGFVGLAAAPSGASTGSREALELRDGDKSRFLGKGVLKAVAAVNNEIAQAIVGKDATNQAEIDQIMIDLDGTENKSNFGANAILAVSLANAKAAAASKGLPLYAYIAELNGTPGVYSMPLPMMNIINGGEHADNNVDIQEFMIQPVGAKTLREALRIGAEVFHNLAKVLKSKGMSTAVGDEGGFAPNLASNADALACIKEAVEKAGYVLGKDVTLAMDCASSEFYNKENGMYEMKGEGKSFTSQEFTHYLEELCKEYPIVSIEDGQDESDWEGFAYQTKVLGDRVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAAFPGLKAVKGQA

SEQ ID NO: 20232 - protein, 581 aa, Nicotiana benthamiana
MGNTCVGPSISKIGLFQSVSAAMWRTRMPDDSGSTTNGDSARGETAESSKDPNLVVPSKPPEQITMPKSDQKEEEPAKKEEGPEKPKKPVQMKRVGSAGLRTDSVLQKKTGNLKEFFSIGKKLGQGQFGTTFKCVEKATGKEYACKSIAKRKLLTDDDVEDVRREIQIMHHLAGHPNVISIKGAYEDAVAVHVVMEYCAGGELFDRIIQRGHYTERKAAELTRTIVGVLEACHSLGVMHRDLKPENFLFVNQKEDSLLKTIDFGLSIFFKPGDRFNDVVGSPYYVAPEVLKKRYGPEADVWSAGVIVYILLSGVPPLWAENEQGIFEEVLHGDLDFSSDPWPSISEDAKDLVRRMLVRDPKKRLTAHEVLCHRWVQVDGVAPDKPLDSAVPSRMEQFSAMNKLKKMALRVIAESLSEEEIAGLKEMFRMIDTDNSGQITFEELKVGLKRVGANLKESEIYDLMQAADVDNSGTIDYGEFIAATLHFNKIEREDHLFAAFSYFDKDCSGYITADELQQACEEFGIGDVHLEDMIRDADQDNDGRIDYNEFVAMMQKGNPVIGGGKKGLEHSFSTGFREALRL

SEQ ID NO: 20233 - protein, 602 aa, Oryza sativa Indica Group
MELALVGNPSNGVAKPSCNSVGSLPVVSSNAVIHPPVTSAARATLGRHLARRLVQIGATDVFAVPGDFNLTLLDYLIAEPGLKLIACCNELNAGYAADGYARALVGAFVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEYAVEAAADFLNKAVKPVMVGGPKIRVAKAKKAFAIAESSGYPFAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKEMLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 20234 - protein, 559 aa, Zea mays
  misc_feature (365)..(365): Xaa can be any naturally occurring amino acid
TLLDVTSVRPYRPPSAFPTVLSNLAAKPHRTMATFTAASSLSLLFSHPHSHSRQPSAQGPTASSHLRLHPRASRARCASSDTTATKHRRPAEENIREEAARLRGPAQGFSAWYEPFPPAPGGDPNERYSLDEVVYRSSSGGLLDVRHDMEALARYPGSYWRDLFDSRVGRTAWPYGSGVWSKKEFVLPEIDSDHIVSLFEGNSNLFWAERLGREHLGGMNDLWVKHCGISHTGSFKDLGMTVLVSQVNRLRRAPLSRPIAGVGCASTGDTSAALSAYCAAAGIPAIVFLPADRISLQQLIQPIANGATVLSLDTDFDGCMRLIREVTAELPIYLANSLNPLRLEGQKTAAIEILQQFNWQVPDWXVIVPGGNLGNIYAFYKGFEMCRVLGLVDRVPRLVCAQAANANPLYRYYKSGWTEFEPQTAETTFASAIQIGDPVSVDRAVVALKATDGIVEEATEEELMDATALADRTGMFACPHTGVALAALFKLQGQRIIGPNDRTVVVSTAHGLKFTQSKIDYHDKNIKDMVCQYANPPISVKADFGSVMDVLQKNLNGKI

SEQ ID NO: 20235 - protein, 267 aa, Haemophilus influenzae R2866
MNPMLNIAIRAARKAGNVIAKNYERRDAIESTQKGINDYVTNVDKASEAEIIEVIRKSYPDHTIITEETDAIEGKDSDVQWIIDPLDGTRNFMTGLPHFSVSIAVRVKNRTEVGVVYDPIRNELFTAVRGEGAKLNEVRLRVDSKREIQGSILATGFPFKQPKLMPTQFAMMNALIEDAADFRRTGSAALDLCYVASNRIDGYFEMGLKAWDCAAGDLIVREAGGLVCDFDAGNGYLRSGNIIAAPSRIIKEMLNKIRPCLGAEFNH

SEQ ID NO: 20236 - protein, 232 aa, Brassica napus
RPTRPILHSDAAKTLVGSVRFPLVRLVDSEGAMVPESISSLELLRPSGRTQGKIRLKLAIKERPIPPPQRPQSQPRDYYSAPQGNHYYSPSPPPAPITSPYREFSPSPSPSPSPYPFTDHYYSGFYYPPPPPRSMYDRASNYGQPPAPVDLPLAPPRFPQPNGPSAPVEAFQMNEYKPQVGSRLSSYGVPSGPSAPVDYSPYDHRQLQKTMGGLSLEEERGAAERSESDFGA

SEQ ID NO: 20237 - protein, 506 aa, Legionella pneumophila subsp. pneumophila str. Philadelphia 1
MDQVFDVAIIGGGINGCGCAADAALRGLSVILFEQDDLASKTSSSSTKLIHGGLRYLEHYEFGLVKKALQERQTLLNLAPHLVHSQSFVLPYLKHMRPSWLLRLGLFFYDHLSRKNHLPKSRSIHRNNKNNYFTPLKEELNRGFLFYDATTDDARLTILNAIQAKNHGASIRPHAKVTHAEVINNIWHLTIQPTKGQSYKAYAKSIINATGPWVQSIAQLTHTPIQKDITLVKGSHIIVPKLFEGNHAYFLQHNDQRVIFVIPYHGFSMIGTTDIHYTGDLNHIEIGEEEIDYLIELVNAYFKFKITKEDVVHSWSGIRPLLADDSKEVKSLSRDYSYEFNHSPAPIITIFGGKITTYRQLAEEVVDQLTPVFPQMKPSKTQHTPLPGATLADMSFTQYVNYAKTKYHWLDDELLNRYLNTYGCYTEIFLSQCNNMEAMGKKYGPSLYQVEVDYLILEEWANYCDDILNRRTKLGLTMDNASKKELADYLASISTYPSAQAELVFH

SEQ ID NO: 20238 - protein, 488 aa, Burkholderia sp. 383
MQTQLFIDGRFVDAVDRGTIDVLNPHDGSVITKIAAATAADVDLAVEAATRAFPKWSALPAAERGRLLLRLADAIEANAEELAQLESLDTGHPIRDSRALDVPRTAACFRYFGGMADKLQGSVIPVETGFLNYVQRAPIGVVGQIVPWNFPLMFTSWKMGPALAAGNTVVLKPSEITPLSTLRIVELMAEVGFPAGVVNIVPGYGHTAGQRLAEHPGVGKIAFTGSTATGRRIVEASQGNLKRVQLELGGKGANIVFDDADLDAAINGAAWAIFHNQGQACIAGSRLVLHERIADAFLERFVALASSIRIGNPLDANTEMGPLTSKQHLDRVLSFVDVAREQGGRVLTGGSAPQDPALANGYYVRPTVIEAKSAADRVAQEEVFGPFVTVLRFGSDDEALAIANATEYGLGSGLWTKDLSRAHKMASQINAGMCWINCYKRVNPGSPFGGVGQSGYGREMGFEAMHDYTEARSVWVNVDGNVPPHFKR

SEQ ID NO: 20239 - protein, 298 aa, Oryza sativa Japonica Group
MTSGAAAAGRTPTWKERENNKRRERRRRAIAAKIFTGLRALGNYNLPKHCDNNEVLKALCREAGWVVEDDGTTYRKGCKPPPSSAGGASVGMSPCSSTQLLSAPSSSFPSPVPSYHASPASSSFPSPSRIDNPSASCLLPFLRGLPNLPPLRVSSSAPVTPPLSSPTASRPPKIRKPDWDVDPFRHPFFAVSAPASPTRGRRLEHPDTIPECDESDVSTVDSGRWISFQMATTAPTSPTYNLVNPGASTSNSMEIEGTAGRGGAEFEFDKGRVTPWEGERIHEVAAEELELTLGVGAK

SEQ ID NO: 20240 - protein, 513 aa, Mycobacterium avium subsp. paratuberculosis K-10
MIPDPSALNAARRTADLAALAEGEPLDVLVIGGGITGAGIALDAAARGLRVALVEKRDLAFGTSRWSSKLVHGGLRYLASGNVGIARRSALERGILMTRNAPHLVHAMPQLVPLLPSMSRATRALVRGGFLAGDALRFLAGTPASTLPRSQRVSAQRVVQLAPTVRRDGLDGGLLAYDGQLIDDARLVTAVARTAAQHGARILTYVAASRATGTSVRLTDVRGGGSFDVSAGAVINAAGVWAGEIDGSLRLRPSRGTHLVFDAAAFGNPTAALTIPIPGELNRFVFAMPEQLGRVYLGLTDEAAPGPIPDVPEPSVEEITFLLDTVNTALGTALAATDVSGAYAGLRPLIDTGEGRTADVSREHAVVESASGVISVIGGKLTEYRYMAQDVLDRAVRVRRLRAAKCQTRNLPLIGAPANPGITGAPHVALPESLVSRYGAEAAKVVATAGCERPTEPVVDGIDVTRAEFEYAITYECALEVSDIVDRRTRIGLVPRDRERVVAVAEEFLARFG

SEQ ID NO: 20241 - protein, 115 aa, Chlamydomonas reinhardtii
MVEVLAANDQLRNQQKKGKVLQGFHEMPIAFAPTFKFTPGTDRYDLKRTPAWTDRVLYAVHADPLFADLKPLYYMAVPELRTSDHKPVIAGFELSVSPQHANAGRHSKRAGCSIM

SEQ ID NO: 20242 - protein, 409 aa, Oryza sativa Japonica Group
MALHAAPPPPPPFTAGRLPTTSRRPCFSAGRIFRCSLPAAAARPRNAAFLAPLRTSSAARSGSQALPKGWDTAAGVVEIDGTPGTSSSPHVVCFGELLIDFVPTVNGVSLAEASAFKKAPGGAPANVAVGIARLGGSSAFIGKVGDDEFGYMLADILKENNVNNQGLLFDAHARTALAFVTLRNDGEREFMFYRNPSADMLLEEKELDLDLIRKAKIFHHGSISLITEPCKTAHIAAAKAAKDAGVLISYDPNLRLPLWSSADDARDGILSIWETADVIKISEEEVSFLTKGEDPYDDSVIKKLMHPNLKLLLVTEGPEGCRYYSKEFNGRVGGLKVNAVDTTGAGDAFVAGILSQLSVDFSLLQDEGRLKEALKFANVCGALTVTERGAIPALPTRQQVVDALTKVVA

SEQ ID NO: 20243 - protein, 439 aa, Bacillus cereus ATCC 10987
MAVENITMPQLGESVTEGTISKWLVNVGDHVNKYDPLAEVMTDKVNAEVPSSFTGIVKELIASEGDTLAVGEVVCVIQVEGADEVAATAVEEKTKEEPKAEVATPEKAPKAKQPTDGKPRFSPAVLKLAGEHNVDLDQVEGTGANGRITRKDILKLVESGNIPQAGAAKKEEAVAAVVEARPEAPKAAPVAQKVESAKPVSVPTMPGDIEIPVTGVRKAIAANMLRSKHEAPHAWMMIEVDVTNLVSYRNSIKGDFKKREGFNLTFFAFFVKAVAQALKEYPQINSMWAGDKIVQKKDINLSIAVATEDELFVPVIKHADEKTIKGIAREITELAGKVRTKSLKADEMQGGTFTINNTGSFGSVQSMGIINYPQAAILQVESIVKRPVIMDNGMFGARDMVNLCLSLDHRVLDGLICGKFLGRVKEILENTSENNTSVY

SEQ ID NO: 20244 - protein, 336 aa, Oryza sativa Japonica Group
MGGDWQELAQAAVIGLLFAFLVAKLISTVIAFKEDNLRITRSTPTFPSAADTPAAPAPPPASLDGGHGDTSDGSGSDSDSDWEGVESTELDEDFSAASAFVAASAASGTSVPEQAQLQLYGLYKIATEGPCTAPQPSALKLKARAKWNAWHKLGAMPTEEAMQKYITVVDELFPNWSMGSSTKRKDEDTTVSASSSKGPMGPVFSSLMYEEEDQGNDSELGDIHVSAREGAIDDIAKHLAAGVEVNMRDSEGRTPLHWAVDRGHLNSVEILVNANADVNAQDNEGQTALHYAVLCEREDIAELLVKHHADVQIKDEDGNTVRELCPSSWSFMNLAN

SEQ ID NO: 20245 - protein, 361 aa, Mycobacterium avium subsp. paratuberculosis K-10
MSQTVRGVISRKKGEPVELVDIVVPDPGPGEALVDVIACGVCHTDLTYREGGINDEYPFLLGHEAAGRVEAVGPDVTAVQPGDFVVLNWRAVCGQCRACKRGRPHLCFDTFNATQKMTLTDGTELTPALGIGAFADKTLVAAGQCTKVDPAADPAVAGLLGCGVMAGLGAAINTGAVARDDTVAVIGCGGVGNAAIAGAALVGARRIIAVDTDDTKLDWARGFGATHTVNARQADVVAAIQDLTDGFGANVVIDAVGRPETWKQAFYARDLAGTVVLVGVPTPDMTLEMPLVDFFSHGGSLKSSWYGDCLPERDFPTLIELYLQGRLPLEKFVSERIGLGDVEAAFHNMHDGKVLRSVVML

SEQ ID NO: 20246 - protein, 500 aa, Xylella fastidiosa 9a5c
MDGWVVVAVALMVPQARCMMSFACVGLGGEERRGIARDAGIFWCVARGITDTGGVSDGRLPVLAGVGTAWRCSQAVAVIGGRLVGWTLGVYLLPDEPGQWRFVSIKEIEMSIVRMTDLALSGKRVLIRQDLNVPIDQGRITSEQRIIASLPTIRVALERGAAVMVTSHLGRPKEGVWSEEDSLAPVAKRLSQLLGIEVPLRRDWVDGVQVAPGQLVLLENCRMNVGEAENDEALARKYAALCDVFVMDAFGTAHRAQASTHGVICCAAIAAGGPLLMAELDALSRGLEHPVKPLLAIVGGSKVSTKLELLSNLVNNVEQLITGGGIANTFLAAAGYSIGKSLYEGDLIETAREIITAAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 20247 - protein, 501 aa, Xylella fastidiosa 9a5c
MLLWLASVKEAFFMSERQRRTRILATLGPATDPPGVLDALFKAGVNVVRLNFSHGDASDQARRAAEVRAAAAHVGVEIGILADLPGPKIRIGRFTEGKVRLVADARFDLLADSNAPLGDATQVGVSYLGLPQDVAAGDVLLLDDGLMQLQVVQVQGARIVTTVLNDGVLSDRKGLNKQGGGLSLGALTDRDRELIGIVSRMGVDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPMPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEVGADGGVSGLWEL

SEQ ID NO: 20248 - protein, 436 aa, Saccharomyces naganishii
MSVPVYPCNSDKLPKSLAAKCPVIIKGFEKAFGTKPDFVARSPGRVNLIGEHIDYADFSVLPLAIDVDMLLAVKALDDKKPSITLANADSRFSERKFDLPLDGSYVTIDPTISDWSNYFKCGLHVAVEYLKKIAPEKFAKAPVKGLQVYCQGNVPTGSGLSSSAAFICAVALAVIRVNMGDSYEVSKNDLTKITVVAEHLVGVNNGGMDQAASVCGEEDHALYVEFKPELKATPFKFPNLKNTEVTFVIANTLVVSNKQETAPTNYNLRVVEVVAAANILAKKYGVVLKHDGPSNLNKGNLRDFVNAYYAKYMNVAEPWNGEITSGIERLTKMLELVEETFGAKKSGYTVDDAASALGISSEEFTKEYLTSFPVRFDTLKLYQRSKHVYAEALRALKALKVMTGSSFTKDEDFFREFGNLMNESQESCDKLYNCSC

SEQ ID NO: 20249 - protein, 187 aa, Synechococcus sp. CC9311
MTELGMDNLWHQPSIASDAFIAPGAVLMADVTVSSGASIWPTAVARGDMAQIHIGARSNVQEGAVLHGDPTFPVHIAENVTIGHRAVVHGASLEAGCLIGIGAVVLNGVTVGRGALVAAGSVVTKDVPAQTLVAGVPAKVKRELSQEEIKDQWHHADHYAELAAQWSQLLQNQTDCPLLIPASPDCP

SEQ ID NO: 20250 - protein, 111 aa, Saccharomyces naganishii
SHTIVELIENGYNCVIVDNLCNSSYESVARLEVLCKTHIPFYHVDLCDREPMEGIFKENKIDSVIHFAGLKAVGESTEIPLKYYHNNILGTLVLLEMMQRYDVEKLVFSSS

SEQ ID NO: 20251 - protein, 451 aa, Thermus thermophilus HB8
MPKEILMPELAESVVEGEILKWLVEEGDYLKKDQPFVEVMTDKVTVELPSPYEGVLLKKLAKEGEVVKVHAPIALIAEPGEAVEGVKEAPPVQAVEERSIVEPGLPAKEEKEDLSLFKPDPTQVAVKNPFLSGEKPQEGARPGRVLAVPAARKLARELGIPIEEVPGSGPLGRVRVEDVRAYAERRKAPPERPEEGPQVLPAGFPPPPKYAPPKGYEHLEERVPLRGIRRTIAQGLWQSHLYTVRTLNVDEADLTELVRLRERLKPQAEAQGVKLTYLPFIVKAVVRALKKFPMLNTSLDEERQEIVYKRYYHIGLAVATERGLIVPVVRDADRKSVLELAQEIAELSQKAREGRLAPEEVTGSTFTITNIGSVGATLSFPIIHLPDAAILGVHSIRKRPWVMPDGSIRPRDIMFLSLSFDHRLVDGAEAAMFTREVIRLLENPDLLLLEM

SEQ ID NO: 20252 - protein, 480 aa, Bordetella parapertussis 12822
MPVLRRTKIVATLGPATSTPERLDGLIRAGMDVARLNFSHGSAQDHRERVRLVRELAAEQGRFVALMGDLQGPKIRIARFTDQQVTLQAGQPFTLSRSHSKEAGDATIVGIDYPELVQDCRPGDELLLDDGRVVLVVDSVGAEEVHTTVTVGGPLSNNKGINRRGGGLSAPSLTDKDRTDIKLAAEMELDYVAVSFPRYGADIDEARALLRAAGSQAWIIAKIERAEAVADDDALDALIRASDGVMVARGDLGVEVGDAELVGIQKRIIQHARTLNKVVITATQMMESMVASPMPTRAEVSDVANAVLDYTDAVMLSAESASGQYPIEAVAAMARVCLGAEKHPTTTHSHHRLGETFTRCDETIALAAMYAANHFPGVKAIIALTESGHTPLIMSRIRSGVPIYCYSPHGPTQRRAALFRGVYTVPFAPAEYDPADLSNAAIDELKKRGRVAAGDWVILTKGDFYRDSGGTNGLKILKVE

SEQ ID NO: 20253 - protein, 464 aa, Thermus thermophilus HB8
MTPMKTYDLIVIGTGPGGYHAAIRAAQLGLKVLAVEAGEVGGVCLNVGCIPTKALLHAAETLHHLKVAEGFGLKAKPELDLKKLGGWRDQVVKKLTGGVGTLLKGNGVELLRGFARLVGPKEVEVGGERYGAKSLILATGSEPLELKGFPFGEDVWDSTRALKVEEGLPKRLLVIGGGAVGLELGQVYRRLGAEVTLIEYMPEILPQGDPETAALLRRALEKEGIRVRTKTKAVGYEKKKDGLHVRLEPAEGGEGEEVVVDKVLVAVGRKPRTEGLGLEKAGVKVDERGFIRVNARMETSVPGVYAIGDAARPPLLAHKAMREGLIAAENAAGKDSAFDYQVPSVVYTSPEWAGVGLTEEEAKRAGYKVKVGKFPLAASGRALTLGGAEGMVKVVGDEETDLLLGVFIVGPQAGELIAEAALALEMGATLTDLALTVHPHPTLSESLMEAAEAFHKQAIHILNR

SEQ ID NO: 20254 - protein, 561 aa, Salinibacter ruber DSM 13855
MRPFGLALTNPVLPPTFMEQFPAPTLLHDPACHMSDPDDTPADTSSRDDRYDDLERRRAEAAKGGGEERIERQHEKDKLTARERLDILLDDDSFEELGTFVRHQETNFGLDEDRPPGDGVVTGYGTIQGRLVYIFSQDFTVYGGSLGRAHADKIVNVMEKALENGAPVIGLNDSGGARIQEGVKSLGGYADIFKLNTEASGVVPQISAIMGPCAGGAVYSPAITDFTLMVEDSSYMFVTGPNVVKTVTQEEVTANDLGGARTHATKSGVSHLTCSNDVDCLRRIRELVGYLPQNCEEDPPRVPREEVESAHDGDALDGLVPEDPNQPYDMRDVIRHLVDADDFFEIQPDFGENLLTGFSRIGGRPVGIVANQPAVLAGTLDIDASIKGARFVRTCDAFNVPLLVLEDVPGFLPGTDQEWNGIIKHGAKLLYAFCEATVPRITVITRKAYGGAYDVMNSKHIGGDLNFAWPTAEVAVMGPKSAVEIIYRDELDDADDTEAAKDDFVEQYRDRFATPYVAAEYGYVDDVIKPSETRKRLICGFDMLENKVVNNPRKKHGNLPL

SEQ ID NO: 20255 - protein, 515 aa, Mycosphaerella graminicola
MGLLQEVLAQFDAQFGQTSLWKLVGLGFLAFSTLAILLNVLSQLLFRGKSSDPPLVFHWVPFIGSTITYGIDPYKFFFSCREKYGDVFTFILLGKKTTVCLGTKGNDFILNGKLKDVNAEEIYSPLTTPVFGKDVVYDCPNSKLMEQKKFVKYGLTTSALQSYVTLIAAETRQFFDRNNPHKKFASTNGTIDLPPALAELTIYTASRSLQGKEVREGFDSSFADLYHYLDMGFTPINFMLPWAPLPQNRRRDYAQKKMSETYMSIIQKRRESKTGEHEEDMIHNLMQCKYKDGNAIPDKEIAHMMIALLMAGQHSSSATESWITLRLASRPDIQDELLQEQKDMLGVNADGSIKELTYANLSKLTLLNQVVKETLRIHAPIHSILRKVKSPMPIEGTAYVIPTTHTLLAAPGTTSRMDEHFPDCLHWEPHRWDESPSEKYKHLSPTTALGSIAEEKEDYGLVSKGAASPYLPFGAGRHRCIGEQFAYVQLQTITATMVRDFKFYNVDCSDKVVGT

SEQ ID NO: 20256 - protein, 454 aa, Haemophilus influenzae R2866
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEHYFENFIEDVESGVVKPAAVILEAIQGEGGVVPAPISFLQKVREVTQKHGILMIVDEVQAGFCRSGRMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQSKDATGAYPRDCELAAAIQKACFKNKLLLERGGRGGNVVRVLCAVNINQNECEEFIKRFKQSVADALKVVRS

SEQ ID NO: 20257 - protein, 769 aa, Xanthomonas campestris pv. vesicatoria str. 85-10
MSTDDFKQAALDYHRQQPAGKIKVTATKPMLTQRDLSLAYSPGVAFACEAIVEDATQASELTARGNLVAVITNGTAVLGLGNIGPLASKPVMEGKGVLFQKFAGIDVFDIEINENDPDKLVDIIASLEPTFGGINLEDIKAPECFIVERKLRERMNIPVFHDDQHGTAIIVGAAVLNALVVTGKKIEEVKLATTGMGAAGISCVNMLVSLGLKPENILALDRDGVIHTGRTDLDPDKQRYARDTDKRTLAEIVEGADIFLGLSAAGILKPEMVASMARQPVIFALANPNPEITPEVAKAVRPDCIIGTGRSDYPNQINNVLCFPYLFRGALDVGATGINEEMKIACVKAIAAMARREASDLGAAYGGETPSFGPDYLIPRPLDPRLLVELSSAVAQAAMDSGVATRPITDMEAYRDKLGQFVYRTSLMMKPVYDRARADKQRVVYAEGEEEVVLRAVQNVVDEGLAFPILIGRPDVIEARIERMGLRLTAGVDFEITNILDDPRFNDYWQYYHALTERRGVTVTAAKELMRSRPTLIAAVMVARGEADAMLSGVVGRFHKKLGYARSVIPLEPRVSSTSAMTGVINQLGVFFFLDTHVQEDPTVEQVVEATLQAAYRLKLFGIEPNIALLSHSNFGSHDSRDALKMRQVREALLKRKPELNIDGEMQGDTAWDEALRKQIMPNSTLKGRANLFVLPNLEAANIAYNLVRVFTDGVAIGPILMGISKPVHILTTSATSRRVMNMTAIAAVDAQIRRQRDAEKAAADKGSD

SEQ ID NO: 20258 - protein, 445 aa, Bacteroides fragilis YCH46
MNIEKIMSSLEAKHPGESEYLQAVKEVLLSIEDIYNQHPEFEKSKIIERLVEPDRIFTFRVTWVDDKGEVQTNLGYRVQFNNAIGPYKGGIRFHASVNLSILKFLGFEQTFKNALTTLPMGGGKGGSDFSPRGKSDAEIMRFCQAFMLELWRHLGPDMDVPAGDIGVGGREVGYMFGMYKKLTREFTGTFTGKGLEFGGSLIRPEATGFGGLYFVNQMLQTKGIDIKGKTVAISGFGNVAWGAATKATELGAKVVTISGPDGYIYDPNGISGEKIDYMLELRASGNDIVAPYADEFPGSTFVAGKRPWEVKADIALPCATQNELNGEDAKNLIDNNVLCVGEISNMGCTPEAIDLFIEHKTMYAPGKAVNAGGVATSGLEMSQNAMHLSWSAAEVDEKLHSIMHGIHAQCVKYGTEPDGYINYVKGANIAGFMKVAHAMMGQGII

SEQ ID NO: 20259 - protein, 86 aa, Oryza sativa
LPFQVCPICATRVGVDLIGHLTMQHGSYFKMQRRRRVRKISSGSHSLLSLLRKDLRDGSLQSFLGGSSYVSNPPAAAPDPFLSSLI

SEQ ID NO: 20260 - protein, 498 aa, Oryza nivara
MRTNPTTSRPGVSTIEEKSTGRIDQIIGPVLDVTFPPGKLPYIYNALVVKSRDTDGKQINVTCEVQQLLGNNRVRAVAMSATDGLMRGMEVIDTGAPLSVPVGGATLGRIFNVLGEPVDNLGPVDTSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNLEESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLASKGIYPAVDPLDSTSTMLQPRIVGNEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEASTKAINLEEENKLKK

SEQ ID NO: 20261 - protein, 423 aa, Corynebacterium ammoniagenes
MNAPLNSAVRLDSIEEAIADIAAGKAVVVVDNEDRENEGDLIFAAELATPELVAFMVRYSSGYICVPLLPEDCKRLNLPPMMGRNEDVRGTAYTVTVDANTGTTGISATSRAETMLRLADPMSVVDDFTRPGHVVPLAARPNGVLERDGHTEAAIDLARLAGLRPAGVLCEIVSEEDPTTMARSEELRRFSDEHDLKMISIEQLIEWRRHNETQVRRTVETQLPTDFGSFTALGYKHEIDGQEHVALIAGGVEELNGAEDVFVRVHSECLTGDVFHSRRCDCGQQLHQSMEIIQEAGQGIIIYLRGHEGRGIGLLAKLKAYSLQDSGLDTVDANLEQGLPEDAREYSVAGQILRDLGIKSANLLTNNPHKGEGLRGFGVEASAHTPVEIEPNADNIDYLRTKRDRMNHDLPQVARWDAAHALK

SEQ ID NO: 20262 - protein, 335 aa, Alteromonadales bacterium TW-7
MSTATSAVTVLGAGSYGTALAICLARNGHKVTLWGRNSDDVATLAAERKNQRYLPDASFPDTLVLEDDLQRAVACSAIVLVVVPSHAFGDTLAQIKPALQIDAKVAWATKGLEPNTGRLLQEVAQQELGDEIALAVLSGPTFAKEMAMGSPTAISVSSTSPEFAQQLADLLHCGRSFRVYNNDDFIGIQLGGAVKNVIAIGAGISDGVGFGANARTALITRGLAELTRLGCALGAKPETFMGMAGLGDLILTCTDNQSRNRRFGLALGKGESVETAIESIGQVVEGFRNTKEVYLLAQRAGVEMPITEQIYKVLYENKDMKAAAMALLGREQRSE

SEQ ID NO: 20263 - protein, 475 aa, Mesorhizobium sp. BNC1
MTTILKPDICVIGAGSGGLTVAAAAASLGASVVLIERGKMGGDCLNYGCVPSKALIASARQAHRLSHGGSLGIAAVEPSIDFARVAGHIEQAIAAIAPNDSKERFTALGVEVISAQGHFKDPRTVVAGGSEIRARRFVIATGSSPAIPPIPGLSDVPFLTNETTFGLKQSPAHLIIVGGGPIGMERAQAHRRLGADVTVLEADTVLGKEDPELALGVKQALLKEGVAILEHARAERVERYKGTGIRVHVADEKGAHSIDGSHLLIATGRRPNVEALALENAGVAYGPGGITISPKLRTTNRRIFAIGDVAGGPQFTHVANYHAGLVIRAILFRLPVKANHEHIPRVTFTDPELAQIGLTENEARRRGLQVKVLRSSFSENDRAHAEGHTDGFIKLIVGRRGRILGVSILGRGAGEMMHFWSLALSRRMRVHDISQYVAPYPTLGEIGKRAALSYFAEAARSSSVRGILGFLRLFG

SEQ ID NO: 20264 - protein, 473 aa, Bacillus cereus ATCC 10987
MAKEYDLVIVGGGTGGYVAAIRASQLGLKTALVEKENLGGTCLHKGCIPSKALLRSAEVYATAKKSEEFGVIASNVELNFAKVQERKEKIVTQLHKGVQHLMKQGKIDVFEGIGRILGPSIFSPMPGTISVELASGEENEMLIPKNVLIATGSRPNSLPGLELDGEYVMSSDHALKMETLPSSIIIVGGGVIGIEWASMLADFGVEVTVLEYAKTILPLEDQDVSKEMQRLFKKKGIKVVTGAKVLPETLVKDNGVTIQAEHNGENKEFKAEKMLVSVGRQANTQNIGLENTDIVVEKGYIQTNEFYQTKESHIYAIGDVIGGLQLAHVASHEGIAAVEHIAGKEVTPIDYSMVSKCVYSSPEVASVGLTEQEAKEKGYKLKVGKFSFRAIGKALVYGESDGFVKLVVDEETNDILGVHMIGPHVTDMISEAGLARVLDATPWEVAHTIHPHPSLSEAIGEAALAVDGKALHA

SEQ ID NO: 20265 - protein, 468 aa, Yersinia pseudotuberculosis IP 32953
MLLPVIMAGGAGSRLWPLSRALYPKQFLALTSDLTMLQETLLRLDGLPHLAPLVICNEEHRFIIAEQLRQKNLVHSGIVLEPVGRNTAPAIALAALRATMSGDDPLLLVLAADHVIQDKLAFIRAVQRAEPLAEAGKLVTFGIVPKSPETGYGYIRQGKQVVDGAYQVAAFVEKPDLITAERYLASGDYYWNSGMFVFKASRYLQELDLHRPDILAACKQAIAGQHTDLDFIRLNEEAFSSCPDESIDYAVMEKTSDAVVVPLDAQWNDVGCWSALWEINTKDDHGNVIRGDVLIEDTNNSYVYSQNRLIATVGINDLVIVETKDAILVAHKDKVQNVKGIVGQLKLESRCEYLQHREVYRPWGSHDAIAEGVRYHVQHVTVKPGQRIATQIHYHRAEHWIVVSGIAKVHYGKETYLVNENESTYIPVGIAHSIENPGQIPLEIIEVHTGNYISEDDVERIDDLGVGY

SEQ ID NO: 20266 - protein, 514 aa, Alteromonadales bacterium TW-7
MTEHKKPLVLMILDGWGYREDEQSNAILAANTPVLDNLWASRPRTLISASGFDVGLPDGQMGNSEVGHVNLGAGRVVYQDFTRITKAINDGEFDSTPALVENIDKAVNAGKAVHVMGLLSPGGVHSHEDHIVASIELAAKRGAKEVYFHAFLDGRDTPPRSAKESIERIEALFAKLECGRLATLVGRYYAMDRDNRWNRVEKAYDVMTSGIGEFNYSDGVTALNAAYERDENDEFVAPTTITPAGREAAQINDGDTVIFANFRADRAREITRAFVEPEFDGFTKKKSPALSAFVMMTEYAADIDAPVAFGPTPLTNVLGEWLEKQGKTQLRISETEKYAHVTFFFSGGREDEFEGETRELIPSPQVATYDLQPEMNSEMLTDKLVEAIKSGKYDAIICNYPNGDMVGHSGVFDAAVKACEAVDTCIGRVVDALNEFGGEALITADHGNAEQMANLKTGQAHTAHTSEPVPFIYVGRDATPSEGKALSDVAPTMLHLMGMEQPSEMTGTPIMTLK

SEQ ID NO: 20267 - protein, 495 aa, Mycobacterium avium subsp. paratuberculosis K-10
MVTDRFDAIIVGAGFGGIGAAIQLKRLGFDNIVILDREDDLGGTWHVNHYPGIAVDIPSTTYSYWFEPNPGWSRLFAPGGEVKQYAADVADKYDVRRHMRFNTTVEGAQWDEDAEVWRVALAGGESLTTRFLITATGFLSQPHTPDIPGIGSFGGKVVHTTAWDHDYRYQGRRIAVIGTGASAVQVVPELAKEAGELTVYQRTATHVLPKVDFEFDPAVRRLFARVPAAQRALRWVTDVLLEIIMIVGALHFKESRGRGNISASDLAKINRFRWIRDKELRAKLTPDYDCGCKRPTFSNSFYRVLTQPNVHLETNPIERIEPDGIVTADGRKTVIDTLVLATGFDLWEANFPAIEVIGRKGRNLGKWWRETRFQAYQGVSMPYFPNYLSLASPFAFSGLSFFHTIEYQMRHMDRLLGEVKRRGATIFEVTEEANDRFMERMTKLLDNSVFYAGNCATSRSYYFSPSGEASLLRPTSTLNSIREASSFPLSDYVIA

SEQ ID NO: 20268 - protein, 326 aa, Zea mays
  misc_feature (39)..(39): Xaa can be any naturally occurring amino acid
MGEASPSIAKDVTELIGNTPLVYLNKVTDGCVGRVAAKXLESMEPCSSVKDRIGYSMITDAEEKGLITPGVSVLIEPTSGNTGIGLAFMAAAKGYKLTLTMPASMSMERRIILKAFGAELVLTDPLLGMKGAVKKAEEIQAKTPNSYILQQFENPANPKIHYETTGPEIWKATAGKIAGLVSGIGTGGTITGTGRYLREQNPNVKLYGVEPVESAVLNGGKPGPHKIQGIGAGFIPGVLDVDLLDETLQVSSDEAIETAKALALKEGLLVGISSGAAAAAAVRLAKRPENAGKLFVVVFPSFGERYLSSVLFQSIKKEAESMVVEP

SEQ ID NO: 20269 - protein, 355 aa, Burkholderia thailandensis E264
MEIACGSRRKTSLFPAPPPGFETLAAPWPNGQKPHAALRHSCTIPPVSTFRTRAAAMSEPIDLSQISPSLKAEILAEALPYIRRYHGKTVVIKYGGNAMTEERLKQGFARDVILLKLVGINPVIVHGGGPQIDQALKKIGKQGTFIQGMRVTDEETMEVVEWVLGGEVQQDIVTLINHFGGHAVGLTGKDGGLIHARKLMMPDRDNPGEYVDIGQVGEVEAINPAVVRALQDDAFIPVISPIGFGEDGLSYNINADLVAGKLATVLNAEKLVMMTNIPGVMDKEGNLLTDLSAREIDALFEDGTISGGMLPKISSALDAAKSGVKSVHIVDGRIEHSVLLEILTEQPFGTMIRSH

SEQ ID NO: 20270 - protein, 1154 aa, Oryza sativa Japonica Group
MDLSRFTAPRPGLQIGAAGNGFRACSLRRLRYRVCGGNPMGASALGGCGSRSLFYLAPNHGSPLALRTRGRALRCQGNDSLAYVDGPLEGTNGSVVDNTEDEANSSGLDEEKGDDDAENLRDLLQKARKELEVARLNSTMFEEKAQRISESAIALKDRADKAQSDVSSAVTTIQEIISKEADAKEAVRTATMALSMAEARLQLASEALDAKRGSVGPMEVSIDDVEEEALASAQEEIKECQESLSKCEEELRRIQEKKMELQKEVDRLTELAERALLDASKAEEDVANIMVLAEQAVALEMEAAQRANDAELALQKAEKAISSVDAVVELPAPAEEQVSDEEDNVSEVYDYSSDAIDDIPERDEVSNVERLTVGDLAVEGIEQLESSREMSDDESTDKLLVEPQKEAEPDIDKSKQGKKQEIERKESQPSNAPKASLKRSSRFFPASFFSSKADGEFTPTSVFKGLMKSTRKHAPKLVVGIVLLGAGAFFLNRAEKSSQLFQQQEITTSIEEVTSTAKPIVREMRKIPQRVKKLIELLPHQEVNEEEASLFDILYLLLASVVFVPLFQKIPGGSPVLGYLAAGVLIGPYGLSIIRHVHGTKAIAEFGVVFLLFNIGLELSVERLSSMKKYVFGLGSAQVLATTAAVGMIAHRFAVLPGPAAIVIGSGLALSSTAVVLQVLQERGESTSRHGRATFSVLLFQDLAVVVLLILIPLISPNSSKGGVGFQAIAEAMGMAAVKAIAAITAIIAGGRLLLRPIYKQIAENRNAEIFSANTLLVIFGTSLLTARAGLSMALGAFLAGLLLAETEFSLQVESDIAPYRGLLLGLFFMTVGMSIDPKLLLSNFPAISVILGLLIIGKTMLVTFIGRVFGISTIAAVRVGLLLAPGGEFAFVAFGEAVNQGLLSPQLSSLLFLVVGISMALTPWLAAGGQFLASKFEQHDVRSLLPVESETDDLQDHIIILGFGRVGQIIAQLLSERLIPFVALDVRSDRVAVGRALDLPVYFGDAGSREVLHKVGAERACAAAITLDTPGANYRAVWALSKYFPNVKTFVRAHDVDHGVNLEKAGATAVVPETLEPSLQLAAAVLAQAKLPMSEIAATVNEFRNRHLSELTELCATSGSSLGYGYSRVMSISKSKTVTSDDESETVDGALAI

SEQ ID NO: 20271 - protein, 390 aa, Halobacterium sp. NRC-1
MLCRSALYCWHPGTPSRGAMIAVGDGSTPQPLLYSPTLARPRVMDGRQSHQPTASDREWCHSAVQDVSRTFALTIDALEEPMATRICVGYLLCRVADTVEDATAMPPTEQAQLLETYDAALDPDCGTTVAEFQAAVGDHVPSEPNADWRVVANTTRVVSAFESLDDAAKAAIRPTVREMATGMASFVQRYADAGGLRIQSPTELEEYCWYVAGTVGELVTELLARDAPSDAAAAMRENARSFALLLQLVNVAKDVRPDYEEENNVYLPQEWLDDHDLAPEDVADPEHAGRVASVVERVTDRARGYVADAQRWLEVMPTSQGNTLAAWAVPFLLAVGTMRELGNRPADVVREGDVKVDREEVHAVIGLVADDFDRSAIDSVRERIATESLS

SEQ ID NO: 20272 - protein, 170 aa, Vitis vinifera
MKESGRKQGAVSPCAACKLLRRRCAQDCVFAPYFPADEPHKFASVHKVFGASNVNKMLQELPEHQRSDAVSSMVYEANARVRDPVYGCVGAISSLQQQIDALQTQLALVQAEVVQMRMNQFTSSTSNQATDSPENASHTSRLAASPQTKSFFSMDMVVDHANMVESLWSY

SEQ ID NO: 20273 - protein, 186 aa, Halobacterium sp. NRC-1
MTDPKETINIENVVASTGIGQELDLQSVAMDLEGADYDPEQFPGLVYRTQDPKSAALIFRSGKIVCTGAKSTDDVHESLRIVFDKLRELSIKVEDDPEIVVQNIVTSADLGRQLNLNAIAIGLGLENIEYEPEQFPGLVYRLDDPEVVALLFGSGKLVITGGKEPKDAEHAVDKITSRLEELGLLD

SEQ ID NO: 20274 - protein, 459 aa, Bordetella parapertussis 12822
MNDLATINDLHSVVEDDRNAIWHHMLQHDALQATAPWVVVEGKGTRIRDASGKEYLDATAGGLWTVNVGYGRERIANAMRDQMLKLNYFAQSAGNVPGALFARQLVSKMPGMSRVYFSNSGSEANEKVFKMVRQISARHHAGRKYKILFRERDYHGSSIATLAAAGQPERAAQYGPFPDGFVQVPHCLEYRKQWDVANYGERAADAIEEVILREGPETVGLLCLEPITAGGGIIVPPEGYWRRVQEICRRHDVLLHIDEVVCGLGRTGKWFGYQHFDIEPDFVTLAKGTASGYAAIACTVTHERIFEQFKDEPDDPLSFFRDVSTFGGCAGSAAAALENLRILEEEGLVEHAAQVGDYLQACLRQLADKHAVIGDVRGKGLLQGVELVSDRAAKTPVSEADAKRVVAQCKAQGVLIGVITRALPGLNTTLCLAPPLILTRDEVDELCGAIDRALATVFG

SEQ ID NO: 20275 - protein, 427 aa, Pyrococcus furiosus DSM 3638
MRVSVVGSGYVGLVTGIGFVKLGNSVIFVDVDERKIQMINNAQPPIYEEGLEELMQEFRGKYYATNDYRDAILNSDITFIAVGTPSREDGSIDLTYVKEASRAIGKALREKEDYHVVVVKSTVLPGTTEEVVRPILEKYSGKKAIQDFGLAMNPEFLREGTALKDFLNPDRIVIGVQDERTKKVLEELYAPINAPKLIVDIKTAEMIKYASNAFLATKISFANEIGNICKKLGIDSWKVFEGVGLDHRISPYFFRTGIGWGGSCFPKDVRALIRKAEELGEDPIILKAVVEVNERQPLKLIELLKKHVPDLKGKTVGVLGLAFKPNTDDVRETRAYIIVRKLLEKGAHIIAYDPKAMENFKRFYPDVGEKIEYANSPEEVLEKSDVILIVTEWNEFEKVDYSGKIVIDGRRIRAAEKTARIYEGVCW

SEQ ID NO: 20276 - protein, 196 aa, Escherichia coli O157:H7
MSYYAFEGLIPVVHPTAFVHPSAVLIGDVIVGAGVYIGPLASLRGDYGRLIVQAGANIQDGCIMHGYTDTDTIVGENGHIGHGAILHGCVIGRDALVGMNSVIMDGAVIGEESIVAAMSFVKAGFHGEKRQLLMGTPARAVRSVSDDELHWKRLNTKEYQDLVGRCHASLHETQPLRQMEENRPRLQGTTDVTPKR

SEQ ID NO: 20277 - protein, 283 aa, Pyrococcus furiosus DSM 3638
MKVRKAVIPAAGLGTRMLPLTKAQPKEMLPVVRKPTIQYVLEEAYEAGIREVLIITGKHKRAIEDHFDRYEHEVKNPHLDKLDKILDDINIYYARQRVQRGLGDAIKYAEAFVGDEPFALLLGDTITLPSCTAGIIESYEELKAPVIAVEEVQEEKISLYGVVGIGRYINERIFEINKLVEKPEIHEAPSNLAILGRYILTPEIFEYLEEVKPDKKGEIQLTDALELMVQNGKKIYGYVFKGRRYDIGNIFDWLRANIELGLEDEELSEKLRELIKSLVGERI

SEQ ID NO: 20278 - protein, 325 aa, Corynebacterium efficiens YS-314
MTAHWKENHKNLMLFSGRAHPELAEAVARDLEVEVTPMTARDFANGEIYVRFEESVRGSDCFVIQSHTQPLNKWLMEQLLMIDALKRGSAKRITAILPFYPYARQDKKHRGREPISARLIADLLQTAGADRIVSVDLHTDQIQGFFDGPVDHMHAMPILTDYIKDKYDLSNIVVVSPDAGRVKVAEKWANTLGDAPMAFVHKTRSTEVANEVVANRVVGDVAGKDCVLLDDMIDTGGTIAGAVGVLKEAGARSVVIACTHGVFSDPARERLSSCGAEEVITTDTLPQSTEGWSNLTVLPIAPLLARTISEIFENGSVTTLFEGDA

SEQ ID NO: 20279 - protein, 163 aa, Corynebacterium ammoniagenes
MSKEGLPEVATIDATGISVAVISATWNADICDRLHERALAHAQQLGAEADGFRVVGALEIPVAVQEAARHYDAVVALGCVIRGGTPHFDYVCDSVTQGLTRIALDTSKPIANGVLTVNTHDQAVDRSGAPGAAEDKGVEAMQAALDTVLQLRNIKERASKRGL

SEQ ID NO: 20280 - protein, 281 aa, Zea mays
MVKPGDATDAVISELADLMEDGDVIIDGGNSLYTDTIRREKEMSERNLNFVGAGISGGEVGALEGPSIMPGGPKEAYDSLGPLLESISAHVDGEPCCTHIGPDGSGHFVKMVHNGIEYADMQLIGEAYDLLRRALGMDVDQIADVFRDWNSGDLESYLVEITAEVLSQKDAETGKPLVDVIVDAAGQKGTGRWTVKSALDLGVPVTGIGEAVFARALSSELDQRAAATDLKPGTIGEKPTDADAFVADVRAALYASKVIAYAQGFDQIRAGSEEYGWDLHP

SEQ ID NO: 20281 - protein, 1781 aa, Haemophilus influenzae R2866
MLNKKFKLNFIALTVAYALTPYTEAALVRDDVDYQIFRDFAENKGKFSVGATNVEVRDKNNHSLGNALPNGIPMIDFSVVDVNKRIGTLVDPQYIVSVKHAHQYMNDFYFGHYNGHRDVSDDENKYSVVTQNNVNPNENWHVDKRLDDYNMPRLNKFVTEVAPTTPTLAGDDLETYKDKEKYLSFVRVGAGRQLVYEKGSHHVEDKEHGEDLKDLSAAYRYAIGGTPYKGINIDPSQSKKGLIGFGDSREDHVINSKTLLSQDPLTNYGVLGDSGSPLFAFDKQQNKWVFIGPYTYWAGYGKKSWQEWNIYKSQFTKDVLNKDSAGLLKGNTQYNWTSNGNTSMISNGSELLEVNLFDNSKHTNREKANYGKSVTFQGNGTLTLKNSINQGAGGLFFEGNYTVEGSSDNIVWNGAGISVAEGKTVTWKVHNPQSDRLAKIGKGTLIVEGKGENKGSLKVGDGTVILKQQADANNKVKAFSQVGIVSGRSTVVLNDDKQVDPNSIYFGFRGGRLDANGNNLTFEHIRNIDDGARIVNHNMTNASNITITGTGLITNPSQVTLDYIRPRDEENPYALRRIKDGGQLYLNEENYTYYALRKGAKANLQLPYNDNESNETWLYMGKDKNEAQKKTMEYINNSRMNGFNGYFGEEDSKNNGNLNVTFKGKSEQNRFLLTGGTNLNGDLTVEKGTLFLSGRPTPHARDIAGISSTKKDQHFAENNEVVVEDDWINRNFKATNINVTNNATLYSGRNVANITSNITASNKAQVHIGYKAGDTVCVRSDYTGYVTCHNGTLSTKALNSFNPTNLRGNVNLSGNANFVLGKANLFGTIHSTENSQVNLKENSHWHLTGNSDVHQLDLANGHIHLNNVSDATKATKYHTLNISNLSGNGSFYYLTDLSKKQGDKVVVTQSATGNFTLQVADKTGEPTKNELTLFDASNATRNNLNVSLIGNTVDLGAWKYTLKETDGRYDLYNPEVEKRNQTVDTPSIAMPNNIQADAPSVPSNNEEIARVDAPVPPPAPPAPATGSVMANGQPETRPAETTQPAMEEANTANSTETAPKSDTATQTENPNSESVPSETTEKVAENSPQENETVAKNEQKATETTTQNGEVAEEAQSSAETKAQTNKVAQSGSETEETQTAETKSEPTESITVSENQPEKTVSQSTEDKVVVEKEEKAKVETEETQKAPQVTSKEPPKQAEPAPEEVPTDTNAEEAQALQQTQPTTVTAAETTSPNSKPAEETQSSEGTNAKPVTPVVSENKVSQPTETEKTAKVESKEAQETPKVASQASPKQEQSETVQPQAELESEKVPTVKNAEEVQAQPQTQPSAIVSTEQPAKETSSNVEQPEQESSTNTGSATAMTETAEKSDKPQMETVTENDRQPEANTVADNSVANNSESSESKSRRRRSVSQPKETSTEETTVTSTDKTTVADNSKSSKPNRRHRRSVSQPQETSTEKTTVADNSKRSKPKRRSRRDVSSAPHNVEPLHNLTSTNTNAVISDAMAKAQFVALNVGKAVSQHISQLEMNNEGQYNVWVSNTSMNENYSSSQYRRFSSKSTQTQLGWDQTISNNVQLGGVFTYVRNSNNFDKASSKNTLAQANLYSKYYMDNHWYLAVDLGYGNFQSNLQTNHNAKFARHTAQFGLTAGKAFNLGNFAVKPTVGVRYSYLSNANFALDQDHIKVNPISVKTAFAQIDLSYTYRLGEFAITPILSARYDANQGSGKINVDRYDFAYNVENQQQYNAGLKLKYHNVKLSLIGGLTKAKQAEKQKTAEVKLSFSF

SEQ ID NO: 20282 - protein, 177 aa, Erythrobacter sp. SD-21
MALMRATGNAPKCADSPFRRKNGILPDTGIVEACMNIAKLIESRSSSDIISVTVDQPVSDAITLLASKRIGALPVMEEGRVAGIFSERDVIYRLAHEGETCLSRRIGEVMTSPAITVERSMLVDQALALMTRRRIRHLPVIDGEAMCGFISIGDLVKSRMDEVQHEADAMRDYIAHA

SEQ ID NO: 20283 - protein, 75 aa, Zea mays
PKSGNPCRSGKIFGCQLPGNNAFYSAQPPKQEGFNKPLFLGAFVSHWGGTWKGDKICSNSKKARYCFEKHQVEGF

SEQ ID NO: 20284 - protein, 171 aa, Rhizobium tropici
NSLVMSHSLHVAVQGLEDVAVIASEDAVYVGHLKDSQEVGKLVKLLASEKKTAKLTETHPTSYRPWGGYTSVLNGERFQVKRIFVLPGKKLSLQKHHHRSEHWIVVKGTAEVTVGENVQMLRENESIYIPLGEVHRLANPGKILLELIEVQTGSYLGEDDIIRLVDEFGRS

SEQ ID NO: 20285 - protein, 359 aa, Aspergillus oryzae
MAAARTLRIGLIPGDGIGREVIPAGRKVLESLPASLNLNFSFVNLDAGFDTFKQTGTALPDKTVETLKKECDGALFGAVSSPSTKVAGYSSPIVALRKKLDLYANVRPVKSTIGGGRNPVDLVIVRENTEDLYVKEEQTKDTPNGKVAEAIKRISENASFRISSIAGEIALRRQKIRDAASTTGLRTKPMVTITHKSNVLSQTDGLFRETARKALAAERFSSVEVEEQIVDSMVYKLFRQPEYYDVIVAPNLYGDILSDGAAALVGSLGLVPSANVGDGFAIGEPCHGSAPDIEGQGIANPIATLRSAALMLEFLGEEGAAAKIYTAVDANLDEGKYLSPDMGGKASTQEVLDDVLKRL

SEQ ID NO: 20286 - protein, 275 aa, Populus trichocarpa x Populus deltoides
MHKNGSWENWKKIDSDALLGIATSKEGGLIVCDAEKGLLKVSEDGVVVLATHINDGSKIRFADEVIESSDGSLYFSVASTKFGFHDWYLDVLEAKPHGQLLKYDPSLYETSILLDGLCFPNGVALSREEDYLVFCETWKYRCQKYWLKGTDKGKTEIFIDNLPGGPDNIYLAPDGSFWIAVLQVASKGLEFVHRSKPSKHLVASFPKLVNLVIGVKRKATVVNVAADGKITRKFDDPDGKVMSFVTTAFEFEDHLYLGSLNTNFIGKLPLNPTNS

SEQ ID NO: 20287 - protein, 630 aa, Bacillus cereus ATCC 10987
MDLTQIQNPSFLKDMSISELEGLSEDIRKFLIEELSQTGGHIAPNLGVVELTIALHKLFDSPKDKFLWDVGHQSYVHKILTGRAKEFGTLRQYQGLCGFPKRCESEHDVWETGHSSTSLSAAMGMALARDLKKTKEYVIPIIGDGALTGGMALEALNHIGHEKTDMIVILNDNEMSIAPNVGALHNVLGRLRTAGKYHWVKDELEYILKKIPAVGGKVAATAEKIKDSLKYLLVSGVFFEELGFTYLGPVDGHDYEKLFETLQYAKKTKGPVLVHVITKKGKGYKPAESDVIGTWHGTGPYKIESGDFVKPKEVAPAWSAVVSETVLKLARTDERIVAITPAMPVGSKLEKFQKEFPDRMIDVGIAEQHATTMAAGMATQGMKPFLAIYSTFLQRAYDQVVHDICRQNLNVFIGIDRSGLVGADGETHQGVFDISFLRHLPNMVLMMPKDENEGQHLVYTAMQYEDGPIALRYARGNGLGVHMDEELKAIPIGSWETLKEGTQAAILTFGTTIPMAMEAAERLEKAGVSVKVVNARFIKPMDEAYLHDLLGKNIPILTIEEACLIGGFGTGVVEFASENGYHSALVERMGIPDRFIEHGSVTKLLEEIGLTTDAVVDRIHTMIPSKQKRA

SEQ ID NO: 20288 - protein, 287 aa, Halobacterium sp. NRC-1
MADVIDAVFDAIADAAPEVRAGLPDHRATRDDQNASGDTQLEADVWADDLLFDRTESIEGVNWYASEERDAVVTVGDAEGGYAVALDPLDGSSNVKSNNPCGTVVGIYDQPLPAPGSSLVAAGFVLYGPTTTMVVARDDTVRESLVSETGATTDLGPVELPADPTVYGFGGRVPDWTPAFESFVRDVEDDLKLRYGGAMIADVNQVLVYGGVFGYPGMESAPDGKLRAQFEALPIAYIVETAGGASSDGTQSLLDVAPTRLHERTPTFVGTDDVIAALDAALPDHTN

SEQ ID NO: 20289 - protein, 249 aa, Burkholderia thailandensis E264
MDKTLDKQVAIVTGASRGIGRAIALELARRGATVIGTATTEAGAEGISAAFKEAGLEGRGAVLNVNDAAAVDALVEATLKEFGALNVLVNNAGITQDQLAMRMKDDEWDAVIDTNLKAVFRLSRAVLRPMMKARGGRIVNITSVVGSAGNPGQVNYAAAKAGVAGMTRALAREIGSRGITVNCVAPGFIDTDMTKVLPEDQQAALKTQIPLGRLGSPEDIAHAVAFLASPQAGYITGTTLHVNGGMFMS

SEQ ID NO: 20290 - protein, 296 aa, Bacillus cereus ATCC 10987
MTIAFDTFLKESKTFVEEKLVSYANELQCPNVLREAMAYSLEAGGKRLRPLLLFATLQAFGKEKNLGVGAACALEMIHTYSLVHDDLPCMDDDDLRRGKPTNHKVFGEAMAVLAGDGLLTYAFQVIMAYEQKEISAEKKVRLVLELAKAAGPEGMVGGQVADMEAEGKQLTIDELEYIHKHKTGKLLEFAVLAGSILSNATEEQEEKLLEFAKYIGLAFQIRDDILDVEGTEEEIGKPIGSDVSNEKSTYTTLFTVDRAKDILEETIAKAKDAISSLQLQDEYLLSICDLIAKRNN

SEQ ID NO: 20291 - protein, 381 aa, Synechococcus sp. CC9311
MHSNVNQTDDPIPKSLTSSFVDSGRWKFIPALTMLGLTQLASMQEWPTLICFIVSATGIIPIALLLSDATEEIAEHSGPTIGAICTAVFGNFAEFIIALSALRLGLIDVVKASITGAILSDLLLVTGVAMLVGGLKYSEQSFQETMVRTNGAAMTLAVMAMALPASLISTSGIDDPVAIHGLSMTVAVILIAIYVLTLIFSLATHSHLFDPQHIKNDATELPQEAAKSINLLPWIVQLILCTSLLAYQSESFVHFLEPATEQLGFSALFTGIIIIPIIGGFSEYVPAVKGAWKDQMDLPISLAMGSSLLVALLIAPALIIIGSLIGQPMNLDFTAFEVIALIFSVLIVNLVNMDAKSNWLEGVLLLGMFAIFGAAFYYYPS

SEQ ID NO: 20292 - protein, 103 aa, Synechococcus sp. CC9311
MVDTPSRSPGGAAVLDKQTERVRKTSPRYKVLLHNDPVNSMEYVVVTLQQVVPQLSEQDAMAVMLETHNTGIGLVIVCDIEPAEFYCETLKNKGLTSTIEPES

SEQ ID NO: 20293 - protein, 333 aa, Pseudomonas fluorescens PfO-1
MGLLVDGRWQDKWYESSKDGAFQREQAQRRNWVTRNGEPGPSGEGGFAAEAGRYHLYVSLACPWAHRTLILRKLKGLESLIDVSVVSWLMLENGWTFDQNLGSTGDKLDHFDFMHQRYTADTADYTGRVTVPVLWDKKLKRIVSNESAEIIRMFNSAFDDLTGNDLDFYPAPLRGEIDALNERIYPAVNNGVYRAGFATSQNAYEEAFDDVFAELDHLEQVLDANRYLTGEYLTEADVRLFTTLIRFDAVYHGHFKCNLRRISDYPNLSNWLREMYQWPGVAETVDFQHIKNHYYGSHKTINPTGVVPKGPKQDFTVAHDRDRLGGKGVWRRG

SEQ ID NO: 20294 - protein, 120 aa, Plantago major
APEVIAEYTVRALQRTMPCAVPAVVFLSGGQSEEEATINLNAMNKLKTKKPWSLSFSFGRALQQSTLKAWAGKEENIGKAQAAFLTRAKANSEATLGTYSGSSTLSEGASESLHVKDYKY

SEQ ID NO: 20295 - protein, 65 aa, Citrus medica
PLTVYFPVEMYIARTKIRRFSFTWVWLKILIWSCFIVSLVALVGSVQGLIQSLKTYKPFQAVQEE

SEQ ID NO: 20296 - protein, 124 aa, Pyrococcus furiosus DSM 3638
MMAKPSYVKFEVPKELAEKALQAVEIARDTGKIRKGTNETTKAVERGQAKLVIIAEDVDPEEIVAHLPPLCEEKEIPYIYVPSKKELGAAAGIEVAAASVAIIEPGKARDLVEEIAMKVKELMK

SEQ ID NO: 20297 - protein, 494 aa, Lactobacillus plantarum WCFS1
MSNEKIALFTIFGGTGDLAQRKLYPSLFKLYQKGYLKDHFAVIGTARRPWTDDHYHEVISDSLADLNADQETVTQFASHFYYQSHDVTDAEHYRTLKKLSEKLDAQYGLQGNRIFYLAMAPNFFGTIAQHLRSENILTDNGFNRVIIEKPFGHDYESAKELNDQLTATFNENQIYRIDHYLGKEMIQNITAIRFGNNIWESLWNNRYIDNVQITLSEKLGVEERAVYYDNSGALRDMVQNHILQILSLLTMDQPVEFTENDIDVEKVKALRSLRPLKPEEVATNFVRGQYGAGDDAKAYRDEDKISSDSNTDTFVAGKVMIDNYRWSGVPFYIRTGKRLADKFTRIDVVFKRPVVNIFNHEDVRANDDAATSLDPNILTINVEPTEGFELRMNAKAIGQGFATTPVKLNYSHDAEATAGSPEAYERLLHDALNGDATNFTHWQEVADSWKFVDVIQKYWDEHQPEFPNYRPGTMGPDAADELLRQDGHRWVYRN

SEQ ID NO: 20298 - protein, 441 aa, Xanthomonas campestris pv. vesicatoria str. 85-10
MSSTVPKLSFARILALNAGFFGVQYSFGLQQSNMSPIYNYLGADHANLPYLWLAGPITGLVLQPFVGAWSDRSVTRWGRRMPYMVLGALVCSLCLLAMPFSTALWMAVCLLWVLDAANNVAMEPYRALVSDVLAPPQRPLGYLTQSAFTGLAQTLAYLTPPLLVWMGMNQDAANAHHIPYVTIAAFVIGAGFSAGSILLTARSVREPAIAPAEIARIRQRGAGLGATVREIGSALREMPPTMRQLAPVMLFQWYAIFCYWQYIVLSLSTTLFGTTDPTSHGFREAGLVNGQIGGFYNFVAFLAAFAMVPVVRRFGPKYTHAACLVAAGIGMWLLPGIENRWLMLLPMIGIGLAWASMMGNPYLMLADSIPSERTGVYMGLFNLFIVLPMLIQIVTLPLYYEHVLHGDPRNVVRLAGALMLAAAAAMLCVRGRKQGTSPAGA

SEQ ID NO: 20299 - protein, 517 aa, Mycosphaerella graminicola
MGLLQEVLAQFDAQFGQTSLWKLVGLGFLAFSTLAILLNVLSQLLFRGKSSDPPLVFHWVPFIGSTITYGIDPYKFFFSCREKYGDVFTFILLGKKTTVCLGTKGNDFILNGKLKDVNAEEIYSPLTTPVFGKDVVYDCPNSKLMEQKKFVKYGLTTSALQSYVTLIAAETRQFFDRNNPHKKFASTSGTIDLPPALAELTIYTASRSLQGKEVREGFDSSFADLYHYLDMGFTPINFMLPWAPLPQNRRRDYAQKKMSETYMSIIQKRRESKTGEHEEDMIHNLMQCKYKDGNAIPDKEIAHMMIALLMAGQHSSSATESWITLRLASRPDIQDELLQEQKDMLGVNADGSIKELTYANLSKLTLLNQVVKETLRIHAPIHSILRKVKSPMPIEGTAYVIPTTHTLLAAPGTTSRMDEHFPDCLHWEPHRWDESPSEKYKHLSPTTALGSIAEEKEDYDYGLVSKGAASPYLPFGAGRHRCIGEQFAYVQLQTITATMVRDFKFYNVDCSDNVVGT

SEQ ID NO: 20300 - protein, 390 aa, Lactobacillus plantarum WCFS1
MMNTNIRIQQIQVSGIRRFDEAISQIPDIIRLTVGEPDLPTPSHVKKAAIQSIHNDWTHYSPLMGFAALQDAASHYFQQKYQLTYAPEQIIATVGASEAVATTLLTLLNPGDTVLLPTPAYTNYQPVVDIANAQLAPIDTTATGYKLTPSALQAALDDHRHDHVKALILNYPTNPTGVTYTDDELWALQAVIATAGIYVISDEIYSELTYEQPHTAFATLYPSKTITINGLSKSHAMTGWRLGFIMAPSNLITEMKKTHQYLVTSTSSITQAAGIEALTHGLDDGSEMRGVYQTRRDYVVKRLSEIGFNYIYPTGAFYIFVQLPQDFQGTSWDFATRLAHEAQVAVVPGSAFGTSGEGWFRISYAASQSALREGLNRLALWRAQTTTQED

SEQ ID NO: 20301 - protein, 687 aa, Corynebacterium efficiens YS-314
MNVIRNTPHRIVAALSAATLALTLSSCVNEDGSSAVTEAADTTQTQDTATSVTTGDTSATTSAETSIATVTETTTGSAPPPMEPCELPEDANREEGTDGTHSGEDISVAPEISTGYRSGMEPVTTRNYAVSTANPHASRAACEILREGGTAADALVTAQFVLGLTEPQSSGIGGGGYILYYDAGTHQVTAIDGRETAPVAADENYLIRVSAEDESAPVPDARRSGRSIGVPGIVAALGHLHESQGRTEWSGLLEEAQTLATDGFEISPRMSASIANSAEDLARDPEAAAYFLDADGEAKSPGTLLRNPEYADTLRLIAEGGPDAFYTGDIAADIVERATREVEGVTPSLLSTADLAAYTPVTHDALCAPYRDRVVCGMPPSSSGGSTVLGTLGILNHFDLGQYAPTGAGPDGGLPDPEAVHIIAEAQRLAYADRNAYIADPAFVDVPGGGVEELISREYTQRRAELIDEKTSMGTAEAGLDDVPVGAPVPESGTSHVSIIDSYGNAASLTTSVEAAFGSFHFTRGFILNNQLTDFSAEPVDENGEPVANRVESAKRPRSSMAPTLVFATGDNGDIGELEMVLGSPGGALIIQYVVKTLVNIIDWGMNPQQAVSAPNFGAMNQPATGIGIEHPLMAEHEAELIDALEDLGHEVNPTEQSSGLSALMRGTGNSIIGGADPRREGVVLGG

SEQ ID NO: 20302 - protein, 303 aa, Nicotiana langsdorffii x Nicotiana sanderae
LQGPCRALLADLSGGKAGRMRTANAFFSFFMAVGNVLGYAAGSYSRLYKIFPFSKTPACDIYCANLKSCFFIAVFLLLSLTTLALTVVRENELPEKDEQEIDEKAAAGGKSKVPFFGEIFGALRDLPRPMWILLLVTCLNWITWFPFFLYDTDWMAKEVYGGKVGDGRLYDLGVHAGALGLLLNSVVLGFMSLSVEFLGKKIGGVKRLWGILNFVLAVCMALTVLVTKMAEKSRQYDAHGTLMAPTSGVKIGALTLFAVLGIPLAVTFSVPFALASIFSSNAGSGQGLSLGVLNLAIVVPQML

SEQ ID NO: 20303 - protein, 423 aa, Xanthomonas campestris pv. vesicatoria str. 85-10
MSTAPQKPLAIRERLSEVRYEIRGELARRARELEAQGRKLIKLNIGNPGAFGFRAPEHLQRAIADDMGRTDPYTHQQGLPEAREAVATAYSRRQHPDAHPDRIFIGNGVSELIDLSLRALLNPGDEVLVPSPDYPLWSAATILNDGRPVYYRCAPENGFQPDPVEIETLVSSRTRAIVLINPNNPSGASYSRELLERIVAIATKHNLLLMVDEIYDQVLYDDAAFVPVAPLAGAHPCITFSGLSKVHRACGWRVGWALLSGDQARINDLRNAMDLLGALRLCANVPGQYAIDAAVNGPDTISALCAPGGRLYETRRAVIEACAASEHLQLVAPAGALYAFPAVVGAAARNFDDHAFALDLMNEEGVLVVPGSSFNVPYRHHFRVTLMPEAGVMRDVFARIDRALARRAEAITKVVPLKPRNVA

SEQ ID NO: 20304 - protein, 436 aa, primary endosymbiont of Sitophilus zeamais
  misc_feature (237)..(237): Xaa can be any naturally occurring amino acid
MMRRSPLQNCFDYAAHSTRIQGNIIEASLPAAAIGEVCEVQSSINDTSLAGYAQVIGFNGSRTMLSLLCDSAGFSQHHLLVPTGKPFQIGLGDALLGAVLDSLGNICARLDGATDDALTVTEHRPIDVGALHFTERRPIAEKFVTRIRAIDGLLTCGHGQCLGIFAAAGCGKTSLMNMLIEHSEADVYVVGLIGERGREVTEFIEELKHSSCSGKVVLVNSTSDRSAGERYNAAQVXTTVAEYFHDQGKNVLLFIDSITRYARALRDMALSMGELPARRGYPASVFERLPKLLERPGSSWLGSITAFYTVLLENDEEPDAIGDEVRSILDGHIYLSPTLASQGHYPAIDILRSTSRLFLQITDQKQQRAAVRFRDLLVRQRDMQLYLDLGEYRRGENEENDNAFDKKMVMSEFLRQPLAEHMELTQTLEQMNECLA

SEQ ID NO: 20305 - protein, 403 aa, Aspergillus oryzae
MAVETAPRKCMGVDCDKIAGTLQCPTCLKQGTDSFFCSQDCFKRSWSEHKTIHKAKSNILTNLFPPKVVSEPDPATGLFNPYPAYPFTGSLRPVYPLSARRTVPKTIPHPDYAKDGIPRSEQKFIGRHNITILNKEEQEGMRKVCRLAREVLDIAARELKPGITTDYLDEVVHKACVERNSYPSPLNYMHFPKSVCTSINETICHGIPDQRPLEDGDIINIDVTLYHNGFHGDLNETYYVGDKARSNPDAVRVVETSRECLDKSIELVKPGMLFRDPGNVIEKHAKSRNCSVVKSYCGHGINQLFHCAPNVPHYAKNKAVGTAKPGMCFTIEPMINIGTHRDRTWPDDWTSTTADGSLSAQFEHTLLVTEDGVEVLTARLPDSPGGPIPMPTVEEPSEAKTEA

SEQ ID NO: 20306 - protein, 296 aa, Oryza sativa Japonica Group
MAGLSLQHPWAFAFGLLGNLISFTTYLAPIPTFYRIYKSKSTEGFQSVPYVVALFSAMLWIFYALIKSNEALLITINAAGCVIETIYIVMYLAYAPKKAKVFTTKILLLLNVGVFGVILLLTLLLSHGEQRVVSLGWVCVAFSVSVFVAPLSIIKRVIQSRSVEYMPFSLSLTLTLSAVVWFLYGLLIKDKYVALPNILGFTFGVVQMGLYVFYMNATPVAGEGKEGKGKLAAAEELPVVVNVGKLAAATPDRSTGAVHVHPVPRSCAAEAAAAEPEVLVDIPPPPPPRAVEVAAV

SEQ ID NO: 20307 - protein, 610 aa, Oryza sativa Japonica Group
MRRGAIVDSPLLRPNVGAGLGQGAAMPAVHLDSGRLQQPPSGFRLHNVRNLPLQFTSTHLEGSRIRRGRRRFLPSHREVAAAIHVLVESCWNNNPLVPACVASSVRPSWFLTASPGIASLQVAGRAMSEFLTGSFQGEQALLKEESTERVCIDNSTCSDCTLVKVDSMNKNGILLEVVQVLSDLDLAISKAYITSDGGWFMDVFHVVDKQGQKVTDEKTIKHIEKALGPDSNLLGGAKGGSSPVRSVGMHSIGDHTAIELKGPDRTGLLSEVFAVLAELGCNVLAAEVWTHRARVACVVYVNDVASGQAVGDPCRLSRIEHRLRLVLRGHAGGDDGDGDDGPAHANFFSSGGAGSNTHVDRRLHQLMHADVDADDDDGLDSRAIVSGEAGNAAAAEERPVVTVEHCEEKDYSVVNVKCRDRSKLLFDIVCTLTDMHYVVSHASVSSDGIYGIQELYIRRKDGRTLQKDEAGRVIKCLEAAISRRVSEGFTLELCGRDRVGLLSDVTRVLREHGLTVTRADVTTVGGQAINVFYVRDASGEPVDMKTIEGLRVQVGHTVMLNVKKVPSSPSSSSAAAAAAANGKSPGQPASGALSRTSFFSFGNLFAKLRA

SEQ ID NO: 20308 - protein, 555 aa, Mycobacterium avium subsp. paratuberculosis K-10
MTTARPVKTRNEGQWALGDREPLNDTEKIKLADGPLNVRERIINVYAKQGFDSIDKSDLRGRFRWMGLYTQREQGYDGSWTGDDNTDKIEAKYFMMRVRSDGKAMSAHTMRTLGQISTEFARDTADISDRENLQLHWIRIEDVPEIWRRLESVGLQTTEACGDCPRGIHGSPLAGDSLDEVLDPSPAIEEIVRRSLNNPEYANLPRKYKTAVSGLQDVSHETHDVAFVGVEHPEHGPGLDLWVGGGLSTNPMLAQRLSVWVPLDEVPDVWEAVTQLFRDYGYRRLRAKARLKFLVKDWGIEKFREILEQEYLNRRLIDGPAPAPVKHTIDHVGVQKIKNGLNAVGVAPIAGRVSGTTLSAVADLMEQVGSDRARWTPFQKLVILDVPDDKVDELVTGLDALGLPSRPSSWRKNTMACTGIEFCKLSFAETRVRTQTLVPELERRLADVDAQLDAPISVHLNGCPNSCARIQVADIGFKGQWIDNGDGTSVEGFQVHLGGGLGEQSGFGRKLRQHKVTSEELGDYIDRVTRKYLEGRNDGETFASWALRADEEELR

SEQ ID NO: 20309 - protein, 163 aa, Pseudomonas fluorescens PfO-1
MRHIISLLLENEPGALSRVVGLFSQRNYNIESLTVAPTEDPTLSRLTLTTVGHDEIIEQITKNLNKLIEVVKLVDLSESAHIERELMLVKVKATGAQRAEIKRTTDIYRGQIVDVSASVYTVQLTGTSDKLDSFIQSIGTASILETVRSGVTGIARGDKVLSI

SEQ ID NO: 20310 - protein, 226 aa, Sinorhizobium meliloti 1021
MMTHPIRIAPSILAADFSKLGQEVRDVAEAGADWIHLDVMDGHFVPNITFGPDVIKSLRPHTRATFDCHLMIAPADPFLEAFAKAGCDIITVHAEAGPHLHRSLQTVKSLGKKAGVSINPATPESAIEYVLDTVDLILVMTVNPGFGGQKFVGATEEKIRRIKAMIGSRPIEIEVDGGIAPDTAGVAAKAGANVLVAGSAIFKGDSVDAYRSAIEVLRTQAQKARG

SEQ ID NO: 20311 - protein, 405 aa, Aspergillus oryzae
MQKLLAKDKAEEKQKQGTKGVVYNIAETCCASISVNDLQELSEDKSLSPLDLSTKLTYGAIRGSERLRRTLANLYSVKTPTQLPSDNVLITPGAIQANFLLLYSLVGPGDHVICHYPTYQQLYSVPASLGAEVSLWKSKENDGWKLDLNELKELIRPNTKLIILNNPQNPTGAVIPQATLEEIVEIARSSSIFVHADEVYRPIFHSITPMEPEFPLSLLSLGYERTIVTGSMSKAYSLAGIRVGWIASRDRSVIEACASARHYTTISVSQLDDAIASYALDASCIHNLLKRNIQLAKTNLAILEKFIESYRWACGWVKPRAGTTAFVRFSKMGKPVDDVAFCEMLLERTGIMFVPGSQCFGEGEDFKGYVRIGVVQETHVLEEGLEVLKSFMEEGYEEVPVIRKK

SEQ ID NO: 20312 - protein, 225 aa, Mesorhizobium sp. BNC1
MTTGADAATERQDKPGGKLFIRPWIFIRGVPAMKFLPPEGPPEVAFAGRSNVGKSSLINGLVGRKGLARTSNTPGRTQELNYFVPEGYSGEAGDLPPMALVDMPGYGFAKAPKAQVDAWTKLVFDYLRGRVTLKRVYLLIDARHGIKKIDEEVMDLLDSAAVSYQIVLTKADKIKSPAVTKLVAETGQKIVKRPAAFPEVIATSSEKGEGLEELRAAIVHAVTAG

SEQ ID NO: 20313 - protein, 379 aa, Candida glabrata CBS 138
MSLANLYMCSVACAINLNINFTMDSKIIKNYLLPKAIYKPGNKIGATIFNDNRTINNKLPLSLEKNANSLNIMDNTNVLKSVLKNYKCNKSLPYSSLIDKENISNESSQIHIAKENSEVDLCNTTLDNAYEYLLKLDEDTYLPDTILNEYSSLRQTRDLLLNWVIKIHQNLKLENETLYMTIDLIDKFLIKKKLPIEKFQLLGLTCLYIASKYEEVLPPSIFQFALESNGIFDSEEIKESEFNILETLNFKIGYPSPIVLLDRQLDGYLNYNEMKFMSLYLLEITFVDFRFLSYRMSMRTKAAALITLKMYNHSIKDLKTRFQKEGLMQTIEKICRYILQYLLEPTIHTELQRKYSQLASYNVADRATKYVKCLIKKYA

SEQ ID NO: 20314 - protein, 170 aa, Zea mays
MAPTVMMASSATAVAPFQGLKSTASLPIARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 20315 - protein, 333 aa, Candida glabrata CBS 138
MDMDKRVERVPLAEVRASNVLSQPVTISSSKRKLEVYDGEETPAKKVKVVDQVAIRDVATVPEYSTDIFKNLFKSEEDTIPSHNYLLDEKSEYHIRANMRAILVDWLVDVHRNFKCLPETLLLAINILDRVLSSTKVSVSKLQLVAVTSLFIACKYEEVKLPKIANFAYITDGAATVEDIREAEFNILETLRFNINWPNPLNFLRRLSQIDDYNYELRDIAKFVLEFIMCTHYFVNYKPSFLSAMAIYLSKRICNDESSNHNEGILTTWSATHTEYSGGINPNNDPKFNDSLNVLIDEFKQPSNSTKSLLAKYKANTYHGMFFRVQDWCLNYI

SEQ ID NO: 20316 - protein, 572 aa, Bacillus licheniformis ATCC 14580
MLELKGIGASAGIAIAKAYRLEEPDLTVEKKNISDSDAEVNRFEDAIERSKKELETIKNHALKELGEDKAEIFSAHLLVLSDPELLNPIKDKIKSDSVNAEFALKETADMFVTMFESMDNEYMKERAADIRDVTKRVTGHLLGVEIPNPSLISEEVIIVAEDLTPSDTAQLNRNFVKGFTTDIGGRTSHSAIMARSLEIPAVVGTKAATKGIQNGVTVIVDGINGDVIVDPSQETISEYEEKHQAFLAQKAEWAKLVNEPTVTSDGHHVELAANIGTPDDVKGVLENGGEAVGLYRTEFLYMGRDQLPTEEEQFDAYKTVLERMEGKSVVVRTLDIGGDKELPYLELPKEMNPFLGYRAIRLCLDEQEIFRTQLRALLRASTYGNLKIMFPMIATVNEFKAAKAILLEEKEKLKAEGQQVSDDIEVGMMVEIPSTAVIADQFAKEVDFFSIGTNDLIQYTMAADRMNERVSYLYQPYNPAILRLITLVIEAAHKEGKWVGMCGEMAGDEIAIPILLGLGLDEFSMSATSILPARTQISKLSKKETESFKEQILSMSTTEEVVQFVKETFNLA

SEQ ID NO: 20317 - protein, 441 aa, Prosthecochloris aestuarii DSM 271
MKSAGKEGKATIGFFGAVAIGIGGMVGGGIFAVLGEAVSLAHGSTSLAFIIAGSVAIVTAFAYARLSVAFPGRGGTVLFIDRAFGNNLASGSVNLMLWLSYLVTIALYANAFASYAETFFHGGGGLPFLRHLLISAAILLPTFINLTNASFVSRSETVIVLFKLLLLIVIIGFSLPAVGVVAVLPTELTLLPSIATAGMVIFVAYEGFELIANASDDVRNPGNTLPAAFFSSVVIVIMLYVIIGYVTVGAVPEKELLRAKDYALAVAARPSLGETGFTIVAIAALLATFSAINATIYGNARLGYFLARDGELPKVFDRQLWNEPVTGVLVTACISLLIANTLDISSIAVIASASFLLVFALVNASAAALTKEINGRRWIHVLGAVCCGVSLSVLLVHAVLSDFSAIVVFLVFIVVSVLFEWIYGKTARGHFLGRPYDAGKT

SEQ ID NO: 20318 - protein, 414 aa, Geobacillus thermoleovorans
AWVMFVLLGLWLVFGLSVPGGRAEAAVSRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFSTERTYRGALTGNYYPELGMNAFSAIVCAPFLGSYRNAALGIDSHWLENDGIVNTISMNGPKRGSSDRIVPYDGALKKGVWNDMGTYNVDHLEIIGVDPNPSFDIRAFYLRLAEQLAKLAGS

SEQ ID NO: 20319 - protein, 99 aa, Triticum aestivum
  misc_feature (9)..(9): Xaa can be any naturally occurring amino acid
RAYSLQHLXIGGTFITDESLYAVANSCTNLKSIILWSCRHVTEAGLVALVNKCRRLECINVGGMRVPPESFVGLLSISPALQIRSIHRILNAGVGVQVS

SEQ ID NO: 20320 - protein, 225 aa, Halobacterium sp. NRC-1
MKQAGGSAEQKRRAGEAAVAEEVTEGAVVGLGTGSTVAHAIRALGAEASDVSGVATSFESRRRAVDAGVTVTSLEAASVDVAIDGADQVADGVLVKGGGAAHTREKYVAASADRFVVVADPSKESDVVDVPVPVAVVPDAWPVVVDRVEALGGTATLRDAERKDGPVVTDTGSLVVDCDFGAIETPEAVAASLSAVPGVVEHGLFVGMADAVYVGTDDGVRVRDP

SEQ ID NO: 20321 - protein, 304 aa, Nicotiana langsdorffii x Nicotiana sanderae
  misc_feature (200)..(200): Xaa can be any naturally occurring amino acid
LQGPCRALLADLSGGKAGRMRTANAFFSFFMAVGNVLGYAAGSYSRLYKIFPFSKTPACDIYCANLKSCFFIAVFLLLSLTTLALTVVRENELPEKDEQEIDEKAAAGGKSKVPFFGEIFGALRDLPRPMWILLLVTCLNWIEWFPFFLYDTDWMAKEVYGGKVGDGRLYDLGVHAGALGLLLNSVVLGFMSLGVEFLGXKIGGVKRLWGILNFVLAVCMALTVLVTKMAEKSRQYDAHGTLMAPTSGVKIGALTLFAVLGIPLAVTFSVPFALASIFSSNAGSGQGLSLGVLNLAMVVPQMLV

SEQ ID NO: 20322 - protein, 516 aa, Corynebacterium efficiens YS-314
MHYFELMLKDTAGTSPGIHTAPSAGPGATSPTVPMRTLIALIVGSMVGAGIFSLPQNIGSVAAPGAMLIGWVIAGVGMLAVAFVFHILARRKPHLDSGVYSYARVGLGDFVGFCSAWGYWLGSVIAQVGYATLFFGTLGHYVPVFSSENRVTSALAVSVLTWVIFAVVAGGVKQAAFLTTVTTIVKILPLLAFIILVAFLGFSWDRFTVDFWGTGANSTVGSVFDQVKGIMVFTVWVFIGVEGASVYSRQARSRKDISRATIIGFFAVLALLVTISSLSFGVLTQQELAVLPDNSMASVLEAVVGDWGAALISAGLCLSVLGAYVSWQMLCAEPLALMAMDGLIPRRVGTINSRGAAWVAQLISTIVIQLFIVIFFLNETTYVSMVQLATILYLVPYFFAALYLVALATRGRGISHPHAGTLIDDSGPTIPPRENTRHAMVGIAATVYSIWLFYAADPKYLLFGAIALLPGLIPYVGTRLYRREQVFNAFEWGVLVLLLVAAGFGAAGLIGGGLTL

SEQ ID NO: 20323 - protein, 302 aa, Zea mays
MRAPVHPMQRHRPSYSSGRAMAWPAPPFLYAPSPLEAWASAAGAVAMAFLAVSEFRGDHLAYSKFSRGGGGGGGGGQQGTKQRQRQRVRVPSRVGMVLLYFPALAAALASFAVPGAVDGARAHVLSAAVAVHFLKRVLEALFLHRYSGSMPLATSLLIAGHYLFAGVGMIYAQRLRRRGLPEPRVDLLLPGVLAFAVGLAGNFYHHYLLSRLRARDGGDAGGEGAYRIPSGGLFGLVACPHYLFETLAFFGLAMVSQTLFALTVAVGTAAYLAGRSRATRKWYAAKFDDFPSSVKALVPYVW

SEQ ID NO: 20324 - protein, 418 aa, Pseudomonas fluorescens PfO-1
MGYKKIQVPAVGDKITVNADHSLNVPDNPIIPFIEGDGIGVDVSPVMIKVVDAAVEKAYGGKRKISWMEVYAGEKATQVYDQDTWLPQETLDAVKDYVVSIKGPLTTPVGGGIRSLNVALRQQLDLYVCLRPVVWFEGVPSPVKKPGDVDMVIFRENSEDIYAGIEWKAGSPEATKVIKFLKEEMGVTKIRFDQDCGIGIKPVSKEGTKRLVRKALQYVVDNDRKSLTIVHKGNIMKFTEGAFKDWGYEVAKEEFGAELLDGGPWMKFKNPKTGREVVVKDAIADAMLQQILLRPAEYDVIATLNLNGDYLSDALAAEVGGIGIAPGANLSDTVAMFEATHGTAPKYAGKDQVNPGSVILSAEMMLRHLGWTEAADLIIKGTNGAIKAKTVTYDFERLMEGATLVSSSGFGEALIKHM

SEQ ID NO: 20325 - protein, 282 aa, Bacillus licheniformis ATCC 14580
MMTAKNLQDRIKLNNGTAMPWFGLGVFKVEEGPELVQAVKTAIKHGYRSIDTAAIYGNEEGVGQGIREGLKEAGISREDLFVTSKVWNDDLGYDETIAAYEASLEKLGLDYLDLYLIHWPVEGRYKAAWKALETLYEQGRVKAIGVSNFQIHHLEDLLKDAAVKPAINQVEYHPRLTQKELQAFCRAHGIQLQAWSPLMQGQLLSHPLLKDIADKYGKTPAQVILRWDLQNGVVTIPKSTKAERIAQNADIFDFELTTEEMKQIDALNENTRVGPDPDNFDF

SEQ ID NO: 20326 - protein, 186 aa, Nicotiana langsdorffii x Nicotiana sanderae
MVPKNLIMFSSLAVEQPLPKSKLWKIIMVASIAAGVQFGWALQLSLLTPYVQLLGIPHKFASFIWLCGPISGMIVQPVVGYYSDNCTSRFGRRRPFIAAGAALVTIAVFLIGFAADLGHSSGDPLEKGSSKPRAIAVFVVGFWILDVANNMLQGPCRALLADLSGGKAGRMRTANAFFSFFMAVGN

SEQ ID NO: 20327 - protein, 742 aa, Vitis vinifera
MTINDNKITDLDHGWDYMQKGIIKLKKILEGLPEPQFSSEDYMMLYTTIYNMCTQKPPHDYSQQLYEKYREAFEEYITVTVLPSLRDKHDEFMLRELVKRWANHKVMVKWLSRFFYYLDRYFIARRSLPALNEVGLACFRELVYQEVHGRVKDAVISLIDQEREGEQIDRALLKNVLDIFVEIGMGKMDYYADDFEADMLNDTAAYYSRKASNWVLKDSCPDYMLKAEECLKRERDRVSHYLHISSEPKLVEKVQTELLVVYANQLLEKEQSGCHALLRDEKVDDLSRIYRLYHKIPRGLEPVSSIFKQRVSDEGLALVNQAIDAANNQVQYLDPSSFNPVLVRKIIELHDKYMVYVCNCFMNQSLFHKALKEAFEIFCNKTVAGCSSAELLAAFCDNILKKGGSEKLSDEAIEDTLEKVVKLLAYIGDKDLFAEFYRKKLARRLLFDRSANDEHERSILTKLKQQCGGQFTSKMEGMVTDLALARENQGHFEEYLSNNPIANPGIDLTVTVLTTGYWPSYKSSDLNLPAEMVRCVEVFKEYYHSKAQQRKLSWIYSLGNCNISGRFDSKTIELIVSTYQASVLLLFNNSDRLSFSEIMDQSNLGHDDLVRVLLSLSCAKYKILNKEPNTKTISPTDYFEFNSKFTDRMRRIKIPLPPVEERKKIVEDIDKDRRYAIDASIVRIMKSRKILSHQQLVTECVEQLSRLFKPDFKAIKKRIEDLISRDYLERDKENPNLYRYVA

SEQ ID NO: 20328 - protein, 425 aa, Corynebacterium efficiens YS-314 [sequence omitted]

SEQ ID NO: 20329 - protein, 160 aa, Nicotiana langsdorffii x Nicotiana sanderae
IMVASIAAGVQFGWALQLSLLTPYVQLLGIPHKFASFIWLCGPISGMIVQPVVGYYSDNCTSRFGRRRPFIAAGAALVTIAVFLIGFAADLGHSSGDPLEKGSSKPRAIAVFVVGFWILDVANNMLQGPCRALLADLSGGKAGRMRTANAFFSFFMAVGN

SEQ ID NO: 20330 - protein, 286 aa, Petunia x hybrida
MAENKEEDVKLGANKFRETQPLGTAAQTDKDYKEPPPAPLFEPGELSSWSFYRAGIAEFMATFLFLYITILTVMGVKRSDSLCHSVGIQGIAWAFGGMIFALVYCTAGISGGHINPAVTFGLFLARKLSLTRALFYIVMQCLGAICGAGVVKGYMQGPYQRLGGGANEVAHGYTKGDGLGAEIVGTFVLVYTVFSATDAKRNARDSHVPILAPLPIGFAVFLVHLATIPITGTGINPARSLGAAIIYNTDAAWDDHWIFWVGPFIGAALAAVYHQIIIRAIPFHKS

SEQ ID NO: 20331 - protein, 266 aa, Coprinopsis cinerea okayama7#130
MTSGTYTPSPSFNAAVAYLSSPSYRGSPSNATKLELYALFKYTTTQSAKPTSSRPGIFDFTGRAKWDAWAEIGSKYRSVEEAERRYVELARELGWDGVVPVEASSSSSSGPERSSERPKAEEGEEEEIQWDSSDDDESSQPPKAGGSGGGGRGGGQGLGVTVSAVARPEEESSGDTKSLHGVVLNGDLSLLQDLLNKDPTLNLDAPDEYGYTPLHLAADRGHVEIVKFLLSKGANPTLKDPDEFTPLELAQVSGNEEIVAALKEAT

SEQ ID NO: 20332 - protein, 312 aa, Mesorhizobium sp. BNC1
MRYETCGPIEARAKSMTEITETAEAQAALLSAALPYMQRYENKTVVIKYGGHAMGDIALGRAFARDVALLKQSGVNPIVVHGGGPQIGDMLKRMGIESKFEGGLRVTDQKTVEIVEMVLAGSINKEIVALINAEGEWAIGLCGKDGNMVFAEKARKTVVDPDSNIERVLDLGFVGEPVEVDRTLLDLLARSEMIPVLAPVAPGRDGYTYNINADTFAGAIAGAVKASRLLFLTDVPGVLDRDKKLINELTVSQARALIKDGTISGGMIPKVETCIEAIQRGVEGVVILNGKTAHSVLLELFTEHGAGTLIVP

SEQ ID NO: 20333 - protein, 397 aa, Legionella pneumophila subsp. pneumophila str. Philadelphia 1
MSQFPRIKRLPPYVFNTINQLKMEARARGEDIIDFGMGNPDQPTPPHIVNKLIEVAQRPDTHRYSMSKGIPRLRRAMATWYLRHYDVHLDSEKQILATIGSKEGLAHLALAISGPGDTVLVPDPAYPIHTYGFIIAGANVKQIPLIDEVQFLAAVEDAINRTWPKPKALVLNFPANPSTHCVEYEFFEKVVDLAKRNNIWIIHDLAYADIVFDGYKAPSILQVPGAIDIAIETYSMSKSYNMPGWRVGFACGNEELVAALTRIKSYLDYGTFTPIQVAAITALEGPDDCVLEIRNLYEKRRNLLCDGLNDIGWEVSKPKGTMFVWAPIPLNYRAMGSLEFSKYLLKEAQVAVSPGIGFGQQGDGYVRFGLIENKDRIRQALRNLKALFKRDGLLKAI

SEQ ID NO: 20334 - protein, 536 aa, Mycobacterium avium subsp. paratuberculosis K-10
MFGLVLIVALVSTVIVGTVIGRRYRVGPPVLLIVLGVLLGLVPQFGHVRIDGEIVLLLFLPAILYWEGLNISFREIRANARIIVFLSVALVIATAVAVSWTARALGMDPHAAGVLGAVLSPTDAAAVAGLAKKLPRRSLTVLKAESLINDGTALVLFAVSVHVAIGAPAISPPEVTLRFIGSYLGGIAAGLLVGGAVTLVRKRIDAPQEEGALSLVTPFAAFLLAQSVECSGVVAVVVSALVLAYSGPVVIRARSRLQSYAFWDIATFLLNGSLWVFVGVQIPGALRGIAGVDGGVRHALFVALVITGVVIVSRIFWGEFTTMLIRLIDRRAVQRERRVGWRQRFVTAWAGFRGAVSLAAAVAVPMTTLSGAPFPDHSLLIFIVTVVILVTVLVQGSTLPAVVRWARLPADVAHAEELQLARTRAARAALAALPAVADEVGVSDELRRRLHKEYEEKAALVLATENGSPDNRILKTREKVRQVRLGVLEHKRREVTALRNQNRIDDTVLRELQNEMDLEEVQLLAAAADEDDGDTE

SEQ ID NO: 20335 - protein, 391 aa, Burkholderia xenovorans LB400
MFPKESPVLPSFSPALLALADGTVFRGYSIGAPGHTIGEVVFNTAITGYQEILTDPSYARQIVTLTYPHIGNVGVNAEDVEAAKVHAAGLIIRDLPVLASNFRMERTLQQYLQDEGVVAIAGLDTRMLTRVLRDKGAQNGAILAGSDDEARAIELARSFPGLSGMDLAKVVSTKESYEWTQTEWRLGSGYGTQNAPKYRVVAFDYGVKYNILRMLAERGCHVTVLPAEASAADALALNPDGVFLSNGPGDPEPCDYAIRATKELIDRGIPTFGICLGHQIMGLAVGAKTMKMKTGHHGANHPVKDLDDGRVVITSQNHGFAVDADTLPANARVTHVSLFDGTLQGFTLTDKPAFCFQGHPEASPGPHDIAYLFDRFTALMDTKKAGKTAAA

SEQ ID NO: 20336 - protein, 265 aa, Coprinopsis cinerea okayama7#130
MPRAIISPSVLASDFGQLTAECKRMIKGGAEWLHMDVMDGFTPTLGAPILSCVRKGIPDIFMDCHMMVAQPERWVDDIADAGGAMYCFHIEATCMYRTVYIFSTLYSTSSGYPTKPHTTADPIALIHQIHKRNMKAGVAISPDTPSTAITDEIGQLADMLLVMTVYPGRGGQKFIERCVPKVSELRARFPDKDIEVDGGVGPKTIDVCAEAGSNVIVAGTAIFGADDPPAVIKSLKETVEAAQAKFAAARAQQQKSNGSNGANGN

SEQ ID NO: 20337 - protein, 360 aa, Streptomyces coelicolor A3(2)
MTEAILLVGGKGTRLRPLTVNTPKPMVRAAGVPFLTHQLARAKAAGVEHIVLATSYLAEVFEPYFGDGSTLGLHLEYVTEEEPLGTGGAIRNVASRLHSGPDEPVLIFNGDILTGLDIGALVRTHETTGADVSLHLTQVTDPRAYGLVPTDDTGRVLAFLEKPQTPEEIVTDQINAGAYVFRRSVIDTIPAGRPVSVERETFPELLATGAHLQGMVDSTYWLDLGTPAAFVRGSADLVLGRAPSPAVPGRCGDRLVLPTAQVAPDAKLTGGTVVGEGAFVAEGARVFGSTILPGAVIEPGAVITDSLIGTRARVGTRSVLADTVIGDGAVIGADNELRSGARIWCDAHIPPASLRFSPDT

SEQ ID NO: 20338 - protein, 92 aa, Oryza sativa
  misc_feature (12)..(12): Xaa can be any naturally occurring amino acid
  misc_feature (20)..(20): Xaa can be any naturally occurring amino acid
  misc_feature (26)..(26): Xaa can be any naturally occurring amino acid
  misc_feature (60)..(60): Xaa can be any naturally occurring amino acid
QPNGSVTESIEXVKMSKRAXWGVMTXHRSGETEDTFIADLAVGLPPGQIKTGAPCRSERXLAKYNQLLRIEEELGAAAVYAGAKFRAPVEPY

SEQ ID NO: 20339 - protein, 389 aa, Bacillus licheniformis ATCC 14580
MEHLLNPNVKEIEISGIRKFSNLVSQYENVISLTIGQPDFFTPHHVKQAAKKAIDENQTSYTHNAGYPELRQAVQLYMKKKADLNYEAESEIIVTTGASQAIDSAFRTILSPGDEVILPGPVYPGYEPIIKMCGASPLIIDTTSHGFKLTAKLIEEALTPKTKCVVLPYPSNPTGMTLSEEELKDIASLLKGRNVFVLSDEIYSELTFDRPHHSIATVLRDQTIVIGGLSKSHSMTGWRIGFLFAPKEIAKHILKVHQYNVSCASSISQKAALEAVTNGFDDALIMREQYKKRLDYVYDRLVTMGLDVIKPSGAFYIFPSIKSFGMSSFDFCMSLLEEEGLAIVPGSSFSEYGEGYVRISYAYSPDTLREGLDRLESFVFNKRQSIQTT

SEQ ID NO: 20340 - protein, 632 aa, Zea mays
MRQQTGKRPSQHREYEREERKDQHKRPFPRAQESSNNDGLVLYRILCPDSLIGSVIGKHGNVINAIRHQTSAKVKVVDPYPGADKRVILVYCYVKHRDLDAEGDDNEPVCAAQDALLRVHNAIVDALQTLHKNHKDSDKKSTEEANILVPASQASNVIGKSGAVIKHLRSTSRAFIKVSPKDPSDPTHSCAMSFDNFVQITGGAEAVKKALFGVSTIIYKHPSKENIPLETSIPDPTPSIIIPSELPVYPASNFYSAPDAAIPSVHPSMSVLGSTRHVPELAVPADDHGRLPIYQSILPVIPTYSAPKCSGELEFRVLCPGGKIGLVIGRGGATIKNIRQESGARIDVDDAKNDKEESIITIISTESTDDVKSAAVEAVLLLQAKINDSEDDRMNLRLLVPNKVIGCLIGRGGSIVNDMRKKTKANILISKGDKPRRASSSDELVEVSGEADKLRDALVQIILRLREAVLKESVESQNSDRDGQLTVAASDSLYGSSLPLPALLPHNQQIAPLGYDRRGEPERALEVFPRTSSYGYSSMQVTDDGYGGLPSYASKAYEEHVPRLEMTVPASGISKVMGKHGTNLDNIRKISGAHIEIIEPKSSRHEHIAYISGTSEQRHSAENLIKAFIMST

SEQ ID NO: 20341 - protein, 476 aa, Ralstonia metallidurans CH34
MQQRDKLFINGSWVTPHGTGFIDVIHSATEDVMGKIPEGDARDAENAIAAARAAFEAWSATPPSVRADYIRKIAEGLKARCEELAQMIAGEVGMPIKLARAIQVGGPVYNWGQAAALLDQFAFEEQVGNSLVVREPVGVVAAITPWNYPLNQITLKVAPALAAGCTVVLKPSEVAPLNAFVLAEVIEAAGLPPGVFNLVTGYGPVVGEVLASHPEVDMVSFTGSTRAGKRVSELAAQSVKRVALELGGKSASVILDDADLPTAVKGTIGACYLNSGQTCSAHTRMLVPRSRYEEVKAIAAKVVEGFTVGDPLADTTKLGPLISAVQKERVTGYIRRGLDEGAELVAGGPDTPAGLDRGFFVKPTVLGNVDPKATVAQEEIFGPVLSVICYDTEDEAIRIANDSIYGLGGGVWSGDESRAIRVARRIRTGQVDINGGPFNMNAPFGGFKQSGNGREGGKFGLEEFLEYKSLQLKKPA

SEQ ID NO: 20342 - protein, 107 aa, Agaricus bisporus
PDFEAVLLLADQLISRIEYIHSRNFIHRDIKPDNFLMGTGKRGNQVNVIDFGLAKKFRDPKTHLHIPYRENKNLTGTARYTSINTHLGVEQARRDGLEIWPNFEAVL

SEQ ID NO: 20343 - protein, 327 aa, Halobacterium sp. NRC-1
MGRMIDGDWRTEADMNEHSDDGAFERDTTSFRHWVGDDVPPAAGRYHLYVSYACPWAHRTLLVRALLGLEDAISVSVVDPVRYDQGWTFDPEKPGCTPDHVFGGTHLRDVYTEADPEYTGRVTVPVLYDTDADTIVNNESEEIMRMLDVAFDDHAARDVDLYPEGYRDEVDRLIEDIYDPINNGVYRAGFADSQRAYDNAVDDLFEALAHYDDVLAEQRYLAGDVLTEADVAMFTTLYRFDEVYHTHFKCNRKRISDYDNLWPYLRELCQLPGVADTLYMEHVKQHYYRSHGHLNPKRLVPTGPNPAFFAPHDRDQLPGGPPAALNQ

SEQ ID NO: 20344 - protein, 163 aa, Streptomyces avermitilis MA-4680
MEFDVTIEIPKGSRNKYEVDHETGRIRLDRRLFTSTSYPADYGFVENTLGEDGDPLDALVILDEPTFPGCLIKCRAIGMFRMTDEAGGDDKLLCVPAHDPRVEHLRDIHHVSEFDRLEIQHFFEVYKDLEPGKSVEGANWVGRTDAEAEIERSYKRLKEQGGH

SEQ ID NO: 20345 - protein, 415 aa, Thermus thermophilus HB8
MLRLDTRFLPGFPEALSRHGPLLEEARRRLLAKRGEPGSMLGWMDLPEDTETLREVRRYREANPWVEDFVLIGIGGSALGPKALEAAFNESGVRFHYLDHVEPEPILRLLRTLDPRKTLVNAVSKSGSTAETLAGLAVFLKWLKAHLGEDWRRHLVVTTDPKEGPLRAFAEREGLKAFAIPKEVGGRFSALSPVGLLPLAFAGADLDALLMGARKANETALAPLEESLPLKTALLLHLHRHLPVHVFMVYSERLSHLPSWFVQLHDESLGKVDRQGQRVGTTAVPALGPKDQHAQVQLFREGPLDKLLALVIPEAPLEDVEIPEVEGLEAASYLFGKTLFQLLKAEAEATYEALAEAGQRVYALFLPEVSPYAVGWLMQHLMWQTAFLGELWEVNAFDQPGVELGKVLTRKRLAG

SEQ ID NO: 20346 - protein, 184 aa, Glycine max
EGSIGDKMAGLKEGRISLNDVLRYGINLAQGVQELHSKGSFILNLKPFNVLLNDNDQAILGDVGIPSLLLGSSFLSSDMAKRLGTPNYMAPEQWEPEVRGPISFETDSWGFGCTIVEMLTGNQPWYGCPVRRIYQSVVEKHEKPNIPSGLPSSVENILSGCFEYDLRNRPLMVDILSVFQRFVN

SEQ ID NO: 20347 - protein, 1074 aa, Bacillus licheniformis ATCC 14580
MNKLDGIPIPKTYGPLGNLPLLDKNRVSQSLWKIADEMGPIFQFKFADAIGVFVSSHELVKEVSEESRFDKNMGKGLLKVREFSGDGLFTSWTEEPNWRKAHNILLPSFSQKAMKGYHPMMQDIAVQLIQKWSRLNQDESIDVPDDMTRLTLDTIGLCGFNYRFNSFYREGQHPFIESMVRGLSEAMRQTKRFPLQDKLMIQTKRRFNSDVESMFSLVDRIIADRKQAESESGNDLLSLMLHAKDPETGEKLDDENIRYQIITFLIAGHETTSGLLSFAIYLLLKHPDKLKKAYEEADRVLTDPVPSYKQVQQLKYIRMILNESIRLWPTAPAFSLYAKEETVIGGKYLIPKGQSVTVLIPKLHRDQSVWGEDAEAFRPERFEQMDSIPAHAYKPFGNGQRACIGMQFALHEATLVLGMILQYFDLEDHANYQLKIKESLTLKPDGFTIRVRPRKKEAMTAMPGAQPEENGRQEERPSAPAAENTHGTPLLVLYGSNLGTAEEIAKELAEEAREQGFHSRTAELDQYAGAIPAEGAVIIVTASYNGNPPDCAKEFVNWLEHDQTDDLRGVKYAVFGCGNRSWASTYQRIPRLIDSVLEKKGAQRLHKLGEGDAGDDFEGQFESWKYDLWPLLRTEFSLAEPEPNQTETDRQALSVEFVNAPAASPLAKAYQVFTAKISANRELQCEKSGRSTRHIEISLPEGAAYQEGDHLGVLPQNSEVLIGRVFQRFGLNGNEQILISGRNQASHLPLERPVHVKDLFQHCVELQEPATRAQIRELAAHTVCPPHQRELEDLLKDDVYKDQVLNKRLTMLDLLEQYPACELPFARFLALLPPLKPRYYSISSSPQLNPRQTSITVSVVSGPALSGRGHYKGVASNYLAGLEPGDAISCFIREPQSGFRLPEDPETPVIMVGPGTGIAPYRGFLQARRIQRDAGVKLGEAHLYFGCRRPNEDFLYRDELEQAEKDGIVHLHTAFSRLEGRPKTYVQDLLREDAALLIHLLNEGGRLYVCGDGSRMAPAVEQALCEAYRIVQGASREESQSWLSALLEEGRYAKDVWDGGVSQHNVKADCIART

SEQ ID NO: 20348 - protein, 286 aa, Petunia x hybrida
MEHREEDVNLGANKYSERQAIGTAAQSQDKDYIEPPPAPLFESGELMSWSFYRAGIAEFMATFLFLYITVLTVMGVSKSDSKCSTVGIQGIAWAFGGMIFALVYCTAGISGGHINPAVTFGLFLARKLSLTRALFYMVMQCLGAICGAGVVKGFGKTLYQTKGGGANVVAPGYTKGDGLGAEIVGTFVLVYTVFSATDAKRSARDSHVPLLAPLPIGFAVFLVHLATIPITGTGINPARSLGAAIIYNQEHAWNDHWIFWVGPFIGAALAALYHQVVIRAIPFKSK

SEQ ID NO: 20349 - protein, 283 aa, Petunia x hybrida
MSKEVIEEGQVQQHGKDYVDPPPAPLLDFAELKLWSFYRALIAEFIATLLFLYVTVATVIGHKKLNGADKCDGVGILGIAWAFGGMIFVLVYCTAGISGGHINPAVTFGLFLARKVSLTRAIAYIISQSLGAICGVGLVKAFMKSYYNSLGGGANSVNSGYSNGTALGAEIIGTFVLVYTVFSATDPKRSARDSHVPVLAPLPIGFAVFMVHLATIPITGTGINPARSFGAAVIYNNDKVWDDHWIFWVGPFVGALAAAAYHQYILRAAAIKALGSFRSNPTN

SEQ ID NO: 20350 - protein, 307 aa, Crocosphaera watsonii WH 8501
MTKLVLFDHDGAIDDFLATLLLMTMPNIEVLGIIVTPADCYINAALNVTRKLLDLMGCDPIPVAESTVRGINPFPALYRRDSLIIDNFPILNQENTIKTPLVSQTGQQFMVETLHRASEPVTLMVTGPLTTVATALDIDPTIENKIKEIVWMGGALNVAGNVEKEFAPEHDGSAEWNAYWDAIAVQKVWQTNIPLIVCPLDITNKVPVTPEFIRRLAKQRQSQLSDLAGLCYALAIPQDYYCWDVLATSYLHRSDLFSLKSWPTEVITTGTSQGRIKVVEKGRNILAMDTIDKDQFHDYILQQWTKF

SEQ ID NO: 20351 - protein, 334 aa, Legionella pneumophila subsp. pneumophila str. Philadelphia 1
MILNVVNSIFSKLSIAPMIDWTNSPFRTLMRLLAPNALLYTEMQTTGAVQNNPDRALYFNSVEHPLAIQLGGADKSALVKCAIIAEQKGFNEINLNLGCPSDKVQAGRFGACLMKEPEHVADCIRAIKQVVGIPVTAKTRIGIDNQDSYEFFRSFSLHLVEAGCDKLIIHARKAWLNGLNPKQNRTIPPVNYDYVYELKKEIPHIFITINGNILTVEEINNHLKHVDGVMLGRLACDNPYQIAEIHQALYPEFIKIKRSQLLMNYLDYWFDQSRANLSLSILVKPLFNLAFGLPGAKHWKKKLMNIIQEKNTSGFSELIQYLLNLEAINQVEFV

SEQ ID NO: 20352 - protein, 256 aa, Petunia x hybrida
MAELKKWSFYRAVIAEFIATLLFLYVTIATVIGHKRLNGANPCDGVGILGIAWAFGGMIFVLVYCTAGISGGHINPAVTFGLFLARKVSLIRAVAYIISQCLGAICGVGLVKAFMNKHYYNSLGGGANEVASGYNKGTALGAEIIGTFVLVYTVFSATDPKRSARDSHVPVLAPLPIGFAVFMVHLATIPITGTGINPARSFGAAVIYNQDKAWDDQWIFWVGPFIGALIAALYHQFVLRAGAVKALGSFRSNPTN

SEQ ID NO: 20353 - protein, 352 aa, Triticum aestivum
MAGTGLWVVGLASLLALPGIFVSVSVEASPGDADPHYRTCVGECQNTGIIGGNIISHCQSRENDSISAGSSWYTQEALRVQWKQLNCMTDCRYYCMMRREEERRLGGLSPIQYHGKWPFKRVSVFQEPLSAALSALNLLMHFTGWLSFFLLVKYRLPLRPQTKKTYYEYTGLWHIYAILSMNAWIWSSVFHTRDIDLTEKLDYSSAVAVLGYSLILTLLRIFNVKEGATRVMFAAPILAFVTTHILYLNFYELDYGWNMKVCVAMGVVQIVAWAIWAGVTHHPSRLKLWVVVFGGALAMLLEVFDFPPYKGYADAHSLWHASTVPLTYLWWSFIKDDAQFRTSTLTLVKKAR

SEQ ID NO: 20354 - protein, 233 aa, Bacteroides fragilis YCH46
MKWESSLVEHLQWSDTITNRESKEQLARMIAMRVQEGEIIGAGSGSTVYLALLAIAERIRTENLHVTVIPASMEISMECVRLGIPQTTLWMCRPDWTFDGADEVDPDHNLIKGRGGALFKEKLLICSSNRTFILVDESKQVSFLGSRFPVPIEVFPMALPYVEREVLTMGALRTELRLAKGKDGPVITENGNLILDAWFGNIHSSLEKEIKSITGVVENGLFMGYDVEVMVAK

SEQ ID NO: 20355 - protein, 299 aa, Salmonella enterica subsp. enterica serovar Typhi str. CT18
MDFTQQLQACVTQANQALSRFIAPLPFQNTPVVEAMQYGALLGGKRLRPFLVYATGQMFGVSTATLDAPAAAVECIHAYSLIHDDLPAMDDDDLRRGLPTCHIKFGEANAILAGDALQTLAFTIISDAPMPEVADRDRIAMIAELANASGIAGMCGGQALDLAAEGQRITLDALERIHRHKTGALIRAAVRLGALSAGDKGRNTLPILDRYAESIGLAFQVQDDILDVVGDTATLGKRQGADQQLGKSTYPALLGLEQARNKARDLIEDARQSLHQLAAQSLDTSALEALANYIIQRDK

SEQ ID NO: 20356 - protein, 286 aa, Petunia x hybrida
MAKNVGSEGSFTTKDYQDPPPAPLIDPAELTQWSFYRALIAEFIATLLFLYITVLTVIGYKSESDPAKNADPCSGVGILGIAWAFGGMIFILVYCTAGISGGHINPAVTFGLFLARKVSLIRAVMYMVAQCLGAICGVGLVKAFQSAYYHRYDGGANMLSDGYSKSVGLSAEIIGTFVLVYTVFSATDPKRNARDSHVPVLAPLPIGFAVFMVHLATIPITGTGINPARSLGAAVIFNQDKAWKDHWIFWVGPFIGAAIAAFYHQFILRAGAAKALGSFRSSTSQA

SEQ ID NO: 20357 - protein, 410 aa, Arabidopsis thaliana
MGSVSLKIGDGTARFRRTSICSSAVNLLMLFSVVTTNLFALYAFSSHSQANSPLLHSSNNISLVSQHLSLILREIDSSQRKLAQMEKQMLGYESIDISRPNIVPELKLFLQRHQLPLGKDSRTGITEMVSSVGHSCEKSTDLLSQYMSYKVFDRCPDDWSLGQKLILRACEPLPRRRCLAKTVQKQDLSKSPDSLWRSVSNKSVNWSGLGCKSFDCLKGKKLSKECVGCFDLGVEKDRFVKVKGKNDFLIDDVLGLGSGKIRIGFDISGGSGTFAARMAEKNVTVITNTLNNGAPFSEFIAARGLFPLFLSLDHRFPFLDNVFDLIHASSGLDVEGKAEKLEFLMFDLDRVLKPRGLFWLDNFYCANDEKKKELTRMIERFGYKKLKWVIGEKADAQVYLSAVLQKPVRA

SEQ ID NO: 20358 - protein, 530 aa, Coprinopsis cinerea okayama7#130
MYPVDGVRSQLEWNSELSLNTVTPTETTKFLRKTSIIATIGPKVNTVEKLTELVRAGVNIVRMNFSHGSYEYHQSVIDNTRAVQANDPKGRPIAIALDTKGPEIRTGVTKEGKDWPVSAGQEFIVSTDERYAEACDSQVMYVDYANLPKVTAPGKLIYVDDGILSLLVLSVDGKNIHVRALNSGNISSRKGVNLPKTDVDLPALSEKDKKDLEFGVKNGVDMIFASFIRKAEDVQDIRTVLGPDGANIKIIVKIENEQGVANFDEILKEADGVMVARGDLGIEIPASQVFLAQKMMIAKCNIVGKPVIVATQMLESMTYNPRPTRAEVSDVANAVLDGADCVMLSGETAKGNYPIQSVLMMAETCLLAESSICYPPLFDDIRAIQPRPTATAETVAIAAVAAASEQGAKAILVLSTSGNTARLVSKYKPSVPIITVTRNQQTARQIHLHRGCYPFWYPEPRGIEAHQWQTDVDNRIRYGLRNALALHLITPGSTVIAVQGWKGGLGHTNTLRVLSVPTDPADLELQPLGA

SEQ ID NO: 20359 - protein, 169 aa, Aspergillus oryzae
MAEPRARAARHKGQMNFAAELRLLLLAYGDPSPHPSFPSEPLPETVRVLDEIVTDFVLEMCHGAAQYAAYSRRQKIKVDDFRFALRRDPNKLGRVQELLRMERELKEARKAFDQNDDQVGNLKDASKKELEDLGEGTDGKKSKGKGKRNARRDSDATEDTTVSKKRKTG

SEQ ID NO: 20360 - protein, 425 aa, Chlamydophila abortus S26/3
MLTDLKNEKKQSKIWHPFAQPGLDHKPIHIVRGEGAYLYTQSGTAYLDAISSWWCNLHGHAHPYIAQKISEQAYQLEHVIFSNITHTPAEELSQRLTELLPEGLERCFFSDNGACSIEIALKITLQYLYNQGRPKTRFVSFKHGYHGDTFGAMSIAGPTDINQPFQSLLFSADTIDPPYYGKEDISLQQAKALFSTGEIAGFIYEPILQGTGGMRVYNPEGLDAILALAKHYDVLCIADEILTGFGRTGPLFASEYMKTHPDILCLSKGLTGGFLPLAVTVVREEIYQAFVAKDRRLAFLHGHTYTGNPLGCAAALASLDLTLSPQCKQQREMIETCHKQFQSQYGSLWQRCDVLGTVLAVDYPTKSLGYFSNLRDTLYNFFIENHLILRPLGHTIYVLPPYCIHEEDLHRIYHYLQEILCLQIQ

SEQ ID NO: 20361 - protein, 390 aa, Pseudomonas fluorescens PfO-1
MAQPYSARSRAIEPFHVMALLARANELQAAGHDVIHLEIGEPDFTTAEPIIRAGQQALTAGKTRYTAARGIPELREAISGFYQTRYGLNIDPRRILITPGGSGALLLASALLVDPGKHWLLADPGYPCNRHFLRLVEGAAQLVPVGPDVRYQLTPDLVARHWDHDSVGALVASPANPTGTILTRDELSGLSTAIKARHGHLVVDEIYHGLTYGTDAASVLEVDDSAFVLNSFSKYFGMTGWRLGWLVAPDAAVSELEKLAQNLYISAPSMAQHAALACFEPDTIAILEERRAEFGRRRDFLLPALRELGFNIAVEPEGAFYLYADISQFGGDAFAFCRHFLETEHVAFTPGLDFGRYQAGHHVRFAYTQNLPRLQEAVERIARGLKSWQG

SEQ ID NO: 20362 - protein, 499 aa, Alteromonadales bacterium TW-7
MNNQNNNTDKPNLSFWQIWNMCFGFLGIQFGFALQNGNVSRIFQTLGAQVDDIPILWVAAPLTGLIVQPIIGYWSDKTWGRFGRRRPFFFVGAVLTTLSLFIMPHSPTLWIAAGMLWIMDASINVTMEPFRALVGDNLPEKQRATGYGLQSFFIGIGAVLASALPWMMTNWFDVSNTAAAGQIPESVKYSFYWGGVVLLVAVLWTVARTKEYSPEQLAEFEQQTAKSTTAIIADINFNKGAIIFVVLGLATLALVMGLSLEKELYLLAGGLLAFGIVQWIAAALKSANKTQGGFYQVVQDVFTMPEAMKQLAWVQFFSWFTLFAMWIYTTAAVTSFHYGSSDATSKAFNDGADWVGILFAAYNGFAAIAAMCIPFLVKKMGLKGAHCFNLLLGALGLASFIFIQDPKMLLIPMIGVGFAWASILSLPYAMLSNALPSNKMGVYMGIFNFFIVIPQLLAASILGLILRFVFSNQPIYALLIGAASFVVAAIAVMRVKNSN

SEQ ID NO: 20363 - protein, 763 aa, Chlamydomonas reinhardtii
MSATLTFWDRNPPYAAVALARLANVPVAATHDPKATKETVPTLSVSGETFTGTMILKYIARASAQRDELYGGSDAVAACQVDQWLDQAGAITPAALEAQAAALNDFLQLRTFLVGYSLTLADLAVWGALQASPLWNKVRGSGKVPHLARWFAFCSEVPQVRAATEELAALAGKKPGAPAAGGADKKGAGAGAAGDNKKGGAAGGAAGAAAGGAEGGDAGGSFDIGLPGAEEGKVVTRFPPEPSGYLHIGHAKAALLNQYFADMYKGKLLVRFDDTNPSKEKDEFVENIMKDIADLGLRYEKLTYTSDYFPQLLDLGERMIRAGLMYADDTPVEAMREQRGRGEESACRGRSVEENLRLWEEMKAGSEVGLANAMRFKIDMKSVNGTMRDPVAFRCNLTHHWRTGTKYKLYPTYDCACPFVDAVEGVTHALRTSEYRDREEQYYWILSAYQKVWPGGLPHVHIWDYSRLNFVNTVLSKRKLTWFVDTGRVDGWADPRMPTVQGILRRGLRIEALKEFILSQGASKNITFQEWDKIWTINKKLIDPVCPRHTAVDVEGKVLLTLEDGPSPPEVVTVPRHLKYPPAGKKAVTRGRTLWLEQADAAAISEGEEVTLMSWGNAVITAVTRDAATGAVTALAGKLNLAGDVKKTKLKLTWLAAVPECETVELSLLDFDYLITKKKVEEDDNFMDLVNPVTKFEKAALGDPNMRSLQKGDVIQLERKGYYIVDEPHGVKGAGKPMVLFAIPDGRTKNMTKPGAAAPAASS

SEQ ID NO: 20364 - protein, 92 aa, Glycine max
  misc_feature (22)..(22): Xaa can be any naturally occurring amino acid
  misc_feature (58)..(58): Xaa can be any naturally occurring amino acid
RVLVKSASIFVEVTWKSKLKAXFPSPNEYSFFRGDFSRSPAIATSQTMFVSQSILPKXGCRVATTITLTVHLLTGVGCLFYNIARGRDCKRS

SEQ ID NO: 20365 - protein, 479 aa, Zea mays
FERPDFPQFFSGATPLVGSLPYAQCYGGHQFGVWAGQLGDGRAIALGEVVNSRGERWELQLKGCGKTPYSRFADGLAVLRSSIREFLCSEAMHGLGIPTTRALCLVETGKSVVRDMFYDGNAKEEPGAIVCRVAPSFLRFGSYQIHASRGKEDIEIVRRLADYTIHHHFPHLENMKKSEGLSFETAIGDSPTIDLTSNKYAAWAVEVAERTAYLIARWQGVGFTHGVLNTDNMSVLGLTIDYGPFGFLDAFDPSYTPNTTDLPGERYCFANQPDVGLWNIAQFTGPLSSAELISQDEANYVMERYGTKFMDEYQSIMTKKLGLTKYNKQLISKLLSNMAVDKVDYTNFFRLLSNVNADPGIPENELLVPLKAALLDIGKERKEAWISWVQTYIEELVESGVPDEERKAAMNSVNPKYILRNYLCQSAIDVAEQGDYEEVRRVLRVMHNPYDEQPGMEKYARLPPAWAYRPGVCMLSCSS

SEQ ID NO: 20366 - protein, 142 aa, Glycine max
  misc_feature (94)..(94): Xaa can be any naturally occurring amino acid
  misc_feature (99)..(99): Xaa can be any naturally occurring amino acid
  misc_feature (109)..(110): Xaa can be any naturally occurring amino acid
MADSSSSSSKRQKQHDDDDDDVEEQQPLIPGLPDHIAELCLSSINHSLLFSISHSCRRLIYSPSFPPFFSLYAILSHSSATIHFHTFDPISALXSPFPXAPSPPPPPPXXHPSFLSRSLSVQCVSFSNRLVLLAVTTHNLSP

SEQ ID NO: 20367 - protein, 340 aa, Aspergillus oryzae
MGQTLSEPVVDKTSSEGEDDCCIYGVSAMQGWRISMEDAHAAVLDLHAKYTSPEETSTDPAKRLAFFGVYDGHGGDKVALFAGENVHKIVAKQDSFAKGDIEQALKDGFLATDRAILEDPKYEEEVSGCTAAVSVISKHKIWVANAGDSRSVLGVKGRAKPLSFDHKPQNEGEKARISAAGGFVDFGRVNGNLALSRAIGDFEFKKSPELAPEQQIVTAYPDVTVHELSDDDEFLVIACDGIWDCQSSQAVVEFVRRGIAAKQELYRICENMMDNCLASNSETGGVGCDNMTMIIIGLLNGRTKEEWYNQIAERVAKGDGPCAPPEYGKSLEDSTASNPY

SEQ ID NO: 20368 - protein, 107 aa, Glycine max
MAQRNVTANSSFERTSLPSLDQKLAMAKRCSHEGVMAGAKAAVVATIATAIPTLASVRMLPWARANLNHSAQALIISTVAGAAYFIVADKTVLATARKNSFNRPSNA

SEQ ID NO: 20369 - protein, 160 aa, Picea sitchensis
MDEFDEEDIWGSTVDPRTKQVIGFQENECNGVAQCRSMGKDGSSNNRRRSVKFHQKESCHEENNNRRRTRYQSSAPLTIPYLSQMVWEEKNSENFGRRSHGISDDDKDLEKLPPHEFIAMQYAQRGITSFSVYEGVGRTLKGRDLSRVRNAVWTRTGFIE

SEQ ID NO: 20370 - protein, 727 aa, Oryza sativa Indica Group
  misc_feature (431)..(431): Xaa can be any naturally occurring amino acid
MAHGGGEEEEERVLSHGDVVLLRCDLTILRGPHFLNDRIIAFYLAHLAADHHDDDLLLLPPSVPYLLSNLPDPASVAAVADPLRLASRRLVLLPVNDNPDVSHAEGGSHWTLLVLDNSNAVSGPRFVHHDSLPPTNLPSARRLAAVLRPLLPASAIPLIEGPTPRQTNGYDCGVFVLAVARAICNWWPTRARHSDSDSDSDWLEAVKRECDMQSHKKVAAVKPVASRPSSRLRSFSMLQEDSTAIDSPRLEDSGTHTTYDQKKAETGKGACWDNLTVSQSVRKPNVSAKNSLSYDGYSWRKYGQKQVKGSEFPRSYYKCTHPTCPVKRKVEMTPDGWIAEIVYNGEHNHPKPHPPRKPTLSTSVETLVATNDAGLENKLEGCDQAIGSDAVVEALRGGCHCLDGFRNGNEISDCKKRTLLTNLFRGKKNQXHENSCPRMPHPRIVPCHCISRLSPSTQLPSHPSIASTSLPVTAQDFGTWCDMQSHKKVAAVKPVASRPSSRLRSFSMLQEDSTAIDSPRLEDSGTHTTYDQKKAETGKGACWDNLTVSQSVRKPNVSAKNSLSYDGYSWRKYGQKQVKGSEFPRSYYKCTHPTCPVKRKVEMTPDGWIAEIVYNGEHNHPKPHPPRKPTLSTSVETLVATNDAGLENKLEGCDQAIGSDAVVEALRGGCHCLDGFRNGNEISDCKKRLFRFGVRFHDGSCKRILAQPHNIINLGSHLVAEYVQEKQ

SEQ ID NO: 20371 - protein, 375 aa, Ralstonia metallidurans CH34
MQRTARLKPLAALLLSASLLTGVAHAQLSPAPAASANAPAGTTAEARKANIVIIGTGGTIAGAGAAATNTAAYQSAVVPVDKIIASVPEISKIANVKGEQVFQIGSESFNNERLIKLAKRVSELLKQPDVDGIVITHGTDTIEETAYFLNLTLKSDKPVVVVGSMRPGTALGADGALNLYDAVLVASNPASKGKGTLVVLNDEIQTGRDVTKTNTFKVETFRSPFGPLGYVVEGRTLYFRLPARPHTTQTEFDIDKIDKLPEVAVVYAYGNMNPAAIDAAVKSGAKAIIFDATGNGSVGDYMVEPLKAARAKGVFIVRASRTGSGVVIRNGEQPDDKYDWIVTDDQIAQKARILMALALTKTNDPKALQEIFWKY

SEQ ID NO: 20372 - protein, 447 aa, Streptomyces coelicolor A3(2)
MALKITVIGTGYLGATHAAAMAELGFEVLGLDVVPEKIETLQRGEVPMYEPGLRELLGKHVAGIEGSSGRLRFTTDFAEVAAFGDVHFLCVNTPQKHGEYACDMSYVDSALASLAPHLTGPALVVGKSTVPVGSADRLAAYLAEHAPAGDGAELAWNPEFLREGFAVEDTLHPDRLVVGVRSERAERLLREVYATPIEEGSPFVVTDFPTAELVKTAANSFLATKISFINAMAEVCEAAGGDVAKLAEAIGYDDRIGKKFLRAGIGFGGGCLPKDIRAFMARAGELGADQALTFLREIDSVNMRQRGRMVELTRQALGGGPFLGKRVAVLGATFKPDSDDVRDSPALNVAGQVHLQGAQVTVYDPKGMENARRLFPTLGYADSALEAVRGADVVLHLTEWREFRELDPEVLGEAAAARVILDGRNALDPALWRKAGWTYRAMGRPTA

SEQ ID NO: 20373 - protein, 499 aa, Oryza sativa
MGALALALVVVVVVHVAVNAFGRRRLPPSPASLPVIGHLHLLRPPVHRTFHELAARLGPLMHVRLGSTHCVVASSAEVAAELIRSHEAKISERPLTAVARQFAYESAGFAFAPYSPHWRFMKRLCMSELLGPRTVEQLRPVRRAGLVSLLRHVLSQPEAEAVDLTRELIRMSNTSIIRMAASTVPGSVTEEAQELVKVVAELVGAFNADDYIALCRGWDLQGLGRRAADVHKRFDALLEEMIRHKEEARMRKKTDTDVGSKDLLDILLDKAEDGAAEVKLTRDNIKAFIIDVVTAGSDTSAAMVEWMVAELMNHPEALRKVREEIEAVVGRDRIAGEGDLPRLPYLQAAYKETLRLRPAAPIAHRQSTEEIQIRGFRVPAQTAVFINVWAIGRDPAYWEEPLEFRPERFLAGGGGEGVEPRGQHFQFMPFGSGRRGCPGMGLALQSVPAVVAALLQCFDWQCMDNKLIDMEEADGLVCARKHRLLLHAHPRLHPFPPLL

SEQ ID NO: 20374 - protein, 465 aa, Oryza sativa Indica Group
MAHGGGEEEEERVLSHGDVVLFRCDLTILRGPHFLNDRIIAFYLAHLAADHDADDDLLLLPPSIPYLLSNLPDPASVAAVADPLRLASRRLVLLPVNDNPDVSHAEGGSHWTLLVLDNSNAVSGPRFVHHDSLPPTNLPSARRLAAVLRPLLPASAIPLIEGPTPRQTNGYDCGVFVLAVARAICNWWPTRARHSNSDSDWLEAVKREPFNSTSFSPFDCIYQSACHSTRLWDLVRYAKPQEGCCCEACGFQAFFQIELEDSGTHTAYDQKKADTGKGACWDNLTVSQSVRKPNVSAKNSLSYDGYSWRKYGQKQVKGSEFPRSYYKCTHPTCPVKRKVEMTPDGRIAEIVYNGEHNHPKPHPPRKPTLSTSVETLVATNDAGLENKLEGCDQAIGSDAVVEALRGGCHCLDGFRNGNEISDCKKRTLLTNLFRGKKNQQHENSCPRMPHPRIVPCHCISRLRSN

SEQ ID NO: 20375 - protein, 159 aa, Triticum aestivum
  misc_feature (152)..(152): Xaa can be any naturally occurring amino acid
MVPGRHGRGISVVPAEGLLPPHLLLASCRRFVKVPAAMAARLAQLRTKAAQAAEFASKHGGAYYKEAMEKNKQYVVQPPSVEKCQELSKQLFYTRLASLPGRYEALWKEVDGVKQLWKNRKELRVEDLGIATLFGVELYAWFCIGEIAGRGXTLTGYKV

SEQ ID NO: 20376 - protein, 490 aa, Ipomoea batatas
LNNNVLLSQSRKSLRLDGNKRKIKPGVAFSVLTRENGTETLTVEAPILERRRANPKNVAAIILPGGAGTQLFPLTNRAATPAVPLGGCYRLIDIPMSNCINSGVNKIFVLTQFNSASLNRHISRTYFGNGVSFGDGFVEVLAATQTQGETGMKWFQGTADAVRQFTWVFEDAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADNYETESEIASLLADGKVPIGVGENTKIRNAIIDKNVRIGKHVVITNKDGVQESDRPDEGFYIRSGITIIMEKATIRYGTVI

SEQ ID NO: 20377 - protein, 462 aa, Shewanella sp. ANA-3
MGKLSIKQWLVFSAMLVAVLLAMFPLQQHPALFSYSASVVLITLLFWSTGFIPPFMAGLIFFALATIFKLIDPSALFSGFGSAAVWLIISGFVIGSAISESGLSRRLAAVIAPALTMSYPRMIAGLVISAMLLGFVMPSSVGRAVVMLPIGMALADQLGFSRGSNGRIGIATALALACNMPSLAVLPANIPNMILAGASENLFNVHFGYAEYLFLHFPILGLLKSAIIVALVVYLFPAKINKNQIAAATDIEAYDVVKQVKLALLLIITLLFWITDSWHGINPAWVGLTTAIILLLPKWGIIEPKRFNQSVDFSTVIFVAAALGLGALVNQSGLGSALGQAFSQYLPLSQGASFLNFISLSLISTLTGLVATVPGVPTVLTPMAADLANATGFSLPAVLMTQVIGFSTVIFPYQAPPLILAMQLSQESLAHLLKVTLPLALITLLVLMPLDYLWWHLLGWIS

SEQ ID NO: 20378 - protein, 119 aa, Streptomyces avermitilis MA-4680
MDRVALRGLKARGHHGVFPKEREEGQTFIVDLVLGLDTRPAAADDDLSKTVHYGIVAEEVVAVVEGDPVDLIETLAERIAFSCLKHAPVLEVEVCVHKPDAPITVPFDDVTVTITRSRV

SEQ ID NO: 20379 - protein, 313 aa, Elaeis guineensis
WDVGHQSYPHKILTGRRDKMHTIRQTNGLSGFTKRSESEYDCFGTGHSSTTISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKRIGGPMHELAAKVDEYARGMISGSGSTLFEELGLYYIGPGDGHNIDDLIAILKEGKGTKTTGPVLIHVVTEKGRGYPYAEKAADKYHGVTKFDPATGKQFKGSAITQSYTTYFAEALIAEAEVDKDIVAIHAAMGGGTGLNLFLRRFPTRCFDVGIAEQHAV

SEQ ID NO: 20380 - protein, 455 aa, Thermus thermophilus HB8
MYDLLVIGAGPGGYVAAIRAAQLGMKVGVVEKEKALGGTCLRVGCIPSKALLETTERIYEAKKGLLGAKVKGVELDLPALMAHKDKVVQANTQGVEFLFKKNGIARHQGTARFLSERKVLVEETGEELEARYILIATGSAPLIPPWAQVDYERVVTSTEALSFPEVPKRLIVVGGGVIGLELGVVWHRLGAEVIVLEYMDRILPTMDLEVSRAAERVFKKQGLTIRTGVRVTAVVPEAKGARVELEGGEVLEADRVLVAVGRRPYTEGLSLENAGLSTDERGRIPVDEHLRTRVPHIYAIGDVVRGPMLAHKASEEGIAAVEHMVRGFGHVDYQAIPSVVYTHPEIAAVGYTEEELKAQGIPYKVGKFPYSASGRARAMGETEGFIKVLAHAKTDRILGVHGIGARVGDVLAEAALALFFKASAEDLGRAPHAHPSLSEILKEAALAAWERPIHL

SEQ ID NO: 20381 - protein, 163 aa, Glycine max
  misc_feature (27)..(27): Xaa can be any naturally occurring amino acid
  misc_feature (39)..(39): Xaa can be any naturally occurring amino acid
  misc_feature (47)..(47): Xaa can be any naturally occurring amino acid
LVPSTLARPSTHLEAPFKEDLDRFPAXYLYQHCMETNGXTITSDGSXTRSQHGPILCGEPCSNAQHSFFQRVHQCTKRIRNDFILPYKSHNPVSDNLHHRMLGSGYYDQDEALMGGKTDDHARAKGTCDELDDHKRYRGNRPTTYILGRGAIGPAELGAQIVY

SEQ ID NO: 20382 - protein, 406 aa, Thermus thermophilus HB8
MQELKVPSVGESIVEVEIGAWLKGEGESFAQDEPLVELITDKATLELPAPFAGTLKQILKRTGETARVGEAIALLEEGRAEAAPKAQAPAEAPKEPSPEPLAMPAAERLMQEKGVSPAEVQGTGLGGRILKEDVMRHLEERAPAKPQEAPPPPPPSRPAPPPSTPPQPPADKPWRVSEAVPMTPLRRRIAERLLMVRQTTAMLTTFNEADMSAVIALRKEFGEAFQKKYGVKLGFMSFFVKAVVQALKEIPELNAEIRDNHIVYHRYYDIGIAVGGGEGLVVPVIRDADRLSFAEIEQKIADFAERARTKKLKPEELMGGTFTITNGGIYGSLNSTPLLNPPQVGILGMHAIQERPVVRDGQVVIRPMMYLALSYDHRIVDGREAVTFLRRVKELIENPARLLLEV

SEQ ID NO: 20383 - protein, 545 aa, Pseudomonas putida GB-1
MATCGEVLVKLLEGYGVDHVFGIPGVHTVELYRGLAGSSIRHITPRHEQGAGFMADGYARTRGKPGVCFIITGPGMTNITTAMGQAYADSIPMLVISSVQTRDQLGGGRGKLHELPNQAALVAGVAAFSHTLMSAADLPQVLARAFAVFDSARPRPVHIEIPLDVLVEPADFLLPGRPVRGSRAGAAPQAVAQMAERLASARRPLILAGGGALAAGAALARLAEHLQAPVALTINAKGLLPASHPLQIGSTQSLPATRELVAEADVVLAIGTELAETDYDVTFKGGFEIPGSLLRIDIDPDQTVRNYLPELALVADAELAAEALFGALQAQPQPVHESTWGEARVAKLRQALAADWDQPTLSQTRLLNAILERLPNAILVGDSTQPVYTGNLTLDMHQPRRWFNASTGYGTLGYALPAAMGAWLGSAEQADQRAPAVCLIGDGGLQFTLPELASAVEAQVPLVVLLWNNQGYEEIKKYMVNRAIEPVGVDIHTPDFIGVARALGAAAEHVTDVVQLQAALGLALERKGPTLIQVDQNQWQETVLR

SEQ ID NO: 20384 - protein, 120 aa, Brassica napus
LTSFGSRATKLSSTATKMSTVTRAYLDQRLAAANRCSKEAAMAGAKAAAVATVAAAVPTLASVRMLPWAKAHLNPTGQALIISTVAGMAYFIVADKTILSMARKHSFDDAPDHLKNTSFH

SEQ ID NO: 20385 - protein, 416 aa, Arabidopsis thaliana
MGLFGTKKIGKYEIGRTIGEGNFAKVKLGYDTTNGTYVAVKIIDKALVIQKGLESQVKREIRTMKLLNHPNIVQIHEVIGTKTKICIVMEYVSGGQLSDRLGRQKMKESDARKLFQQLIDAVDCCHNRGVYHRDLKPQNLLLDSKGNLKVSDFGLSAVPKSGDMLSTACGSPCYIAPELIMNKGYSGAAVDVWSCGVILFELLAGYPPFDDHTLPVLYKKILRADYTFPPGFTGEQKRLIFNILDPNPLSRITLAEIIIKDSWFKIGYTPVYHQLSDSIKDNVAEINAATASSNFINAFQIIAMSSDLDLSGLFEENDDKRYKTRIGSKNTAQETIKKIEAAATYVSLSVERIKHFKVKIQPKEIRSRSSYDLLSAEVIEVTPTNCVIEISKSAGELRLYMEFCQSLSSLLTAEVS

SEQ ID NO: 20386 - protein, 188 aa, Erythrobacter sp. SD-21
MNRPGVNIIPIHGKTPQIHDSAFIAPGCTIIGNVTIGAESSIWYNCVLRADVSRIVIGERTNVQDGSVLHCDPERPGDPDGSPLIIGDDVLIGHMAMIHGCRIEDRGFVGLGAIAMNKAVIGSDAMLAAGAMLTEGKVMGARELWGGRPARKMRDLDDAAVAGMRMGVAHYAENAKAHSKAVDEALED

SEQ ID NO: 20387 - protein, 364 aa, Angelica archangelica
MAPTTITALAQEKTLNLAFVRDEDERPKVAYNQFSNEIPIISLAGMDDDTGRRPQICRKIVEAFEDWGIFQVVDHGIDGTLISEMTRLSREFFALPAEEKLRYDTTGGKRGGFTISTHLQGDDVKDWREFVTYFSYPIDDRDYSRWPDKPQGWRSTTEVYSEKLMVLGAKLLEVLSEAMGLEKEALTKACVNMEQKVLINYYPTCPEPDLTLGVRRHTDPGTITILLQDMVGGLQATRDGGKTWITVQPVEGAFVVNLGDHGHYLSNGRFKNADHQAVVNSTSSRLSIATFQNPAQNAIVYPLRIREGEKAVLDEAITYAEMYKKNMTKHIEVATLKKLAKEKRLQEEKAKLETESKSADGISA

SEQ ID NO: 20388 - protein, 554 aa, Pseudomonas fluorescens PfO-1
MAYYRTPHDVTALPAWQALKDHRQAMQDFSMREAFNADPQRFNQFTLSSCGLFLDYSKNLINAETRNLLVGLANEVDLKGAIKALFDGEIVNSSEGRPALHTALRRPVGDKLSVNGVNVMPEVHKVLNQITDLVGRIHDGLWRGYTEKPITDVVNIGIGGSFLGPELVSEALLSYAQKGVRCHYLANIDGSEFHELTQKLRAETTLFIVSSKSFNTLETLKNAQAARAWYLAQGGSEAELYRHFIAVSSNNAAAVAFGIREENIFPMWDWVGGRYSLWSAIGLPIALAIGMSNFKELLSGAYTMDQHFQSAPFEQNMPVLLALLGVWYGNFWGAQSHAILPYDHYLRNITKHLQQLDMESNGKSVRQDGTPVSTDTGPVIWGGVGCNGQHAYHQLLHQGTQLIPADFIVPIVSFNPVSDHHQWLYANCLSQSQALMLGKTLPEAEAELRDKGMSEDQVQKLAPHKVIPGNRPSNTLVVERISPRRLGALVAMYEHKVFVQSVVWGINAFDQWGVELGKELGKGVYNRLVGSEETAAEDASTQGLINYFRGRHRG

SEQ ID NO: 20389 - protein, 163 aa, Oryza sativa Japonica Group
MMSSRERKKAAALQEKLQILRSITHSHALSNTSILMDASKYIKELKQKVVRLNQEIACAQDALRQNRVTVETLRHGFLVNVFSGKSCPGLLVSILEAFDELGLSVLEATASCTDTFRLEAIGSENLMEKVDEHVVKQAVLRAIRSCSGSGGDHHDDDDDDDDE

SEQ ID NO: 20390 - protein, 531 aa, Chlamydophila abortus S26/3
MMDRKGFLDSPSTKILQDLAVAPVDLTTPGIISQERVERFSLSIGGFTLSYATERVDEGVVSALTDLASERGLVSSMQAMQSGEVVNYIDNFPSESRPALHTATRAWVKEIPLTGNAEDIALRSKIEAQRLKDFLHQYRDAFTTIVQIGIGGSELGPKALHRALKGCCPSDKKVYFVSNIDPDNAAEVLQEIDCSKTLVVTVSKSGTTLETAVNEEFIADHFLKQGLHFRDHFIAVTCEGSPMDDRSKYLEVFHIWDSIGGRYSSTSMVGGVVLGFAYGFDVFFQLLEGAAAMDLAALAPQMSENLPMLAAMLGIWNRNFLGYPTSVIVPYSAGLEYFPAHLQQCGMESNGKSIAQTGEIIGFATSPILWGEVGTNSQHSFFQCLHQGSDVIPIEFIGFLDNQRGRDIVISGSTSSQKLFANMVAQSIALAKGRENTNPNKSFRGNRPSSLLVAERLTPYTMGALLAFYEHKIVFQGFCWGINSFDQEGVTLGKDLANQVLGIMQGQAKEGACLEAEALLKLFNSTQKKKS

SEQ ID NO: 20391 - protein, 315 aa, Sinorhizobium meliloti 1021
MREPKPQEDLQAIIDDIYRELTPRLGEGKVADYIPQLARVDARHFGMAIVTTGGEVYRVGDAEMPFSIQSISKVFTLTLALGKHGENIWNRVGREPSGSAFNSIVQLEHEGGKPRNPFINAGAIRISDLILAGHTPKELIGEIVRFVRYLADDENIVIDHEVARSETATGYRNIALANFMRSFGRLDHPVEHVLGVYFHHCALAMTCSQLAKAGLFLAAGGTNPLTGHSVVSRQRARRINALMLTCGHYDGSGDFAYRVGLPGKSGVGGGIMAVAPGKASIAVWSPGLNDYGNSLLGSLALEMLAARTGWSVFGP

SEQ ID NO: 20392 - protein, 370 aa, Thermotoga maritima MSB8
MRVLGLILAGGKSDRLWPLTKVRASAAVPVFGKYRAIDFTLSNMVNSGIRKVGILTQYNPRSLMDHLGSGKEWDLDRKSGGLFILQPYVGPNREVWYRGTADAIFQNMTILRRGEEDHVLIGSGDHIYKMIYRDLFNYHLKKGADITLVVKELDETYNLSEYGIVQLDDDMRVVEIEEKPAHPKGNIAFLGVYFMNKELLKELLYATVPQGKYDLLLDIVIPNLDRLKVYAYRFDGYWRNVKKGIKEYYRINMDILKKEVRDELFYRNGKVYTKLKDLPPPKFTTTAVVENSLIADGSIVSGTVRNSVIFRNVRIKVGAVVENSIIMENTVVEEGAVLRNVILDKNCIVREGRVIEGDTELPVFEKRAVL

SEQ ID NO: 20393 - protein, 533 aa, Anabaena variabilis ATCC 29413
MTKAPVAPVVLVILDGWGYCEETRGNAIAAAKTPVMESLWTAYPHTLIHTSGKAVGLPEGQMGNSEVGHLNIGAGRVVPQELVRISDAVEDGSILSNSALVKICQEVRNRNGKLHLVGLCSEGGVHSHITHLFGLLDLAKEQRISEVCIHAITDGRDTAPTDGINAISALEDYINHVGIGRIVTVSGRYYAMDRDRRWDRIQRAYDVMTQDGAGDGRKAVDVLQASYAEGVNDEFIVPVRIAPGTVESGDGVIFFNFRPDRSRQLTQAFVSPEFTGFARQQIKPLSFVTFTQYDSDLSVSVAFEPQNLTNILGEVIANQGLNQFRTAETEKYAHVTYFFNGGLEEPFAGEDRELVSSPMVATYDKAPAMSATAVTDTAIAAIQKGIYSLIVINYANPDMVGHTGQIEPTIQAIETVDRCLGRLLEGVSKAGGTTIITADHGNAEYMLDEAGNSWTAHTTNPVPLILVEGEKVKIPGYGTNVELRSDGKLADIAPTILDILQLPQPPEMTGRSLLQPAEYDVQSPRTRIPVGLN

SEQ ID NO: 20394 - protein, 551 aa, Mycobacterium avium subsp. paratuberculosis K-10
MSSAGENTRRAEPVEPRGAAVLDSAHLGDIEGAFGRIRVGETEHARTWKTRLLTLLAIVGPGIIVMVGDNDAGGVATYAQAGQNYGYSLLWVLLLLVPVLIVNQEMVVRLGAVTGVGHARLINERFGRGWGWFSVGDLFLLNFLTIVTEFIGISLAAEYIGVSKYVVVPVSAAALVAIMASGSFRRWERAMFIFIAITLLQIPMLLMSHPQWGRAAKSFVVPSISGGVSSDAVLLIIAIVGTTVAPWQLFFQQSNVVDKRITPRFMGYERADTVLGAFVVVIGAAALVMTGDWAARSTDTVGGFTDAGATAHLLGQHRQVLGSIFAIVLMDASIIGAAAVTLATSYAFGDVFGLKHSLHRGFADAKQFYLSYTAMVVVAAAIVLIPGAPLGLITTAVQALAGLLLPSASVFLLLLCNDREVLGPWVNRAWLNWVAGLIVGTLLLLSGILMATTLFPDLNVVAVAGYLTLALIILAAGAAPVLRWLARRQPARPGPRLPARGVDRSTWRMPPLALLEPVTWSPGTRLAMIALRGYLVVGALLLVVKAIQLSR

SEQ ID NO: 20395 - protein, 115 aa, Magnaporthe grisea 70-15
MSAQSSAGIQTLLEAEREASKIVQKAREFRTKRVKEARDEAKKEIEAYKAEKEGEYKAFESKHTQGNKQAEEEANKEAETEIKEIKEAGKKHQDKVIKDLLKAVFEPHPVPPTAA

SEQ ID NO: 20396 - protein, 423 aa, Thermotoga maritima MSB8
MGNTVAMILAGGQGTRLGVLTERIAKPAVPFGGKYRLIDFTLSNCVNSGIYRVGVLTQYRPHVLSKHIGIGRPWDLDRKDGGVEILPPYVGRHESDWYKGTANAVYQNLEFLEENDAELVLILSGDHVYAMNYNDLIDYHLLKEADGTIACMEVPIEEASRFGIMITDVDGRIVDFEEKPAKPRSNLASLGIYVFNYEFLKKVLIEDENDPNSSHDFGKDVIPRILRENLGSLYAFRFDGYWRDVGTLRSYWEANLELVLPVPPFNLYDPNWRFFTHTEEMPPAYVAPGSKVSTSLVSEGAEVYGNVFNSVIFQGVKIGRGTVVKNSVIMTRTEIGENCYLENVIIAENVKIGSNVRMGVGEDAESKLDPKVYSGLLTVVGMNSVIPDDMVIGKNCVIGIGVRPEDFKSKTLESGDYVIVREE

SEQ ID NO: 20397 - protein, 1192 aa, Candida glabrata CBS 138
MERDYHVNTGFQMGRREEERGIAMAPASLRMMGKSGARELMEPATVNAGVQDIDANAEMQATDMPGAPASVPAERKSQGQGQSQGQGQGQGQGQGQMKQFHRKSLGDWDFLETVGAGSMGKVKLAKHRRTGEVCAIKIVNRATKAFLHKEQNSPPPVNNQEIMERQKKLEKEISRDKRAIREASLGQIFYHPHICRLFEMCTMSNHFYMLFEYVAGGQLLDYIIQHGSLREHHARKFARGVASALQYLHANNIVHRDLKIENIMISNSGEIKIIDFGLSNVYDTRKQLHTFCGSLYFAAPELLKAHPYTGPEVDVWSFGVVLYVLVCGKVPFDDENSSVLHEKIKRGKVEYPQHLSIEVMSLLSKMLVVDPSRRASLKQVVEHPWMTKGYDTPAPSYVPNRIPLTPEMLDSTVLREMFRLEFIEDIEETRKLLATIVSDPTYLTLSNEYWTRLQSITETTGQGKTTHFEIQGVSINFHLTSGVNKIPFEDPTRAFHPLLSIYYLVAEMLQRKMAKLQKKQALIQQQQQQIQKQQQQRVQQQQPQQQKQPLTPKEPEQTEFAYSKTPNTSDKSAGLTVPSRPTDIINEMKAKSDRTDYIMNTPKQDTGSNTTVEKLYTPKEQQSVERKTAPLHIMVPPKLTMPEQAHTSPTTRKSSDIHDELNTAMSPKVLSKEYEQRPNTQLDSPEKKRFPALFGKLSQKRQPSSQQSPQSNNNPQFQVHAAPNLEPAKRSTKTHTRTVSEYVPGPSNNKEFIETYLPSNYANKNNSPSRSVSTKVANTERFPALPANANTMVEQQLAKDMDNLNVNNNTNRAPDTSSADYDENKPLPPLTVTKGRKLHPSARAKSVGHSRRESLKFTRPPVPTNVQGYDNDDAGFLEYSDDNRNDSAIIRTPNSSKYLSPPTPNTRFGFGSTEELTDEQILEQASRAPPGTMPSIDYPRSLFLKGFFSVQTTSSKPLPIVRYKIMHLLKKMHVEFKEVKGGFVCTHEGQLSFLNNDNELPEYNPLAETDENNIDNRLTINTNLSPHPSQNHLQLPTPIENQAVTYRSIRSGSRQNSIRRQGSTKISPNIPTTPMATTEHHRNISEVMSPVAQNINLGSTLSDEHSTTSLDNIANQEDILTTSRVQNMNRPDLDLEQQAIAKASNEKSRVKFEIHIVKVRIVGLAGVHFKKVSGNTWLYKELASHILKNLNL

SEQ ID NO: 20398 - protein, 749 aa, Oryza sativa
  misc_feature (564)..(564): Xaa can be any naturally occurring amino acid
MGRAIDRPLEFPNNICMNLAVKRKKQHYSFALHKFQGRRFKHHPNLVKQHDFAESTSRTVCDRWQMDGTGNNAPTPRPVSGGVGAANPSLPDWLSACLVNLLENKLEDLLASGNLVIRQESNASSVLWQSFDDITDTWLPAPGMFSVEIDPDGSNQYIISWNKSVVYWGTGNWTGSSFPNMPELSPANTYPNTPYTYKFVNNDKETYFTYNVTDDRVLSRHAIGVSGQTQSLVWVESAQAWVLYFSQPKANCGVYGLCGVNSKCSGSALSSCSCLKGFSIRDPNSWNLGDQTAGCRRNVMLQCGSKSSAGGQQDRFYTIGSVKLPDKSQSIEATSIHSCKLACLSNCSCTAYSYNGTCSLWHSELMNLQDSTDGTMDSIYIRLAASELPNSRTKKWWIIGIIAGGFATLGLVVIVFYSLHGRRRISSMNHTDGSLITFKYSDLQILTKNFSERLGVGSFGSVFKGALPDTTAMAVNKLEGVRQGEKQFRAEVSTIGTIHHINLIQLLGFCSEGAKRLLVYEYMPNGSLDHHLFGSTGVSLSWSTRYQIAAGIAKGLAYLHEKCXRDCIIHCDIKPQNILLDSSFTPKVADFGMAKLLGRDFSRVLTSMRGTIGYLAPEWISGEAITTKADVFSYGMMLFEIISGKRNGMHGGSFFPVLVARELVEGELHKLFGSESSDDMNLGELDRACKVACWCVQDSESSRPTMGEIVQILEGLVDVEMPPVPRYLQVLGQGVKSYEISSEMNQASN

SEQ ID NO: 20399 - protein, 531 aa, Shewanella sp. ANA-3
MSADQQTVTPLENFSPKVAQRAVHRVQPELNFWQIFNMCFGFLGIQFGFALQNANVSRIFQTLGASIDDIPILWIAAPLTGLLVQPIIGYLSDNTWGRLGRRRPYFLIGAICTTLAIFVMPHSPTLWIAAGMLWIMDASINIAMEPFRAFVGDNLPPKQRTQGYAMQSFFIGIGAVVASALPYVLSNYFDVANTAPAGEIADSVRYAFYFGGAVLFLSVAWTVVSTKEYSPDELAAFHGNADAGADEQQHRTRTHKNYQFAAIVWMAVGALLTFAVWAQDLDKQLYILTLGIFVFGPLQLYCALRLGKSTPSQRAQLGIVFNVVDDLFHMPKAMHQLAIVQFFSWFALFAMWIYTTSAVTSYHFGSSDVLSKAYNDGADWVGVLFASYNGFSAIAALFIPLLAKRIGIKLTHTFNMFCGGFGLISFYFIKDPSLLWLPMIGVGIAWASILSVPYAMLSGALPPKKMGVYMGIFNFFIVIPQLLAASVLGLILNGLFDGQPIYALITGGVLMLCAGIAVLFVEQPNTQHTQA

SEQ ID NO: 20400 - protein, 129 aa, Triticum aestivum
  misc_feature (81)..(81): Xaa can be any naturally occurring amino acid
MGTYKCCLIFKRRFRWTDAPPPDDVRALFAEHSGGAATMGADGLRRYLETRRTACWTRSACRATSSAPARASRASAAASCXLDDFHRFLFSADLNPPVRRPRVHHDMSQALSHYYVYTGHNSYLTGNQL

SEQ ID NO: 20401 - protein, 354 aa, Zea mays
KLGTRKLGPLEGYSRAAAAVALLVLCYRSSSVVTVRPWATGLSGQLQKAFVTGVPSLKRSELEAACEDFSNVIGSLSDYMVYKGTLSTGVEIAVVSTTKNSAKEWSKHCESQFRKKITSLSRVNHKNFLNLLGYCQEEQPFTRMMVFEYAPNGTLFEHLHVREDGYLDWPTRLRVAVGVAYCLEHMHQLSPPEILRALDTSTICLTDDFAAKISDVFFCDEPRRQEGSLSLSALSDRESVVYSYGMVLLETMTGRFTASDGGLLEAWAAAYLRGERQLRDVMDPALRRSFHAATVDRLDGVIRGCTDREPRRRLTIAEVAKRLREITAMSPDAATPKVSPLWWAELEIICAEVN

SEQ ID NO: 20402 - protein, 206 aa, Pyrococcus furiosus DSM 3638
MLHLKEKLKGTTTVGLVCKEGVVLAADTRASLGNIIYAKNVTKIHKIDEHLAIAGAGDVGDILNLVRLLKAEANLYKSTVGKEMSVKALATLLANILNGSKYFPYLGWFLVGGYDEKPRLFSVDMVGGITEDNYAAAGSGMEFAYSILDSEYREEMSVNDGIKLAVKAINVAIKRDVFTGDGLLVVTITKDGYKEYRGAELEKMLK

SEQ ID NO: 20403 - protein, 538 aa, Vitis vinifera
MGLNSLAGLGMRSTSDQVSIDAITLFVALLCACIVIGHLLEEYRWMNESITALFIGLCTGIVLLLTTGGKISLILLFNEELFFIYLLPPIIFNAGFQVKKKQFFRNFMTIILFGAIGTLISFGIISLGAIQLFKKLDIGFLEIGDYLAIGAIFSATDSVCTLQVLNQDETPLLYSLVFGEGVVNDATSVVLFNAIQRFDLSHITSGIAFQFVGNFLSLFFASTLLGVFIGLLSAYIMKKLYFGRHSTDREVALMIVMAYLSYIMAELFYLSGILTVFFCGIVMSHYTWHNVTESSRVTTKHTFATLSFVSEIFIFLYVGIDALDIEKWRVVSNSPGTSIGVSSILLGLVLIGRAAFVFPLSFLSNLTKKSESDKIGFKQQITIWWAGLMRGAVSVALAYNQFTMSGHTQLRGNAIMITSTITIVLFSTLVFGLMTKPLISFLLPPPKYFSSMMSSEPSSPKSFSMPLLANGQDPDIEGDSHNTPPPTNLRMLWTTPTHTVHHYWRKFDNAYMRPVFGGRGFVPYVATSLTERNAPQLQ

SEQ ID NO: 20404 - protein, 445 aa, Pyrococcus furiosus DSM 3638
MKCPKCGREWTTFIPPFCTCGAELEISYDYSKVDVRKWKNRLSSVWKYRELLPPVKRMITLREGGTPLIKARISEKIGIDVYIKDETRNPTGSFRDRLATVAISYGLPYASNGFIVASDGNAAVSVAAYAARAEKEAFVVIPRKVDRGKLIQMMAFGAKIIRFGESVDEAIEYAREIAKLNGLYNVTPEDNIIGLEGQKTIAFELWEELNPTHVVVPTGSGSYIYSIYKGFKELMEIGVLEEIPNLIAVQTDKCNPIASEVLGTKKKCTETKALGLYVKNPVMKNKAVKAIKESKGTAVIVNEEEIMRGEKLLASEGIYAELSSAVVMPALLKLKENGFIEKGDKVVLVVTGSGLKTGEGGKEKFSIGPTKIEILRLLKEREMYAYEIWSLLGKPLKYQAVHQHIKELLELGLVEQAYRKGKRVYYKITEKGLRILQNFEDLENI

SEQ ID NO: 20405 - protein, 418 aa, Picea abies
MTKKAVLVGCNYPGTKAELKGCVNDVNRMYKCLVERYGFEEENIRVLIDTDDSYPQPTGANVRRALKTLVEGSRAGDIIFFHYSGHGVRLPAETGDQVDTGYDECIVPCDMNLITDDDFREFIDKVPRDCFCTIVSDSCHSGGLIERAKEQIGESTKDGDERPEHKKQGGFGFRDLLSESVHGAFESRGIHLPSRHEHKDRRESDEGETQEIEYHGKGRAKNRSLPLSTLIEILNEKTGRHDIDVGKIRPTLFDMFGDDASPKVKKFVKVLVTKLQSSGNEGGLLGAIGNLAQQFLKQKLDGSDGGSEYVKPALQEEVSSTQEIYAGSGKRGLPDMGILVSGCQSDQTSADANPTGNPAHAYGALSNAIQTILAEHDGPIPNRQLVMKARQILSKQGFAQRPGLYCTDRLANAPFICD

SEQ ID NO: 20406 - protein, 470 aa, Glycine max
  misc_feature (215)..(216): Xaa can be any naturally occurring amino acid
MESVKPSAVTPRKKLARSFAKVLHVKALIGIASVDGLKNVISDANLKDEGKIAKSKTTLNWSESFNEDDDEELQERVANEALLAKLFASISTVKAAYAELQYAQSPFDPDGIEAADQLLVSELKNLSELKQCYLKKQFDPSPEKEILAAESKELQGVIKTYEIMGKKLESQVRLKDSEIIFLREKLEEANRQNKAIEKRLNQSGQLSGLDNLHIXXLSPSHFIMVLRHAVRSIRNFVRLIVDEMRSAGWDIDAAVDAIEQNVVYMAEDHKCFAMEAFVCREMFDAFHIPNFSLSSESPLEKNRRQQWFFGKFNEMKSMKAKYYLAEKPRSSFAKFCRVKYSRLVHPKMESSFFGNQSHRNLVNAGGFPDTEFFASFAEMAKRVWLLHCLAFSYEPQASIFQVGKGCRFSDVYMESVNDEVFLYSEVESDPQVAFTVVPGFRIGKTVLQCQVYLSQHQTKVKKKITSTKQR

SEQ ID NO: 20407 - protein, 282 aa, Zea mays
MECSRVRGLSLVERLNDIPRHVLDIVEFDVHRGETIALIVGELYSGHILLDMVDLSRNLPSEALEEMLGNEIRDISTGSSIVETAGSIREKPEAKYHLHMEKVKEVCVQDMLVDLEKGKCLLPIEDNSGMKVNSIAGHASTMRPSSWDDLVALKDDKSHHICCFSSHRQDSSVKSGEPMKAEGEIKVGILDKSTADKENKKWYKKPPRPPRSQTTSPLDPADQKLISALSELAVLKKARIERMKALKKMKNSKPASSIGNLVALIITVILCFFILWQGLLMK

SEQ ID NO: 20408 - protein, 529 aa, Salinibacter ruber DSM 13855
MPTGRRTTDCTLKFSAPRFGKALFPSKLSLFVSGMPDTFENYIGGRWTGAASQATFDNRNPADPDDHIGDFPDSAPADVDAAVQAAQDAFSDWGSTPAPDRGKILKASGDLLAERKDEIARSMTREMGKPFFETKGDVQEAIDTAYYAASETRRLFGTTVPSELPDKMNMAIRRPLGVCGIITAWNFPVAVPSWKIFPALAAGNTIVFKPSEDAPHSGLRFVQTLIDAGIPDGVINVVHGADEAGQALVEHPEVDAIGFTGSYEVGTAIAETCGRLNTPVSLEMGGKNPMIVMDDADLDLALEGAIWGAYGTTGQRCTATSRLICHESVHDELVAMIRDEAEALVLGDGNDADTDVGPLINQAAAETVHRYVEIGQEEGATLEMGGAPASVDGLDGHFYEPTLFTDVTPDMTIAQEEIFGPVLATFEVGSYDEAVTVANDTQYGLSSSIYTQDVNKSFRAMRDLEAGITYVNGPTIGAEAHMPFGGVKDTGNGQRDGGYAAFEFWTEHKTLYVDYSGQLQKAQMDSVED

SEQ ID NO: 20409 - protein, 326 aa, Erythrobacter sp. SD-21
MGFDTPGGPEVFRAEKLDLPQPGPDQLLIEVSHAGVNRPDVIQRQGFYPPPPGASPIPGLEVSGKVVAIGPGVAPEMLNRRVCALVSGGGYAEYCLAHAAHCLSVPPHMDMAEAAAIPETLFTVWHNVFERGFAVDGETLLVHGGTSGIGTMAIQLAKAFELDVVTTAGSEEKCNAARELGADLAINYKTEDFVEKVNEFTGGKGANVILDMVSGDYVQRNLDCLAVDGRHVTIAVLGGLKSEINMAKLMSKRQVMTGSTLRPRSDEFKALLADEIYTHAWPLFEDRTIAPVMDKTFPLTEVSAAHARMEAGDHIGKIVLEVRSAQ

SEQ ID NO: 20410 - protein, 362 aa, Bacteroides fragilis YCH46
MKPYLLLTPGPLTTSETVKETMMTDWCTWDEDYNLHIVEALRKELVGIATRNTEEYTSVLLQGSGTYCVEAVIGAAIGKNDKLLICSNGAYGDRMGNIAEYYHIDYELLAFDETEQVSVDYVDDYLSNNSDVTHVAFVHCETTTGILNPLKELAHVVKMHGKKLIVDAMSSFGGIPMDVSELGIDFLISSANKCIQGVPGFGFIIARRSELVRCKGVARSLSLDIYDQWETMEKGHGKWRFTSPTHVVRAFKQALTELIEEGGVEARHRRYCENHRVLVEGMRSLGFVTLLDDAIQSPIITSFLYPKTGFDFKAFYTALKSKGFVIYPGKISKADTFRIGNIGDVHPEDFARLVEVVRETEY

SEQ ID NO: 20411 - protein, 568 aa, Pseudomonas putida GB-1
MFLSRWLPGLANLLHYRREWFHADMQAGLSVAAIQIPIAIAYAQIVGLPPQYGLYACVLPMMVYALIGSSRQLMVGPDAATCAMIAGAVAPLAMGDPQRIAELSVIVTVLVGVMLIAAGLARAGFIASFFSRPILIGYLNGIGLSLIAGQLSKVVGFKIEGDGFILSLINFFQRLGEIHWVTLIIGLAALGLLIWLPRRYPRLPAALTVVALFMLLVGLFGLDRFGVAILGPVPAGIPKLAWPHSNLAEMKSLLRDALGIATVSFCSAMLTARSFAARHGYAINANHEFVALGVSNLAAGISQGFAISGADSRTAVNDMVGGKSQLVGIIAALVIALILLFFTAPMAWIPQAALGAVLLMAGWGLIDIKSLGRIRRLSRFEFWLCLLTTAGVLGLGVLPGIVFAVTLAILRLLYSIYQPTDAVLGWLPGTEGQVDIRKFKDARTVPGLVVYRFDDAILFFNADYFKMRLLEAVQSQNQPKAVLFDAEAVTSIDVSGIAALREVRDTLAAQGIFFAIARARGTFLRMLVRSGMAREMEDKLLFGSVRAGIRAYRVWRNRNRSVQTAEQR

SEQ ID NO: 20412 - protein, 314 aa, Oenococcus oeni PSU-1
MAKVRAYTNIALIKYWGKSDLNWNLPTSSSIGLTLDRFYTDTSVEIDQFSKKDFFQLNGQQIEGPKISKIINFIRNSCGNKNFVKVISENHVPTSAGLASSASAFAALTKAANQAFGLELDNRELSKIARIGSGSASRSIFGGFSIWHKGQNKDDSFAESILDPVDFDIRVIDILADKRVKKISSSQGMQLAQTSPNYDSWLKKNDRQIDEMLKAISDHDLEKIGLIAETNSASMHELNRTAKVPFDYFTENTREIIAEVDQLYKKGILAFATVDAGPNVKVITNSEYQEKIINVLKEYGEILVQKPGRGVANV

SEQ ID NO: 20413 - protein, 473 aa, Oryza sativa
  misc_feature (18)..(18): Xaa can be any naturally occurring amino acid
  misc_feature (151)..(151): Xaa can be any naturally occurring amino acid
  misc_feature (160)..(160): Xaa can be any naturally occurring amino acid
MARFILSLLELGVSATVXVLFGLYVFSTAVAADISQAAAASGCLLLRRPAAPGLVNVAAAGEEEERRGAAPVVLDGSPPPIVLVHGIFGFGKGRLGGLSYFAGAEKKDDRVLVPDLGSLTSIHDRARELFYYLKGGQVDYGEEHSKVFGHXTRFGRTYDXTGHYPVWDEQNPVHFVGHSAGVQVVRVLHQMLADKAFPGHDTSEDWVLSLTSLSGALNGTTRTYYDGMLAEDGRSMKSICLLQLCRIGVIVYDWLDIPWLKNYYNFGFDHFEMSWRKVGLSGLIDLLLGHTGPFASGDWILPDLTIQGSLTLNSTLRTFPNTFYFSYATKRTRKLFGITVPSSVLGIHPMLFLRVLQMCMWRHPQNAPLPYKGYRDEDWEDNDGALNTISMTHPRIPTEHPNRLVVDDSDCHPLQPGIWYYKIIEADHILFIVNRERAGVQFDLLYDGIFQRCRKHAFRRSPPTVPNESSQSQ

SEQ ID NO: 20414 - protein, 316 aa, Listeria monocytogenes str. 1/2a F6854
MTMYAKNNTSGKDMLSLLEWNKEELTDIIKLAVAMKTNPAHYSHILSGKILGMIFDKPSTRTRVSFEAGILQLGGQAIVMSSKELQIGRGEPIKDTAHVMSEYIDAIMIRTFSHEKVEELAYHAEIPIINGLTDLHHPCQALADLMTIYEWKDQLEGIKLAYIGDGNNVCHSLLLAGAMVGIDIRLAMPKGYEVDETILAKAENLAKQSGGKIFVTEDPKLAVTDADFIYTDVWTSMGQEDENAKRLADFGEKYQVNAELVSGAKPDYHFLHCLPAHREEEVTTEIIDGIHSVIYQQAGNRLHAQKALLAAILEAK

SEQ ID NO: 20415 - protein, 314 aa, Mesorhizobium amorphae
VMFDGSSIAGWKAINESDMVLMPDLDTVHMDPFFAQSTMVILCDILDPVSGESYNRDPRGTAKKAEAYMKSEGIGDTIYVGPEAEFFVFDDVKYKADPYNTGFRLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 20416 - protein, 250 aa, Listeria monocytogenes str. 1/2a F6854
MENTIVIKLGGVASDNLTEGFFRQITEWQTANKKIVLVHGGGHYITKMMEALAIPVETKNGLRVTNKATLEVTKMVLIGQVQPAITTAFQKRNISVIGLNASDTGLLEADRLSDIDLGLVGKITKVKTNLIEQLLSENIITVIAPLGINSEHDWLNVNADTAACEVASALHAEALYLLTDVPGVKNGSEIIGEIATAEIEKLQSTGVIKGGMIPKLASAAFAAENGVGQVIITDSLNNSGTKIKNKVAIG

SEQ ID NO: 20417 - protein, 207 aa, Salmonella enterica subsp. enterica serovar Typhi str. CT18
MSYSGERDNLAPHMALVPMVIEQTSRGERSFDIYSRLLKERVIFLTGQVEDHMANLIVAQMLFLEAENPEKDIYLYINSPGGVITAGMSIYDTMQFIKPDVSTICMGQAASMGAFLLTAGAKGKRFCLPNSRVMIHQPLGGYQGQATDIEIHAREILKVKGRMNELMAHHTGQSLEQIERDTERDRFLSAPEAVEYGLVDSILTHRN

SEQ ID NO: 20418 - protein, 181 aa, Coprinopsis cinerea okayama7#130
MSAAQKLQQHPVFVQAQNKASFYVNQLDKELTKYPVLNNLEQRTQVPKAYAVIGTLLLVVVLHTFNALAAPVSNLVGWGLPAYLSFKAIESPSPHDDVQWLTYWVVFGFFNFLESFALRLVLYYVPWYFAFKSAFIVWLQLPAFRGAQKIYFTALKPILQNISSQTKVVAPTTSTNAEQSD

SEQ ID NO: 20419 - protein, 325 aa, Nicotiana tabacum
MAGEKNGIAKDVTELIGNTPLVYLNNVVDGCVARVAAKLESMEPCSSVKDRIGYSMITDAEEKGLIKPGESVLIEPTSGNTGVGLAFMAAAKGYKLIITMPSSMSLERRIILRAFGAELVLTDPAKGMKGSIQKAEEIKAKTPNSFILQQFENPANPKVHYETTGPEIWKGSNGKVDALVSGIGTGGTITGSGKYLREQNPDIKLYGVEPVESAILSGGKPGPHKIQGIGAGFIPGVLEVGLIDEVIQVSSEEAIETAKLLALKEGLLVGISSGASAAAAIKLAKRPENAGKLIVVVFPSFGERYLSSVLFESVRREAENMTVEP

SEQ ID NO: 20420 - protein, 523 aa, Triticum aestivum
MARGGGNGEVELSVGVGGGGGGAAGGGEQPAVDISLGRLILAGMVAGGVQYGWALQLSLLTPYVQTLGLSHALTSFMWLCGPIAGLVVQPCVGLYSDKCTSRWGRRRPFILTGCILICIAVVVVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDLHGYIQHAITASKEIKIVSLALFAFLGIPLAILYSVPFAVTAQLAAKRGGGQGLCTGVLNIAIVIPQVIIAVGAGPWDELFGKGNIPAFGMASAFALIGGIVGIFLLPKISRRQFRAVSGGGH

SEQ ID NO: 20421 - protein, 566 aa, Chlamydophila abortus S26/3
MKVALSFKHLIPKLYTCIKNGYTFNTFKKDFIAGLTVGVLAFPFAIAIAIGVGVSPIQGLLASIIGGFIASALGGSRVLISGPTSAFISILYCISAKYGVEGLFTITLMGGIFLVAFGLTGLGTFIKYMPYPVVTGLTTGLAVIIFSSQIRDFLGLQMGDTIPTDFIAKWVAYWDYLWTWDSKAFAVGLFTLLIMIYFRNYKPRYPGVMIAIIVASTLVWLLKIDIPTIGSRYGALPQSIPLPAFPHLSLTKMLQLMPDALTIAVLSGIETLLSAVVADGMTGWRHQSNCQLVAQGIANIGTSFFAGMPVTGSLSRTAASIKSGATTPIAGLIHSAFICVILLALAPLTVKIPLTCLAAVLILIAWNMSEIHHFIHLFTAPKKDVVVLLTVFILTVMTTITSAVQVGMMLAAFLFMKQMSDLSDVISTAKFFDENKQTKDNDLFSKSEVPAHTEIYEINGPFFFGIADRLKNLLNEIEKPPKIFILCMSRVPTIDASAMHALEEFFLECDRQGTLLLLAGVKKTPLSDLKRYHLDELIGVDHIFSNTKSALLFAQALINLESKSSH

SEQ ID NO: 20422 - protein, 817 aa, Oryza sativa
  misc_feature (749)..(749): Xaa can be any naturally occurring amino acid
MPPLHAYLGLLLLLLSMHTPSCYATNDTLAAGQLLAVGEKLISRNGKFALGFFKPTLPEDAGSKYKNIASPGWYLAIWFNEIPVCTTVWVANRERPITDHELNLAQLKFSQDGSSLAIIINRATESTVWSRQIANRTAQAKTSMNTSAILLDSGNLVIESLSDVYLWQSFDDATDLVLPGAKFGWNKVTGLHRTGISKKNLIDPGLGSYFVQLNERGFILWRRDPYIEYLTWSSVQLTNMLIPLHNSQLEMNSQTKGFLMPSYVNNDEEEYFMYHSSDELASSFVSIDMSGQLKLSIWSQVNQYWQELYAQPPDPCTPFATCGPFGICNGNSEQFCDCMESFSQKSPQDWKLKDRSAGCIRNTPLDCPSNRSSTDMFQTIARVTLPANPEKLEDATTQSKCAEVCLSNCSCNAYAYKDSVCSVWHSELLNVKLRDNIESLSEDTLYLRLAAKDMPASTKNKREPVIAVVTTCSIVGFGLLMLVMFFLIWRIKFNCCGVPLHHNQGNSGIIAFKYTDLSHATKNFSEKLGSGGFGSVFKGVLSDSTTIAVKRLDGLHQGEKQFRAEVSSLGLIHHINLVKLIGFCYEGDKRLLVYERMINGSLDAHLFHSNGTILDWSTRHQIAIGVARGLFYLHESCHKCIIHCDIKPENILLEASFAPKIADFGMAAFVGRDFSRVLTSFRGTKGYLAPEWLSGVAITPKVDVYSFGMVLLEIISGRRNLSEAYTSKHYHFDYFPMQAMSKLHGGSVXDLLDPKLNGDFNLEEAERICKVACWCIQENEFDRPTMGEVVHILEGLQDVEMPPTPRLFADISEKVSY

SEQ ID NO: 20423 - protein, 455 aa, Oryza sativa Indica Group
MSKPQQQSPPSTTTSSPPPPPASTPPPASSSRSLLSALRRSPVTTLVAAFFLLALFMYGEDVRTLAELSIDDYLYPDADFYNVSALPPLLLPPTTCDLSRGRWVFDNNSLPAYREKECTFLTKQVSCLANGRPDDLWQYWRWQTNNCSLPTFDARRFMEKMRGKRMMFVGDSLNRNQWESLVCLVQPILSKGRKKIVKRGSFNIFYAKEYRATLEFYWAPFLVESNSDNPNFHHIDQRIISPERIESHANNWKDVDYLIFNTYIWWMNNEDIKVRRPNSTSWSDHDEVPRIETYGRVFKTWSTWLEQNVDPARTSVFFMTISPLHNSPAQWGNPNGIKCVKETLPVLNYTKPLDLNHDMRMYDLVAKVAKNMKNVPVSLIDITRMSDYRKDAHTSLYSIRQGKLLTPEQKADPQKYADCIHWCLPGVPDVWNQILYTRILSKSSPPSTHPSLPPQ

SEQ ID NO: 20424 - protein, 160 aa, Caulobacter crescentus CB15
MAIKVGDTLPAATFMTSTAEGPAPISTDDIFKGKTVALFAVPGAFTPTCSAKHLPGFKEKADELKAKGVDSIVCVSVNDVFVMKAWGKDQGIDGEVLLIADGNGDFTKAIGLDFDGSKFGMGARSQRYSLVAKDGVVTQLHVEDAGQFKVSSAEYLLEQL

SEQ ID NO: 20425 - protein, 445 aa, Wolbachia endosymbiont of Drosophila ananassae
MSTPITVAYGDGIGPEIMEAVLSILRGAEAKISIDIIEIGERVYSKEWSHGISPSGWESIERTKILLKSPTTTPQGKGHKSLNVALRKNLGLYANIRPCISYHPVIENKFGKFDIVVIRENEEDVYTGIEHRLTGDSYQCTKIITRSGSEKICRYAFEYAKKHNRKKVTCLTKDNIMKMTDGTFHAAFDRIAKEYQDIKAEHYIVDIGMARVATEPENFDVIVTENLYGDILSDIVAQTSGSVGLAGSSNIGNEYAMFEAVHGSAPDIAGKNIANPSGLLNAAVHMLIYIGQVGTAKLIYDAWLKTLEGGIHTADLYKEKRSKQKVGTKEFAEAVIDNLGKKPAELTIGSGSDSKINLDSKINKVQDNYEQDYKVKKLVGSDITLAWDKSSNVDQIVGLFESSNPQIIAIYSKGLAIWPGSSKSSSDQITCSLSRIAKKTITIVT

SEQ ID NO: 20426 - protein, 360 aa, Oryza sativa
  misc_feature (253)..(253): Xaa can be any naturally occurring amino acid
MEHDGTAALGWAARDASGHLSPFSFTRRVQEEDDVTIKVLYCGICHTDLHTIKNEWGNAMYPVVPGHEIVGVVAGVGAGVTRFKAGDTVGVGYFVDSCRACDSCGKGDENYCPTMVITSNGTDYGGATTQGGFSDVMVVRQDYVLRVPASLPPDGAAPLLCAGVTVYSPMVEYGLNAPGKHLGVVGLGGLGHLGVKFGKAFGMKVTVISSSPAKREEALGRLGADAFLSSRDGEGMAAAAATMDGIIDTVSAXGHPLVPLLSLLKPKGQMVVVGAPAAPLQLPAIAIIDGGKRVAGSGGGSVAECQAMLDFAGEHGIAADVEVVAMGDVNAALGRLERNDVRYRFVIDVAGTLHAAAAPS

SEQ ID NO: 20427 - protein, 423 aa, Caulobacter crescentus CB15
MTASLRTLKNGVRVVCDPMPGLETLALSVVAGRGAAYEDPARSGWSHLLEHMVFKGAGSRSARDIVEVIENQGGSINAATGYERTSFQVRALKGGLDLGMDVIADLVRRPTLDPADLTREKQVVAQEIAEAADAPDDYVFDLIQRASWGDHPVGRPILGSDETVNAASVEALSDWRGDLYAADRLVIAATGAVEEAELMAAAERAFGDLPATPGVGLAQSAAFVGGPQAEARKLEQAHLVFMLPACGAREDDYFALRIFAECLGGGMSSRLFQEAREKRGLAYNIDAYADTYADHGALGIYAGCAASDAVETAKVCADELIKLADRIEEAELARAKAQLKAHMFMAREQPLSRAEQGAGQVLLFDRLYPPAELAREVDAVTPQDVARLGQRLLAAGRAATAVLGAKSALKAGEVFDKALFSAA

SEQ ID NO: 20428 - protein, 1178 aa, Oryza sativa Indica Group
  misc_feature (2)..(2): Xaa can be any naturally occurring amino acid
  misc_feature (26)..(26): Xaa can be any naturally occurring amino acid
MXRVFIKFVVRERRGQVECESSVLLXHFSVNSVTTQWVQLQCWKEAMSRDTRISVLSRVNHKNFMNLIGYCACEEPFTRMMVFEYAPCGSLFEHLHIREAEHLDWKTRLRIIMGVAYCLEHMSQLDPPPLLPTNLSSSSIYLTEDNAAKIADIKFWKDDINKQDDQESVVYKFGILVLEVISGRRPFSEDDRLLVLWASSYLDGKRPLSAMADRTLVRSSSAAPEKDVAALCDVVRQCVRRPEAGKRAISMGEVARLIYCSKSPTGPLQPKIYLACHSHSLPVSDEPREHCASSALLPGTVMRARSHACQMAKQGKERIKLATLNMGRKKKRTLSDDDDMLSEIESLLSGEIDIPLPSDRFDVKERSRYNSVNSELERLRGLVRELEEREVKLEGELLEYYGLKEQETDVVELHRQLKIKMVEIDMLKMTINSLQEERKKLQDDVTRGTGAKRELEAARNKIKELQRQIQMEANQTKGQLMLLKNQVIALKSKEEEAAIKDAEVQRKLKKLKELEVEVVELRRKNKELLYEKRDLIVKLDAAQGKITESDVVSHAREEINKLRHANEDLTKQVEGLQMNRFSEVEELVYLRWVNACLRYELRNYQAPSEKISARDLNKTLSPKSRERAKLLMLEYAGSERGQGDTDLETASSAPSSPRSEDFDNVSVDSSSSRYSFFGKRPNLMQKLKKWGRGKDDGSSLASPTQSFTSDSPKSASQKPKGPLEALMLRNAGDGMGITTFGKREQDPSDIMDEANVASSFHLMSKTVQGFADDKYPAYKDRHKLATEREKAIKEKAEKARVQRYGGVNSSGIVPSPRSALPPKLAQIKEKAPTANAESSDQPSDNQNNPLVVTQLKLANIEKRAPRVPRPPPAPSATANTASALPPPPPRPPGAPPPPPPPGKPGGPPPPPPPPGSLPRNLAGGDKVHRAPEVVEFYQSLMKREAKKDTTSLGSTTSSVSDVRSNMIGEIENRSTFLLAVKVDVETQGDFVESLANEVRAASFVNIDDVVAFVNWLDEELSFLVDERAVLKHFDWPESKTDALREAAFEYQDLLKLEHKVSSFTDDPKLACEEALKKMYSLLEKVEQSVYALLRTRDMAISRYREYGIPVDWLSDSGVVGKIKLASVQLAKKYMNRVATELDALQGTEKEPNREFLLLQGVRFAFRVHQHGGPRRLRG

SEQ ID NO: 20429 - protein, 198 aa, Wolbachia endosymbiont of Drosophila ananassae
MNSGVLLYKFTYYVEWYYMLKKNVPNLLTISRALAVPAIILSFYIENKYAGLITISIFVFACITDFFDGYLARAWKVQSKFGKLFDPIADKLIVVSTIIMLVYKQKINDFTIVPSIIIICREILVSGLREFLIATNVSLPVSKAGKIKTFLQMVAVVALIMNDYYMIQYTGAICLWVAAIITMWSGYNYILAGIKQID

SEQ ID NO: 20430 - protein, 498 aa, Brucella melitensis 16M
MRNIGHFIGGKHVAGKSGRTADIFQPLDGTVQGKVALATKEEVRAAVENAKAAQPAWAATNPQRRVRVLRKFIELVEAEYDSLAELLAREHGKTIADARGDIQRGLEVVEVCLGAAHMLKGEFTDNAGTGIDTYSMRQPLGVVAGITPFNFPAMIPLWKAGPAIACGNAFILKPSERDPGVPMRLAELFQEAGLPAGIFNVVNGDKESVDALLDDPDVQAIGFVGSTPIAQYIYGRGCANGKRVQCFGGAKNHLLIMLDADMDQTVDALIGAGYGSAGERCMAISVAVPVGEDTANRLMEKLIPRVESLKIGPSTDNSADYGPLVTKAALDRVRGYVDLGVEEGAKLVVDGRNFKMQGYENGFYMGGCLFDHVTPDMRIYKEEIFGPVLSIVRAKNYEEALALPSDHEFGNGVAIFTRDGDAARDFASRVQVGMVGINVPIPVPIAYYTFGGWKASGFGDLNQHGPDAFRFYTKTKTVTSRWPSGVKDGAEFVIPTMK

SEQ ID NO: 20431 - protein, 327 aa, Triticum aestivum
  misc_feature (303)..(303): Xaa can be any naturally occurring amino acid
  misc_feature (313)..(313): Xaa can be any naturally occurring amino acid
VTLQNKFVQKSRLVPVRNSRDIVDPRVRLQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRARAFGLLLNSVVLGFSSFLIEPLCKRLGPRGVWVSSNFLVCLSMAAICIISWWATQDLHGYIQHPITASKEIKIVSLALFAFLGIPLAILYSVPFAVTAXLAAKERRWQXLCTGVLNIAIVIPK

SEQ ID NO: 20432 - protein, 440 aa, Wolbachia endosymbiont of Drosophila ananassae
MNDDLDSTTKQEALNYHSRGGKPGKISIMPTKPLSTQYDLSLAYSPGVAAPCLEIAKNPEVVYDYTAKSNCVAVISNGTAVLGLGNIGPLAAKPVMEGKAVLFKRFADIDAVDIEVGTENIEDFINAVRYLGPSWGGINLEDIRSPDCFIIEKRLNELMDIPVFHDDQHGTAVVVAAGIENALDIVGKKLEDVKIIMNGAGAAGIACLEILKSMGAKNIVLCDKQGVIYKGRNEDMNEWKEKYAIDTSERSLLDTIKGADVFIGLSAKDVLNEEMLKSMGKDPIIFALANPDPEVRPEFAKSVRPDAIIATGRSDYNNQVNNVMGFPYIFRGALDVHATTINDEMKIAAADAIAKLAREPVPGEISAVYGGRKMGYGREYIIPTPFDPRLISIVAPAVAKAAVDSGVARKAIQDWSKYENQLKSRLASALNMLKLLSSQC

SEQ ID NO: 20433 - protein, 489 aa, Zea mays
MDARIILAVKKKKKKKKKKKKKRHASAAPPPSALRCPLASAPERQSLLAPAPPPPRGVGQTLAHRTRRPARSHSPPPPMAALSAPLRAVAAGSRVAASDPVKVSCVRSTGSAHFGCAFPYIRASSSAARNLEPLRAIATQAPPAMPQYSSGEKTKIGINGFGRIGRLVLRIATSRDDIEVVAVNDPFIDAKYMAYMFKYDSTHGPFKGSIRVVDDSTLEINGKKVTITSKRDPAEIPWGNFGAEYVVESSGVFTTTDKASAHLKGGAKKVVISAPSADAPMFVVGVNENSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKTASEGALKGILGYTDEDVVSNDFVGDSRSSIFDAKAGIGLSSSFMKLVSWYDNEWGYSNRVLDLIAHMALVSAKH

SEQ ID NO: 20434 - protein, 233 aa, Zea mays
LEEPNASVSELTARRTRSPLLSSPLLLAFGYAYPAYECYKTVELNKPEIAQLIFWCQYWILVALLTVLERFGDFTISWLPFYSEAKLMFFVYLWYPKTKGTTYVYGTFFKPYISQHENEIDRNLLELRARATDTVVLYFQKAASAGQSTFFDVLKYVAAQSPSQKSRQRLHQDSQQPPQQQQPQVQVQQAQPQKQAAPVMRRASSIAARQAAMAQQSQETKPVSSSPKIKRQT

SEQ ID NO: 20435 - protein, 493 aa, Oryza sativa Japonica Group
MESMLVAGAGAAAVAAVGGLVAAAALADKLVAAPPPRKNRANPPPAVPGLPIIGNLHQLKEKKPHQTFAKWSETYGPIYTIKTGASPVVVLNSTEVAKEAMIDKFSSISTRKLPKAMSVLTRKSMVAISDYGDYQKMAKRNIMIGMLGFNAQKQFRGTRERMISNVLSTLHKLVSLDPHSPLNFRDVYINELFSLSLIQSLGEDVSSVYVEEFGREISKDEIFDVLVHEMMMCAVEADWRDYFPYLSWLPNKSFDTIVSTTEFRRDAIMNALIKKQKERIARGEARASYIDFLLEAERSAQLTDDQLMLLLSESILAAADTVLELLYQEIREACGGEAVTEDDLPRLPYLNAVFHETLRLHSPVPVLPPRFVHDDTTLAGYDIAAGTQMMINVYACHMDEKVWESPGEWSPERFLGEGFEVADRYKTMAFGAGRRTCAGSLQAMNIACVAVARLVQELEWRLREGDGDKEDTMQFTALKLDPLHVHLKPRGRM

SEQ ID NO: 20436 - protein, 456 aa, Glycine max
MRPPVILKTTTSLLDSSSSSPPCDRRLNTLARHFLPQMASHDSISASPTSASDSVFNHLVRAPEDPILGVTVAYNKDPSPVKLNLGVGAYRTEEGKPLVLNVVRRVEQQLINDVSRNKEYIPIVGLADFNKLSAKLIFGADSPAIQDNRVTTVQCLSGTGSLRVGGEFLAKHYHQRTIYLPTPTWGNHPKVFNLAGLSVKTYRYYAPATRGLDFQGLLEDLGSAPSGSIVLLHACAHNPTGVDPTLEQWEQIRQLIRSKALLPFFDSAYQGFASGSLDADAQPVRLFVADGGELLVAQSYAKNLGLYGERVGALSIVCKSADVASRVESQLKLVIRPMYSSPPIHGASIVAAILKDRNLFNDWTIELKAMADRIISMRQELFDALCSRGTPGDWSHIIKQIGMFTFTGLNAEQVSFMTKEFHIYMTSDGRISMAGLSSKTVPLLADAIHAAVTRVV

SEQ ID NO: 20437 - protein, 111 aa, Brassica napus
MKEATASGGGATATASDPRQPATARPYAPPKLSSQDLPVDYAGFLAVVFGVVGVMLHYKVCSWIAIIFCAQSLANMKNFENDLKQLSMAFMFAVMGLVTNYFGPRPGGTKR

SEQ ID NO: 20438 - protein, 542 aa, Vitis vinifera
MNGIFIIFLGGGASMAEPQQALSRTFPVKPKLKAKSKKPSKTPESKYWSSFKSHTIPNLISSITSLSFSPATPHHFAAAYSTSLTLFNSKTLEPISSISSFKDVVSCASFRSDGLLIAASDHSGLVQVFDVKTRTALRKLRGHTRPVRLVRYPRSDKLHLFSGGDDAVVKYWDVAAESGVVEFRGHKDYVRCGDGSPASSELFATGSYDHTVKVWDVRVSNSDAAMKINHGKPVEDVIFLPSGGLIATAGGNCVKIWDVIGGGKLLYSMENHNKTVTSICVGKIGRDGGEGSEQYRVLSVGLDGYMKVFDYSKFKITHSMRFPAPLLSIGFSPDCATRAIGTSNGVIYAGKRKVKGEVESGLREFPSLGLMEEPQRRVLRPSYFRYFHRSQGEKPSEGDYLITRPKKVKIAEHDKLLKKFRHKDAFVSALSGKNPENVVAVMEELVARKKLLKCVSNLDTEELGLLLAFLHRHSTVPRYAGLLMGLTKKVVQMRAEDIIASDVLKGHIRNLKRSVEEEVRIQQSLQEIQGIISPLLRIAGRR

SEQ ID NO: 20439 - protein, 334 aa, Salinibacter ruber DSM 13855
MSIKLGINGFGRIGRLCFRALLEREEDEIEIVGINDLTDAETLATLLKYDSVHGQFPGDVHLEDSTLVVDEQEFPVFSKKDPTNLPWGDHDTDVVIESTGVFRTYDKASQHLEAGADQVVISAPAKSEVDAMVVLGVNDEILTGDEKVVSNASCTTNCLAPLVKVLDDAFGVESGLMTTVHAYTASQNIVDGPHGDLRRARTAAESIIPTTTGGAKAVGKVLPHLDGALDGMAMRVPTPDGSVTDLTAVVEQDVTVEDVNEAFYEAANGALDGILAYSDDPIVSRDIIHDPHSCIYDAPWTKVAGSQVKLVGWYDNEWGYANRTVDLVERLMNV

SEQ ID NO: 20440 - protein, 314 aa, Mesorhizobium chacoense
VMFDGSSIAGWKAINESDMVLMPDTDTVHMDPFFAQSTMVILCDILDPVSGEAYNRDPRGTAKKAEAYMKAEGIGDTIYVGPEAEFFVFDDVKYKADPYNTGFKLDSTELPSNDDTDYETGNMGHRPRTKGGYFPVPPVDSAQDMRSEMLTVLAEMGVRVEKHHHEVAAAQHELGIKFDTLVRNADKMLIYKYVVHQVANAYGKTATFMPKPVFGDNGSGMHVHQSIWKGGKPTFAGNEYSGLSETCLFYIGGIIKHAKAINAFTNPLTNSYKRLVPGYEAPVLLAYSARNRSASCRIPFGSSPKSKRVEVRFP

SEQ ID NO: 20441 - protein, 252 aa, Lactococcus lactis subsp. lactis Il1403
MSRKPIIAGNWKMNKTLSEAQAFVEAVKNNLPSSDNVESVIGAPALFLAPMAYLRQGSELKLAAENSYFENAGAFTGENSPAAIVDLGVEYIIIGHSERREYFHETDEDINKKAKAIFAAGATPILCCGETLETFEAGKTAEWVSGQIEAGLAGLSAEQVSNLVIAYEPIWAIGTGKTATNEIADETCGVVRSTVEKLYGKEVSEAVRIQYGGSVKPETIEGLMAKENIDGALVGGASLEADSFLALLEMYK

SEQ ID NO: 20442 - protein, 314 aa, Mesorhizobium plurifarium
VMFDGSSIAGWKAINESDMVLMPDTDTVHMDPFFAQSTMVILCDILDPISGEAYNRDPRGTAKKAEAYMKSEGIGDTIYVGPEAEFFVFDDVKYKADPYNTGFRLDSTELPSNDDTDYETGNLGHRPRIKGGYFPVPPIDSCQDMRSEMLTVLAEMGVRVEKHHHEVAAAQHELGIKFDTLVRNADKMLIYKYVVHQVANAYGKTATFMPKPVFGDNGSGMHVHQSIWKGGKPTFAGNEYAGLSESCLYYIGGIIKHAKAINAFTNPLTNSYKRLVPGYEAPVLLAYSARNRSASCRIPFGSSPKSKRVEVRFP

SEQ ID NO: 20443 - protein, 443 aa, Crocosphaera watsonii WH 8501
MNLPPTLSQPRLLRLFKLIFYPLDYLEDNYQRYGDIFVAGKSETPFVYISNPQGIQTILTRDKTDFKTGGGSGFLSTLLGDNSLLFLQGERHRRERKLLMPPFHGERLKSYANLIYSISDKVTDKLQINRSFNVRDIMQEITLKVILKAVFGITEGERYQRLQELLKSWLSFFDSPANAILIFFPWLRKNWGNWTPWGRFLQIKAEIQELIYTEIRERREQKKYEGTDILTLLMLAKDEEGKPLSDQELHDELITLLIAGHETTASALTWALYWIHFCPDVEDKLRFHFSNLNNNTDLLDIVKLPYLDAVCKETLRIYPVLLTTFIRVLQTPLELMGYQFKPGTVFAPAIYLVHHREDIYPNSQQFRPERFLERNFSPYEYFPFGGGSRRCIGMELAKMEMKIVLYTILSKHKLKLPSSRPLKAVRRGLTVAPPSNFKMILSN

SEQ ID NO: 20444 - protein, 551 aa, Sinorhizobium meliloti 1021
MPDSLVPKTVSILAEGYGAARLKADAFAGLTVAIVALPLSMAIAIASGVTPDRGLYTAIVGGFLVSLLGGSRVQIGGPAGAFIVLVAATVARHGVDGLLLATLMSGFMLIAAGYLRLGRYIKFIPYPVTVGFTAGIAVIIFASQLRDLFGLTLAGAEPGPIVDKVAALAQAAGTVSWAAVLTAALTVGIILALRRVRPHWPGMLIAVAAASTFVALLQLPTETIGSRFGGIPRGLPLPALPPLSLEKAAAVFPDALSFALLGAIESLLSAVVADGMTGRRHRSSVELVAQGAANICSALFGGICVTGTIARTATNVRAGATSPVSGILHSAFLLLFMLLAAPLASYIPLASLAGVLAIVAWNMIEKPAFMALLRSSYGDAVVLLATFLIVVFRELTEGIVVGFALGAVLFIDRMARSISVQEARPLSAQRQENGDERPVIADDPDTVIYRLSGIFFFGSAATVGTVLDRIADQRRNFILDCSDVPFMDSTAANVIEGTLRKAERTGVRFIITGARSQVRRALYQHHVRPPRVMMRASVAAALDTIRTERVP

SEQ ID NO: 20445 - protein, 417 aa, Oenococcus oeni PSU-1
MPKNQFRDDFPILNNVKMNDEPLAYLDNAATSQKPQLVIDRISRYYGYENANIHRATHALALKATDDYEQVRDQVRHFINAKSRDEIIFTRSTTESLNWVAQRWGEAKLKPGDEIVLSILEHHSNLVPWQQVAKKTGARLRFLDFNQEGVIDLNAAKKTINAKTKIVSITQVSNVLGSIQPVKELAIMAHEVNAIMIVDAAQSVPHFKIDVQNLDCDFLAFSAHKMLGPTGVGVLYGKSELLEKIDPEFFGGEMIEEVSKNEASFKSGALRFEAGTQNIAGVIAFGAALTYLQKVGFDKIAAQDRSLMEAAISALQNRPQVKIYGSADPANHTGIISFNVGEIHPHDVSTVFDLDGVAIRAGHHCAEPLMNRLGVSATCRASFYFYNNLDDVERFLIAIKDTEDFFNRHPSKESSNG

SEQ ID NO: 20446 - protein, 314 aa, Mesorhizobium septentrionale
VMFDGSSIAGWKAINESDMVLMPDPDTVHMDPFFAQSTMVILCDILDPVSGESYNRDPRGTAKKAEAYMKSEGIGDTIYVGPEAEFFVFDDVKYKADPYNTGFRLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGASPKAKRVEVRFP

SEQ ID NO: 20447 - protein, 294 aa, Populus tremula x Populus tremuloides
MDQYEKVEKIGEGTYGVVYKARDRVTNETIALKKIRLEQEDEGVPSTAIREISLLKEMQHGNIVRLQDVVHSEKRLYLVFEYLDLDLKKHMDSSPEFAKDPRLVKTFLYQILRGIAYCHSHRVLHRDLKPQNLLIDRRTNALKLADFGLARAFGIPVRTFTHEVVTLWYRAPEILLGSRHYSTPVDVWSVGCIFAEMVNQKPLFPGDSEIDELFKIFRILGTPNEDTWPGVTSLPDFKSAFPKWPSKDLATVVPTLEKAGVDLLSKMLFLDPTKRITARSALEHEYFKDIGFVP

SEQ ID NO: 20448 - protein, 232 aa, Oryza sativa Japonica Group
MAGGGDELKLLGMWASPYVLRVKFALSLKGLSYEYVEEDLMNKSDLLLSSNPVNKKVPVLIHNGKPVCESQVILQYLDEAFPGAGATLLPADPHERAVARFWAAFNDDTLVEASQAASWGKTEEERAEGEKKVVEALEKMEVGLRECSKGKPFFGGDTVGYLDVVLGGFLAWVRATDVMRGVKRFDPATTPLLAAWAERFVELDAAKAVMPDMDKMIEFGKVLQARAAAATN

SEQ ID NO: 20449 - protein, 314 aa, Mesorhizobium temperatum
VMFDGSSIAGWKAINESDMVLMPDTETVHMDPFFAQSTMVILCDILDPISGESYNRDPRGTAKKAEAYMKAEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPVFGDNGSGMHVHQSIWKEGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 20450 - protein, 173 aa, Alteromonadales bacterium TW-7
TFKERIIFLTGQVEDNMANLILAQMLFLESENPDKDIFLYINSPGGSVTAGMAIYDTMNFIKPDVSTICVGQAASMGAFLLTAGAKGKRFCLPNSRVMIHQPLGGFQGQASDFEIHAKEILSIKDKLNRLMAEHTGQPLDVISKDTDRDNFMSASEAVEYGLVDSVFANRDKK

SEQ ID NO: 20451 - protein, 236 aa, Crocosphaera watsonii WH 8501
MSRQSSPSLQPLLGGIIAALLVVISFNSFVVINPGQAGVLSVLGKAQNGALLEGLHFKPPLVSAVDVYDVTVQKFEVPAQSATKDLQDLSASFAINFRLDPVQVVTIRRTQGTLQNIVSKIVAPQTQESFKIAAAKRTVEQAITQRSELKEDFDNALNSRLEKYGIIVLDTSVIDLNFSPEFAKAVEDKQIAEQKAQRAVYIAQEAEQEAQADINRAKGKAEAQRLLAETLKAQGG

SEQ ID NO: 20452 - protein, 290 aa, Chlamydophila abortus S26/3
MKRNDPCWCGSKRKWKYCHPLAPKLSWEQQKQYYASQYDIILKTPKQIEKIRHACQITAHILDALCQASKEGVTTEDLDQLSRQLHKEYDAIPAPLNYGSPPFPKTICTSLNEVICHGIPNNTPLKNGDIMNIDVSCIVDGYYGDCSNMVMIGEVSEIKKRVCQASLDCLNAAIARLKPYVPLYEIGEAIEACADSYGFSVVDQFVGHGVGIKFHENPYVPHYRNRSAIPLAPGMIFTIEPMINVGKKEGVIDPNNHWEARTCDNQPSAQWEHTLLITETGYEILTLLEK

SEQ ID NO: 20453 - protein, 363 aa, Aspergillus oryzae
MSLFGSVGTTSTTAGQTNTTGDISKDVALNSPPEDSISDLQFSPASEHLAVASWDKKVRIYEINDQGQSEGKALFEHEAPVLSCCWAPDGTKVVGAGADKAARMLDLAANATTPVQVAAHDAPIKCCQMIPNPAGGTPLLVTGSWDKTVKYWDLRQSTPIATVECQERVYTMDVKNKLLVVGTADRYINIINLDNPTKFYKTMQSPLKWQTRVVSCFTDATGFAVGSIEGRCAIQYVEDKDSSSNFSFKCHRETPPNQRDINNIYSVNAISFHPVHGTFSTAGSDGTFHFWDKDAKHRLKGYPSVGGTISSTAFNRNGNIFAYSVSYDWSKGYSANTQQLPNKVMLHPVAQEEVKPRPGTRKR

SEQ ID NO: 20454 - protein, 484 aa, Mycobacterium avium subsp. paratuberculosis K-10
MSRDDWISADEGPRRTVSTTIPVFNPSTEEQIAEVPDSDQAAVDAAVARARETFELGVWRKAPASHRANVLFRAARIIEERKDELAALESQDNGMNLTAAGHIIPVSVDMLKYYAGWVGKIHGESANLVSDGLLGTWETYHTFTQLEPVGVVGLIIPWNGPFFVAMLKVAPALAAGCSAVLKPAEETPLTALKLEEIFREAGLPDGVLNVITGYGETTGAALTAHPDVDKISFTGSTEVGRLIVKAAAGNLKRLTLELGGKSPLIMFDDANLDKAIMGAGMGLLAGSGQNCSCTSRIYVQRGIYDQVVEGLAEFAKMLPMGGSDDPNSVLGPLISEKQRQRVEGIVNDGVAAGAKVITGGKPMDRKGYFYEATIITNTTPDMRLIREEIFGPVGCVIPFDDEDEVIAAANDTHYGLAGAIWTENLSRAHRVVNELRAGQIWVNSALAADPSMPISGHKQSGWGGERGRKGIEAYFNTKAVYIGL

SEQ ID NO: 20455 - protein, 213 aa, Populus trichocarpa
MMGIALKGYFVVLLLALLSSPEAVFGIRFVIDREECFSHDVKYEGDTVHVSFVVVKVDSSWHYSDDGVDLVVKGPSGDQIHDFRDKISEKIEFVAHQKGVHRFCFTNKSPYHETIDFDVHVGHFSYYDEHAKDEHFQPLLEQISKLEEALYNIQFEQHWLEAQTDRQAIINDAMSRRTIHKAFFESAALVAASILQVYLLRRLFERKLGMSRV

SEQ ID NO: 20456 - protein, 642 aa, Arabidopsis thaliana
MPLGERGGWERTESRYCGVETDFSNDVTHLLNFNISTGGFDYVLAPLVDPSYRPSLVEGNGVDTQVLPVCGSDLVLSPSQWSSHVVGKISSWIDLDSEDEVLRMDSETTLKQEIAWATHLSLQACLLPTPKGKSCANYARCVNQILQGLTTLQLWLRVPLVKSEGDSMDDTSEGLNDSWELWNSFRLLCEHDSKLSVALDVLSTLPSETSLGRWMGESVRAAILSTDAFLTNARGYPCLSKRHQKLIAGFFDHAAQVVICGKPVHNLQKPLDSSSEGTEKNPLRIYLDYVAYLFQKMESLSEQERIELGYRDFLQAPLQPLMDNLEAQTYETFERDSVKYIQYQRAVEKALVDRVPDEKASELTTVLMVVGAGRGPLVRASLQAAEETDRKLKVYAVEKNPNAVVTLHNLVKMEGWEDVVTIISCDMRFWNAPEQADILVSELLGSFGDNELSPECLDGAQRFLKPDGISIPSSYTSFIQPITASKLYNDVKAHKDLAHFETAYVVKLHSVAKLAPSQSVFTFTHPNFSTKVNNQRYKKLQFSLPSDAGSALVHGFAGYFDSVLYKDVHLGIEPTTATPNMFSWFPIFFPLRKPVEVHPDTPLEVHFWRCCGSSKVWYEWSVSSPTPSPMHNTNGRSYWVGL

SEQ ID NO: 20457 - protein, 500 aa, Oryza sativa Indica Group
MEPWAIRVAYFIVFSFLVTARFGSCAPHSEEGRALPGYRESEQDQSIGSLSNWGEGKLIGRVFNLLLKENMFASETPSESKEHSSISESVPHDSAGFEPCRKCLAKTVHNATPRRLLQARELASNQTQTHPKSQSSPVQSSASHLVPRWAIYALPVAGVLFIAAVATAIYVFFSRRKKDNTVMPWTTGLSGQLKKAFVTGVPSLERTELEAACEGFINVIGTLPECTLYKGTLSSGVEIAVLSTSVNSSQQWSAQSEEQFRNKISVLSRVNHKNFMNLIGYCACEEPFTRMMVFEYAPCGSLFEHLHIREAEHLDWKTRLRIIMGVAYCLEHMSQLDPPPLLPTNLSSSSIYLTEDNAAKIADIEFWKDDINKQDDQESVVYKFGILVLEVISGRRPFSEDDRLLVLWASSYLDGKRPLSAMADRTLVRSSSAAPEKDVAALCDVVRQCVRRPEGGKRAISMGEVARLVRGIAGLSPEQAAPREKPLWWAELEIASSETA

SEQ ID NO: 20458 - protein, 527 aa, Oryza sativa Indica Group
MTKPQQQSPPSTTATTTTTTSPPPPPPSTPPPASSSSSSLAKLPLRLHSLASSSRSLLSALRRSPVTTLVAAFFLLALFMYGEDVCTLAELSIDDYLYPDADFYNVSALPPLLLPPPTCDLSRGRWVFDNTSLPAYREKECTFLTKQVSCLANGRPDDLWQYWRWQPNNCSLPTFDARRFMEKMRGKRMMFVGDSLNRNQWESLVCLVQPILSKGRKKIVKRGSFNIFYAKEYRATLEFYWAPFLVESNSDNPNFHHIDQRIISPERIESHANNWKDVDYLIFNTYIWWMNNEDIKVRRPNSTSWSDHDEVPRIETYGRVFKTWSTWLEQNVDPARTSVFFMTISPLHNSSKIGIGGRWFNTDAVITFCQFNIDEPCISATGSLELWNILKYRHRVRWFPAQWGNPNGIKCVKETLPVLNYTKPLDLNHDMRMYDLVAKVAKNMKNVPVSLIDITRMSDYRKDAHTSLYSIRQGKLLTPEQKADPQKYADCIHWCLPGVPDVWNQILYTRILSKSSPPSPHPPLPPQ

SEQ ID NO: 20459 - protein, 269 aa, Photobacterium sp. SKA34
MDIEIYQVDAFTNEIFKGNPAGVCITKETLSEDLMLSIAAEMAVSETAFLSLNNMVLKWFTPQSEVKLCGHGTLSVAHILKEKKLFNVNDTVTFNTLSGALTALIKSLAIELDFPAPILDLNITPSTELLASLGIEATHVIAYGIFDSKIFIEVDNEEIVLNLTPNFDRLKKIDGRGVLITALTQRDDLDFISRFFAPWVGVNEDPVTGSAHCALTLYWSEKLNKVKLNGYQASVRGGYVSTELLPNKRIKLIGSAITTMRGTMQLPSI

SEQ ID NO: 20460 - protein, 230 aa, Magnaporthe grisea 70-15
MSSLSRRACYKCGNVGHYAEVCSSAERLCYNCKQPGHESNGCPLPRTTEAKQCYHCQGLGHVQADCPTLRLSGAGSNGRCYSCGQPGHLARACPNPNGANMGRGAPVPRGGYGGGYGGRGGFAGGARPATCYKCGGPNHFARDCQAQAMKCYACGKLGHISRDCTAPNGGPLNTVGKTCYQCGEAGHISRQCPTKATANGDSNAAAPAHNDAPMPDATAVAQAPIAAPVV

SEQ ID NO: 20461 - protein, 175 aa, Candida glabrata CBS 138
MAAPQVNEKFDVKDIKFQYIDFDQSVSHDACAMPSTTSWSDFLAKNKTVVITGAPAAFSPTCSISHIPGYISKLSDLEAKGVDQVVVVTVDNPFANEAWAKNLGVQNTKHIKFATDAGAELVRHLGYELKVGEGVYWSGRWTVIVKDGVVVYAGNESNPASDVTVSSVEEALKHL

SEQ ID NO: 20462 - protein, 454 aa, Pyrococcus furiosus DSM 3638
MELRPNVKEIPGPKAREIIEKHHKYMATTTNDPNEYFLVIERAEGVYWIDVDGNVILDFSSGIGVLNVGLRNPRVVEAIKKQLDLVLHAAGTDYYNPYQVALAEKLVQITPGDFEKKVFLSNSGTEANEAALKIAKWSTNRKMFIAFIGAFHGRTHGTMSLTASKPVQRSRMFPTMPGVEHVPYPNPYRNPWHIDGYENPDELINRVLEYIEEYLFSHYVPAEEVAGIVFEPIQGEGGYVVPPRNFFKELKKLADKYGILLIDDEVQMGIGRTGKMWAIEHFGIAPDIITTAKALGGGIPIGATIFRKDLDFGVSGVHSNTFGGNAVAAAAALAVMEELENGLLENVQKLEPLFRERLEEMKEKYEIIGDVRGIGLAWGVEFVKDRKTKEYATKERNEVVVEALKRGLALLGCGKSAIRLIPPLIISEEEAKIGLDIFEEAIRVVSERYGYKIH

SEQ ID NO: 20463 - protein, 432 aa, Wolbachia endosymbiont of Drosophila ananassae
MRKLRFNVMNKIINNVFAREILDSRGYPTIEVEIELCDGAIGRASVPSGASTGKLEALELRDQDEKRYCGKGVLKAVQAVNGIIADEIIGMNAADQNAIDKALIELDGTKNKSKLGANATLGVSLAVAKAAANSFKMPLYRYLGGKQTSVMPVPLINIINGGVHADNKLDFQEFMILPVGAETFSEAIRISAEVFHNLRSILKKKGYSTNVGDEGGFAPNIESTEEALDLIIYAIESAGYSAQSDFALGLDVASSTFYEDGIYEFESKGLTSEELTEYYCNLVERYPIISIEDAMSEDDYEGWKLLTAKLGNKIQLVGDDLFVTNCELICKGIEEKMANAVLIKPNQIGTLTETFAAIEMAKSNGYKAVVSHRSGETEDTTISHIAVASNCGQIKTGSLSRSDRLAKYNELMRIESTLGKDAKYYRGLAWVL

SEQ ID NO: 20464 - protein, 205 aa, Haemophilus influenzae R2866
MSEIKLNYHKTHFLTSAPNIRSIPEDTGIEIAFAGRSNAGKSTALNALTNQKNLARTSKTPGRTQLINLFEVEPNCKLVDLPGYGYAAVPEQMKIQWQKSLGEYLQKRECLAGLVVLMDIRHPLKDLDQQMIEWAVSANLPILLLLTKADKLSQSARSKQVKMVREAILPFQGDIQVEAFSAQNKIGIDKLAAKLDFWFSPLFAK

SEQ ID NO: 20465 - protein, 116 aa, Oryza sativa Indica Group
FTPTCSNQHVPGFINQAEQLKAKGVDDILLVSVNDPFVMKAWAKSYPENKHVKFLADGLGTYTKALGLELDLSEKGLGIRSRRFALLADNLKVTVANIEEGGQFTISGAEEILKAL

SEQ ID NO: 20466 - protein, 517 aa, Oenococcus oeni PSU-1
MIELEKKYDKILVLDYGSQYNQLITRRIREFGVFSELKSRKMTIDEIKDYVPKAIILSGGPKSVYADDAFTIDPEIFRLGIPILGVCYGMQLMAYVLPGGKVLPNDGNGEFGQAALHFDENSLLFANTPEGQKVLMSHGDSVEAVPEGFVVAAKTDKTKIAAIADDDKKLYGAQFHAETTLSEYGNQILKNFVFKIAQCQANWQMKDFINDQIEKIRTEVGNKKVLLGLSGGVDSSVVAVLLHKAIGRQLTCIFVDHGLLRKNEAKLVMESLAGKFGLNIIKVDAQKRFLDKLEGISEPEQKRKIIGKEFIETFNDEAKKLDGIDFLAQGTLYTDVIESGTDTAQTIKSHHNVGGLPKEMHFKLIEPLRTLFKDEARKLGEEMQMPHALVWRQPFPGPGLAIRILGEITEEKLAVVRDSDAILRDEIAKAGLEDSVWQYFTILTGLRSVGVMGDGRTYDWTIAIRAITSVDGMTADFAKLPWDLLGKISERIVNEVGHINRVVYDITSKPPATIEWE

SEQ ID NO: 20467 - protein, 463 aa, Yersinia pestis KIM
MELPVKNKLKRGLTTRHIRFIALGSAIGTGLFYGSADAIRMAGPSVLLAYLIGGVVAFVIMRALGEMSVNNPQASSFSRYAQDYLGPMAGYITGWTYCFEILIVAIADVTAFGIYMGLWFPDVAHWVWVLSVVLIIGAVNMMSVKVFGELEFWFSFFKVATIIIMILAGIGIIVWGIGNGGQPTGIHNLWTNGGFFSNGFVGMLLSLQLVMFAYGGIEIIGITAGEAEDPKKSIPKAINSVPWRILVFYVGTLFVIMSIYPWNQVGTNGSPFVLTFQHMGITIAAGILNFVVITASVSAINSDVFGVGRMLNGMAEQGHAPKAFTAISKRGVPWVTVLVMMCAMLIAVYLNYIMPENVFLVIASLATFATVWVWIMILFSQIAFRRSLSKDQVKALDFPLRGGTFTSVLAIIFLVFIIGLIGWFPTTRISLYVGLVWIVLLLVGYYFKVKYQKKQATLIKNAD

SEQ ID NO: 20468 - protein, 123 aa, Sinorhizobium meliloti 1021
MTATYTITLKNCAFFARHGVLDEEEFLGQRFFVDAELVVDQGTALAEDCIDDTVHYGIAFAEIERIVTGRRRYLIEALALEVAKTLCARFRQIRKAKVSIRKPNAPVPGILDYVEVTVEHVAE

SEQ ID NO: 20469 - protein, 189 aa, Zea mays
MNALAATTRNFRRASKLLGLDSKLEQSLLIPFREIKVECTIPKDDGSLATFVGFRVQHDNARGPMKGGIRYHNEVDPDEVNALAQLMTWKTAVAAVPYGGAKGGIGCSPGELSRSELERLTRVFTQKIHDLIGTHTDVPAPDMGTNAQTMAWMLDEYSKFHGHSPAVVTGKPIDLGGSLGRDAATGRGV

SEQ ID NO: 20470 - protein, 453 aa, Mesorhizobium sp. BNC1
MRFLSFIAAFLIVAAASLPQASAQSSPDVFEAETFSLENGLQVVVIPQRRVPVVTHILFYKAGGADEERGQSGIAHFFEHLMFKATKNHEAGAFEAAVKAVGGSQNAFTTSDFTAYFEQVPPSALKDMMAFEADRMRNLVLSDDAIETERRVVMEERLMRVDNDPSGILREAVGANLFHNHPYGTPVIGWMHEIEKLTKEQLQTFYDRYYRPNNAVLVVAGDVDAETVRKLAEETYGKLERGPDLPPRIRPMEPDLKVEQVVILRDPRVTLPSFSRNWFGPAPFGENEQDADALVLLSTILGGGERSRLHQELVVKRQIASSAGAWTSMNLRDYSQMGVYASPIDPDKLREVQQAVDKEIEKMASENVSEHELETAKKVLASQLIFSWERQMSRALEVGTTLMVGGTLDDVASIRERIDAVTADQIREAAQRYLSVRRSVAGYLLPVDAEDPA

SEQ ID NO: 20471 - protein, 467 aa, Listeria monocytogenes str. 1/2a F6854
MLYSEDDKRKQESYRIPLFGSEEESTSIPKYVLKKEPMEPRIAYQLVKDQLMDEGNARQNLATFCQTYMEKEAEILMAETLEKNAIDKSEYPQTAELENRCVNILADLWNAPKDMSYLGTSTVGSSEACMLGGLAMKFRWRNNAEKRGLDIQAKRPNLIISSGYQVCWEKFCVYWDVDMRVVPMDKNHLSLDVDKVFDLVDEYTIGVVGILGITYTGKFDDIQLLDEKVEAYNATNEHQLVIHIDGASGAMFTPFVNPELPWDFRLKNVVSINTSGHKYGLVYPGVGWILWKDKEYLPKELIFEVSYLGGSMPTMAINFSRSASQIIGQYYNFLRYGFEGYREIHEKTKKTALYLAKTVEKSGYFEIINDGANLPIVCYKMKEGLDVEWTLYDLADQLLMKGWQVPAYPLPADLSDTIIQRFVCRADLGYNVAEEFAADFADAIHNLEHARVLYHDKERNDSYGFTH

SEQ ID NO: 20472 - protein, 599 aa, Mesorhizobium sp. BNC1
MEAALDTYYQPLLLLGAAVIAAPLFKRLGLGTVLGYLAAGIAMGPVARLISDGEDLLPIAELGVVFLLFLIGLDLNPSRLWAMRRQIFGLGAAQVVVTGAVLALAALVFFGLSPAAAVVIGFGLALSSTAFGVQIMESEGTLNRPYGRTAISILLLQDLAIAPLLALIPLLSPGGEGAEDITFSGFALALACVAALILAGRYLLNPLFRLIGSTGAREAMIAAALLVVLGSATLLQVAGLSMGLGAFIAGVLLADSSYRHELTADIEPFRGILLGLFFMAIGLSLDLDVVLENWLLVLGLVPAFMLAKAVLLYGICRLFGCQHNQAVHVASLLPQGGEFGFVLFTAASAALIFSPETASLLIAIVTLSMAMTPAVVRMGALLMLPEEREEIDETFDGAGSEILMIGFSRFGQVASQILLAGGVDVTIIDHSATRVRSVEKFGFRIYFGDGRRKEVLEAAGINKAKVVAVCTNVRATTDAIVNMIRSEFPHVKLYVRSYDREHTLSLKARGVDYEIRETFESALVFGQRSLTELGTSEEVALEIVEDVRRRDEERLAIQAVEGIQAGGDRMHVRPVTPEPLTKPAREARRLDPAVKENSG

SEQ ID NO: 20473 - protein, 483 aa, Mycobacterium avium subsp. paratuberculosis K-10
MPATPIGLRAQLLRRRPVVGAHVAPGTADHLRRGIGTFQLTMFGVGSTIGTGIFFVMSQAVPEAGPAVIVSFLLAGVAAGLAAVCYAELASAVPVSGSSYSYAYTTLGEVVAMGVAACLLLEYGVATAAVSVNWSGYLNKLLSNVVGFQLPHALSAAPWDAQPGYVNLPAVMLIGMCALLLIRGASESAKVNAIMVMIKLGVLVVFGILAFTAFDVHHLDDFAPFGVAGVGTAAGTIFFSYIGLDAVSTAGDEVTNPQKTMPRALIAALSTVTGVYVFVALAALGTQPWQDFGGQQEAGLATILDHVTHGSWASTILAAGAVISIFSVTLVTMYGITRILFAMGRDGLLPPRFARVNPRTMTPVNNTVIVAVAASTLAAFIPLQNLADMVSIGTLTAFVVVSVGVIVLRVREPDLPRGFRVPGYPVTPVLSIMACGYILASLHWYTWIAFSGWVLLALIFYFVWGRHHSALNDAAVDPSGQER

SEQ ID NO: 20474 - protein, 420 aa, Ralstonia metallidurans CH34
MKNAELVRRKDAATPRGVGVMCNFYADRAENSEIWDVEGKRYIDFAAGIAVLNTGHRHPRLVAALQAQLNRFTHTAYQIVPYASYVELAEKINQRAPGRSARKTAFFTTGAEAVENAVKIARAATGRPGVIAFSGGFHGRTMMGMALTGKVAPYKTGFGPFPGEVFHAPYPSALHGVTVEDSRRALEHLFKADIDPRRVAAIIFEPVQGEGGFNVAPPEFVRMLRAVCDEHGILLVADEVQTGFGRTGKLFAMEHYDVAPDLTTMAKSLAGGMPLSAVCGRAEIMDAPAPGGLGGTYAGNPLAVASALAVLDVLESENLIARGAELGERLTARLNSLKPRVPQIAEVRGIGAMVAVEFRRADGSPDAEFTREVQNRALERGLLLLSCGVYGNVIRFLFPLTIQDAVMNEGLDILADVLTR

SEQ ID NO: 20475 - protein, 256 aa, Anabaena variabilis ATCC 29413
MKTEFIVILSQREIEKMRQAGRLAAKLLQHLEPLVKPGVSTLELNDEAERWTQAHGAKSAPLGYKGFPKSICTSVNEVICHGIPNAKQILKDGDIINIDVTPIVDGYHGDTSKTFIVGNAAPKTKKLVEVTQECLNLGIAEVKPGAKIGDIGAAIQEYAEAQGFSVVRDFVGHGISNIFHTAPDVPHYGTRGKGKRLRPGMVFTIEPMINEGTYEVEMLGDGWTAVTRDRKLSAQFEHTIVVTEDGVEILTLPENE

SEQ ID NO: 20476 - protein, 881 aa, Thermotoga maritima MSB8
MAKKYVYFFANGKAEGRADMKDILGGKGANLAEMTNLGIPVPPGFTISAEVCKYYYDHGRTYPEELKEQVEEAMRRLEEVTGKKFGDPNNPLLVSVRSGAAISMPGMMDTVLNLGLNDETVKGLAKLTNNERFAYDAYRRFLQMFGDVVLKIPHEKFEKALEELKKEKGVKLDTELDAEDLKKLVERYKQIYKEEGKEFPQDPWKQLWLAIDAVFGSWMNERAIKYRQIHGIKEGDLLGTAVNIVAMVFGNMGEDSGTGVAFTRDPNTGEKKPYGEFLPNAQGEDVVAGIRTPLKLEELKNRMPEVYNQLLEIMDKLEKHYRDMQDIEFTVERGKLYILQTRNGKRTSQAAIRIAVDMVHEGLITKEEAILRVRPEDVEQVLHPVFDPKEKAQAKVIAKGLPASPGAATGKVVFNAKKAEELGKAGEQVILVRPETSPEDVGGMAAAQGILTSRGGMTSHAAVVARGMGKPAVVGAESIEVHPEEGYFKVGDVVVKEGEWISIDGTTGEVLLGKVTTIKPQGLEGPVAELLQWADEIRRLGVRTNADIPRDAEVARKFGAEGIGLCRTEHMFFEKDRIPKVRRMILAKTKEEREKALDELLPLQKEDFKGLFRVMKGLPVTIRLIDPPLHEFLPQEDEQIKEVAEQMGVSFEELKNVVENLKELNPMLGHRGCRLTITYPEIAVMQTKAIIGAAIELKKEEGIDVIPEIMIPLVGHVNELRYLKKIIKETADALIKEAGVELTYKIGTMIEVPRAAVTAHQIAEEAEFFSFGTNDLTQMTFGFSRDDVGKFLPEYLEKGILEHDPFKTLDYDGVGELVRMGKEKGRSTRPDLKVGVCGEHGGDPRSILFFDKIGLDYVSCSPYRVPVARLAAAQAALKNKK

SEQ ID NO: 20477 - protein, 428 aa, Trichodesmium erythraeum IMS101
MSDSLFDDASRRLERALQYVSLSEDTKERLKYPKATLIVSIPVRMDDGSLRVFQGYRVRYDDTRGPTKGGIRYHPNVSIDEVKSLAFWMTFKCAVVSLPFGGAKGGITVNPKELSRMELERLSRGYIDAIADFIGPDTDIPAPDMYTNPMIMGWMMDEYSIIRRQLSPAVITGKPVSIGGSLGRNTATAMGAFFAIETIMPKFEYTPEKTTVAIQGFGNAGAFLAELLCLHGYKVVAVSDSQGGIYSAQGLDIPSIRQYKEVNKQIQAVYCKDSVCNIVEHTVLTNEELLALDVDILIPAALENQITEENVKDIQAKFIFEAANGPTTSGADKILEDRGVYVFPDILINAGGVTVSYFEWVQNRSGLYWTLDEVNQKLKAKMVAETENIWQISQELSISMRTAAYVHGLDRLGQAINAKGTRAFYAKR

SEQ ID NO: 20478 - protein, 499 aa, Ralstonia metallidurans CH34
MSELKDLEYWRGRARALPIPAHAYIDGQWTSAADGATFDCINPATGEQLARVAACGAADVDRAVAAARRAFEAGVWSAMPRRERKAVLLRLAALIETHREELALLETLDMGKPIGDTMLYDIPEAARTYAWYAEAIDKVYDEIAPTDAGVLATITREPLGVVAAVVPWNYPLLMASWKVAPALAAGNSVVLKPAEQSPLTAIRLAALAEEAGVPPGVFNVVPGLGAEAGQALGRHPDVDCLAFTGSTATGKRFMEYSGQSNLKRVWLECGGKSPHIVFDDCPDLDRAALAAAIGIFNNQGEICIAGSRLYVQRGIYDTFMAKLEAHAAAMQPGDPLDPRSAMGAIVDGRQFDRVMSYVEAGQREGARLRAGGQAARADSGGWFVQPTIFECPTQSLSIVKEEIFGPVLAVTVFDTEAEAVAMANDSAYGLGAGLWTSDLSRAHRVSRRLRSGLVWVNCYMDGDITVPFGGVKQSGFGRDKSLHALEKYQDLKTTWIRLE

SEQ ID NO: 20479 - protein, 447 aa, Candida glabrata CBS 138
MATNEEFIRTQIFGTVFEITNRYSDLNPVGMGAFGLVCSATDTLTNQQVAIKKIMKPFATAVLAKRTYRELKLLKHLRHENLICLQDIFLSPLEDIYFVTELQGTDLHRLLQTRPLEKQFVQYFHYQILRGLKYVHSAGVVHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPSDVIDTICSENTLKFVTSLPHRDPIPFSERFKTVEPDAVDLLEKMLVFDPKKRITAADALAHPYLAPYHDPTDEPVAEAKFDWHFNDADLPVDTWRVMMYSEILDFHKIGGTDGQIDTSATFDDQVAAATVAAAQAQAHALAQAQMSQNMIDPNQLLNEDGTPVSGSIAENSSNSATTNLNGAAAGMNSASDTINEYANQAVHFANEFQQ

SEQ ID NO: 20480 - protein, 99 aa, Anabaena variabilis ATCC 29413
MATFKVTLINEAEGTSNTIDVPDDEYILDAAEEQGYDLPFSCRAGACSTCAGKLVSGTVDQSDQSFLDDDQIEAGYVLTCVAYPTSDVTIQTHKEEDLY

SEQ ID NO: 20481 - protein, 430 aa, Oryza sativa Indica Group
MEAWTIRVVYFIVFSFFLVSARFGSCAPCSEEGRALLRYSESERDKSTDSLSNRGEGKVIGRVLNLLLKEKMFSSETPSELKELGTISESVADAVATAIYVFFSRRKKDNTVMPWATGLSGQLKKAFVTGVPSLERTELEAACEGFINVIGTLPECTLYKGTLSSGVEIAVLSTSLNSAQQWSARSEEQFRNKISVLSRVNHKNFMNLIGYCACDEPFTRMMVFEYAPCGSLFEHLHIREAEHLDWKTRLRIIMGVAYCLEHMSQLDPPPLLPTNLSSSSIYLTEDNAAKIADIKFWKDDINKQDDQESVVYKFGILVLEVISGRRPFSEDDRLLVLWASSYLDGKRPLSAMADRTLVRSSSAAPEKDVAALCDVVRQCVRRPEAGKRAISMGEVARLVRGIAGLSPEQAAPREKPLWWAELEIASSETA

SEQ ID NO: 20482 - protein, 255 aa, Photobacterium sp. SKA34
MKKTIIAMTIAGLFLVGCDQAKQDTATDSTSAAQHSTVEMKDKVTEQSGTALDATKDTVSDAADVVKDQTNKVVDKASELSDSAVQKASEMTDSVKEKTTDVVDKSKQVVDNSFDSMKEKASELKDSLTNSSADEKTSTGVSEMNSSVSEVKDTVADDSKALMDETKEKATEASDAINTAEGSADHSMDEMKDAAIDKTAVAEDDVKNAANEAVKSVDDSAEAAQDKAAEMSDSAVDKTENAADDLEKKASDVLN

SEQ ID NO: 20483 - protein, 500 aa, Vicia faba var. minor
MAKLLALSLSLCFLLFSSCFALREQSQQNECQLERLDALEPDNRIESEGGLIETWNPNNRQFRCASVALSRATLQRNALRRPYYSNAPQEIYIQQGNGYFGMVFPSCPETFEEPQQSEQGEGGRYRDSHQKVNRFREGDIIAVPTGIVFWMYNDQDTPVIAISLTDIGSSNNQLDQMPRRFYLAGNQEQEFLRYQHQQGGKEEQDNDGNNIFSGFKRDFLEDALNVNRHIVDRLQGRNEDEEKGAIVKVKGGLSIITPPERQARHPRGSRQEEDEDEDEKEERQPSHHKSRRGEDEDDKEKRHSQKGESRRHGDNGLEETVCTAKLRLNIGSSSSPDIYNPQAGRIKTVTSLDLPVLRWLKLSAEHGSLRKNAMFVPHYNLNANSILYALKGRARLQVVNCNGNTVFDEELEAGRALTVPQNYAVAAKSLSDRFTYVAFKTNDRAGIARLAGTSSVINDMPVDVVAATFNLERNEARQLKSNNPFKFLVPPRESQKRASA

SEQ ID NO: 20484 - protein, 733 aa, Silicibacter sp. TM1040
MTDFKYDVDADGIAIITWDAEGKSMNVLTREAFGLVEDYIDRALGDDAVKGVVITSGKKDFAGGMDLNVLATIREESGENPAQGLFDFTMNGHRILRKLERAGMDAKNNKGGKPIACAINGTCAGIGTEIALACHYRTMTDNPKAKIGLPEILLGIFPGGGGTIRYSRMVGAVNAAPVLLEGKMMDPKKAKSASLVDEVAADPLEAARQWVLNAKDADIVKPWDQKGYKMPGGAPYHPAGFMNFVGASAMVHGKTQGAFPAAKALLSAVYEGALVDFDTALRIEARWFTHVLMNPSSSAMIRSLFLNKQALEKGAVRPKGIEDQSVKKIGVLGAGMMGAGIALVSAQAGMEVVLIDRDQDAADKGKAYSATYMDKGIKRGKATPEKKEALLAQITATADLDALKGCDLIIEAVFEDPGVKAEMTKKVEAIIPEDCIFASNTSTLPITSLAEASVRPEQFIGIHFFSPVEKMFLVEIIKGEKTGDRAVAKALDYVRQIRKTPIVVNDARFFYCNRCIIPYINEGARMITEGVSPVLIDNAARQLGFPVGPIQLTDETSIDLGAKIARATKAAMGDAYPESPADDLIFWMEDQGRLGRKANAGFFDYDDKGKRVEYWKGLAEKYPLAEVQPDLVEVQERLMFAQVLEAVRALEENVLMDIREGDVGAVLAWGFAPWSGGPLSWLDIIGTPYAAERCDQLAEAYGDRFACPPLLREMAEKGQTFYGRFAPEEDQAA

SEQ ID NO: 20485 - protein, 436 aa, Aspergillus oryzae
MEPYDDGFIEEQEEQEEERTEEKVINEEYKTWKKNAPFLYDMILSTALEWPTLTTQWLPDKQEVPDKPYSTHRLLLGTHTSSDAQNYLQIAHVQLPNPSAPNPDDYDEERGEIGGYGGSSKKAPMEIKFNIVQKIDHKGEVNKARYQPQNPNVIATMCTDGRVMIWDRSKHPSLPTGTVNPQMELLGHTKEGFGLSWSPHTAGHLVTGSEDKTVRLWDLTTYTKGNKALKPSRTYTHHSSIVNDVQYHPLHSSLIGTVSDDITLQILDIREAETTRAAASAEGQHRDAINAIAFNPAAETVLATGSADKSIGLWDLRNLKTKLHTLECHTDSVTSLSWHPFEESVLASASYDRKIMFWDLSRSGEEQTPDDAQDGPPELLFMHGGHTNRISDFSWNLNDPWVLCSAAEDNLLQVWKVADAIVGKDLEDVPTEELEA

SEQ ID NO: 20486 - protein, 378 aa, Wolbachia endosymbiont of Drosophila ananassae
MSPFSLENSGCVYADYNATAPISENVKKSIFEVLLKQTLNPSSLHKRGQEARKILQDARDNVRGAIGVSSDKEIVFTSGATEANNLVMRGIAGYLHVISAIEHPSILNSACNPYIIPVNQEGIVDFLELEKILSELKGNKAIVSVMMANNETGVIQPIEEIAEIAHKFGAICHTDTAQSVGKIKVNMEDLGVDLLTLSAHKFGGVAGSGVLIFNKELAIEPIIIGGGQEKGFRGGTENIVAIAGLSAALQNIPDLLSKMDEVKELRDQLECELLNFASDIRIFGKNSKRLPNTSFIYMPGVKSDVQLMHFDLNYIAVSNGSACSSGKVEPSHVLLAMGATKEQAECSIRISIGPETKPQDIKKIVDCWYNIYKQNTLV

SEQ ID NO: 20487 - protein, 634 aa, Photorhabdus luminescens subsp. laumondii TTO1
MEQQKKFDVICMGRIAVDLYGQQIGARLEDMGSFAKYLGGSSGNVAYGTARQGLKSSMLARVGDEHMGRFLREELQSVGCDTSHLTTDKERLTALVLLGIKDKTTFPLIFYRDNCADMAITGDDFSEEYIASARCLAITGTHLSHPNTRDAVLTALNYARRNRVKTVMDIDYRPVLWGLTSLGDGETRYITSEQVTAQLQEVLSLFDLIVGTEEEFHIAGGSTDTIEALRNIRKLTSAALVCKRGSLGCSIFTAEIPNDLNDSITIQGVSVDVLNVLGAGDAFMSGLLRGYLNNEGWEKACTYANACGALVVSRHGCAPAMPDKTELDNYLSRANQILRPDLDETLNHLHRISARKNQWDELCVMAFDHRIQFIELARQANASIKRISSLKQLLLRASREVATEAGLQGKIGLLCDSTFGQDVLNEITGQGWWIGRPIELPGSRPLCLEHGNIGSQLIDWPLEHIVKCLVFFHPEDAHPLRLEQEKKIREIYAACCKSGHELLLEVILPAEMKHSDEFYIRALRRFYNLGVKPDWWKLPPLSSESWDNINYLIEQRDPYCRGVVILGLDAPQEELEMGFNAAAGKSIVKGFAVGRTLFGQPSLKWLKNEIDDNRLIQKIKTNYHNLISLWRQRG

SEQ ID NO: 20488 - protein, 226 aa, Brucella melitensis 16M
MSDVVANLNAVKAVIARAEKEARRENGSVTLVAVSKTFDAQAIRPALDAGQRVFGENRVQEAQGKWPALREAWASIELHLIGPLQSNKAADAVALFDAIETVDREKIAAALASEIRKQGKSPKLYVQVNTGLEPQKAGIPPQEAVAFVERCRKEHGLVIEGLMCIPPAGENPGPHFALLEKLAREAHVEKLSMGMSGDYETAIGFGATSVRVGAAIFGGRAYSASV

SEQ ID NO: 20489 - protein, 504 aa, Yersinia pestis KIM
MTIHLADGTDTFINFRETAPSTANADMYLDKDGNVTKDASLYGYLAVGVPGTVLGMDSAQKKYGKLTRQQVMAPAIRLARDGFILTCADTDILDTTVKRFRQDPESARIFLRKDGEALQPGDRLVQADLADTLSAISEKGPDAFYQGKIPQAVEAAAKKGGGILTAADFADYKITETAPITCSYRGYKFVSAPPPSSGGVTLCETLNVLEGYNLKSMGFNSADYIHTLTEAMRHAYMDRNTFLGDPEFVKNPLDRLLSKSYAADIRKQIVANKATPSVEVQPGMQPHEKPETTHYSIVDHEGNAVSTTYTVNGRFGAVVIAPCTGFFLNNEMDDFTVKVGEQNLYGLVQGATNAIAPGKRPLSSMSPTLVTKDGKTFMVLGSPGGSRIISITLQTALNVIDHGMAPQEAVDAPRIHHQWLPDEVYYEQRGVSADSLNILKSMGYKMVEQSPWGAAELILVGLAGVEGVSPANSGNDSAVSGKVREGYLYGANDVRRPAGAAIGY

SEQ ID NO: 20490 - protein, 529 aa, Zea mays
MQHRRKPASAAAPPAAKQPAARRPTARLSLAGLVVSIFLVATFLYNEDVVKAASGSSSSATTADAAEVGVSGRARSPDLRVLQEAAHQGVEAEEREVGDRTEAEQKQKPLTLPIPIPVVALAEEELVENTKGRQKQQQQEEEQTQKPPPPPPPPPQVAGCDLYRGRWTFDAAGEQAPLYRESECEFLTEQVTCMRNGRRDDSYQKWRWQPDGCDLPRYDARLLLERLRNKRLMFVGDSLNRNQWESMVCLVQSVVPWGHKTLHKFVNNGSLNVFTAHDYNATVEFYWAPFLVESNSDDPQAHSVMNRVIAWRAIAKHAKNWKGVDYLVFNSYIWWLNTFEMKVIRRHQHQLEKEEEGVRWSKYALVDRPVAYREVLKTWARWVDRHIDPNRTRVFFMGMSPNHVTPWAWGNDGGIKCAMETQPISNNRTGRLDIGTDWRLHGVARGVLARYLRRVPVHFVDITGLSELRKDAHTSVHTLRQGKLLTPEQQADPKTYADCIHWCLPGLPDTWNHFLYAHILSLSSSAQDH

SEQ ID NO: 20491 - protein, 195 aa, Lactococcus lactis subsp. lactis Il1403
MTINTNNLTITISAASKKQYPENDWPEIALAGRSNVGKSSFINTLLNRKNFARTSGQPGKTQLLNFYNIDDQLHFVDVPGYGYARVSKKEREKWGKMIEEYLTTRENLKAVVSLVDIRHEPSEDDLMMYEFLKYYHIPVILVATKADKVPRGKWNKHESIIKKAMKFDSTDDFIIFSSTDKTGFEEAWEAILRYL

SEQ ID NO: 20492 - protein, 116 aa, Lactococcus lactis subsp. lactis Il1403
MYKIKLNNIKFRAHIGVLPEEKVLGQNLEIDLIVETNFDFSGKDELDETLSYVDFYEATKAVVESSKADLIEHVAFEIIQAVKATSERISTVEVHLRKLAVPIEGIFDSAEIEMRG

SEQ ID NO: 20493 - protein, 345 aa, Zea mays
MEEEKAAAYYDELNRKGEGARRFKQGLGFSSSSATAFPSKPTASSFLSGFVRAGAAPGPAKQPLPHSRTPSSPHHRSSSPPLSRPRIRSRSRSRSPSRSSRRQSRSRSRSRERRRRSRSRERDRRASCRRSRSRGSRSPSRRSGRSLHLEARRERHGDQRRRHDDGHQSSKGRSDRDGGKMDYSRLIKGYDKMTPAERVKAKMKFQLSETAAKDSTLGTATVGWERFQFNKDAPLDEDNDDVEVANDDASLVKNIGKSFRLSAVESKREDKIRDAHDEAIFGVPTTSFVDVEIGGDELKTNHEDGKVEDTESDEPSSSLISDKVLAMQKGSWRDRAQKLRKNLNT

SEQ ID NO: 20494 - protein, 535 aa, Pseudomonas fluorescens PfO-1
MAILHTQLNPRSAEFAANSAAMLKQVDVLHTLLAQVAQGGGAKAQERHTSRGKLLPRERINRLLDPGSPFLEISQLAAHAVYGEEVPAAGVIAGIGRVEGVECMIVANDATVKGGSYYPLTVKKHLRAQTIAQQNRLPCIYLVDSGGANLPRQDEVFPDREHFGRIFFNQANMSAMGIPQIAVVMGSCTAGGAYVPAMADEAIMVRNQATIFLAGPPLVKAATGEVVSAEDLGGADVHCKTSGVADHYAESDEHALALARRSVANLNWRKLGEVQQRAPIAPLYASEELYGVVSADAKQPFDVREVIARLVDGSVFDEFKALFGTTLVCGFAHLHGYPIAILANNGILFAEAAQKGAHFIELACQRGIPLLFLQNITGFMVGQKYEAGGIAKHGAKLVTAVACAKVPKFTVIIGGSFGAGNYGMCGRAYDPRFLWMWPNARIGVMGAEQAAGVLVQVKREQAERSGQAFSAEQESEIKQPILDQYEEQGHPYYSSARLWDDGVIDPAQTRDVLALALSASLNAPIEPSRFGVFRM

SEQ ID NO: 20495 - protein, 303 aa, Spinacia oleracea
MSKEVSEEAQAHQHGKDYVDPPPAPFFDLGELKLWSFWRAAIAEFIATLLFLYITVATVIGHSKETVVCGSVGLLGIAWAFGGMIFVLVYCTAGISGGHINPAVTFGLFLARKVSLLRALVYMIAQCLGAICGVGLVKAFMKGPYNQFGGGANSVALGYNKGTALGAEIIGTFVLVYTVFSATDPKRSARDSHVPILAPLPIGFAVFMVHLATIPITGTGINPARSFGAAVIFNSNKVWDDQWIFWVGPFIGAAVAAAYHQYVLRAAAIKALGSFRSNPTNLEQKLISEEDLNSAVDHHHHHH

SEQ ID NO: 20496 - protein, 341 aa, Frankia sp. CcI3
MRAVQVIKYDNAPRLVDVPEPKILHPLDVVVRIGGAGVCRTDLHIIEGQWEQKSGVTLPYVLGHENAGWVHEVGSAVSDIAVGDPVILHPLVTCGLCRACRDGDDVHCARASFPGIDSDGGYAELLRTNARSVVKLDPSLQPADVAALADAGLTAYHAARKAAAALSPGDRVVVIGAGGLGHIGVQVLRALTPAEIIVVDRSAEALRLAGELGADHTVRADGSEVSAVLDLTGGSGAEAVIDFVGEGGAIEAGVAMLRRAGSYYVVGYGGVLNVSTIDIISTEINFIGNLVGSYSDLVELMVLATRGKVTLHTSAYPLAEFHQALDDLHHGKVRGRAILIP

SEQ ID NO: 20497 - protein, 455 aa, Crocosphaera watsonii WH 8501
MFTSPPIPLLATETTANLGPTILAGVLLSLIVIYLASKLGGEISRSLNLPPVLGELVGGVVVGASALHLLVFPESGATAADSVLMSTLQLVGGLTPEAVPEVFNSQSEVISVLAELGVIILLFEIGLESDIRELQEVGYQAAIVAVVGVIAPFTAGTVGLMLLFNVPTIPAIFAGAALTATSIGITSKVLSELGYLKSKEGQIIVGAAVIDDVLGIIVLAVVASLAKTGTVDVVNVIYLIVSATVFLLGSIFLGKFFNKSFVAVSEVLQTRGKLVIPALIFAFFMAFLANVIQLEAILGAFAAGLVLDETDKRKELDQQVIPIADILVPVFFVSVGAKVNLGVLNPFVAENREGLIIATFLIVVAIIGKLITGWSFTGQEKINRLAIGFGMIPRGEVGLVFAGIGSASGVLSQSLEAAIIVMVILTTFLAPPLLRFAFKDPSETSEKLQNADIAN

SEQ ID NO: 20498 - protein, 253 aa, Picea sitchensis
MPFRGIAVGRPEEATHPDALKAALAEGISTLIFVFAGEGSGMAFDKLTNDASTTPAGLVAVALAHALGLFVAVAVGANISGGHVNPAVTFGAFVGGHITLLRGILYWFAQLIGATVACLLLKFTTGGLSTSAFSLSSGVGVGNAVVFEIVMTFGLVYTVYATAIDPKKGSLGTIAPICIGFIVGANILAGGAFDGASMNPARAFGPALVSWTWENHWIYWVGPLLGGGLAGVIYELFMISPEPTHEPLPSNDY

SEQ ID NO: 20499 - protein, 314 aa, Triticum aestivum
  misc_feature (119)..(119): Xaa can be any naturally occurring amino acid
MAEHLASIFGTEKDRVNWPFYFKIGACRHGDRCSRLHNKPSVSPTLLLCNMYQRPDMITPGVDAQGNPIDPVKIQGDFEDFYEDIFDELSKHGEVENWHVCDNLADHLIGNVYVQFREXDQAAKALQALQGRFYSGRPIIAEFSPVTDFREATCRQFEEHNCNRGGYCNFMHVKEIGRDLRKRLYGHLHRSRRSHSRSPSPYRHHARDRDRSSRSRDRGDYYGGSLDRGDYGDYYHHSRRSSERNRNYDSDGSRRRRRHRSRTRSPVREGSEERRAKIEQWNREREAPARQGSEERRAKIEQCCLVHRMFCLLV

SEQ ID NO: 20500 - protein, 404 aa, Ralstonia metallidurans CH34
MELLLQAVLFLASALVVVPLSIRLGFGSVLGYLVAGMLIGPSALGFVTDVNAVLHIAELGIMLMMFIIGIEMDVRKLWNLRRSIFGHGGAQVLLCAVLLALAFTAFGVNWRVGVAAGFALSLSSTAMVIAILEQRGLMQAPIGRASFGILLFQDMAAIPMIALLPLLSPAPATTNTIAGWIVALEALGMLAAVVFGGTILLRYLLPIIRRSGTRDMVTVFALLWVIGIALLMQSVHLSMSLGAFVAGVLLAGSDCREEIEADISPIKGVLLGLFFMAVGMSIKFDVLASKPFLVAVLLLVLLVAKISGLLFLARQIQLPRGDRVYFAVLLSQGGEFAFVVMAVAEAARLLNGEQASIVTAVVALSMAATPLLLMALRTKEVARDVERPLPAANRHADAPDADLH

SEQ ID NO: 20501 - protein, 104 aa, Glycine max
  misc_feature (39)..(39): Xaa can be any naturally occurring amino acid
  misc_feature (53)..(53): Xaa can be any naturally occurring amino acid
NPRRVLREQPEAAKIMEDEFIVHLSSVLEIAELKSASVXLKVLLMPPSIHDKXLVLDASAHDEFVSLKNVAEVTVTKVQELQDNIDAASSSPHCSDREAFNVLM

SEQ ID NO: 20502 - protein, 303 aa, Ralstonia metallidurans CH34
MSKIGFIGLGVMGKPMALHLQTGGHAVHAHTRSGVPQALLDAGVKSCASAADVARQADVIFLMLPDTPDVARVLFGEQGVAEGLSPGKIVVDMSSISPIETREFAARIEKLGCDYVDAPVSGGEVGAKAATLSIMAGGKQDVFDKVLPLLQLMGKNITLVGNAGDGQVAKVANQVIVALTIEAVSEALVLAAKAGADPARVRQALMGGFASSRILEVHGERMIKRTFEPGFRIELHQKDLNLALSTAKALGLGLPNTASCQQLFNVCVAQGGAGWDHSGLVKAIEHMSSFAIGDKPTNAPTKG

SEQ ID NO: 20503 - protein, 87 aa, Glycine max
MAQHGFLSSLRSHLRTTPPPSHVQPRRGYHVELGAREKALLEEDVALKRFKSYKNSVKRVSKIGNVLTLVVFAACSYEVVTLATSTQ

SEQ ID NO: 20504 - protein, 267 aa, Physcomitrella patens subsp. patens
KEPASGELEGIVYEFDLCSLIVHHLNPSCQVRNSITILTREYIDGLPNGWRDYAWKRINKGYSMCSNITLCNEKLAPVIPSTPPFIPRQYGRCAVVGNSNDLLQDLFGAEIDEFDAVIRMNGAPVENYTHYVGEKTTFRILNRGSAKALDKIVALSASAQETIIVKTTIHDFMSRMIREVPILNPVYLMVGAPLGKSAKGTGVKAIEFALSVCEMVDIYGFTVDPGYLEWTRYFSESRRGHAPLQGRAYYQTMECLGVICNHFHTQL

SEQ ID NO: 20505 - protein, 462 aa, Microcystis aeruginosa PCC 7806
MSILELIEKRLEENFALHEQYLNPQMVRVLKTIGYDRHYVKAEGPYLFDNQGEKYLDLLSGFGVFALGRNHPKIVQALQEVLTAALPNLVQLDASILAGLLAERLAAIAPTGLERVFFANSGTETVEAAIKFSRYATGRSQIVYCQGGYHGLTMGSLSATGDPHYREGFGPFVADFKEIPFGDLAALEKALINQDVAAFITEPIQGHGVRIPEPNYLPAAAALCRRYGTLFVADEVQTGLGRTGKIWAVEHWGVEPDILCVAKALSGGFVPVGAVLCRRWIFDRVFDRMDRSVVHGSTFGKNNLAMAAGIATLQVIEEEKLVERAAVIGQQIIAELQPLVDQYECLQEVRGLGMMIALEFTEPSSWSLKAAWKMLETANKGLFSQLIVVPLFTRHQILSQVSGHGMNIIKFIPPLTLSDEDCRWFVTAVKDVVADAHRFPGAAWEFGKTLASQAIRQKTAKK

SEQ ID NO: 20506 - protein, 443 aa, Coccidioides immitis RS
MFKLARSRPIAAALRPIVETPLRSALQSQKRNLSIHEYLSANLLKSYGIGVPKGEVARTADEAEAVAKQLGGEDVVIKAQVLAGGRGKGTFDNGLKGGVRILYSPTEARMFAGQMIGHKLVTKQTGARGRICNAVYICERKYARREFYLAVLMDRASQSPVIVSSSQGGMDIEAVAKENPEAITTTKIDINVGVTDEIARKIAAGLGFSEQCLEEAKDTIQKLYKVFMERDATQIEINPLAETTDYRVLAMDAKLNFDDNAEFRQKEVFSWRDTTQEDPDEVKAAEFGLNFIKLDGDIGCLVNGAGLAMATMDIIKLNGGNPANFLDVGGGATPSAIKSAFELITSDPKVTAIFVNIFGGIVRCDAIAQGLINVVRDMNLRTPIVARLQGTNMEKAHQLINDSGLKIFSIEDLQNAAEKSVQFSKVVKMARDIDVGVEFTLGI

SEQ ID NO: 20507 - protein, 368 aa, Candida glabrata CBS 138
MQILTLLTSFVLANAVVGSPGDQLDEFIDCICACEYDRKCAGSGINYIDPNTNEFHNVNFVSMIDGRKTFLSSMVSKATFWDCMSECDYECQQIITYDRIRKNKKILQFHGKWPFKKIMGFQEFFASIFSIGNFIPQYRGYKLIQKRLERNSKRAVTDVFYEMMLRNYMWVSIMGMLAWTSSTVFHLRDLVVTEKFDYFFAGGTVLSGFHAILTRLIYKHVAEERRYRYMKIVSGLVVTIFTCHILRLYIDWSYRYNMKFNIFFGVLQYIVLIYVGIDNYIEIQRVRNGSKTEDKSKLQASVFKLSYLPILLVLFTSMSMSLELFDRFSIKWQLDSHATWHLLTIVPSWYLFDFFLADLDFALHRRNE

SEQ ID NO: 20508 - protein, 503 aa, Photorhabdus luminescens subsp. laumondii TTO1
MEQVQNYVNGQLIPSYSTRFSPVFNPATGKQIRQVALSTAHEVEQAIEIAHQAYREWSKISPLKRARVMFQFKTLLEANIDKLARLISEEHGKIYSDAIGELTRGLEVVEFACGIPHLQKGEHSANTGTGVDSHSLMQPLGVCVGITPFNFPAMVPMWMFPIALATGNTFVLKPSEKDPSLALELASLLKQSGLPNGVFNVINGDKEAVDILLTDPHVQAVSFVGSTPVAEYIYTTASAHGKRCQALGGAKNHCILMPDADLDMASSAIAGAAFGAAGERCMALSVVLAIGDETADALIEKLRQQINKISVGPGIVATTENDMGPVISAQHQAKICDYIDSGEKQGASLLIDGRQLKVPGYENGYFIGPTLFDNVTPEMKIYQEEIFGPVLSIVRVPDYATALTLINCHQYGNGTAIFTRDGETARQFSEDVQAGMVGINIPIPVPMAFHSFGGWKRSIFGPLNVHGNDGVRFYTRMKTVTSRWPASIRLEHHSSNFVMPTME

SEQ ID NO: 20509 - protein, 279 aa, Caulobacter crescentus CB15
MSKLVPAVRSGDVLMPALGFGTWQLENGTAVPLVEKALEIGYRHIDTAQIYGNERDVGAAIRNSGVKRDEIFLTTKVWIDQFADGDLQRSAEKSLEKLGVDQVDLLLLHWPKPEVPLAETLKALNAVRAKGWTRAIGLSNFPSAQLEEAAKLSEAPIATDQVEYHPYLSLKTLKAKADQLGVSITAWSPLAQGKVAQDPVLIEIGRAHGKTPGQVTLRWIIQQGIIAIPRTSNPKRIEENFDILDFELSEKEMAQIHGLARPDGRIGDWIDRAYAWDAE

SEQ ID NO: 20510 - protein, 127 aa, Glycine max
LAIKSADRPDIVLAIPEGGNPKGLWFTLKEGSRYRLMFTFQVENNIVSGLKYTNTVWKTGIKVDSSKEMIGTFSPQAEPYTHEMPEETTPSGMFARGQYSARSKFVDDDNKCYLEINYTFDIRKEWQ

SEQ ID NO: 20511 - protein, 759 aa, Silicibacter sp. TM1040
MPDKTSESLRDAALRYHEFPRPGKLEIRATKPLATGNDLARAYSPGVAEACLEIKDDEANAARYTARGNLVAVVSNGSAVLGLGNIGALASKPVMEGKAVLFKNFANIDCFDIELNESDPEKLADIVCALEPTFGAVNLEDIKAPDCFIVEKLCRERMNIPVFHDDQHGTAIVVGAAAKNALHVAGKKFEDIKIVSTGGGAAGIACLNMLLKLGVKRENVWLCDIHGLVYEGREEDMNPHKAAFAQASEKRTLDEVIDGADLFLGLSGPNVLKPEMVTKMAKRPIIFALANPTPEIMPDEARKVAPDAIIATGRSDFPNQVNNVLCFPFIFRGALDVGATEINDEMQIACVEGIAELARTTTSAEAAAAYKGEQLTFGADYLIPKPFDPRLVAVVSSAVARAAMSSGVAKRPIDDLGAYRAKLNQSVFKSALLMKPVFEAARAAARRIVFAEGEDERVLRTAQEMLRETTETPILIGRPEVIEHRCQRLGLSIRPGQDVQIVNPENDPRYRDYWTSYHRIMERRGVTPDLAKAILRTNTTAIGAIMVHRGEADSLICGTFGEYRWHLNYVQQILGGGSYAPHGALSMMILDDGPMFIADTQVRIEPTPEEIAETVIGAARHVRRFGLKPQIALCSQSQFGNIQCDTGERLRAALAILDDKRRDFVYEGEMNIDTALDPELRERIFPNSRLEGAANVLVFAHADAASGVRNILKMRSGGLEVGPILMGMGNRAHIVSPSITARGLLNMAAIAGTPVAHYG

SEQ ID NO: 20512 - protein, 184 aa, Triticum aestivum
MQRLFATLASKMSNPKVFFDLSIGGAPAGRVTFELYADKVPKTAENFRALCTGEKGTGKSGKALHFKGSKFHRVIPQFMCQGGDFTRGNGTGGESIYGEKFEDENFDLKHTGPGILSMANAGKNTNGSQFFICTAKTAWLDGKHVVFGKVVDGYSAIEACQAQGSESGATKKTITVDDCGEIKE

SEQ ID NO: 20513 - protein, 521 aa, Brucella melitensis 16M
MAKAATPKTTAAAEAKPAAKAPAKKAAPKTTAAAKPAATKSGAPKAAAAGAIGHITQVIGAVVDVKFPEGQLPLILNALEVDNQGHRLVLEVAQHLGEDTVRTIAMDATEGLVRGQEARDTGEPIMVPVGVETLGRIMNVIGEPVDEAGPIKTKATRAIHQNAPEYIEQSTEAEILVTGIKVVDLLAPYAKGGKIGLFGGAGVGKTVLIMELINNVAKAHGGYSVFAGVGERTREGNDLYHEMIESGVNKLGGGEGSKAALVYGQMNEPPGARARVALSGLTVAENFRDQGQDVLFFVDNIFRFTQAGSEVSALLGRIPSAVGYQPTLATDMGAMQERITTTTKGSITSVQAIYVPADDLTDPAPATSFAHLDATTVLSRSIAEKGIYPAVDPLDSTSRMLDPKVVGEEHYAVARQVQSILQRYKALQDIIAILGMDELSEEDKLTVARARKIERFLSQPFFVAEVFTGSPGKLVDLADTIKGFKGLCAGDYDHLPEAAFYMVGSIEEALEKAKKLAAEAA

SEQ ID NO: 20514 - protein, 438 aa, Bacillus subtilis subsp. subtilis str. 168
MHTEDNGLKKEIGLLFALTLVIGTIIGSGVFMKPGAVLAYSGDSKMALFAWLLGGILTLAGGLTIAEIGTQIPKTGGLYTYLEEVYGEFWGFLCGWVQIIIYGPAIIGALGLYFGSLMANLFGWGSGLSKVIGIIAVLFLCVINIIGTKYGGFVQTLTTIGKLIPIACIIVFGLWKGDQHIFTAVNESISDMNFGAAILATLFAYDGWILLAALGGEMKNPEKLLPRAMTGGLLIVTAIYIFINFALLHILSANEIVTLGENATSTAATMLFGSIGGKLISVGIIVSIFGCLNGKVLSFPRVSFAMAERKQLPFAEKLSHVHPSFRTPWIAISFQIALALIMMLISNPDKLSEISIFMIYIFYVMAFFAVFILRKRAKGEKRAYSVPLYPFMPILAIAGSFFVLGSTLITDTMSCGLSILIGLAGLPVYYGMKKRKAS

SEQ ID NO: 20515 - protein, 381 aa, Arabidopsis thaliana
MFTDLPRDLETEILSRVPATSLQKLKPTCKRWYTLFKDPEFLKKHVGRAEREVISLMSLRVYSLSVNLSGIHSSVEMTGMLNSLKDSEDVKISDITECNGLLLCTTDDSRLVVWNPYTGETRWIPYKSNSPYEMYQKFVLGYDNTNKSRYSYKILRCYHGLIDFGYEFEIYEFNSHSWRRFYDNSPNCSFESKGVTLKGNTYWFASDTEGRHIILRFDFATERFGRLSLLYQSGGYVDNVVETGVLSAVREEKLALLYERFDELNDSSEMKIWVTNTKIVEAKDLSWSDFLVVDSSKFMVTRMTNVMSFLVDEEKKMVVVCDTDIDQHMNRFYIVGEDIYKEVYKDIAQGWFSYWPLLISYAPSLVQIQQGKVIPGGKRKR

SEQ ID NO: 20516 - protein, 269 aa, Streptomyces avermitilis MA-4680
MTQKVAVLGTGKIGEALLSGMIRAGWAPTDLLVTARRPERAEELRARHGVTPVTNAEAAKTADTLILTVKPQDMGTLLTELAPHVPTDRLVISGAAGIPTSFLEERLAQGTPVVRVMTNTPALVDEAMSVISAGSHATAGHLAHAEEIFGAVGKTLRVPESQQDACTALSGSGPAYFFYLVEAMTDAGILLGLPRDKAHDLIVQSAIGAAIMLRDSGEHPVKLRENVTSPAGTTINAIRELENHGVRAALIAALEAARDRSRELASGSS

SEQ ID NO: 20517 - protein, 272 aa, Bacillus subtilis subsp. subtilis str. 168
MEQIGLIGYGSMADMIARQLLKHEQIKENELFIETRTKGERLRALMSDYPNVSADPLENWANTCQLILICVPPLHVIETMRRLYPYVNRNTHIVSIAAGVPLRLLEAETEAGISRVIPAITSEAEAGISLVVHSEALAAEKKERLNELLSVFSRVREIKESNLDVASNLTSSAPGFIAAIFEELALSAVRNSSLSKEEAFDFLIHSLYGTGKMLIEKNMSFEETLERVATKGGITGEGAEVIHASVPDVFDEVFERTLRKYELLTEQVGKQT

SEQ ID NO: 20518 - protein, 563 aa, Crocosphaera watsonii WH 8501
MIALPMALAFGVASGAGPAAGLWGAVLIGFFAALFGGTPTLISEPTGPMTVVMTAVITKLTADNPENGLAMAFTVVMIAGVFQIILGALKLGKYITLMPYTVISGFMSGIGLILITLQFGPLLGTANPKGGVIAALQNAPTVLSNLSPNIGEVILGLLAVAVLFLMPSKLKKVVPPQLVALIGCTLISVFFFGNAEIKTIPEFSAGLPSLVMPTFTVDQVQIMIVDGLVLGMLGCIDALLTAVIADSLTQTQHNSDKELIGQGIGNLVSGLCGGLPGAGATMGTVVNIQAGGRTAVSGLSRAFILLVVVLWAAPLTQNIPLAVLAGIAFKVGIDIIDWKFLQRAHKLSWKAAAIMYGVMLLTVFYDLITAVGLGVFVANILTIQKLANIQADRVKAIDTHEDDRLANQEARHLMKEANGRILLLDLGGPMSFGASKAITQRQNILDNYEMLVIDLTHVPLLGVTATLALEKTIDDAYAKGLEVYIVGGEGKLKERLQKFDILDRVPHKNRVQTRVAALQLAVASINGNTMEQIQKGMGINGSHFPEDDNNPSNGVTSGDRLSN

SEQ ID NO: 20519 - protein, 530 aa, Candida albicans SC5314
MSANIDDVPIEVSKVFDTILVLDFGSQYSHLITRRLREFNVYAEMLPCTQKIAELSWKPKGIILSGGPYSVYAEDAPHVDHDIFKLGVPILGICYGMQELAWINGKGVARGDKREYGPATLNVEDPECALFKGVDHSQVWMSHGDKLHALPTGFKVVATSDNSPFCGISNESEHIYGIQFHPEVTHTVQGKKLLKNFAVDICQAKTNWSMENFIDTEIARIKKLVGPTAEVIGAVSGGVDSTVGAKIMKEAIGDRFHAIYVDNGVMRKNETESVKKTLDEGLGINLTVVDAGDLFLGRLKGVTDPEKKRKIIGNTFIHVFEEEAAKIKPRDGSEIEYLLQGTLYPDVIESISFKGPSQTIKTHHNVGGLLEDMKLKLIEPLRELFKDEVRHLGELLGVPEDLVWRHPFPGPGLAIRVLGEVTKEQVKIAREADAIFIEEIKKAGLYRQISQAFAALLPVKSVGVMGDQRTYEQVIALRAIETLDFMTADWFIFEAAFLKKVASRIVNEVDGVARVTYDITSKPPATVEWE

SEQ ID NO: 20520 - protein, 103 aa, Brassica napus
MAQQEASPSPGAEVVGRAFVEQYYHILHQSPGLVHRFYQDSSLLTRPDATGAVTTVTTMLAINDKIMSLKYEDYTAEIETADAQESHVRGVIVLVTGRLTGND

SEQ ID NO: 20521 - protein, 619 aa, Bordetella petrii
MTKAVSNQRRQFVQGLAAGGLLTGLGLWRQPAWALPTPEQANVLSGTEFDLEIGESPANLTGSPRMATTVNGMLPAPTLHWKEGDTVTLRVTNRLSEDTSIHWHGILLPTGMDGVPGLSFPGIRPGETFTYQFEVRQSGTYWYHSHSGFQEQTGLYGAIVIEPKRPDPVRAERDYVVLLSDWTDEDPMSVFRKLKVMPDYYNYIQPSVENLMDDAKKSGWKNALNERLMWQKMRMNQTDLADVSGATYTFLTNGKAPAGNWTGLFKPGERVRLRFINGSAMTYFDVRIPGLKMTVVSADGQPVRPVEVEEFRIAVAETYDVIVEPSEDRAYTIFSQAMDRSGFARATLAPREGMAAEVPPTDPVQVLTMMDMGMAHDMSGMDMGGESGGSMKGMDHGSMSNADQSSSGAGNQGAMSGMDHGSMGGMAGMSHGGMNHGAGDGEGGMVEVKHPYPAENSPATTMPPDVVSTRLDDPGVGLRGNGRKVLTYADLHSMVEPPDNRPPTREIELHLTGNMERYMWSFNGLKFTEAKPIVLKFGERVRFVLVNDTMMTHPIHLHGMWSDLESPEGNFQVRKHTISLNPAQRVSYRVSADARGNWAYHCHLLYHMEAGMFRAVVVE

SEQ ID NO: 20522 - protein, 240 aa, Brassica napus
MCTLEKRGNLFLLTLTGDNEHRFNPDAIATILSLLAQAKSQAKRGSVLITTGHGKFFSNGFDLAWAQASGSLTGAAERLHQMVESFKPVVAALLDLPMPTIAALNGHAAAAGLMLALSHDYIFMRKDRGVLYMSEVDIGLSMPDYFAAMVRSKIGTSAARREVLLSGKKIRGEEAVALGIVDSAAHDSAEGVVEATVGLAEKLAAKKWNGDVYASIRKSLYPELCEILGLKATIFATPKL

SEQ ID NO: 20523 - protein, 183 aa, Salmonella enterica subsp. enterica serovar Typhi str. CT18
MTATAQQLEFLKNSIKSIQDYPKPGILFRDVTSLLEDPKAYALSIELLVERYKNAGITKVVGTEARGFLFGAPVALGLGVGFVPVRKPRKLPRETIAETYELEYGTDQLEIHVDAIKPGDNVLVVDDLLATGGTIEATVKLIRRLGGKVTDAAFIINLFDLGGEQRLEKQGITCYSLMPFPGH

SEQ ID NO: 20524 - protein, 642 aa, Salmonella enterica subsp. enterica serovar Typhi str. CT18
MSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPAHVKFLLATTDPQKLPVTILSRCLQFHLKALDVEQIRHQLEHILNEEHIAHEPRALQLLSRAADGSLRDALSLTDQAIASGDGQVSTQAVSAMLGTLDDDQALSLVEAVVDANGERVMSLINEAAARGIEWEALLVEMLSLLHRIAMVQLSPAALGSDMAAIEQRMRELARTVPPGDLQLYYQTLLIGRKELPWAPDRRMGVEMTLLRALAFHPRMPLPEPETPRQSFAPVAPTAVMTPPQVQQPSAPAPQTSPAPLPASTSQVLAARNQLQRAQGVTKTKKSEPAAASRARPVNNSALERLASVSERVQARPAPSALETTPVKKEAYRWKATTPVVQTKEVVATPKALKKALEHEKTPELAAKLAAEAIERDPWAAQVSQLSLPKLVEQVALNAWKEQNGNAVCLHLRSTQRHLNSSGAQQKLAQALSDLTGTTVELTIVEDDNPAVRTPLEWRQAIYEEKLAQARESIIADNNIQTLRRFFDAELDEESIRPI

SEQ ID NO: 20525 - protein, 465 aa, Crocosphaera watsonii WH 8501
MGSITAVAFSEDNQFIATGSHIGIVRIWGAISGQEWRCLEDHQTAVESLSFSPDSKLLASGGRDKKIRLWDVTSGKFQQILEGHQDWVTALIFDKNADHLASASAINDKDICIWSLAQRQKPQKLKGDSNSIQAIAFCPDERYLISAASDNTIRLWDRETGEEIKQMQQHSNWVYSLACSKDGRWVAIAYSDGIIHLWDIIKQREINCLEGHESVISSLAFCPDNQHLVSGSWDGTVRVWDIHTRKCKRILQGHQNWVSSVAVSPNGEWVASGSWDKTVCLWEITNSWPNFKGSKPTRILQGHLEDIEGVAFSPDNQLIASCSNDKTIKIWEVASGQQVQQLEGHKYSVEDIVFSPDGQFIASVSRDKTVRVWHIISGKEIHRFQGHTNYVNCVAFSLEGRYLASGGKDKMIAIWDLVSGELTQLIQGHTNYINSLAFTGDGSFLVSGDNDGVVRLWKLELGKLE

SEQ ID NO: 20526 - protein, 311 aa, Populus trichocarpa
MATSRPPPPVPLDLDLTIISAKHLKNVNWKTGDLKPYAVFWVDPSRRLSTKSDESGSTRPVWNERFTLPLTFALRDSFLTLEIFHSKPSETPKPLVGTLRVALKDLSDPDDSNRVRTLELTRPSGRPQGKIRIKLGVRERPFSPHPPPQPVYGITAPQSYYYSGAAVPPPPDYRRLSMALPASLSPPPPPAPHYGPYHDAYPPPYYPGYHSSAPPPPTQPRPFLDRTMGSYGSGPSAPVDYGSYDTQRERHKGGKSMGFGTGLAVGAVAGALGGLALEEGLKHEDEKIAEKVENDLATRDDYSDYRADYGC

SEQ ID NO: 20527 - protein, 752 aa, Sulfitobacter sp. EE-36
MTKNRITSEEALAFHLEPTPGKFEITATVPMTTQRDLSLAYSPGVAVPCEAIAENPELAYDYTNKGNMVAVISNGTAVLGLGNLGALASKPVMEGKSVLFKRFADVNSIDVELDTEDPEAFINAVKLMGPTFGGINLEDIKAPECFIIEQRLKEEMDIPVFHDDQHGTAVICAAGLLNALRISGKKIEDVQIVLNGAGAAGIACLELLKAMGAKHNNCIMCDTKGVIYQGRTEGMNQWKSAHAAQTELRTLEEAMKNADVFLGVSVKGAVTPAMVASMADNPVIFAMANPDPEITPEEAHEVRPDAIVATGRSDYPNQVNNVLGFPYLFRGALDIHARAINDEMKIACAHALADLAREDVPDEVALAYGKNLSFGRDYIIPTPFDPRLIHRIPPAVARAGMDTGAARRPIIDMDAYELSLKSRMDPTANILRGINARARANQARMIFAEGDDPKVLRAAVMYQRSGLGKALVVGRADDVKAKLTAAGMEDAYRELEVVNAANTQHLETYKSFLYNRLQRKGSDSKDIHRLAARDRHVFAALMLAHGHGDGLVTGATRKSAHVLERLNHVFDANAKHGAVGITALLHKGRIVFIGDTLVHEWPNEEDLANIAEKGAKVARHMGLEPRVAFVSFSTFGYPVSERAEKMQRAPDVLDARGVDFEYEGEMTVDVALNAESQKNYPFSRLTGPANILVVPARHSASISVKLMQEMAGATVIGPILTGLDKSIQICSTTSTANDILNMAILAACKVGE

SEQ ID NO: 20528 - protein, 292 aa, Sulfitobacter sp. EE-36
MIWNLGSINADNFYYLRHLPAPGETIAAHDFRQGLGGKGANMSVAAARAGTRVMHIGAVGPDGKWTVDRLLEYGVETQHISMIDTATGHANICVAEDGENSIVLFSGANHQITTQMIGAALAEASPGDFLLMQNETLGQRFAAQTAHTLGLRVAYAAAPFDAEIVAQVLPDIDLLVLNEVEAEALEKTTGARIDALPIDDIIVTLGAEGCKWVSNKAKTVQSFPAYPVKAIDTTGAGDTFTGYLIAALDRKLSMPDAIALAMQAGALMVTRQGTADVIPDLKDIQDHGFDED

SEQ ID NO: 20529 - protein, 560 aa, Bacillus cereus ATCC 14579
MKFSSKQRKDVLNGVNKQELDVIVIGGGITGSGIALDGATRGLSTIVFEMQDFAAGTSSRSTKLVHGGLRYLKQLEVKMVAEVGKERAIVYENGPHVTTPEWMLLPFHTGGTFGSFSTSIGLRVYDFLAGVKRSERRKMFNREETLNKEPLVKKEGLKGGGYYVEYRTDDARLTIEVMKEAIEHGAKAVNYAKVDSFLYKDGKVCGVRVIDLLDGEVYEVYGKKIVNAAGPWVDTLREKDNSKKGKVLQLSKGVHLVIDQKRFPLGQAIYFDTPDKRMVFAIPRGGKTYVGTTDTFYDKDAAVPQMTTEDRTYIINAINYMFPSVKITEKDIESSWAGVRPLIYEEGKSASEISRKDEIWTSESGLITIAGGKLTGYRKMAEMVVDYVTNLLQKEGHSAYPKSDTKHMPISGGHVDGSHGFPAFVAKKAGEGTKYGLTTAQAEEFAKFYGSNVDVLFDLAKKHKEEAKEYNMPLDVLIPLVYAMDYEMTAKPVDFFVRRRGAVFFNIHWVYEWKEAVINYMAAKLGWSKEEQMKYTAELEKALTDAVIPVDQQEQAAALA

SEQ ID NO: 20530 - protein, 189 aa, Populus trichocarpa
MEELQNNKKRVRDDSFELELDLPEVKKIREDLLGIIDDSDPDSLGQDLDSVMKSFEQEISAYSSSPVPVVDLTSESGESRPDLGYLLEASDDELGLPPSMNSSRGEVKGEEETELVRVDSAESSGIGGEIWGFEDQIPTYDSFGLGAGDVDYNSRYVAFDDGLFEYSNACFDSTEFVDLSWRFGGMPAE

SEQ ID NO: 20531 - protein, 386 aa, Chlamydophila abortus S26/3
MHLHEYQAKDLLTSYAIPMPPYRVASSVEEGRHTLNELGINAGVVKVQVHAGGRGKNGGVIVAKSPEEILAAVDQLLHMRFVSNQTSGEALPVEKVLITPLVNIAAEYYLAVIMDRKNRCPTIMLSKAGGVDIEEVAQKYPDQQLTISLTPFARLYNYQLRQMIKFMGWEGDTGKQGVQMIKNLVQCFYDNDASLLEINPLVRTQEGDLLVLDAKVTIDDNALYRHPKLEVLYDPSQENVRDVLAKQIGLSYIALDGNIGCLVNGAGLAMSTLDILKIHGGSAANFLDVGGSATEQQIQEAVSLVLSDENVEVLFINIFGGIMDCSAVASGLVAVMQTRENLIPTVVRLEGTNVELGKEIVQCSGIPCKFTDSLNTGAQLAVALSK

SEQ ID NO: 20532 - protein, 270 aa, Physcomitrella patens subsp. patens
MASLSSSSSSLAERWKLYGKTALVTGGTRGLGRAIVEELAGLGVSVYTCARSKEGLDTSLNSWRQAGFTVEGSVCDLSLRDAREELFRNVRAHFGGSLDILVNNVGTNIRKSTVDFTPEDFSFVMSTNLESAYHCSQLGHPLLKASGNGCLVFISSVAGVVAVRSGTLYAATKGAINQITKNFACEWAKDGIRVNSVAPWYINTDLAQQVLANPDFKAEVVGRTPLRRVGEPYEVAGLVAFLCMPTAGFITGQTISIDGGFTINGFYPTD

SEQ ID NO: 20533 - protein, 353 aa, Saccharomyces cerevisiae
MPKRIVYNISSDFQLKSLLGEGAYGVVCSATHKPTGEIVAIKKIEPFDKPLFALRTLREIKILKHFKHENIITIFNIQRPDSFENFNEVYIIQELMQTDLHRVISTQMLSDDHIQYFIYQTLRAVKVLHGSNVIHRDLKPSNLLINSNCDLKVCDFGLARIIDESAADNSEPTGQQSGMVEFVATRWYRAPEVMLTSAKYSRAMDVWSCGCILAELFLRRPIFPGRDYRHQLLLIFGIIGTPHSDNDLRCIESPRAREYIKSLPMYPAAPLEKMFPRVNPKGIDLLQRMLVFDPAKRITAKEALEHPYLQTYHDPNDEPEGEPIPPSFFEFDHYKEALTTKDLKKLIWNEIFS

SEQ ID NO: 20534 - protein, 400 aa, Anabaena variabilis ATCC 29413
MSKKTVASLSAADISGKRALVRVDFNVPLDDQGNITDDTRIRAALPTIQDLTQKGAKVILASHFGRPKGVDEKLRLTPVAKRLSELLGQEVVKTDDSIGDEVAAKVAALQNGQVLLLENVRFYKEEEKNDPEFAKKLAANADFYVNDAFGTAHRAHASTEGVTKFLSPSVAGYLVEKELQYLQSAIENPQRPLAAIIGGSKVSSKIGVIETLLEKCDKLIIGGGMIFTFYKARGLNVGKSLVEEDKLELAKSLEAKAKERGVSLLLPTDVVLADNFAPDANSQTVSIDNIPDGWMGLDIGPDSVKVFQEALADTKTVIWNGPMGVFEFDKFAAGTEAIAHTLAEIGKTGTTTIIGGGDSVAAVEKVGLADQMSHISTGGGASLELLEGKVLPGIAALDEA

SEQ ID NO: 20535 - protein, 465 aa, Canavalia lineata
MASSVLSGANQSSPSSTVLNTHLKGKPRLGDNALRFSGNKGGSNAFSSRSRGRISMAVADNVSRFEGIPMAPPDPILGVSEAFKADNSDVKLNLGVGAYRTEELQPYVLNVVKKAENLMLERGQNKEYLPIEGLAAFNKATAELLLGADNPAIKQQRVATVQGLSGLVSLRLGAALIERYFPGAKVLISSPTWGNHKNIFNDARVPWSEYRYYDPKTVGLDFEGMIEDIKSAPEGTFVLLHGCAHNPTGIDPTPEQWEKIADVIEEKNHRPFFDVAYQGFASGSLDEDAASVRLLVARGIELFIAQSYSKNLGLYAQRIGAINVISSSPESAARLTSQLKRIARPMYSNPPVHGARIVADLVGNPLLFEEWKAFMEMMAGRIKNVRQLLYDSISSKDKSGKDWSFILKQIGMFSFTGLNKEQSDNMTNKWHVYMTKDGRISLAGLSLAKCEYLADAIIDSYHNVS

SEQ ID NO: 20536 - protein, 179 aa, Triticum aestivum
  misc_feature (58)..(58): Xaa can be any naturally occurring amino acid
  misc_feature (77)..(77): Xaa can be any naturally occurring amino acid
  misc_feature (90)..(90): Xaa can be any naturally occurring amino acid
  misc_feature (101)..(101): Xaa can be any naturally occurring amino acid
  misc_feature (125)..(125): Xaa can be any naturally occurring amino acid
  misc_feature (144)..(144): Xaa can be any naturally occurring amino acid
  misc_feature (147)..(147): Xaa can be any naturally occurring amino acid
  misc_feature (155)..(155): Xaa can be any naturally occurring amino acid
  misc_feature (166)..(166): Xaa can be any naturally occurring amino acid
  misc_feature (168)..(169): Xaa can be any naturally occurring amino acid
  misc_feature (174)..(175): Xaa can be any naturally occurring amino acid
  misc_feature (177)..(177): Xaa can be any naturally occurring amino acid
MAPTVMASSATSVAPFQGLKSTAGLPVSRRSNGASLGSVSNGGRIRCMQVWPIEGIKXFETLSYLPPLNTGGLLKQXDYLIRSKWVPCLXEFNKVGFIFRXEHNASPGYYDGRLLGQCWKLPMFXGCTDATQVINEVEEVKEGXPDXYSASSGFXNMRQVQCVSSXAXXPRGCXXSXKG

SEQ ID NO: 20537 - protein, 181 aa, Helicobacter pylori
LVTKLAPDFKAPAVLGNNEVDEHFELSKNLGKNGVILFFWPKDFTFVCPTEIIAFDKRVKDFQEKGFNVIGVSIDSEQVHFAWKNTPVEKGGIGQVSFPMVADITKSISRDYDVLFEEAIALRGAFLIDKNMKVRHAVINDLPLGRNADEMLRMVDALLHFEEHGEVCPAGWRKGDKGMKA

SEQ ID NO: 20538 - protein, 472 aa, Hordeum vulgare
  misc_feature (118)..(118): Xaa can be any naturally occurring amino acid
MDVPLASKVPLPSPSKHEQCNVYSHKSSSKHADLNPHAIDSVLGIILGGGAGTRLYPLTKKRAKPAVPLGANYRLIDIPVSNCLNSNISKIYVLTQFNSASLNRHLSRAYGSNIGGYXNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLEDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 20539 - protein, 315 aa, Thermotoga maritima MSB8
MNVLCTGEILIDFISEDKGKNLSQSELFRKKAGGSPLNVAVALKRLGREVSFLGKLGGDQFSEFLLEVMKKEGIDTTHIIFDSSCKTTLAFVARDAQGNPDFVFFREKPADTNLRPEEVNIDPAQFSFLHIGSYSLAVEPSRSAYLKVMETFLEEGKPVSYDPNVRPSLIEDRNTFVKDFLEISSKVDIVKLSDKDLEYIFQEDLETAVDKIPIKENGLLFVTMGERGCLVKFKGEKRMVPSFKVKPVDATGCGDSFTAAVIHKYLEKTPETIEDAVEIGKFANAVAAIVITRVGGVDAMPVLDEVEMFLSNQER

SEQ ID NO: 20540 - protein, 181 aa, Helicobacter pylori
LVTKLAPDFKAPAVLGNNEVDEHFELSKNLGKNGAILFFWPKDFTFVCPTEIIAFDKRVKDFHEKGFNVIGVSIDSEQVHFAWKNTPVEKGGIGQVSFPMVADITKSISRDYDVLFEEAIALRGAFLIDKNMKVRHAVINDLPLGRNADEMLRMVDALLHFEEHGEVCPAGWRKGDKGMKA

SEQ ID NO: 20541 - protein, 513 aa, Hordeum vulgare
  misc_feature (159)..(159): Xaa can be any naturally occurring amino acid
MAMAAAASPSKILIPPHRASAVTAAASTSCDSLRLLCAPRGRPGPRGLVARPVPRRPFFFSPRAVSDSKSSQTCLDPDASTSVLGIILGGGAGTRLYPLTKKRAKPAVPLGANYRLIDIPVSNCLNSNISKIYVLTQFNSASLNRHLSRAYGSNIGGYXNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLEDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 20542 - protein, 181 aa, Helicobacter pylori
LVTKLAPDFKAPAVLGNNEVDEHFELSKNLGKNGVILFFWPKDFTFVCPTEIIAFDKRVKDFHEKGFNVIGVSIDSEQVHFAWKNTPVEKGGIGQVTFPMVADITKSISRDYDVLFEEAIALRGAFLIDKNMKVRHAVINDLPLGRNADEMLRMVDALLHFEEHGEVCPAGWRKGDKGMKA

SEQ ID NO: 20543 - protein, 181 aa, Helicobacter pylori
LVTKLAPDFKAPAVLGNNEVDEHFELSKNLGKSGAILFFWPKDFTFVCPTEIIAFDKRVKDFQEKGFNVIGVSIDSEQVHFAWKNTPVEKGGIGQVTFPMVADITKSISRDYDVLFEEAIALRGAFLIDKNMKVRHAVINDLPLGRNADEMLRMVDALLHFEEHGEVCPAGWRKGDKGMKA

SEQ ID NO: 20544 - protein, 330 aa, Kluyveromyces marxianus
VRIAINGFGRIGRLVLRIALSRKNIEVVAINDPFITVDYAAYMFKYDSTHGRFDGEVSHDGKSLIIDGKKVLVFQERDPATLPWGAEKIDIAIDSTGIFKELDSAQKHIDAGAKKVVITAPSSTAPMFVVGVNEDKYAGQTIVSNASCTTNCLAPLAKIINNAFGIEEGLMTTVHSITATQKTVDGPSHKDWRGGRTASGNIIPSSTGAAKAVGKVLPELQGKLTGMAFRVPTVDVSVVDLTVKLAKPATYEEIKAVVKKASENELKGVMGYTEDAVVSSDFLGDTHSSIFDAAAGIQLSPQFVKLVSWYDNEFGYSTRVVDLVELVAKN

SEQ ID NO: 20545 - protein, 123 aa, Zea mays
MVPPLPSRLLYFSVSGLTLMLGSVARKIPDELVEHYLGRSGFHCPDLRLTRLVAVATQKFLSDIASDSLQDRGGGGHLGQEPELLPSLLDPTPVAGTELAPVSCDTVNLEGDGSGGQFESTDK

SEQ ID NO: 20546 - protein, 181 aa, Helicobacter pylori
LVTKLAPDFKAPAVLGNNEVDEHFELSKNLGKNGAILFFWPKDFTFVCPTEIIAFDKRVKDFQEKGFNVIGVSIDSEQVHFAWKNTPVEKGGIGQVTFPMVADITKSISRDYDVLFEEAIALRGAFLIDKNMKVRHAVINDLPLGRNADEMLRMVDALLHFEEHGEVCPAGWRKGDKGMKA

SEQ ID NO: 20547 - protein, 196 aa, Monacrosporium haptotylum
MADHDEDLTATATEGYKVGEKKSLAEYQKLDANDESLNKWKASLGLGDGAAASSDPAKVTIKKLSLLVDGREPLEIDLTKPNALETLGTHPFIVKEGTEYQIEITFVVENQIITGLRYVQVVKRKGIKVDRSEEMMGSYGPNTATNPTYSKKLPLETAPSGMLLRGTYDAASAFIDDDKHNHLSFNWAIKIAKDWS

SEQ ID NO: 20548 - protein, 812 aa, Pseudomonas veronii
MSRLQPHILWFKTLGLNDVAQVGGKNASLGEMYQKLTGEGIRVPNGFAVTSDAYRYVLEHNNAWAPLHAALDGLDPDDIKDLQARGKRARAVVYGCTLPDDLKAAILQGYAELQHEYGNSLSLAVRSSATAEDSPQASFAGQNETYLNIAGEEALLDAYKRCLASNFTDRSIHYKFDNGFDCFKVDLAVVVMKMVRSDLGASGVMFSLDTETGFKDVVFINATWGLGENVVQGTVAPDSFYVHKPSFVAGYRAVLKRSLGSKEKKMVFTDTLNTGNIAQEYTANIDTPSEEQTRFCLSDADVMVLADYAIKVENHYSSNAGAYKPMDMEWAKDGIDGQLYMVQARPETVASQKKGNVLQIYHLKQRSPVLLRGKAVGTRIGAGIARVVNDVKQLSAFQPGEVLVSEATTPDWEPVMKTAAAIVTNRGGRTCHAAIVARELGIPAIVGAANAAALIKTGTSLTVSCAEGENGTVYEGILEFEVEETDLSQLGHPDTHIMMNLANPDRAFSLASLPVDGIGLARMEFIINECIKIHPMALVHPEKLDDATRQQIAVLSAAYKDPTDFFIKTLAEGVATIAAAVYPKPCVVRMSDFKSNEYATLLGGQYFEPAEHNPMIGFRGASRYSHPAYAEGFALECAAMKWAREHIGLTNIKLMIPFCRTVAEGERVLATMASHGLQRGENGLEVYIMCEIPNNVIQIDAFAKLFDGFSIGSNDLTQLTLGVDRDSDIVAFDFDERDPGVKQMIRLAVEGAKRNGRHSGICGQAPSDYPEMAEYLVSIGIDSMSLSPDAVLATIRHVLAVQKSLLSSDGRS

SEQ ID NO: 20549 - protein, 518 aa, Staphylococcus epidermidis ATCC 12228
MAKGDQYQAHTEKYHDKKSKKSYKPVWIIISFIILITILLLPTPAGLPVMAKAALAILAFAVVMWVTEAVTYPVSATLILGLMILLLGLSPVQDLSEKLGNPKSGDIILKGSDILGTNNALSHAFSGFSTSAVALVAAALFLAVAMQETNLHKRLALLVLSIVGNKTRNIVIGAILVSIVLAFFVPSATARAGAVVPILLGMIAAFNVSKDSRLASLLIITAVQAVSIWNIGIKTAAAQNIVAINFINQNLGHDVSWGEWFLYAAPWSIIMSIALYFIMIKFMPPEHDAIEGGKELIKKELNKLGPVSHREWRLIVISVLLLFFWSTEKVLHPIDSASITLVALGIILMPKIGVITWKGVEKKIPWGTIIVFGVGISLGNVLLKTGAAQWLSDQTFGLMGLKHLPIIATIALITLFNILIHLGFASATSLASALIPVFISLTSTLNLGDHAIGFVLIQQFVISFGFLLPVSAPQNMLAYGTGTFTVKDFLKTGIPLTIVGYILVIVFSLTYWKWLGLV

SEQ ID NO: 20550 - protein, 678 aa, Emericella nidulans
MSTEDNHDSQILTARHRSDASEQSFKSLFGGPSSEDGKETEPDTHDHNHSFSNAKAPAKFANQNVAPFLARHIPEQYAPLGAQSILPADLSSANSKYCYRHRPDQKCRRQADEPSMDKLQRELESLPQGDQQSISHVWSLFSAAPAKHRKLILQGIMAQCCFPQLSYISATVRDLIRIDFITALPPEIAFKILCYLDTTSLCKASQVSRGWRALADDDVVWHRMCEQHIHRKCKKCGWGLPLLDRKRLRESKREIELRATTWDKGVVGPRSPDASAESPPSGKRKLEDDEVAVVKRHCSSLGSDAGVDKDSDFFKTRYRPWKEVYKDRFKVGTNWKYGRCSIKTFKGHTNGVMCLQFEDNILATGSYDTTIKIWDTETGEELRTLRGHESGIRCLQFDDTKLISGSMDRTIKVWNWRTGECISTYTGHRGGVIGLHFDASILASGSVDKTVKIWNFEDKSTFSLRGHTDWVNAVRVDTSSRTVFSASDDCTVRLWDLDTKTCIRTFHGHVGQVQQVVPLPREFEFEEHDAECENDDLSTTSGDANPPSIQASMGLEPNAAYSQSSAFGTSFDNGRAAPPRYMVTSALDSTIRLWETTTGRCLRTFFGHLEGVWALGADTLRIVSGAEDRMIKIWDPRTGKCERTFTGHSGPVTCIGLGDSRFATGSEDCEVRMYSFQS

SEQ ID NO: 20551 - protein, 586 aa, Zea mays
MSGGASLGLRSSGSYGSLPHQQLGGCQSSSPPLAARKPAKMSLGGTSGPRVCARICKLAGRRQRMLLLLLVSVAVAFCFLFSSLVSKDEDASPGVETMLVFSDHVRSFVNPVWTSSGRPVAQRGSLTVNGLNTPSQMEKQSDSKQVQELMQSFPPAIVVDHHPCENFSLSPPPVDRKRTGPRPCPVCYLPVEQALALRPAKPSLSPVLQSLNYVLEEILIPKESKSGSLFGGFPSLEERDKSYDIKDSMTVHCGFVRGKVPGLNTGFDIDEADHSEMQLCQSTVVASAIFGNYDVMQQPENISKFSKDTVCFFMFLDEETEAAIKNTTIGHTKKIGLWRVVVVRNLPFTDARRNGKVPKLLLHRLFPNARYSIWIDGKLKLVRDPYQVLERFLWRKNVSFAISRHYRRFDVFEEAEANKAGGKYDNTSIDYQIEFYKREGLTHYSSAKLPITSDVPEGCVIIREHIPITNLFTCLWFNEVDRFTSRDQLSFSTVRDKIRWRVNWTADMFLDCERRDFVVQSYHRELLEQRQSALRRWPPQRSPVARFQPRKMLPDNAAREPWKASATKKLSRKRARDKKSSSRRTH

SEQ ID NO: 20552 - protein, 159 aa, Zea mays
MATSDKKTRGYVPWNDEMDKVLLDTFVDYYNKGDRCQNGWKSHVYTVAVKNVCEKCNVTITKENISSRSKTFDKHYNIINGLLSTSGFGWDWEKNKLKVDSDTVWDEYVERNKEAKGYRHKVVKFWDLLSLVYSKDQANGEGAKTAAESSKEMAKEYDT

SEQ ID NO: 20553 - protein, 472 aa, Pseudomonas putida GB-1
MPVGNHSAHGQATEGGPLKRELGERHIRLMALGACIGVGLFLGSAKAIEMAGPAIMFSYIIGGLAILVIMRALGEMAVHNPVAGSFSRYAQDYLGPLAGFLTGWNYWFLWLVTCVAEITAVAIYMGIWFPDVPRWIWALAALGSMGAVNLVAVKAFGEFEFWFALIKIVTIIAMVIGGIGVIAFGFGNDGVAVGISNLWSNGGFMPNGVTGVLMSLQMVMFAYLGVEMIGLTAGEARNPQKTIPQAIGSVFWRILLFYVGALFVILSIYPWNEIGSQGSPFVMTFERLGIKTAAGIINFVVITAALSSCNGGIFSTGRMLYSLAQNGQAPAAFARTSKNGVPRNALLLSIGALLLGVLANYLVPEKVFVWVTSIATFGAIWTWVMILLAQLKFRAGLTTAERKALKYRMWLWPLSSYLALAFLVLVVGLMAYFEDTRVALYIGPAFLVLLTVLYYAFRLAPKEVQGVASTAS

SEQ ID NO: 20554 - protein, 511 aa, Arabidopsis thaliana; identical to SEQ ID NO: 1062

SEQ ID NO: 20555 - protein, 436 aa, Sulfitobacter sp. EE-36
MSKIEGCVDRVTWESYRQVFNGKVDEMTDMFKTAARSAAQQMREVFPATPLMRNEHLSEKYDADIWLKREDLSPVRSYKLRGAFNAMRKVIPEKSVFVCASAGNHAQGVAFMCSHFGVKGVIFMPVTTPQQKIQKTKMFGGRQVEVRLIGDYFDKTLAAAQQYCVEEGAHFLSPFDDEDVIEGQASVAVEIEEQLGRVPDHILLPVGGGGLSSGVYSYFQNACRYSFVEPEGAPSLAKALVAGAPVDVSPINSFVDGAAVAKIGQRNFARLDRVAESDVIHLAEDRICVTIIEMLNVEGIVLEPAGALSIEALGEVADQIKGKTVVCVASGGNFDFERLPEVKERAQRYSGVKKYFILRMPQRPGALKEFLSILGPDDDICRFEYLKKSARNFGSVLIGIETRSPDSFGPFLAQLKDAGFTYTDITNDETLAQFVL

SEQ ID NO: 20556 - protein, 770 aa, Sinorhizobium meliloti 1021
MNTGDKAKSQAVPASGDIDQQALFFHRYPRPGKLEIQPTKPLGNQRDLALAYSPGVAAPCLAIKDNPETAADFTARANLVAVVSNGTAVLGLGNIGPLASKPVMEGKAVLFKKFAGIDVFDIEIDAPTVDRMVDVISALEPTFGGINLEDIKAPECFEVERRLREKMEIPVFHDDQHGTAIIVAAAVLNGLELAGKDIAEAKIVASGAGAAALACLNLLVTLGARRENIWVHDIEGLVYKGREALMDEWKAVYAQESDNRVLADSIGGADVFLGLSAAGVLKPELLARMAEKPLIMALANPTPEIMPEVARAARPDAMICTGRSDFPNQVNNVLCFPHIFRGALDCGARTINEEMKMAAVRAIAGLAREEPSDVAARAYSGETPVFGPDYLIPSPFDQRLILRIAPAVAKAAAESGVATRPIQDFDAYLDKLNRFVFRSGFIMKPVFAAAKNAAKNRVIFAEGEDERVLRAAQVLLEEGTAKPILIGRPQIIETRLRRYGLRIRPDVDFEVVNPEGDPRYRDYVDDYFALVGRLGVIPEAARTIVRTNTTVIGALAVKRGEADALICGVEGRYSRHLRDVSQIIGKRSGVLDFSALSLLISQRGATFFTDTYVSFSPSAEEIAQTTVMAANEIRRFGITPRAALVSHSNFGSRDSESAFKMRTALQLVRELAPDLEVDGEMHGDSAISEVLRQRVMPDSTLNGEANLLVFPNLDAANITLGVVKTMTDSLHVGPILLGSALPAHILSPSVTSRGVVNMAALAVVESSHPV

SEQ ID NO: 20557 - protein, 385 aa, Oryza sativa
MRTTTTATVLLAAAVALLLATAARGDGGDGGCGKEDAAAGRDQARARGLKIAAFFSILVCGALGCGLPSLGRHVPALRPDGDVFFLVKAFAAGVILATGFIHILPDAFDNLTDDCLPAGGPWKEFPFAGFGAMVGAIGTLVVDTLATGYFTRAQSKKDAAAAVADEEKQSAAATTQQHNHHYVVGDGGGGEEHEGQVHVHTHATHGHAHGSSALVAAVGEDDKETTLRHRVISQVLELGIVVHSVIIGISLGASQNPETIKPLVVALSFHQMFEGMGLGGCIVQAKFKVRSIVTMVLFFCLTTPVGIAVGVGISSVYNESSPTALVVEGILNSVAAGILIYMALVDLLAEDFMNPRVQSKGKLQLGINLAMLAGAGLMSMLAKWA

SEQ ID NO: 20558 - protein, 540 aa, Prochlorococcus marinus str. MIT 9215
MSNISSKNIKRLSAPQSPVVLAILDGWGYREEKSDNAIKNANTPIMDSLWHAYPHTLISASGSDVGLPDGQMGNSEVGHLTIGSGRIIQQELVRISNIVRNNQLGLVNELKEMADSLKKNNSTLHITGLCSDGGVHSHIDHLLGLIKWASDNEIKKVAIHIITDGRDTPAKSASKYLKQIESCIKKFNTGEIASICGRYWIMDRNLIWDRTEKAYSNLTDPDIQITNISPQDYIEKSYAKNITDEFIEPIRISENYLKDGDSLICFNFRPDRARQIVKSLSIHEFSDFERKNYPNLDFVTFTQYDPNFPVKVAFPPESLNNFIGQIVSENGLKQYRTAETEKYPHVTYFFNGGVEIPLPGEDRHLIPSPRVATYDMDPEMSAEELTISCSKAIKSGNYAFVVINFANPDMVGHTGNMNATIKAIEKVDKCVGQIVNATGEMGGSILITADHGNAEVMKGPEGEPWTAHTINKVPLILIEGEKRKIPNMGNEINLRDNAGLADIAPTLLQLLNLPIPREMTGKSLIQEIELKGYNKVVQHV

SEQ ID NO: 20559 - protein, 303 aa, Crocosphaera watsonii WH 8501
MSYDQFMSSENDYIQEADANRVRVLSEALPYIQQFAGRTFVIKYGGAAMKDSSLKDKVIRDIIFLACVGVHPVVVHGGGPEINSWLGKLGIEPQFKDGLRVTDAATMDVVEMVLVGRVNKELVSLINQAGGKGVGLCGKDGNLVKARRVDQEDIGFVGEVSKVDVKIVDALVNNNYIPVISSVAADETGQAHNINADTVAGEIAAALGAEKLILLTDTAGILENYQDPNTLLTKLDIKQARDLIAQGIVGGGMIPKVNCCVRSLAQGVRAAHIIDGRIPHSILLEIFTDRGIGSMIVASEYQS

SEQ ID NO: 20560 - protein, 97 aa, Glycine max
  misc_feature (80)..(80): Xaa can be any naturally occurring amino acid
  misc_feature (88)..(88): Xaa can be any naturally occurring amino acid
RLSLGKASLWSQYFHYTEIVEQIDRDLQRTHPDLPFFPGESSISCKKREAMKNIILLFAKLNPEIRYVQGMNEVLAPMYXVFSTDPDXQNAVSMFPA

SEQ ID NO: 20561 - protein, 445 aa, Pseudomonas fluorescens PfO-1
MIESVESFLARLKKRDPDQPEFHQAVEEVLRSLWPFLEANPHYLTSGILERICEPERAVVFRVSWVDDQGRVQVNRGFRIQMNSAIGPYKGGLRFHPSVNLGVLKFLAFEQTFKNSLTSLPMGGGKGGSDFDPKGKSDAEVMRFCQAFMSELYRHIGADVDVPAGDIGVGAREIGFLFGQYKRLSNQFTSVLTGKGMTYGGSLIRPEATGFGCVYFAEEMLKRREQTVEGKRVAISGSGNVAQYAARKVMDLGGKVISLSDSEGTLYCEAGLSEEQWLALLELKNVKRGRISELASAFGLEFRAGQLPWSLPCDIALPCATQNELDAESARTLLRNGCVCVAEGANMPTTLEAVDIFIEAGILFAPGKASNAGGVAVSGLEMSQNAMRLLWTGGEVDSKLHGIMQSIHHACVHYGEENGRINYVKGANIAGFVKVADAMLAQGVV

SEQ ID NO: 20562 - protein, 159 aa, Microcystis aeruginosa PCC 7806
MNIRIGNGYDIHRLVTGRPLILGGVEIAHTVGLLGHSDADVLTHAIMDAMLGALSLGDIGHYFPPTDPQWQGANSLKLLEQVNQLIVDKGWQINNIDSVIVAEKPKMKHHLIAMRTKLAETLNINLEQVGIKATTNEQLGPVGREEGIAVYAVVLLVKE

SEQ ID NO: 20563 - protein, 510 aa, Oryza sativa Japonica Group
MESMLVAGAGAAAVAAVGGLVAAAALADKLVAAPPPRKNRANPPPAVPGLPIIGNLHQLKEKKPHQTFAKWSETYGPIYTIKTGASPVVVLNSTEVAKEAMIDKFSSISTRKLPKAMSVLTRKSMVAISDYGDYQKMAKRNIMIGMLGFNAQKQFRGTRERMISNVLSTLHKLVSLDPHSPLNFRDVYINELFSLSLIQSLGEDVSSVYVEEFGREISKDEIFDVLVHEMMMCAVEADWRDYFPYLSWLPNKSFDTIVSTTEFRRDAIMNALIKKQKERIARGEARASYIDFLLEAERSAQLTDDQLMLLLSESILAAADTVLVTTEWTMYEIAKNPDKQELLYQEIREACGGEAVTEDDLPRLPYLNAVFHETLRLHSPVPVLPPRFVHDDTTLAGYDIAAGTQMMINVYACHMDEKVWESPGEWSPERFLGEGFEVADRYKTMAFGAGRRTCAGSLQAMNIACVAVARLVQELEWRLREGDGDKEDTMQFTALKLDPLHVHLKPRGRM

SEQ ID NO: 20564 - protein, 376 aa, Vibrio vulnificus CMCP6
MTQDKFIKSRAAVAWGPKQPLSIEEVDVMLPRKGEVLVRIVATGVCHTDAFTLSGDDPEGVFPAILGHEGGGIVEMVGEGVTSVSVGDHVIPLYTAECGQCKFCLSGKTNLCQAVRETQGKGLMPDGTTRFYKDGKPIFHYMGCSTFSEYTVLPEISLAKVNKEAPLEEICLLGCGVTTGMGAVINTAKVKQGDTVAIFGLGGIGLSAIIGARMAGASRIIAVDINDRKFELAKQLGATDCINPKEHAQPIQEVIIEMTDGGVDFSFECIGNVNVMRQALECCHKGWGESVIIGVAGAGQEISTRPFQLVTGRVWRGSAFGGVKGRSQLPAIVEQYLAGEFGLQEFITHTMPLEGINDAFELMHSGESIRSVVHFE

SEQ ID NO: 20565 - protein, 431 aa, Trichodesmium erythraeum IMS101
MTSTLVPPTLSYLNTPTVRQLPNGLTIIAEHLAVEAVNLNIWLNVGSALESESINGMAHFLEHMVFKGTPKLPSGEFERLVEQKGGLMNAATSQDYTYFYITTAPKDFAKLAPLQWEILLNPSIADDAFEQERLVVLEEIRRSDDSPSRRCYQKVIETAFEKLPYRRPVLGPPEIISQLQTQQMRDFHQSLYKPSSMTATVVGNLPVEELIDIVTDSFTEANNGKSTSETLLPPNINFTPESPFTKIVRHEVVDEALQQPRLIMFWRVPGLTELYETYALDVLATILGGGKTSHLVRDLREERGLVYSIGISNVSHRYQGLFYVSARLPEENLAEVEAAIAHHIYTIQQESVTDAEMQRIRTLVAKRFIFANETPSDRASLYSYYQSMVGDLGSAINYPQNIQAFESSDIQQAALKYLSVDAYGVAVFRPK

SEQ ID NO: 20566 - protein, 263 aa, Triticum aestivum
  misc_feature (201)..(201): Xaa can be any naturally occurring amino acid
  misc_feature (230)..(230): Xaa can be any naturally occurring amino acid
  misc_feature (232)..(232): Xaa can be any naturally occurring amino acid
MESSSPSVPFPLLQAPVESTYRACTIPYRFPSDNPHKATPVEIQWIDLFLKSVPSFRQRAENDPTVPDAPAKAEKFAQRYTDMLEELKKNPESHGGPPDCILLCRLRELILRELGFHDIFKKVKDEENAKAMSLFEGVVQRNDEIEDGEKRAENLIRGILAGNIFDLGSAQLAEVFAKDGMSFLASCQNLLSRPWVIDDLXAFTRNGPPNLGKGSPVVDSPGADCLLGSXTXVRELSTRAPRVALPPLTFFSYQTTGPLLFKF

SEQ ID NO: 20567 - protein, 248 aa, Oryza sativa Japonica Group
MGFCTVQSPIDGIFVLTMASSDGHQYLTDEAIGDLIASLTAVRDTPGLRGLVTTSRLGSFCDGVDHDAARQPDEQVAARVGEVVRLLLEMPAPTAAAVNGDATSLGLALALAHDHCVVWEGAAVALPEARRRRPLPGYVAALLRDKVAYARLRKLLMLRAEACTGKELVGTWYSANDPAAADREVVAAEACELLEGIEVGSGKNYATARQAMWPESCAAVGMEITRPRRPSSPEQILHVRLTVQSFPS

SEQ ID NO: 20568 - protein, 181 aa, Helicobacter pylori
LVTKLAPDFKAPAVLGNNEVDEHFELSKNLGKNGAILFFWPKDFTFVCPTEIIAFDKRVKDFHEKGFNVIGVSIDSEQVHFAWKNTPVEKGGIGQVTFPMVADITKSISRDYDVLFEEAIALRGAFLIDKNMKVRHAVINDLPLGRNADEMLRMVDALLHFEEHGEVCPAGWRKGDKGMKA

SEQ ID NO: 20569 - protein, 504 aa, Oryza sativa Japonica Group
MESLLAAGAGGIGVAAAAVGGFIAAATLAVAPPKNRRNPPPAVPGLPIIGNLHQLKEKKPHQTFTKWAEIYGPIYTIRTGASSVVVLNSTEVAKEAMVAKFSSISTRKLSKALTVLSHDKSMVATSDSGDFHKMGKRYIMLSMLGTSAQKQFRDTRDMIINNMLSTFHQLVKDDPHAPLIFRDVFKDELFRLSMIQSLGEDVSSVYVDEFGRDISKEEIYNATVTDMMMCAIEVDWRDFFPYLSWVPNKSFETRVFTTESRRTAVMRALIKQQKERIVRGEARTCYLDFLLAENTLTDEQLMMLVWEALIEAADTTLVTTEWAMYELAKNPDKQERLYQEIREVCGDEAVTEEHLPWLPYLNAVFQETLRRHSPVPLIPPRFVNEDTMLAGYDVPAGTEMVINLYGCNMNKKEWESPEEWAPERFAGGRFKVADMYKTMAFGAGRRVCAGSLQATHIACAAIARFVQEFGWRLREGDEEKVDTVQLTAYKLHPLHVHLTPRGRM

SEQ ID NO: 20570 - protein, 164 aa, Oryza sativa
MASLADSFLADLDELSDNEAYPEEQNADALGTEEIGDDDMPDLQSLNYDELDSVSKLHKAQRDADIMQKVENALQRGTDFSNQGSILEEDPEYQLIVDCNALSVDIENEIVILHNFIRDKYRLKFPELKTLVLPPINYALVVQKIGNEMELTLGNREGFLPSGI

SEQ ID NO: 20571 - protein, 254 aa, Microcystis aeruginosa PCC 7806
MGNDTITLLSSREIEKMRRAGRLAAKLLDHLADMVKPGVSTLEINDEAERWTRAHGAKSAPLGYHGFPKSICTSINEVICHGIPSADQILKDGDIINIDVTPILEGYHGDTSQTFFVGTPSPLAKKLVEVTRECLQRGIDAVQPGGKIGDIGAAIQEYAEGQGFSVVRNFVGHGISNVFHTGPQVPHYGIRGKGKTIRPGMVFTIEPMINEGTWQHILLKDGWTAITKDGKLSAQFEHTIAVTETGVEILTLPD

SEQ ID NO: 20572 - protein, 328 aa, Ralstonia metallidurans CH34
MGLLVNGEWQDRWYDTTSTGGRFVRKNAAFRNWVTCDGAAGPTGIGGFRAEVGRYHLYVSLACPWAHRTLIMRELKGLEDMISFSVVHWLMREEGWTFADGPGVIPDSVSGARVLHQVYTLANPNYTGRVTVPVLWDRQQATIVSNESSEIIRMMNSAFDRLGARLGDYYPLDLRAQIDAINARIYDTVNNGVYKAGFATSQAAYEESVRSLFDTLDWLEAQLSQQRWLVGNRFTEADIRLFTTLIRFDAVYVGHFKCNLRRIVDYPALSAYLRDIYQRPGIAGTVDFLHIKGHYYESHRMLNPTGIVPLGPMLDLSSPHGRERLGQD

SEQ ID NO: 20573 - protein, 242 aa, Brassica napus
  misc_feature (225)..(225): Xaa can be any naturally occurring amino acid
MSSAAASPSLSLLKSTGGVASSAATRARATLLPITPKSKSISTRPLGFSAVLDSRFTVHVSSKVQSFRGKGTRGVVSMAKKSVGDLTSADLKGKKVFVRADLNVPLDDNQTITDDTRIRAAIPTIKYLIDNGAKVILSTHLGRPKGVTPKFSLAPLVPRLSELLGIEVKKADDCIGPEVESLVGSLPEGGVLLLENVRFYKEEEKNDPEFAKKLASLADLYVNDXFGTAHRAHASTEGVTKF

SEQ ID NO: 20574 - protein, 181 aa, Helicobacter pylori
LVTKLAPDFKAPAVLGNNEVDEHFELSKNLGKNGAILFFWPKDFTFVCPTEIIAFDKRVKDFHEKGFNVIGVSIDSEQVHFAWKNTPVEKGGIGQVSFPMVADITKSISRDYDVLFEEAIALRGAFLIDKNMKVRHTVINDLPLGRNADEMLRMVDALLHFEEHGEVCPAGWRKGDKGMKA

SEQ ID NO: 20575 - protein, 329 aa, Legionella pneumophila subsp. pneumophila str. Philadelphia 1
MNKKTIAMLGAGSWGTAVAIHLAKIGHKTLLWSHNPQHVALMAEQHSNPAYLPGIPFPENLIPSDNLIECVQSADYVIIAVPSHAFAEIINKIPKPTQGLAWLTKGVDPASHELLSQLVASRFGVDFPIAVISGPSFAKEVARFLPTALTLASNNTNYQKKMHQLFHHDNIRVYLSDDLIGVQLCGAVKNILAIACGISDGLGYGANAKAALITRGLAEMTRLGLSMGARQDTFLGLAGVGDLVLTCTDDQSRNRRFGLLLGREVPIPEAEHQIGQVVEGKHNAAQICAIANKNKVEMPICEQINALLHGIVHAQEAVNNLMSRPAKEE

SEQ ID NO: 20576 - protein, 311 aa, Methanosarcina barkeri str. Fusaro
MTGLGQKILLPSLQLTPQMIIGVLGPEGSYSEKAAQIWTLRHRLDNVKIQYFADIEDAFLAVIQGKSDLSIVPIENSIEGSVGITLDLLLENGVEIVGEIVVKIEHCLLSKGGPEKIKVVLSHPQGLAQCRHFLKKYFPEAELRSTGSTSHAARLAGEFEEMAAIASPEAAECYRLKVLLPNIQDRKENYTRFIALQAAGKISDEQVLCSTEDKTGKPENSSHSAFKTSIIVYLEKDRPGALYEILGAFAKNKINLTRIESRPSKKELGDYYFYIDFEGHTGDALIEKTLKDIENKIDTLKILGSYPAFKT

SEQ ID NO: 20577 - protein, 569 aa, Streptomyces avermitilis MA-4680
MSLLVVGLSHRSAPVSVLERATLTADAQVKLLQDTVAAEPATEAAVLATCNRIELYADVDKFHAGVAELSTLLAQHSGVGLEELTPYLYVHYEDRAVHHLFSVACGLDSMVVGEGQILGQIKDALATAQELHTAGRLLNDLFQQALRTGKRAHSETGIDRAGQSLVTFGLEQLSAGTAVEAWAKGKRALVIGAGSMSSLAAATLARAGVAEVVIANRTPDRAERLAQILTEGDDTDVLARAVPMDAVPAELTRADVAVSCTGATGLVLTAEAVAAAVEGRTGTPVAVREETPASAAGGLAPAGTDEGCPLDLSAVQGATGFSVMGEAAVAGMDAATLEQHAAWVDRGTVDRRDSRRTPEVEAELITALAATVAAGGRLPERRRPEPVVEAPRPAPALALLDLAMPRDIDAAVHRLLGVRLVDIESLAEASADAPMAADVDLVRRIVADEVAAFGAAQRAAHITPTVVALRTMAADVVANEIARLDGRLPGLDEKQRGEITQTVRRVVDKLLHAPTVRVKQLAAEPGGAGYADALRTLFDLDPETVAAVSRADDRDTSDSTENAKNRGRE

SEQ ID NO: 20578 - protein, 304 aa, Brucella melitensis 16M
MEKLPVDFTTLLNRRAMEVEAALAGLLDERPRTGEIARPQRLIAAMRHGVLNGGKRLRPFLVLESAALFGQYGQAVLRVAAALECIHCYSLVHDDLPAMDDDDLRRGQPTVHKAFDEAAAILAGDSLLTYAFDIIASDETELDATTRIKLVCALTRASGLGGMAGGQALDLMAETRKPDEAGIITLQAMKTGALIRFACEAGAIIAGASQEDRERMAEFGSAIGLAFQLADDLLDVTADAGTMGKATGKDAAAGKATLVSLHGIDWTRQQLSGLVAQAESLLAPFGEDAEPLKQAARFIAERQN

SEQ ID NO: 20579 - protein, 496 aa, Silicibacter sp. TM1040
MPRARKSCPIATDTNEAEMRNYPDLKLFIGGTWRDTPETLSVVNPATEEELGRLPCARISDLEDALAAAQKGLEIWRNTPPRSRADLILRAARLLRDRQEEIAQSITAEHGKPLAQARLEVIRGAEFFEWDAAEAMRTYGRVIPSAAGTKISVHHHPIGVVAAFSPWNFPMSQPARKIAGALASGCSLILKAAEETPAGAIHIVRAFQDAGLPDGVLNLVFGRPAEISAYLIPQPCVRLVALTGSTAVGRQLTALAAQSDTRVLMELGGHAPVIVCEDTDVQKAALSGAIRKMRNAGQVCTSPTRFFVHQDIFDEFATTFTQRAAATRVGNGMHDGIEMGPTANARRIPVLTDLVNDALAQGATLCTGGTRVGERGYFFAPTVLTHVPDSARIMREEPFGPIAVLNTVRNLDEAIAQANAVDYGLAGYAFTNRADYIARMIDEVEVGNFSINTLEASLPETPFGGVKSSGYGREGGTEGLESYLTTRNVWQSSDIT

SEQ ID NO: 20580 - protein, 608 aa, Gaeumannomyces graminis var. tritici
MKFLVVSLFALVCGSAALATPANSSVSSSSGQHHPKPHHPHQPLDSGCKNGPKSRNCWGKHSIDTNYYETAPDTGVTREYWLSVEEGICNNDGYKRYCQTFNGSFPGPLIWANWGDNLVIHVTNNMKTNGTAIHWHGLHQRGSVEYDGVPGVTQCPIAPGKSLTYKFRVTQYGTTWYHSHFSLQYTEGLFGPMIFYGPTTANYDEDLGTLFLQDWDHDTAWHGWENVASKGAGPLPANGLINGTNTFDCKNSTDTNCLGGGKKFSATFKKGKKHLIRIINNSADAHFQFSIDGHSLIVVSNDLVPIKPFKTQSVRVSIGQRYDVIVEANAKPGDYWLRSGMSCVPGDTGALRERVTGIIRYDKKSKADPKTTSDVVVDETCSDEDPKKLVPHVALDVTHMGEIVQSDLGFKPNGTPAEGQNWFQWTLNNSSLVLDWHDPTLERIFDRQSIFPTKYNVIKAEPPATAPASKWFTLVIQSNEILLTPLPSHSLTHPIHLHGHDFWVLSQSKAKWDGTPRGFNTKNPARRDTAMLPAGGHLAIAFQLDNPGAWLVHCHIAWHAGQGLSLEFVESQGRIALGMPDHHVFQQTCREWDAVRNKMPFPQHDSGI

SEQ ID NO: 20581 - protein, 621 aa, Zea mays
  misc_feature (367)..(367): Xaa can be any naturally occurring amino acid
MFAWSRPRPHQPPAPISSSITPPNQNPNSTSPAIADVDGGFAGRSSADGCFAPPSSGPAAQASMPSIAPPSSSVAALTRQPVQFFKGCSVSKETKGPVRSFFTANSKSTTVKSADLKVASSFKNDGGYPAGGVSWKDDTLLPKSTTIRGQDHPVADPVLPMDSMITPEILSANVERVIDMFADDDTDTELDLDSPTEDFTSIAEAIEDIQQGKLVIVVDDESRENEGDLIMAASLVTPEAMAFIVRHETGIVCVSMKEDDLERLSLPLMVTTKENEKLCTAFTVTVDAKEGTTTGVSAKDRAKTVLKRAGHTEASVDLAMLAGLPPVAVLCEIVDDADGSMARLPKLHVFAEKENLKIISIADLIRXELNYQNFSFWYRRKRDRLIERASVARLPLKWGNVHAYCYKSVIDGIEHIGMMKGDIGDSQDILVRVHSECLTGDIFGSARCDCGDQLAMAMEMIEKAGRGVLVYLRGHEGRGIGLGHKLRAYNLQDDGRDTVEANEELGLPVDSQEYGIGAQILRDLGVRSMKLMTNNPAKYSGIKGYGLSIAGRVPLITPITSENRKYLETKRTKMGHVYGLANAQANQANKWQPEHRRESLGPQACFHYYSSNPASWHKRVI

SEQ ID NO: 20582 - protein, 253 aa, Triticum aestivum
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAAAVKSA

SEQ ID NO: 20583 - protein, 578 aa, Gaeumannomyces graminis var. tritici
MVAHHSFMLLSLAALALGSPFGELQQRAEPRIQQRAACAGNTATTRSKWCDFDIKSDYYTGQHPNTGVTREFWLELTDSVKLAPDGVPRYAQAFNGTVPGPTLVMDWGDDVVIHVTNKLTQSINGTSVHWHGLHQKDTVLSDGVVSVTQCPAVPGTTQTYKFKATNYGSSWYHSHFALQAWQGVFGGIIINGPASANYDEDVGMVVLSDWGHKTPDELWHQAETQGPPTLENALINGMNVYGAEGNQTGKRWETSFESGKSYRVRLVNTAIDTHFKFGIDNHTLTVIALDFIPVEPYEATMINIGMGQRVDVIVKADQAAVASDFWMRAIPQSACGTIQMAKNTRAIVHYGASKGVPATTGHTYVDACEDEPLEKLKPIIRIDAEEATYQQLKIATAGVNAKSVFRWYLNSTTMELDWSKPTVSQLANNASVAFSNSNAVMELPEADKWAYVIIQTNFGVAHPVHLHGHDYSVLAQGSGAYQPGVTKLITTNPMRRDTAILPAAGHLVLAFKTDNPGAWLMHCHIGWHTAQGFAMQFVERRSEMFSKNIINNNDIEGLCEPWRTHVGKHNIKLEDSGI

SEQ ID NO: 20584 - protein, 581 aa, Gaeumannomyces graminis var. tritici
MKSFGLIKGLALLAGLVASAPVASRDESLDLFPQLAGLRASTSTRDYESNTPNTGVTRRYNLVVTEVDNYVGGDGLVKSKAMLINNQFPGPIIKADWGDWVEVTVTNRLRTNGTSMHWHGVRMLNNNPNDGANGITECPIPPNASKVYRFRVEQYGTAWYHSHFSGQYGNGVVGTLLFNGPASLPYQEDLGVYPITDWYYRGADEIQFSLIPSPGVPPPSDNILFNGSHVNAQGGGSYNRVKLKPGRRHRLRIINTSVDNTFTVSLVGHQFTVIQTDFVPVNAFTTSQIFLGIGQRYDVTIEANQPVGNDWFNVTFAASGLCGTSLIQKPASIFQYEGASDTALPTNPGPTPTESLCEDLNSWTPVVAKNVPRASFSAVPGNTLEANTNVENWEGRQRVYWEINGSDMNITWDEPTLEYLVKGNMNFPQNFNVFQVPQGNQWSFWIIQNPTVAPHPMHLHGHDFYLLGRSPAQTNPFAGPVRRFNAATDLATLRFDNPVRRDVTMLPANGWIVVAFRTDNPGAWLFHCHIAWHVAQGLSVQFLERVQDIPSAFPLSAIEPTCSQWTAYYATSPHKQHDSGL

SEQ ID NO: 20585 - protein, 279 aa, Staphylococcus epidermidis ATCC 12228
MTNDVQILNNGYPMPAVGLGVYKIADEQMEEVVRTALDAGYRAFDTAYFYGNEKALGSALKHSNVERDELFITSKLWNDYQGYDQTIEYFNKSLDNLGLDYLDLFLIHWPCENDQLYIESYKALEHLYEEGKIKAIGVCNFKIHHLEKLMKETKITPQVNQIELHPYFNQQDVQDFCDEHDIKVTAWMPLMRNKGLLDDPVITDIAHRYDKTPAQIVLRWHLAHNRIIIPKSQTPKRIKENFDIFDFNLELTDVAEIDSLNKNARQGKDPDDVSIGDLK

SEQ ID NO: 20586 - protein, 349 aa, Oryza sativa Japonica Group
MASASLSLRLPTPSTAPSSGASSSFLSLPPTLLRQARGGAAASSALVARAASGGSPNPLFNPRADPFLSTLAAASPEELQAAAAGGGRRGDDHLPFLEIFQNAKLMASPAQVERSSSSYSQHRPRRPPPDLPSLLLHGRIVYIGMPLVPAVTELVVAQLMYLEWMNSKEPVYIYINSTGTARDDGEPVGMESEGFAIYDAMMRMKTEKIRIHTLCIGAAAGHACLVLAAGKKGKRYMFPHAKDSIMPAMIQQPRIPSYGMMQASDVVIRAKEVVHNRNTLVRLLARHTGNPPEKIDKVMRGPFYMDSLKAKEFGVIDKILWRGQEKYMADMLSPEEWDKVAGVRRPDIM

SEQ ID NO: 20587 - protein, 713 aa, Physcomitrella patens subsp. patens
MINGHDIYNVLSAMVPLYVAMMLAYGSVKWWGILTPQQCGGINRFVSIFAVPLLSFQFISGNNPYAMNFRFIAADAVSKVFVLLCLGLWARYSKRGSLEWMITLFVLITIPNTLVMGTPLLAAMYGPGPGDLTIQAVVLQCIIWYTLLLLMYEYRAAKILIMQQFPENAGSIVSFKVDSDVMSLDGREPVLTEAEIGDDGKLHVKVRRSVSSRSQGMHSAHHSMPSSKALTPRPSNLTGAEIYSMHSSVNLTPRDSSFNQGEYFSMMAQRSPHRQSNFDISDVYSLQSSRGPTPRTSNFNEENSKDMHTHHRGLNLTSPRFVPPLYRNVAGGRMFMPRTGLGGLPVHGNDPTGHGSLSTLGTPGMGPDGRTIYPGSQTAISLVTPGGTGNIATPLSSSLNTQIVNPVYSPRASQIAKKVKDTRTSPKSDEDAKELHMFVWSANASPVSEAGLHVFGGNDTSANLHQSFDPKEVRMLVHPQSDLRHPEANPRTYDNYAQEDFSFGNRNDLKLEDLDKDGPRLDNKFGSTSTAELTPKVPEDEAKKSMPPSAVMIKLIAVMTFRKLVWNPNTYSSLLGVIWSLVANRWHFTMPLILYKSVHILSDAGLGMAMFSLGLFMGLGDRIVVCGRKMAIFGMSLRFLAGPAVFAAASYLVGLRGVPLKVSIVQAALPQGIVPFVFAKEYGVHPEMLSTAVIFGMLIALPITMVYYILLGL

SEQ ID NO: 20588 - protein, 307 aa, Bacillus licheniformis ATCC 14580
MVRVANSVYDLIGNTPVVKLNRLVDEDSAEVYVKLEYMNPGSSVKDRIALAMIEDAEEKGLLKEGDTLIEPTSGNTGIGLAMVAAAKGIKAILVMPDTMSSERRNLLRAYGAELVLTPGAEGMKGAIKKAEELAEEHGYFMPQQFNNPANAEVHRRTTGKEIAEQFGDGLDAFIAGIGTGGTITGAGEVLKEKNPSIKIFAVEPTDSPVLSGGKPGPHKIQGIGAGFVPKILNTEIYDEIITVKNEEAFEFARKAAREEGILGGISSGAAICAALQVAKKLGKGKKVLAVLPSNGERYLSTPLYQFE

SEQ ID NO: 20589 - protein, 380 aa, Lactococcus lactis subsp. lactis Il1403
MVDFNKVLDLHELHTGVLDIQADIDVKKPSDLAEAYTPGVAELSKLIQSDPEAKRKYTMSGKLVAVVTDGTAVLGLGNMGPAGGLPIVEGKALLYKELAGVDAIPIAVEQIGAEKIIETIKNISQSFAGIHLEDISAPQCFEIEERLSKNLNIPVYHDDQAGTAIVVLAGLMNAAKLVNKKLEDLKIVINGVGAAGVATGRLFAEVGIKNVTLIDIEGKVNDKVKSYNRYQLELAKRFNQVAGTTLDEVIDGQDVFIGLSDAKVLTGTQVERMAKDAIIFALANPVPEILPEEALKHGAAVVATGSNQWPNQVNNVLVFPGLFKGLLSANVQHVDYKLQANIATAIADVIKNPDRNHIVPGVFDAGVVESVTKAVKDSAK

SEQ ID NO: 20590 - protein, 232 aa, Zea mays
MAAASAPLLLALALAFAASLAAAGDTNRVYDPCTDTKIQRGDGFTFGLAFAANGAFYSGSTQLSPCDRRLTQLSQLSLFRPKVDEISLLTVNTTTGFSPASAGGYMVAFAGRKYAARSQPVFVSNSSVTVSSFTLVLEFNKGKLQNLHWKKDGCGACTGKPNFICLGKQTCAIRTNICKSNNQGSMDCSIGIQLAFSGTDKHESVLNSWYGLWTCSSACSRLSPARTSTGRF

SEQ ID NO: 20591 - protein, 508 aa, Pseudomonas putida GB-1
MSQPVSSQPPLADCYDLAVIGGGINGVGIAADAAGRGLKVFLCEKDDLAQHTSSASSKLIHGGLRYLEHYEFRLVREALAEREVLLAKAPHIVKPMRFVLPHRPHLRPAWMIRAGLFLYDHLGKRKRLGASRSLRFGPGYPLKPAISRGFEYADCAVDDARLVVLNAMAAREHGAHIHTRTRCLRAERVDGLWQVELQHADGSLQTLRARALVNAAGPWVASFIKDDLKLDAPYGIRLIQGSHIIVPRLYEGEHAYILQNEDQRIVFCIPYLERFTLIGTTDREYSGDPAQVKITEGETDYLLKVVNQHFNHQISRADILHTYSGVRPLCNDESDNPSAVTRDYTLALSAGDGQAPLLSVFGGKLTTYRKLAESAMGELKPFFTEMRGSWTAESPLPGGENMTDAQALVDALLARHHWLPMDIAKRWATTYGSRAWQLLDGVQGPVDLGQAIGGGLFTREVDYLRNEEWALTADDILWRRTKLGLFTTAAEQQTLKQYLNDRQGVQAA

SEQ ID NO: 20592 - protein, 219 aa, Vibrio angustum S14
MTQDEMKKAAGWAALEYVQKGTIVGVGTGSTVNHFIDALATRKEEIKGAVSSSVASTERLEQLGITVFDANEVASLDIYVDGADEINADYDMIKGGGAALTREKIVAAIAKKFICIVDDTKQVDVLGQFPLPVEVIPMGRSFIGRELVKLGGDPAYREGVVTDNGNMILDVYNMKITDPKAMEDKINALPGVVTVGLFAHRGADVLLVGSPDGVKKFEK

SEQ ID NO: 20593 - protein, 176 aa, Oryza sativa Indica Group
IFTFYKAQGYAVGKSLVEEDKLELATSLIEKAKAKGVSLLLPTDVVVADKFAADAESKTVAASAIPDGWMGLDVGPDAIKTSSEALDTCNTIIWNGPMGVFEFDKFAAGTDAIAKKLADLTTTKGATTIIGGGDSVAAVEKAGLADKMSHISTGGGASLELLEGKTLPGVLALDEA

SEQ ID NO: 20594 - protein, 478 aa, Oenococcus oeni PSU-1
MDIFRKKDVGEILKHSTPLKRTLRTWDLTFLGIGAIIGTGIFVLTGKGALTAGPAISVSFLVAAICCGFAGLCYAEFASMAPVAGSAYTYSYIAFGEIIAFIIGWDLILEYTLGAATVSVGWSGYFANLLGNLGIHIPTVLTAAAGTTAGVTSYFNLPAFLIVLLITWIISIGITQTKRANDTMVIVKLAVILLFIVCTIWFIKPHNWQPFSPYGLYSFHNGTAAGIIPAASIVFFSFIGFDSVSSSAEETINPSKTLPRGILLSLFISTVLYIIMTLIMTGVVKFTVFAKYLNAPVLAVLHSTGQTWLSIIVSIGAILGITTVILVQLYGQSRISYSMSRDGLFPKFFGDVNMKYQTPFKGTWFFGIITAIAGGLINLNILAELVNIGTLTAFILVSAGVLWMRHSHPEVHRGFKAPGVPFTPIIAIIFCLVLIAGLNWETWIRFIVWFAIGMILYFGYAKKHSKLNSFKPQDKGAD

SEQ ID NO: 20595 - protein, 193 aa, Candida albicans SC5314
MTRFKSERIAKFAFDFALKNNRKLVTAIHKANIMKLGDGLFRQTVKDVGQDYPGIGVSDLIVDNASMQAVAKPQQFDVLVTPNLYGSILSNIGAALIGGPGLVPGANFGREYAVFEPGCRHVGLDIKGKNSANPTAMILSSAMMLRHLGLNDHADKISKATYDVIAEGNVRTADIGGTATTTEFTEAIINKLD

SEQ ID NO: 20596 - protein, 471 aa, Triticum aestivum
MEADSGKLFVGGISWETDEDRLREYFGRFGEVTEAVIMRDRNTGRARGFGFIVFAEAGVAERVTMDKHMIDGRMVEAKKAVPRDDQSIASKNNGSSIGSPGPVRTRKIFVGGLASNVTEVEFRRYFEQFGMITDVVVMYDHNTQRPRGFGFITYDSEDAVDKALHKNFHELNGKMVEVKRAVPKEQSPGPVARSPAGGQNLAISRVHNFLNGFNQGYSPNPIGGYGMRVDGRFGLLSGARNGFSSFGPSYGMGMNVETGMNANFGANSSFLNNSNGRQMGSYYNGGLNRLGSPIGYVGLNDDSGSILSSMGRNVWGNGNVNYQNSPTNMSSFVPSGSGSQVGITGDGINWGGPTSAHGMGSISSLGSNIGRGAGDNFGLPSGGYGRSNPTGTIGEPFSASANAYEMNNIDTYGNNSIYGDSTWRFTSSEIDIPPFDNDLGNIDPDIKSNMPASYMGNYTVNNNQTSRGITS

SEQ ID NO: 20597 - protein, 437 aa, Trichodesmium erythraeum IMS101
MTHATKTHNQIETTNTAVENLRCKECGEEYPLEAKHICEDVCFGPLEVKYNYEKLSQIVSRATIEAGPKSIWRYRHFLPVVTDNFIDVGTGMTPLVKSERLARRLGLKNLYIKNDAVNMPTLSFKDRVVSVALSRARELGFSTVSCASTGNLANSTAAIAAKAGLECCVFIPADLEAGKVLGTLIYNPTLMAVKGNYDQVNRLCCEVANSYGWGFVNINLRPYYSEGSKTLGFEVAEQLGWQLPDHVVAPIASGSLYTKIYKGFQEFIKVGLVEDKAVRFSGAQAEGCSPVAQAFKEERDFISPVKPNTIAKSIAIGNPADGVYALELARKTNGNIESVNDTEIIEGIKLLAETEGIFTETAGGTTIAVLKKLVEAGKIDPEETTVVYITGNGLKTQEAVQGYVGEPLTIEAKLDSFERAWERAQTLERLDWQQVLV

SEQ ID NO: 20598 - protein, 381 aa, Vibrio vulnificus CMCP6
MSKRDFYEVLGVSRDASERDIKKAYKRLAMKFHPDRNQGDESAADKFKEVKEAYEILTDPQKKAAYDQYGHAAFEQGGGGFGGGFGGGGADFGDIFGDVFGDIFGGGRRGGGHARPQRGADLRYNMELSLEEAVRGVSKEIEVPTLVHCDTCEGTGAKKGTSAETCGTCHGHGQVQMRQGFFAVQQTCPTCHGKGKIIKDPCNVCHGQGRKQKTKTLNVKIPAGVDTGDRIRLSGEGEAGERGAPAGDLYVQVHVREHHIFEREGNNLYCEVPVSFAMAALGGEVEVPTLDGRVNLKVPSETQTGRMFRMRGKGVKGVRGGAIGDLIVKLVVETPVNLSSRQKELLKEFEESCCGEAATKHKPKSEGFFNGVKKFFDDLTS

SEQ ID NO: 20599 - protein, 286 aa, Listeria monocytogenes str. 1/2a F6854
MILPGNGTIPYIGLGVFQVTEQEFIAGAVEKAIEVGYRLFDTAAVYNNEAIVGQAIASSAVSREELFISSKVWNGDLGYDETLFAFERTLRNLKLDYLDLYLIHWPVAGKYRDSWRAMERLHDEKLIKSIGVANFKQHHLSDLLVAANEKPVLNQVETHPLLPQNDLRKYLVEQNIAHAAWSPLAKGILMQNPVITEIAKKHQASVDQVILQWHLNRNTIIFPKSITSSRIEENSRLSYFQLDASDMEKIDRLETGKRVGPDPDDLEYFLSSIERERAYLASENEE

SEQ ID NO: 20600 - protein, 542 aa, Oryza sativa Japonica Group
MEAFVSGGAGGVGAAAVVGVFVAAAVVGGFVAAVALAERAGVIAPRKRPNAPPAVPGLPIIGNLHQLKEKKPHQTFTKWAEIYGPIYTIRIGASSVVVLNSTEVAKEAMVAKFSSISTRKLSKALTVLTRDKSMVATSDYGDFHKMVKRYVMSSTLGTSAQKKFRDTRDMMINNMLSTFHKLVKDDPHVPLIFRDVFKDELFRLSMIQSLGEDVSSVYVDEFGRDISKEEIYNATVTDMMMCAIEVDWRDFFSYLSWVPNKSFETRVFTAEARRTAVMRALIKQQKERIVRGEAKICYLDFLLAENTLTDEQLTMLVWEELIEAADTTLVATEWAMYELAKNPDKQARNICYSVPAHSWHYQPKRFLLGVFLERLYQEIREVCGDETVTEEHLPRLPYLNAVFHETLRRHSPVPLIPPRFVHEDTKLAGYDVPAGTEMVINLYGCNMNKKEWESPEEWVPERFTGGRLEVADMYKTMAFGAGRRACAGSLQVMHIACTAIARFVQEFGWRLTEGDEEKVDTVQFTAYKLHPLHVHLTPRGRM

SEQ ID NO: 20601 - protein, 181 aa, Helicobacter pylori
LVTKLAPDFKAPAVLGNNEVDEHFELSKNLGKNGVILFFWPKDFTFVCPTEIIAFDKRVKDFQEKGFNVIGVSIDSEQVHFAWKNTPVEKGGIGQVTFPMVADITKSISRDYDVLFEEAIALRGAFLIDKNMKVRHAVINDLPLGRNADEMLRMVDALLHFEEHGEVCPAGWRKGDKGMKA

SEQ ID NO: 20602 - protein, 315 aa, Frankia sp. EAN1pec
MRYDSLVDSVGRTPLVGLPRLSPSAEVRLWAKLEQDNPTGSIKDRAALWMIADGEKRGLLTPGATVLEPTSGNTGISLAMVCSQRGYRLICVMPENTSVERRQLLQMWGAEIVSSPAAGGSNEAVAVAKRLAAENPDWVMLYQYGNPANAQAHYETTGPEILEDLPGITHFVAGLGTTGTLMGTGRYLRERKPDVVIVAAEPRYGELVYGLRNIDEGFVPELYDASVLTSRYSVGPRDALRRTRELVQQEGIFAGISTGAILHAALAQADRAVREGRRADIAFIVCDGGWKYLSTGAYAGTLAEAEAALEGQLWA

SEQ ID NO: 20603 - protein, 181 aa, Helicobacter pylori
LVTKLAPDFKAPAVLGNNEVDEHFELSKNLGKNGVILFFWPKDFTFVCPTEIIAFDKRVKDFHEKGFNVIGVSIDSEQVHFAWKNTPVEKGGIGQVSFPMVADITKSISRDYDVLFEEAIALRGAFLIDKNMKVRHAVINDLPLGRNADEMLRMVDALLHFEEHGEVCPAGWRKGDKGMKA

SEQ ID NO: 20604 - protein, 421 aa, Escherichia coli O157:H7 EDL933
MSNNEFHQRRLSATPRGVGVMCNFFAQSAENATLKDVEGNEYIDFAAGIAVLNTGHRHPDLVAAVEQQLQQFTHTAYQIVPYESYVTLAEKINALAPVSGQAKTAFFTTGAEAVENAVKIARAHTGRPGVIAFSGGFHGRTYMTMALTGKVAPYKIGFGPFPGSVYHVPYPSDLHGISTQDSLDAIERLFKSDIEAKQVAAIIFEPVQGEGGFNVAPKELVAAIRRLCDEHGIVMIADEVQSGFARTGKLFAMDHYADKPDLMTMAKSLAGGMPLSGVVGNANIMDAPAPGGLGGTYAGNPLAVAAAHAVLNIIDKESLCERAMQLGQRLTKTLIDAKENVPAIAAVRGLGSMIAAEFNDPQTGEPSAAIAQKIQQRALAQGLLLLTCGAYGNVIRFLYPLTIPDAQFDAAMKILQDALRD

SEQ ID NO: 20605 - protein, 146 aa, Pseudomonas fluorescens
MQLKNPILGLCQQSTFMLSAAKVDQCPDDEGFEVAFAGRSNAGKSSALNTLTHASLARTSKTPGRTQLLNFFKLDDERRLVDLPGYGYAKVPIPLKQHWQRHLEAYLGSRESLKGLILMMDIRHPMTDFDLLMLDWAVASGMPMHI

SEQ ID NO: 20606 - protein, 570 aa, Fusobacterium nucleatum subsp. nucleatum ATCC 25586
MKSNKKIYMWPSAWEKPVVKGTYGAVSSNSCYATQAGLEILNKGGNAFDAAVAVSLVLSVVEEHHSGIGGGCFTLFYSVKDNETFALDGRGTAPKKATKDLFLKDGEVQDEWKDLGGQSVLVPGLLKTMDVLLKKYGTMELKEVVLPALKYAKEGFEIGYTYSLTMHDDSVQRKINLSNEFKKLYLKEDKSFYKFGDIYRNEKIAKLLELISKNGIDIFYNGEIAEKIVNIVNKNGGCFIAEDLKKYMPKIRKVEVSTYRGYEIKSFSPPSSGATLIEMLNIIENKNIKDMGHNSAETIHILAEAMKLGFSDRNVVLADPDYAKINDDKLISKEYAKERYSLVSSEAKEYTSGNLSNIKEYNGNTSHFSIIDRYGNVVSQTQTIRDWFGSGIIVDDYGFVLNNGMSDFSALAGAITSQGLTYGDLNAIEGGKIPLSSMSPTIVFKDKKPFMSIGAAGGPRIITGILQGIINAIDYDMLPEQLVNMPFINCLTKNQGLEVEYGISKDTLNILEKKGHIIKEIPVYQAMSTMLNSVMNIDGVLYAASTKRVDGCGGVLFENGHIALEGIIQR

SEQ ID NO: 20607 - protein, 495 aa, Escherichia coli O157:H7 EDL933
MNFHHLAYWQDKALSLAIENRLFINGEYTAAAENETFETVDPVTQAPLANIARGKSVDIDRAVSAARGVFERGDWSLSSPAKRKAVLNKLADLIEANAEELALLETLDTGKPIRHSLRDDIPGAARAIRWYAEAIDKVYGEVATTSSHELAMIVREPVGVIAAIVPWNFPLLLTCWKLGPALAAGNSVVLKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEESIADEFLALLKQQAQNWQPGHPLDPATTMGTLIDCAHADSVHSFIQEGESKGQLLLDGRNAGLAVAIGPTIIVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 20608 - protein, 431 aa, Arabidopsis thaliana
MTRSVSFPLFLFAVVLSLSSSLLADDPKPIRREVYEGGKIYDISHRYTPEIPAWESSEGLGKTFLRLAASMKNGSFANVSEMKLSVHSGTHVDAPGHFWDNYYDAGFDTDSLDLQVLNGPALLVDVPRDKNITAEVMESLHIQRGVRRVLFRTSNTDKRLMFKKEFDSSFAGFMTDGAKWLVENTDIKLIGLDYLSFAAFEESPATHRVILKGRRYSLDKKVREIGRLKREMNYVLTREIHMFSGYNPSGSAEAGWCGGRNILASLLTAEISWSGRSTDKMHSHQVIQFFFFFFCYICNSEGHDNKPRLKQTNNITTCSECMNLIRRATKSKSKNRKKRSMQELKHVFFLDRGKRKHNLCVLVVFHYIERDMQVPSSLQKASVLSTKEKPLNAQESVLVVHQLNDNRSEPALLTTKIRLLDVAKRIAKEKS

SEQ ID NO: 20609 - protein, 471 aa, Escherichia coli
MSQNVYQFIDLQRVDPPKKPLKIRKIEFVEIYEPFSEARPKRRLTAACRAANPYCEWKCPVHNYIPNWLKLANEGRIFEAAELSHQTNTLPEVCGRVCPQDRLCEGSCTLNDEFGAVTIGNIKRYINDKAFEMGWRPDMSGVKQTGKKVAIIGAGPAGLACADVLTRNGVKAVCFDRHPEIGGLLTFGIPAFKLEKEVMTRRREIFTGMGIEFKLNTEVGRDVQLDDLLSDYDAVFLGVGTYQSMRGGLENEDADGCTQRCRSSSPTPNSLMGFGETRDEPFVSMEGKRVVVLGGGDTAMDCVRTSVRQGANDVTCAYRRDEENMPGSRREVKNAREEGVEFKFNVQPLGIEVNGNGKVSGVKMVRTEMGEPDAKASPRGDRCRFRTYRTGRCGDHGVWFRPHNMEWLAKHSVELDSQGRIIAPEGSDNAFQTSNPKIFAGGDIVRGSDLVVTAIAEGRKAADGIMNWLEV

SEQ ID NO: 20610 - protein, 380 aa, Candida boidinii
MSTVGKTITCKAAVAWKPGEDLSIETIEVAPPKAHEVRIKIEYTGVCHTDAYTLSGADAEGEFPVVFGHEGAGIVESVGEGVTSVKVGDSVICLYTPECRECKFCKSGKTNLCGKIRATQGKGLMPDGTSRFTCKGQPLLHYMGCSTFSQYTVVADISVVAVNPEAPKDRTCLLGCGITTGYRAATNTVKMNEGDNIAVFGVGCIGLSVIQGAVAKKAGKIIAIDINDGKTEWAEKFGATDFVNPTKLAEGETIVSKLIDMTDGGCDFTFDCTGTVQVMRNALEACHKGWGESVIIGVAAAGKEISTRPFQLVTGRVWRGCAFGGVKGRTQMPGIVEDYLSGTLKVDEFITHRHKLDDINKAFHDMHAGDCIRAVITMEE

SEQ ID NO: 20611 - protein, 174 aa, Cyanidioschyzon merolae strain 10D
MKHTLSVLVEDEAGVLTRIAGLFARRSFNIESLAVGPAEQAGISRITMVVPGDDRTIEQLMKQLYKLIPILQVENLTQVPCVERELILMKVQANSQTRREILDMANIFRARVVDISADDVMLEVTGDPGKMVALEQILTKFGIVEVARTGKIALKRSSKVNTEWLRYNFGEGGT

SEQ ID NO: 20612 - protein, 525 aa, Rhodopseudomonas palustris CGA009
MRDFHKTGRSLAVAQNGMAATSHPRATLAAIDILRRGGNAIDAAVAAVAIQGVVEPQMTGIGGDCFALVSLGGGRPIALNGSGRTPAGTDAEKYAGGEARDIPPTSPEAVTIPGAIDAWCTLIERHGSLPLAEVLAPAIEAAEQGFCVTPRVASDWRRFRARIEIDPNAAAQFLPGGRVPDIGDVRAQPRLGATLRKIAREGRAGFYEGEVAEEMVAVLRKLGGAHSVDDFAAHRCEHVTPISADYRGYTVMECPPNGQGLAALMILRVLEGFDVGKLNDADRIHLLAEATKAAYATRDAYFCDPAIHPLEPARFLSDAVIGKIRQGIAMDRAGEAQPWLDTEHRDTVYVTVVDRDLNAVSLINSIFSPFGSGIYAPNSGVLLHNRGWSFRAKPGHPNSLAPSKRPMHTIIPGMLMQGDQAVMPFGVMGGHYQAAGHANFLSNVLDFGLDIQAAAERPRSFCFDGALSLETTIGQDIYDEMQRRGHTVRWTEEAIGGCQAIRIDRARGVLLGASDHRKDGVALGY

SEQ ID NO: 20613 - protein, 584 aa, Xanthomonas oryzae pv. oryzae KACC10331
MLLALVLSPSAWCADAAKPTASTTAPVAVHSPGAAIASGHALATDAGLQILREGGNAFDAAVAVSSTLAVVEPISSGLGGGGFFLLHDAKTGKDVMLDARETAPESATEAQFLDKNGELDRDRSVNGPWSAGIPGLPAALLELASKHGRLPLKQSLAPSIRIATEGFPVYARMAKGYASRREVMERYPGTREVYLRGGKPIAEGETFKQPELAHTLQLLGDKGFDGFYKGETAKKLLAGVKQAGGQWTAAELAGYRVKERTPIQFDYRGWTITTAPPPSSGGIALAVMLQILEGWDLNKLDDVHRTHLVVESMRRAYRDRTFFLGDPDFVHVPQRVLTSKDYAQGLRATINPDKATPSDLLSGNPTPLEDDETTHFSIIDSEGNRVGATQTVNLLYGSGLIPQGTGVLLNNEMDDFALKPGTSNVFGVMGYAANAPKPGKRMLSSMTPTFMESADKAIVLGTPGGSRITTMVLLGILGYDAGLDAQAVSALPRYHHQWLPDVIDAETDAFSPQTVKGLQAMGHALKLPGDTAEGGRGSSHVWGNLQTVEWDKRSNVLSGGSDPRNPVGKAQVQLDGGIGSKANL

SEQ ID NO: 20614 - protein, 420 aa, Trichodesmium erythraeum IMS101
MTIIQERTLAEKLRADFPILNQEINGEPLIYLDNAATSQKPLAVINAWQEYYLKYNSNVHRGIHTLSSKATDAYEGARDKVAALINAASRNEIIYTRNASEAVNLVAYSWGLNNLKSGDEIIVSVMEHHSNFVPWQMVAQKTGSVLKFVELNETEELNLEQYKALISDKTKLVALAHVSNVLGCINPIQEICSIAHKNGAKVLIDACQSVPHCVVDVQSIDCDWLVASGHKMCAPTGIGFLYGKLELLKEMPPFLGGGEMISEVFLDHYTYAELPHKFEAGTPAIGEAIALGAAVDYLTNIGMEKIHNYEVELTTYLFNKLRQIPQITIYGPQPNTYGEGRGTLVSFTVENIHPNDLSTMLDEAGIAIRSGHHCAQPLHQYLKVSSTARASLSFYNTRDDIDIFVDALKDTINFFADIMG

SEQ ID NO: 20615 - protein, 394 aa, Listeria monocytogenes str. 1/2a F6854
MKNLVKVKVFPKFTKGYKEGFPLILKERMEKWPKELQEGDVLELTDTNGQFIARGYHGEQNKGSGWLFTWDKKQQLDEDFLTNLITTAIEKRQFLFADDSTTAFRIFNGEGDGLGGFTVDYYDGYLVIQWYSLGIYAFQKMIIDIFLSFPEIKGIYEKRRFQEDTKDDFVAGQKATFPLIIKENGINYATYLDDGWMTGIFLDQRDVRRRISEDYSVSKNVLNTFSYTGAFSVAALFGGASKTTSVDVAGRSLSKTKEQLEVNGLDPNEQAIIVEDVFHYFKYAARKQLTFDLVVVDPPSFARTKKVTFRAAKDYPAMLREIIDITAPNGTIIASTNYAGFGMKAFKKLIAEAFQTSDRTYKIVETHSLPADFTVNKNFPEGNYLKVLFLTLDI

SEQ ID NO: 20616 - protein, 241 aa, Populus trichocarpa
MTDNNNNPSFNSYNNDGEESSPLLKKNLEDNDKKPAKVSADAKTATAEYGCTVNGLPLIHGSVMGEPMGRTQWDSCLFCCLGRNDEFCSSDLEVCLLGSIAPCVLYGSNAERLGSTPGTFASHCLSYYGLYLIGSSFLGGNCLAPWFSYPSRTAIRRKFNLEGSCEALNRSCGCCGSFVEDGLQREQCESACDFATHFFCHTCALCQEAREIRRRVLHPGFNAQPVLVMIPPGEQSMGRGA

SEQ ID NO: 20617 - protein, 402 aa, Pseudomonas syringae pv. tomato str. DC3000
MTASRIAARVLRIKPSPSSAAADRANELRRAGKSIINLVVGEPDFDTPAHIRQAACAAIENGETRYTLNAGTATLREAIAAKLQRENGLTYAPGQIVVTSGAKAAIFNAFAATLGVDDEVLIPAPYWVSYPDMVLACDGRPVTLACPEENQFKLTAEQLREAITPRTRWLLLNSPSNPTGATYSAAEWRALADVLLDYPDVLIMTDDIYEHIRYDDTPLSHLLTVEPTLRERVLIINGVSKTYAMTGWRIGYAAGPSDIISAMATLQSQSTSNACSVSQAAAVAALNGDQSFVGESVKVYKQRRDRCLELINAIDGLSCIKPEGAFYLYVNCGALIGKTTPSGAVLHADTDVVLYLLESQGVAVVAGTAYGLAPFFRMSTATAIETLESGCARIATAVAALR

SEQ ID NO: 20618 - protein, 523 aa, Vitis vinifera
MSNIEGSPGSSMHGVTGREQTFAFSVASPIVPTDTSANFALPVDSEHKAKVFKILSFANPHMRTFHLSWISFFTCFVSTFAAAPLVPIIRDNLNLTKGDVGNAGVASVSGSIFSRLVMGAVCDLLGPRYGCAFLVMLSAPTVFCMSFVSSAGGYIAVRFMIGFSLATFVSCQYWMSTMFNGKIIGLVNGTAAGWGNMGGGATQLIMPILYEVICRVGSTPFTAWRIAFFIPGWLHVIMGILVLTLGQDLPDGNLSTLAEKGRCVFWYAITNYRTWIFVLLYGYSMGVELSIDNVIAEYFYDRFNLKLHTAGIIAATFGMANLVARPFGGYSSDLAGRRFGMRGRLWTLWILQTLGGVFCIWLGRANSLPIAVLAMMLFSVGAQAACGATFGIVPFISRRSLGIISGLTGAGGNFGSGLTQLVFFSSSKFSTATGLSLMGAMIVACTLPVTLVHFPQWGSMFLPPSKDVIKGTEEHYYESEWNEEEKQKGMHQGSLKFAENSRSERGKRVASAPTPPNSTPSHV

SEQ ID NO: 20619 - protein, 376 aa, Arabidopsis thaliana
MAIRKEEESREEQSNSFLLDALYCEEEKWDDEGEEVEENSSLSSSSSPFVVLQQDLFWEDEDLVTLFSKEEEQGLSCLDDVYLSTDRKEAVGWILRVNAHYGFSTLAAVLAITYLDKFICSYSLQRDKPWMLQLVSVACLSLAAKVEETQVPLLLDFQVEETKYVFEAKTIQRMELLILSTLEWKMHLITPISFVDHIIRRLGLKNNAHWDFLNKCHRLLLSVISDSRFVGYLPSVVAAATMMRIIEQVDPFDPLSYQTNLLGVLNLTKEKVKTCYDLILQLPVDRICLQIQIQSSKKRKSHDSSSSLNSPSCVIDANPFNSDESSNDSWSASSCNPPTSSSSPQQQPPLKKMRGAEENEKKKPILHLPWAIVATP

SEQ ID NO: 20620 - protein, 620 aa, Mucor circinelloides
MSPIIDFVRRQLSSTKLHEEQQTATTNDLVSRSGYLNEGKYEVRLNCINAGCLQKKLNYIGTAMDPAKRQRLGLNGLLPAGVETLEIQKARALRVLRSKHNLLEKYILMAQLRTTNVRLFYKIVIDELETVQLAPVIYTPTVGTACLEYSTIYPFLAAPGVPDGLYLTKAELPELCQTIRNYRPTDTEGFEPEIAVISDGSRILGLGDLGTNGMGIPMGKLQLYVAGAGIDPRRTLPIILDLGTNNEKLLNDEFYIGLRQKRPNDEEFYQTVDTVLTALHTVYPNLLIQFEDWSSEHAFGLLEKYQNQMLCFNDDIQGTGAVILSGVINAIRKVEKENQVSPRDHRIVFYGAGSAAIGVARQIQSYFQIEHNMTEEEAKHVFWIVDSKGLVTTTRGDKLAQHKVYYARGDNEGQQYKELIDIVNYNLYSLIGLSSTTGAFNTQVLERLASLNEQPIVFPLSNPATQAECTFEQAMEATNNKVIFASGTAFPAYTIKSTGEVNTPGQGNNMYIFPGLGLGACLANPAHFDRMIYEASKALADSLTEEEISKAWLYPSLNYRSVSAIVAAAVCQETLNENLATSQAMMTQCKSHEDILDYVSAHMWSPDYGNNNSNQQAGKL

SEQ ID NO: 20621 - protein, 533 aa, Magnaporthe grisea 70-15
MGINVKFSDLYRAPEVNPITRKARSIPALNVINMYGRVFFFSWFGFMIAFWAWYTFPPLLTVTIRKDLNLTAAEVANSNIVSLVATLFVRMVAGPLCDLWGSRVVFGGVLLVGAIPLGLAPLIQNATGLYVSRFFIGILGGAFVPCQVWSTGFFDKNVVGTANALTGGFGNAGGGITYFIMPAVFDSFVHRMGYTPGQAWRLTFVVPLVMIIVTGVSLLLLCPDTPTGKWSERHMHAQQMVGQASTTDATNQDKIVDVPGSITDKGPNASNSSEGNSFVEEKEKTRKEKDEQVGELLDAEAGRVIKSDDAAVQNTDTIAKPTFGESLRVMASPQTLVHVLTYFCSFGGELAINAILSSYYLKNFPELGQTGASNYAAIFGFLNFITRPLGGVVSDLLYNAAGSGPRGLWLKKGWIHVCGIATGALLILIGQLNPHHQPTMLGLVIFMAFFHEAGNGANFALIPHVHPHANGLVSGITGAGGNLGGVVFAVVFRFVGGGTGYATGFWIIGIVHIAINIAMAWIKPLPKGQIGGY

SEQ ID NO: 20622 - protein, 498 aa, Escherichia coli O157:H7 EDL933
MHTDSNGGHYILRFDNERKTNQRRRIMETNIVEVENFVQQSEERRGSAFTQEVKRYLERYPNTQYVDVLLTDLNGCFRGKRIPVSSLKKLEKGCYFPASVFAMDILGNVVEEAGLGQEMGEPDRTCVPVLGSLTPSAADPEFIGQMLLTMVDEDGAPFDVEPRNVLNRLWQQLRQRGLFPVVAVELEFYLLDRQRDAEGYLQPPCAPGTDDRNTQSQVYSVDNLNHFADVLNDIDELAQLQLIPADGAVAEASPGQFEINLYHTDNVLEACDDALALKRLVRLMAEKHKMHATFMAKPYEEHAGSGMHIHISMQNNRGENVLSDTEGEDSPLLKKMLAGMIDLMPSSMALLAPNVNSYRRFQPGMYVPTQASWGHNNRTVALRIPCGDRHNHRVEYRVAGADANPYLVMAAIFAGILHGLDNELPLQEEVEGNGLEQEGLPFPIRQSDALGEFIENDHLRRYLGERFCHVYHACKNDELLQFERLITETEIEWMLKNA

SEQ ID NO: 20623 - protein, 329 aa, Frankia sp. EAN1pec
MRILVTGASGFVGGVTADLLSAAGHQVTALVRDATARTRLSRVIEVVQADLLEPRQLAAAGVSRGFDGVCHLAALTRVRESRETPLRYFAANVTGTTNLLAALDAGTRATGVAPRFVFGSSCAVYGDTGTSPIPETRAPAPTNPYGASKLAAEQAVAYQAATGRLGAVVLRSFNVAGAVGSHADRDSSRIIPAALGVATGRRDAFRVNGDGASIREYVHVVDMARAYLTALRATVPGRCTVYNVGSGLGVSVTDVLRTVESVTGRDVPRVTLPPVPEPRALIADSRRIRADLGWTSPSSTIEKIVTDAWRSTAVPEPVAARRGDVPIVS

SEQ ID NO: 20624 - protein, 461 aa, Escherichia coli O157:H7 EDL933
MAINSPLNIAAQPGKTRLRKSLKLWQVVMMGLAYLTPMTVFDTFGIVSGISDGHVPASYLLALAGVLFTAISYGKLVRQFPEAGSAYTYAQKSINPHVGFMVGWSSLLDYLFLPMINVLLAKIYLSALFPEVPPWVWVVTFVAILTAANLKSVNLVANFNTLFVLVQISIMVVFIFLVVQGLHKGEGVGTVWSLQPFISENAHLIPIITGATIVCFSFLGFDAVTTLSEETPDAARVIPKAIFLTAVYGGVIFIAASFFMQLFFPDISRFKDPDAALPEIALYVGGKLFQSIFLCTTFVNTLASGLASHASVSRLLYVMGRDNVFPERVFGYVHPKWRTPALNVIMVGIVAMSALFFDLVTATALINFGALVAFTFVNLSVFNHFWRRKGMNKSWKDHFHYLLMPLVGALTVGVLWVNLESTSLTLGLVWASLGGAYLWYLIRRYRKVPLYEGDRTPVSET

SEQ ID NO: 20625 - protein, 320 aa, Dehalococcoides sp. CBDB1
MENRTSKYNIHNGRGIASNITELIGNTPLVRLNKIGSGLKAEIILKLESFNPTHSAKDRPALYMIKKAEQEGKLIPGSIVIESTSGNTGIALAAVCAAKGYRLMLTMPENFSVERRRLLRLLGAELVLTPAELGMQGAIEKAAELKAKLPQAFIPNQFENPANPESHYKTTAEEIWRDTDGKVDILVAGVGTGGTISGIARGLKAAKPSIRIIAVEPAESPVISGGEPQPHLIQGIGAGFIPRILSLELIDKVIRVPGKEAVNMALRLAREEGIMAGISSGAALWAALETAKQAENSGKLIVAIMPDSGERYLSSLPLGD

SEQ ID NO: 20626 - protein, 478 aa, Brucella melitensis 16M
MKRNRKVKILATLGPASGEEAVIRKLFEAGADVFRINMSHADHDLMRTLVKRIRNVEKELGRPIGILADLQGPKLRVGKFKDGKVDLVPGQTFTLDNNEALGDETRVFLPHPEILEAVEPGHRLLIDDGKLHLVAEACDGKSIRCKVVSGTRISDRKGVSLPDTTLGVGALTEKDRCDLDAVLKEEIDWVALSFIQRPEDLAEVRKVSRGKVGLMSKIEKPQAVTRLDEIIELSDALMVARGDLGVEVPLENVPGIQKQITRKARRAGKPVVVATQMLESMITAPVPTRAEVSDVATAVFEGADAIMLSAESASGQYPVEAVATMNRIAEQVEREPTYSTIIDAQRAMPEPTGADAISLAARQIAETLKLSAIVTYTASGTTGLRAARERPRTPIIALSPVVDTARKLSLVWGLHCVITDDAHDLEDMVNHACEIVFHEEFGKAGDRVIITAGVPFGTPGATNMLRIAYIGADGKSGI

SEQ ID NO: 20627 - protein, 612 aa, Streptococcus pyogenes MGAS315
MEFSRETRRLALQKMQERDLDLLIIGGGITGAGVALQAAASGLDTGLIEMQDFAQGTSSRSTKLVHGGLRYLKQFDVEVVSDTVSERAVVQQIAPHIPKPDPMLLPVYDEPGSTFSMFRLKVAMDLYDLLAGVSNTPAANKVLTKEEVLKREPDLKQEGLLGGGVYLDFRNNDARLVIENIKRANRDGALIASHVKAEDFLLDDDGKIIGVKARDLLSDQEIIIKAKLVINTTGPWSDEIRQFSHKGQPIHQMRPTKGVHLVVDRQKLPVSQPVYVDTGLNDGRMVFVLPREEKTYFGTTDTDYTGDLEHPQVTQEDVDYLLGVVNNRFPNANVTIDDIESSWAGLRPLLSGNSASDYNGGNSGKVSDDSFDHLVDTVKAYINHEDSREAVEKAIKQVETSTSEKELDPSAVSRGSSFDRDENGLFTLAGGKITDYRKMAEGALTGIIQILKEEFGKSFKLINSKTYPVSGGEINPANVDLEIEAYAQLGTLSGLSMDDARYLANLYGSNAPKVFALTRQLTAAEGLSLAETLSLHYAMDYEMALKPTDYFLRRTNHLLFMRDSLDALIDPVINEMAKHFEWSDQERVAQEDDLRRVIADNDLSALKGHQEG

SEQ ID NO: 20628 - protein, 138 aa, Brassica napus
VVHSECATRKDVWNGKELEGGPEEEEEDTDPYVEIDENTIQHFSHKEHYLRRIHGNGIMYEEQKRCNACIHPIGLYSFFDCMDCDFSLHQKCAECPKRKRHVLHNDRLTLVTNKDLEVFSCYACSRWSNGFMYKDGNM

SEQ ID NO: 20629 - protein, 363 aa, Cyanidioschyzon merolae strain 10D
MRKAILLLADGTCFRGWSSSPPITAVGELVFNTGMTGYQEIVSDPSYHQQIVTFTAPEIGNTGTNLFDQESVHPQVAAILVRNLSPSVPHARSQSSFTSYLQQHSILCIQQLDTRALVRHIRRFGVMHAIASNQLLDLSQLRALLQSSTIQPSPSLVATHSYYEWTEPSHWFYPSSSYPCRILVVDYGVKYNILRLLKSFGASVFVVPPTSDISLWESLQPHGVLLSNGPGDPSTLHDCIHNLKLWLSKHASIPILGICMGHQLLSLAHGASTFALKFGHRALNHPTGFHRLVEISSQNHGYAVHAPSFAKITHFNLHDGTVAGLSYSPKPYISVQYHPEASPGPHDATYLFEHFLRLAIHHV

SEQ ID NO: 20630 - protein, 471 aa, Debaryomyces hansenii CBS767
MTIDSSIRSVAVIGGGAAGAATLHSLVAENYFNKIRLFERKDKAGGLWVYDKEPDRLPQLSTDFSESIEIPDHLPGNYPTRGYLKFAKSATYGYLETNVPEPLMSFSYSNFAEERTEQSIKLFGPDHPFRHHSVVKDYIQTTISSFEDLVQYNTSVEKVMKHGTKWIISLRVINKNGKDHDYWYEEVYDAIIVANGHYSIPYIPKVSGLVELQQQNSDIIQHTKSFRKVSEYKDKKILIVGTGTSATDLISDVLGLSKSPIVVSSRREPGELFKYSFGDSKKILVKPEIFKIDVSDDKLTAHIQFVDGSVVRNVEKIIFATGYLYDFPFFRQNEVTVNKYNRVENLYQHIFKMDDPTLSFVGIVVASITFRVFEYQSTLISGVLRGRVSLPPIEEQNIWEEERIVTKGNSRAFHVIPPEYQKYYEDLLDLVGPYSGLGHKLEPYDKKWEEIINNAISLKLKYWTRNVDLQL

SEQ ID NO: 20631 - protein, 222 aa, Medicago sativa
MAASITAITVENLEYPAVVTSPVTGKSYFLGGAGERGLTIEGNFIKFTAIGVYLEDIAVASLAAKWKGKSSEELLETLDFYRDIISGPFEKLIRGSKIRELSGPEYSRKVMENCVAHLKSVGTYGDAEAEAMQKFAEAFKPVNFPPGASVFYRQSPDGILGLSFSPDTSIPEKEAALIENKAVSSAVLETMIGEHAVSPDLKRCLAARLPALLNEGAFKIGN

SEQ ID NO: 20632 - protein, 197 aa, Medicago sativa
KSYFLGGAGERGLTIEGNFIKFTAIGVYLEDIAVASLAAKWKGKSSEELLETLDFYRDIISGPFEKLIRGSKIRELSGPEYSRKVMENCVAHLKSVGTYGDAEAEAMQKFAEAFKPVNFPPGASVFYRQSPDGILGLSFSPDTSIPEKEAALIENKAVSSAVLETMIGEHAVSPDLKRCLAARLPALLNEGAFKIGN

SEQ ID NO: 20633 - protein, 241 aa, Petunia x hybrida
MSPPVSVTKMQVENYAFAPTVNPAGSTNTLFLAGAGHRGLEIEGKFVKFTAIGVYLEESAIPFLAEKWKGKTPQELTDSVEFFRDVVTGPFEKFTRVTMILPLTGKQYSEKVAENCVAHWKGIGTYTDDEGRAIEKFLDVFRSETFPPGASIMFTQSPLGLLTISFAKDDSVTGTANAVIENKQLSEAVLESIIGKHGVSPAAKCSVAERVAELLKKSYAEEASVFGKPETEKSTIPVIGV

SEQ ID NO: 20634 - protein, 424 aa, Hordeum vulgare
MVVTVAATGPDTAETLHSTTFASRYVRDQLPRYRMPENSIPKEAAYQIISDELMLDGNPRLNLASFVTTWMEPECGKLIMDSVNKNYVDMDEYPVTTELQVCWEKFARYFEVELKEVKLTEGYYVMDPKKAVEMVDENTICVAAILGSTLTGEYEDVKLLNDLLVEKNKETGWNVPIHVDAASGGFIAPFLQPELEWDFRLPLVKSINVSGHKYGLVYPGVGWVIWRSKDDLPEELIFHINYLGADQPTFTLNFSKGASQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIIGELDAHAVHAIKLSTAAAGGDGASKSAVDAATEAFKDLAGKKKAGVC

SEQ ID NO: 20635 - protein, 220 aa, Petunia x hybrida
MSPSVSVTKVQVENYVFPPTVKPPASTKTLFLGGAGHRGLDVEGKFVKFTVIGVYLEESAVQFLAPKWKGKSAEELIHSVDFFRDIVTGPFEKFTRVRFILPLTGKQFSEKVAENCVAHWKATGTYSDAGSRAIEKFLNVVKSETFLPGASILFTQSPLGSLTISFTKDDSISEAGNAVIENKQFSEAVLETIIGEHGVSPAAKCSIAARMSELFKNSLF

SEQ ID NO: 20636 - protein, 570 aa, Magnetospirillum magnetotacticum MS-1
MSDVVTLSVSDRIATVTIDSAPVNAADYPVRAGLQKAFTDLAARTDFDAVLVICAGRTFMAGADIGEFDTGIKAPHHQDLFNLVESCAKPVVAALHGTALGAGTELAMACHYRIADKGARIGLPELSLGIIPGAGGTQRAPRLIGLDAAMDLVLSGKPLPAPKALELGLVDEIAAGDLNAAALAFAKKLVAEGKGVRRTCDMTPKDADKAAEIVAARQAQVAKTMKNRTSPVKALEAMAATTSLSFKEGLKLEADISKQLEHAVEARAMRHLFFADREVRKIPGITKDIKARPIRKVGIIGAGTMGGGIAMCFANIGVPVTIIDVSDENLQRGLGVIRKNYERSVSRGSLSQEQLESRMGLLSASTDYAALKDADLAIEAVFEKMELKKDIFAKLDAVLPAGAILGTNTSIARHRRDRQYHQASGGCHRPALLQPRQCDAAAGDRSGQADRHGRSAHRSRHGQADQEDRCGLQGLLRLHRQPHDGPLWPRGRAHGARRRHAGRSGRRAGGMGHGHGHPGRLRHGRCGSGREHPHRQSAHGPQGPQLLPLLHPSGGQQMAGPEGGARLLPL

SEQ ID NO: 20637 - protein, 446 aa, Escherichia coli
MISEHDFVLERYPRIQRVLNSTVPTLSLNSSTRYEGKITNIGGTIIKARLPKARIGAFYRIEPSQRLAEVIAIDEDEVFLLPFEHISGMYCGQWLSYQGDEFKIRVGDELLGRLVDGIGRPMGSNITAPYLPFERSLYAEPPDPLLRQVIDQPFTLGVRAIDGLLTCGIGQRIGIFAGSGVGKSTLLGMICNGASADIIVLALIGERGREVNEFLALLPQSTLSKCVLVVTTSDRPALERMKAAFTATTIAEFFRDQGKNVLLMMDSVTRYARAARDVGLASGEPDVRGGFPPSVFSSLPKLLERAGPAPKGSITAIYTVLLESDNVNDPIGDEVRSILDGHIVLTRELAEENHFPAIDIGLSASRVMHNVVTSEHLRAAAECKKLIATYKNIELLIRIGEYTMGQDPEADKAIKNRKAIQSFIQQSTKDISSYEKTIESLFKVVA

SEQ ID NO: 20638 - protein, 508 aa, Synechococcus elongatus PCC 7942
MAKRGAIAAGHPQTVAAGLVALEAGGNAFDAAIAALAASWITEPLLTSPAGGGFLLAAQPHQSPRLYDFFCQTPSQRSPEPQDFYPVGVDFGDAIQEFHIGLGSVAVPGLLAGLLRVQAELGRLPRSVVLEPAIALGREGVEINAFGEYCFRLLDPIVTATPEARSLYQPQGQPLRSGDRFRNTDLAAVLEELAAPKGQAFYEHELLPAIANYCAAGGNLQLTDLQQYPVAVRSPLAIPFGNYRLLTNPPPSSGGLLIAFALSLLNQSVINLNPQQHPQDLVQLMRLTNRARRDFLDGALQQAGIDRQFLTGAAFEQAAAGWLNRLGSTTHISVIDAEGNAASLTSSNGEGCGHVLPDTGIMLNNMLGEADLHPLGFHRWPLGQRLGSMMSPSLLWGEDDRPHLVLGSGGSNRIRTAILQVIHRWAVEGYALAEAIAAPRLHWEAGVLNWEPGWDPAGIEAASQPSETAIAWTTPNMFFGGVHAVGLTATGEFCGAGDPRRSGVYGCC

SEQ ID NO: 20639 - protein, 279 aa, Streptococcus pyogenes MGAS315
MVTTVKMTSGYEIPVLGFGTYQAADGEEAYQSTLAAIKADYRHIDTAAIYKNEESVGRAIKDSGVLREDLFITTKLWNDAHSYEGAKDALAASLDRLGLDYVDLYLIHWPNPKALRNTWKEANAQAWQYMEEAVEAGLIKSIGVSNFMVHHLEALQETAKITPAINQIRLAPGCYQKEVVDYCKANEILLEAWSPLGQGEIFDNETMQQLANKYDKTVAQVALAWSLAEGFIPLPKSVHDERIKENMAIFDVSLTPEDKKTIRYLSGMSAISNPDTTSF

SEQ ID NO: 20640 - protein, 458 aa, Triticum aestivum
MARESSPEIDDELFNEVYGKAYSGPVASAANSVIPKANDEKKPLTCEKSDDEDEPRDPNAVPTDFTSREARVWEAKAKATERNWKKRKEEEMICKICGESGHFTQGCPSTLGANRRNADFFERVPARDKQVRDLFTERTINQIEKDVGCKIRMDEKFLFVSGKDRLVLAKGVDAVHKLIQDSKGKHSSSSPKRDRSRSPVRKSVDFRPRHSDSQWSHSPRNVSRSQSKGHYNERPVDARLHDDIPKCPKGSPQAYTNYGAKDHPVQSKSPFRPSYLDEPLRSHGGNSQYAAAHMPNNCSTERHGPDAHLDLKFDLPSYPQTLEELEIEFKREAMELARARDQEEDEENSKHRESLREMRENHMKSVSVTRSMQARKWDEFLEQSFKRQQQAQQTSYAQTGYSDFDQRTAHYAATGPPIDSKNTYPYATDNYSAPRRHAAYGEFQHDRHDDLGRTYGRY

SEQ ID NO: 20641 - protein, 181 aa, Oryza sativa Japonica Group
MGGATSPAAPCLSVCLLPLLFLFLHGCWSCVAIERERTLAMIKPDGLSGNYTERIKEVILESGFDIVKEAVVQLDAERASLFYAEHSGRSFFDSLVKYMTSGPVLVMILERPDAISHWRVLIGPTDARKAKISNPNSIRAMCGVDSEKNCVHGSDSPQSAAREISFFFGDVRSDTVEHDEL

SEQ ID NO: 20642 - protein, 277 aa, Corynebacterium glutamicum ATCC 13032
MSSVARKHLLSLADWNRGELEALFELAEQYEAGGGPRFDGAAAMFFPPTSLRTRLSFERGATAMGLQPITFPSDSLDKDEDLVDVVGYLSQWADVVVVRHPQLTALQRLASADAAPVINAMTSENHPCEVLSDLYALSRHHDISALRYLFVGGDGNIARAWWEAAQAFGLEMRQSCPEELRVVGMPWEENLPHAIASADVVLTDGPGRHAELLEPYRVTAALLDRAPRGVRLAPCPPFIRGREVSADAIEHPAFVGYSFKRHLMPVQQAILARSINA

SEQ ID NO: 20643 - protein, 433 aa, Prochlorococcus marinus str. MIT 9215
MKSLDSKTPNQDWHPNIWPPFTQINNSKPQIEVTHGQDALLFTKNPKKELIDAISSWWVTLHGHSNQYIADAIFNQSKKLEQVIFADFLHPQAKKLAERLSELTKLERLFFSDNGSTAVEVALKIAFQSWQNRGETRNQIVAFDGAYHGDTFGAMALGERNIFNENFDNLMFPVKRVPWPSTWMNDEEVENKENEAIQKLETLLKTPTVAVILEPLVQGAGGMNMVRPQFIKKVSEIINNNNSLLIADEVLTGFGRCGSLFAFQKAKIVPDLISISKGLTGGFLPMGITLCKEKIFQSFIDDSPRKTFWHGHSFTANPLGCAAANASLDLLEKEPHKYLSFEEKHLSHLIKFQNLPYIKKIRVSGTISAFDLDIGNKKGYFNNIGKEIKSLAMEQGLFIRPLGNVIYLLPPLCITDDQLEKSYWIIRQILENL

SEQ ID NO: 20644 - protein, 164 aa, Triticum aestivum
  misc_feature (98)..(98): Xaa can be any naturally occurring amino acid
  misc_feature (106)..(106): Xaa can be any naturally occurring amino acid
  misc_feature (142)..(142): Xaa can be any naturally occurring amino acid
  misc_feature (150)..(150): Xaa can be any naturally occurring amino acid
SRSSSPPSYGYSAPAPRGGYTAAPYYSPSPFVSFGPAVGIGFGGSGFLVTLIGFAAFLYLAGFLSDSSGGTSVLTETDKTTVLKLQVGLLGMARSFQXKELDQIAXKADTSTPAGLSYVLTETTLALLRHPDCCISAYSSVXDVKRNVDXGEKRSINFNLGEGQ

SEQ ID NO: 20645 - protein, 193 aa, Trichodesmium erythraeum IMS101
MPKMFSSPESQENGQSQETYITLTDEAERILCCTIEYSLESDDEEYVMLLPLDLPVEIFTWGPEDVEQASIPVDNELEIDKIFDTAKVVLEEQNLVLQRTAITLTVTGELPEWGEDELDEVDENDEASEYYEELATFLYEDRKYAIYTPLDPFLIPARKSDNGKLELLSEEEFKQIQPMVQTMLENQLFNDME

SEQ ID NO: 20646 - protein, 258 aa, Chlamydomonas reinhardtii
QVFLTPTHLCIVMEFAPGGDMFEYVVRKNGLREDEARWFFQQLIVGLDYCHRMGVVNRDIKLENTLLDSSPRPLVKICDFGYSKHEKFQSAPGSRVGTPAYLAPEVILTTKGKTYDGKVDWMHARSSRKHGAVDTTRRARRIRHVDYHIPPHVRASEDCKDLLAKILVADPHKRITVDGIYNHKWYLKGLPPGVREMNDRVQPPPEGLQSVEEIKRLIEEARHVGVGAPGYVNPVETDEYIDDAMDNMYDEGSLDYND

SEQ ID NO: 20647 - protein, 172 aa, Populus trichocarpa
MDRDETGCQAPPERPILCINNCGFFGSAATMNMCSKCHKDMLLKQEQTKLAASSIGSIVNGSASSNVNEPVIADTINVQINAVEPKTITVQPSCASVSGERVEAKPKEGPSRCTSCKKRVGLTGFKCRCGDLFCASHRYSDKHDCPFDYRTAAREAIAKANPVVKAEKLDKI

SEQ ID NO: 20648 - protein, 482 aa, Pseudomonas syringae pv. tomato str. DC3000
MLEVPLLIGGQSCPARDGRTFERCNPVTGEVVSRVAAATLEDADAAVAAAQAAFPGWAALAPGERRARLLKAAEQLQARSGEFIAAAGETGAMANWYGFNVQLAANMLREAASMTTQITGDVIPSNVPGSFAMALRQPCGVVLGIAPWNAPVILATRAIAMPLACGNTVVLKASELSPAVHRLIGQVLQDAGLGDGVVNVISNAPADAAAIVERLIANPAVRRVNFTGSTHVGRIVGELSARHLKPALLELGGKAPFLVLDDADLDAAVEAAAFGAYFNQGQICMSTERLIVDQKVADVFVAKLTAKIETLRAGHPDDSQSVLGSLVDVSAGSRIKALIDDAVNLGATLVIGGQLQGSILQPALLDGVTDRMRLYREESFGPVAVVIRGEGDEALLALANDSELGLSAAIFSRDTGRALALAQRVESGICHINGPTVHDEAQMPFGGVKSSGYGSFGGKASIEHFTQLRWVTLQNGPRHYPI

SEQ ID NO: 20649 - protein, 137 aa, Populus trichocarpa
MESDMVMHYGGCHCRRVRWRVQAPSSVVAWNCNCSICSMRASIQFIVPSEKFELLGDSKEFLTTYTFGTHTAKHTFCKFCGITSFYVPRSNPDGVSITYRCVDPGTLTHVEIKNFDGQNWERSYNETFASSSQGAGC

SEQ ID NO: 20650 - protein, 434 aa, Vibrio angustum S14
MSKIVKVLAREIIDSRGNPTIEAEVHLEGGFVGMAAAPSGASTGSREALELRDGDKSRFLGKGVLKAVAAANGPIAEALIGQDAKDQAAIDQVMIDLDGTENKSNFGANAILAVSLANAKAAAASKGMPLFEHIAELNGTAGQFSMPLPMMNIINGGEHADNTVDIQEFMIQPVGAKTLREAVRMGSEVFHSLAKVLKSKGMSTAVGDEGGFAPNLESNEAALKAIKEAVEAAGYELGTDITLAMDCAASEFYNKEQGIYDLKGEGKQFTSEEFNYFLKDLTEKFPAIVSIEDGLDESDWAGFKHQTELLGDKIQLVGDDLFVTNTKIFAEGIEKGITNSILIKLNQIGSLTETLAAIKMAKDAGYTAVISHRSGETEDATIADLAVGTAAGQIKTGSMSRSDRVAKYNQLIRIEEALGERAPFNGLKEVKGQA

SEQ ID NO: 20651 - protein, 465 aa, Rhodopseudomonas palustris CGA009
MSLARLATPKDRTPKGLIDLIGNTPLVQLTRLDAGPCRLFAKLEGQNPGGSIKDRPALAMIEAFERSGELRPGGTLVEATAGNTGLGLALIAALKGYRLVLVIPDKMSREKVLHLKAMGAEVVMTRSDVGKGHPAYYQDLAQKITSETPGAVFVNQFANPANPLAHEYGTAPEIWEQMDRRVDAVVCGIGSGGTLTGIARFFQRASPSTEIILADPKGSVLVDVVEGREPGPVGSWLVEGIGEDFVPSNAELKLVTRGYTVTDAESFHAARELLRREGILAGSSSGTLLAAALRYCREQTRPKRVVTLLPDGGNKYLSKMFNDTWMADQGFVPRRHDGDLRDLIVRRHDEGASITVAPEDTLNFAYSRMKLYEVSQLPVLVDDRVVGIIDESDLLMATIGDPAKFAEPVHSAMSKRVETVEASAPFESLMPVFDRGLVVVVVDGSRFLGLITRIDLINHLRSKVH

SEQ ID NO: 20652 - protein, 183 aa, Triticum aestivum
  misc_feature (11)..(11): Xaa can be any naturally occurring amino acid
MKGELHCYLDXAENCDNDFHGNHITYTDTCTVSGEDLKKHQSMDSIRDLVMSRERSNPRGKADLIVFCNGGFKDLDNAKSEGELLSELVSVLKMSEARYTVLYASQPYGLLENLSNLPLARYLAEKTNTTTKSGLGKCDGECLVKSSLLEGTFVGLVLLIILISGLCCMMGIDTPSRFEAPQD

SEQ ID NO: 20653 - protein, 884 aa, Gibberella zeae PH-1
MLWAAPAMMEHSPKPPSRPRYAAMRDDQERDDQGERALDEQVERSPEEIEVLDRGQGIIAPSLLQGSTVDTPHGDDAKHRLAITYGLQNPQCDHASDPQQNQNQAPGVQIEKEGPGNSHRVGHLCQSIEHLRRGEFSRYLLRANVNQTMNNSPRGDSIRQGHLTLAKNGDLERDHLAGATLQGNDPYGQSPQNSYHNSPTRSPYGSSRGGRNGQQSHPQGSNYGPPSGPSSQYHPNPSRSPPHSAPTGPMQQYPQGGSYRGGYRGGGFRGGSFGNRGRGGFKNSHWNQGPPQRGHHDDLGNGRFSNVDEPSAMDIDRMDDGDESYQTHDRNAEDGADGLATPNRPPPTGPGSQSQSGGSGSKFSFAFKPSSKPALTAPKPEISQKLNAAPRRDAQKDSRDNDRDRSRDHDRERERDRDRDREREREREREREREKGRERDRDREPPRSAPTEPASSRSRHDRRQPPEGPRVTPRMRKVKKMMKRPKPRPTLPADLVDSESVFFRKPGNESVVGSGTYGKVFKGLNVYTKGMVALKKIRMEGERDGFPVTAVREIKLLQSLRHVNIVNLQEVMVEKNDCFMVFEYLSHDLTGLLNHPTFKLEAAQKKDLAKQMFEGLDYLHTRGVLHRDIKAANILVSNEGVLKIADFGLARFYAKRHQLDYTNRVITIWYRSPELLLGETKYTAAVDVWSAACVMVEIFDRNAIFPGDGTEFNQLEKVYNVMGTPNLKDWPGLVEMPWFELMRPTVKKKNIFEEKYREKMSPAAFELLSVMFHYDPVKRPSASEVLQHTYFTKEEPPARQATELSTHNDWHEFESKALRKENDRREREARKLAKEGASRDADKDKDKKRVNEGIDQPDAKRVQVDKNGGNKPTPAVTSSKPTEA

SEQ ID NO: 20654 - protein, 493 aa, Pseudomonas syringae pv. tomato str. DC3000
MSASDGTPFLQRAIDAECIFNGNWIPSSSALLPVIEPATSELLMNTAMAGAADIAIACREAALAQPAWAAMGPREKAEIFLMAADHAVCAFDELALYVARETGGSLHKGQHEVNETIVLLRQAAGMLSQAHGHGVILPSAAGRLSYARRVAHGVVGVISPFNFPLVLSLRSVAPALAAGNAVVLKPDPQTPISGGFLIARLFEEAGLPKGLLHVLPGAADAGEALCRDTNVQMITFTGSTGAGRKVAEAAGRNLKKVSLELGGKNPLVILEDADLDLAASNAAFGAWLHQGQICMATGLILVHESIVAAFTRKLADKARALTVGNAARGQAALGPLINQRQLQHVHQVVSDSLQAGAQLETGGEYEGLFYRPTVLSGVKPGMRAFEEEIFGPVAVVVSFSSDEQAIELANRSEYGLAAAVISPDVGRATALGDRLRCGMLHINDQTVADECINSFGGRGASGNGSSAGSPSDWDEYSQWQWVTVKNQAPVYPF

SEQ ID NO: 20655 - protein, 806 aa, Oryza sativa
MALSTAQTGESMHSSTFASRYVRTALPRFRMPEKSIPKDAAYQIINDELMLDGNPRLNLASFVTTWMEPECDKLMMAAINKNYVDMDEYPVTTELQNRCVNMIAHLFNAPIGDDETAVGVGTVGSSEAIMLAGLAFKRKWQNRMKAEGKPHDKPNIVTGANVQVCWEKFARYFEVELKEVKLTQGYYVMNPEKAVEMVDENTICVAAILGSTLNGEFEDVKMLNDLLTAKNAETGWNTPIHVDAASGGFIAPFIYPELEWDFRLPLVKSINVSGHKYGLVYAGVGWVIWRNKEDLPDELIFHINYLGADQPTFTLNFSKGSNQIIAQYYQLIRLGFEGYKDIMQNCRDNATVLREGIEKTGHFDVVSKDSGVPLVAFSLKDSSRYTVFEVAESLRRFGWIVPAYTMPADAEHVAVMRVVIREDFSRGLAERLITDLTKTVADMDAHAVKKAAAEPAKKTVREIEKEVTTYWRSFVARKKSSLWEDEGNGGSGGPRCCSSSSPSQLPVRSSTARESLDHISINCTGGVGATSGCRSVHSRRSAPTRRARLLVPAQPRLCLDSPDWRQSAAGREWEQERDDGDDRRGSWLASESWWFVGDDATAAAATRVRREKRRACAGAGGAGGDGAARAPPSSSSASTRAAASTPGGGMRGSRMHYLRYYDAAFDAVDAAGLLETRPARAKVEEMFAREIRNAVAFEGAERFERHESFAGRRRRMEDGGGLQWGSKAEEKCLLPSSSLARRPRRQPSPPVSLRPDGSLPPAVAAAPLVLPLPRASAAEPPRCAPMPPTAAPLVLPPPLPTEKERI

SEQ ID NO: 20656 - protein, 335 aa, Fusobacterium nucleatum subsp. nucleatum ATCC 25586
MVKISVIGSGGWGIALAILLHKNGHNLTIWSFDKKEAEELKINRQNKTKLPNILLPEDIKVTDNLKEAVDNKDILVLAVPSKAIRSVSKSLKDIIKDNQIIVNVAKGLEEDTLKTMTDIIEEELKEKNPQVAVLSGPSHAEEVGKGIPTTCVVSAHNKELTLYLQNIFMNPSFRVYTSPDMIGVEIGGALKNVIALAAGIADGLNYGDNTKAALITRGIKEISSLGVAMGGEQSTFYGLTGLGDLIVTCASMHSRNRRAGILLGQGKTLDEAIKEVNMVVEGIYSAKSALMAAKKYNVEIPIIEQVNAVLFENKNAAEAVNELMIRDKKLEIQSW

SEQ ID NO: 20657 - protein, 314 aa, Aspergillus nidulans FGSC A4
MASTTKESAKPAVDFLHHPYTRAALPFINGGLAGMTATVVIQPIDMIKVRLQLAGEGVRTGPRPSALGVARNIIASGKVLDLYTGLSAGLLRQAVYTTARLGFFDTFMKALTKNADTANRKVTFAERAGAGLTAGGIAAMIGNPADLALVRMQSDGLKPPEARAHYRSVIDALFRISKAEGVTALWAGAFPTVVRAMALNLGQLAFFAESKAQLKTRTSLSAQNQTFAASAIAGFFASFLSLPFDFVKTRLQKQQKDPKTGQLPYKGMFDCARKVVRDEGWLRFYRGFGTYYVRIAPHAMVTLIVADYLNLITK

SEQ ID NO: 20658 - protein, 404 aa, Brucella melitensis 16M
MIRTERRNMMFRTLDDANVQSKRVLVRVDLNVPMANGEVTDLTRIERIVPTIAELSRKGAKVILLAHFGRPKGVASDENSLKHVVKPLSKVLDHSVHFAEDCIGDKAKAAVDALKDGDVLLLENTRFHKGEEKNDPEFVQALAANGDLYVNDAFSAAHRAHASTEGLAHVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAIVGWHFAADTPHQTYGVDSVPGDAMILDAGELSTDLIASAIDDAATLVWNGPLGAFELRPFDTATVKVARHVAKRTKEGKLVSVGGGGDTVAALNHAGVADDFTYISTAGGAFLEWMEGKPLPGVDVLKK

SEQ ID NO: 20659 - protein, 333 aa, Glycine max
MEIGLSIPLQRGHVHVATSFGSTTPTLSEKRSMFILGMGFMGQSLARKLHNQGWVVSGTCTAHVKKKQLQDMGFHVHLFDANHPDVDVLQVLKNYTHILVSVPPLVGIGDPTLRHEELLRSSMIDGDLRWLCYLSSTSVYGDCDGELVDEDYPTNPKSESAKLRLASEEGWSNLAHNLGISLLLFRLGGIYGPGRSAVDTIIKQKPMSEGQKRRKNRKYTSRIHVDDICQALMATVLAPPPREVYNIVDDDPAPREEVFEYATRLVEKKWPGSKLQSVEQRQKEWSNVKNPRGEKRLCNARMKRELGVQLLYPDYKSGLKSIIHQIQTPFHSH

SEQ ID NO: 20660 - protein, 335 aa, Brucella melitensis 16M
MAVRVAINGFGRIGRNILRAIVESGRTDIQVVAINDLGPVETNAHLLRYDSVHGRFPKEVEVAGDTIDVGYGPIKVHAVRNPAELPWKEENVDIALECTGIFTSRDKAALHLEAGAKRVIVSAPADGADLTVVYGVNNDKLTKDHLVISNASCTTNCLAPVAQVLNDTIGIEKGFMTTIHSYTGDQPTLDTMHKDLYRARAAALSMIPTSTGAAKAVGLVLPELKGKLYGVAIRVPTPNVSVVDLTFIAKRETTVEEVNNAIREAANGRLKGILGYTDEKLVSHDFNHDSHSSVFHTDQTKVMDGTMVRILSWYDNEWGFSSRMSDTAVALGKLI

SEQ ID NO: 20661 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGRQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFSAAVAYYDSYRAAVLPANLIQAQRDYFGAHTYKRIDKEGVFHTEWLD

SEQ ID NO: 20662 - protein, 125 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGT

SEQ ID NO: 20663 - protein, 515 aa, Coprinopsis cinerea okayama7#130
MPRERSMSGTIPSMETQHDDLKDNTIIIVLGASGDLAKKKTFPALFGLYRQGFLPRDTKIVGYARTKMDKAEFEKRTTSYIKGVDENPEVANSLEAFKQTLSYVAGGYEDGESFDNLNAHLESIESHYQTKECNRIFYLALPPSVFIPVTKNIKEHCYVTKGGVNRIIIEKPFGKDLQSARDLLGSVKQYWSEEETFRIDHYLGKEMVKNLLVLRFANVAMGAFWDKNSISNVQITFKEPFGTEGRGGYFDEFGIIRDILQNHLLQVLTILAMERPVSFAAEDIRDEKVKVLRAIPPIEKEDTLLGQYVSANGKPGYLDDDTVPPGSICPTFAATTLFIHNPRWEGVPFILKAGKALNEAKVEVRIQFKDVTQGIFKDIARNELVIRIQPSEAVYLKINAKTPGLRTRAIPTEMDVTYKRRFTEAKIPEAYESLILDALRGDHSNFVRHDELDYAWKIFTPILHWIDGKNGPRPRPSAYPYGSRGPKELTAFIEKYGYKRLADAYFWPVTNMAVL

SEQ ID NO: 20664 - protein, 465 aa, Brassica napus
MPSMICLLLGFVVSSFLFIFVSKKLLSRHNMSEVSRLPSVPVVPGLPLIGNLLQLKEKKPHKTFTRWSELYGPIYSIKMGSSSLVVLNSTETAKEAMVTRFPSISTRKLSNALTVLTCNKSMVATSDYDDFHKLVKRCILNGLLGANAQKRKRHYRDALIENVTSKLHAHTRDHPEEPVNFRAIFEHELFGVALKQAFGKDIESIHVDELGETLSREEIFKVLVHDMMEGAIDVDWRDFFPYLKWVPNNSFESRIQQKHKRRLAVMNALIQDCLKQNDSDDCYLNYLMSEGKTLTKEQIAILVWETIIETADTTLVTTEWAIYELAKHQSVQARLCEEIKSVCGGEKIKEEQLPLLPYVNAIFHETLRKYSPAPLVPIRYAHEDTEIGGYYVPAGSEIAINIYGCNMDKKRWEKPEEWWPERFLDDRYELSDLHKTMAFGAGKRVCAGALQASLMAGIAIGRLVQ

SEQ ID NO: 20665 - protein, 166 aa, Coprinopsis cinerea okayama7#130
MKLLMSDFEVNLVNDNMQEFCVRFYGPPETPFAGGVWKIHVELPDQYPFKSPSIGFMNKIFHPNIDELSGSVCLDVINQTWSPMFDMINIFEVFLPQLLRYPNPNDPLNGEAAALLMRHPEEYETKVKEYVKRYATKEAADALSSDKTEDEDEEMSDIGSISDDES

SEQ ID NO: 20666 - protein, 125 aa, Escherichia coli
MSKQQIGVVGMAVMGRNLALNIESRGYTVSVFNRSRDKTEEVIAENPGKKLVPFYTVKEFVESLETPRRILLMVKAGAGTDAAIDSLKPYLDKGDIIIDGGNTFFQDTIRRNRELSAEGFNFIGT

SEQ ID NO: 20667 - protein, 65 aa, Dendrobium hybrid cultivar
GEAGLFCWVNMETLMDEKTPEGELRLWKVIVDELKLNISPGSSCCCSEPGWFRVCFANMSRETLE

SEQ ID NO: 20668 - protein, 158 aa, Vibrio angustum S14
MRIGHGFDVHKFGGEGPVIIGGVAIPYEQGLIAHSDGDVALHAVCDALLGAIGAGDIGRHFPDTDAEWAGADSRFLLRDVYSKVKAQGYSLGNVDVTIIAQAPKMAPYIDAMCQAIAEDLETDIANVNVKATTSERLGFTGRKEGIACEAVVLITKVS

SEQ ID NO: 20669 - protein, 506 aa, Oryza sativa Japonica Group
MERDAWLLCAALAAATVVYYLACTTSRRAQRRRLPPGPTPLPVIGNVLSLRGNMHHALARLARERYGPVMALKLGLVTAVVVSSPDAAREAFTKHDRRLAARAVPDTSRVRGFADRSMIWLPSSDTRWKTLRGVVATHVFSPRSIAAARGVRERKVRDIVGYFAAHVGEVVDVGEAVYSGVVNLVSNAFFSGDVVDVGEESAHGLREAVEDIILAIAKPNVSDLFPFLRPLDLQGWRRWAEKRYDTVFDILDNITNSRLADASAGNHAGDFLDSLLGLMSYGKIARDDVTTIMFDVFGAGTDTIAITVQWAMAELLRNPSIMAKARTEMEDVLAGKKTIEENDTEKLPYLRAVIKEAMRLHPVAPILLPHQAAEDGVEIGGYAVPKGSTVIFNVWAIMRDPTAWERPDEFMPERFLQRAEVDFRGKDFEFMPFGAGRRLCPGLPMAERVVPFILASLLHAFEWRLPDGMSAEELDVSEKFTTANVLTVPLKAVPILASSASELQAS

SEQ ID NO: 20670 - protein, 311 aa, Chlamydomonas reinhardtii
MTSDITSTSSLNHGTLADYQLDRLLGRGKYSQVYLARETHTGQMVAIKRVEIFDMMDPVSRQACVKEVKILQNVEHPNIVKCFRSFLSEADNELVIVLEWAEAGDLGQLIKQRAEAGQPFSEEQVWRQFQQVCNALKHMHDRRMMHRDLKPSNIFVTASGDLKLGDLGLSRYFSSRTLQANTTVGTPYYMSPEVVRGQPYDFSSDIWSLGCLLYELVALRNPFYKENQSLYVLGKNIQNCAYEPLPPSVPDELRTLVTSMLQPQPSSRPSISHVADQVDLYVATHHPPPPAAAAAAGPGGERAAAIFDCNR

SEQ ID NO: 20671 - protein, 76 aa, Zea mays
STLIMASLDHQLKSPSPLILPVKDAGTPLAESEGIDLSKDVVPSATERDIYTGDKLEIVVINKGGTMREYFDPEKD

SEQ ID NO: 20672 - protein, 565 aa, Corynebacterium glutamicum ATCC 13032
MRGYQRSWLKGDVIAGITVAAYLVPQVMAYAVIAGLPAVVGLWGVLAPMALYFFLGTSRNLSVGPESTTALMTAAGVGALVGAAGGPERYAEVAALLAIAVGIVCAVGFIGRLGFLTRLLSRPVLVGYLIGIAVLMIVSQLSKVTQVNVESGQTWQEIISFIKVAGQAHIPTVILAVVVLSLLYLANWLTPKFPSTLMVLLLSAAAVGFFHLDRFGLEVIGEVPRGLPQPSIPSIGDLEIWSLLPYAVGIAIVGFSDNVLTARAFASGKDEVIDSNQELLALGTANLANGFFQGFPVSSSGSRTVLGDTAGARTQVHSLVVVALVIMVLLFAGPVLESFPDAALGALVIYAATQLIDIAEIKRIARFRKSELVITAATAASVVASGVLAGIGVAVTLSILDLIRRITRPYADVLGYTPGMAGMHSLEDYPESTAVEGLVVFRYDSPLFFANADDFSKRAIEAVDEATQPVHWFLLNAEANTEVDLTAVDAMEALRKTLEERGIRFAMARVKQDLRRSLEPAGFIESVGEEYIFATLPTAVKGYSVEFRDRFGNYPEGVPKEILEL

SEQ ID NO: 20673 - protein, 428 aa, Trichodesmium erythraeum IMS101
MKNVLSIILGGGAGTRLYPLTKLRAKPAVPLAGKYRLIDIPISNCINSEIQKIYVLTQFNSASLNRHITRTYNFSGFSDGFVEVLAAQQTKDNPEWFQGTADAVRKYIWLFKEWDIDYYLILSGDHLYRMDYRDFVQRHIDTKADITLSVLPIDEARASEFGVMKIDNSGRIVEFSEKPKGNALKAMAVDTSILGVSPEIATKQPYIASMGIYVFNKDAMIKLIEDSEDTDFGKEILPKSAQSYNLQAYPFQGYWEDIGTIKSFYEANLALTQQPQPPFSFYDEQAPIYTRSRYLPPSKLLDCEITESIVGEGCILKKCRIDHCVLGVRSRIEANCIIQDSLLMGSDFYESPTERRYGLKKGSVPLGIGAETKIRGAIIDKNARIGCNVQIINKDNVEEAQREEEGFIIRSGIVVVLKNATIPDGTVI

SEQ ID NO: 20674 - protein, 107 aa, Triticum aestivum
MAEQTFIMIKPDGVQRGLIGDIISRFEKKGFYLKGMKFMNVERSFAQQHYADLSDKPFFPGLVEYIISGPVVAMVWEGKDVVLTGRRIIGATRAWEAAPGTIPGDYA

SEQ ID NO: 20675 - protein, 574 aa, Prochlorococcus marinus str. MIT 9303
MLRLEHVNKIYPTHEVLKDVTWEIKPGDRIGLVGVNGAGKSTQLKLIAGLEEASSGQIVRQGNPRIAYLQQEFDVDPCRTVREELFQAFGEAAAVVHQQRLVETAMATKRAAEDSVFLDSLIKDLSRLQNRFEALHGYELEARIEKLLPTLHFTSEGADQRVGDYSGGWQMRIALGKILLQDPDLLLLDEPTNHLDVDTIQWLEDYLIKQTAAMVVISHDRTFLDRICTQIVITERGVSRTYLGNYTAHLEQKALEEEATQAAFERQQKDLASQQAYVDRFRASATRSTQAKSREKLLEKVERIEAPVKSVSGPSFRFPDAPRSGRQVAVIEDLSHSYGDKILFLGAHLEVEPGDRIAFIGPNGAGKSTLLRLIMGLESPDDGKASLGEHNVMAGYFEQNQAEALDLQKTVIDTMFEAVPDWTQTQVRSLLGSFCLSNDAVFKDVDNLSGGEKARLALALMLVQPCNLLVLDEPTNHLDIPAKQMLEDALQAYEGAALLVSHDRYFISRVANRIVELRDGELILYRGNYAYFQEKKSEEQAAAAAAMTLAEQEVKRLANRDRQRKRQARKKGAA

SEQ ID NO: 20676 - protein, 493 aa, Methanosarcina mazei Go1
MSNKPENLTLITDDGLRLDGRRADEIRPMKIEVGVLSRADGSCYLEWGRNKILVGVFGPREAHPRRSQRADSAVIRYRYNMASFSVEDRARPGPSRRSIEISKVSREAFEPVIMAELFPKTAIDIFVEVLQADAGTRTAAINASSIALADAGIPMKGLITSCAFGKVDGKIVLDLNKEEDNYGEADFPVAMTQDGEITLIQMDGNLTPDEIKQGLELVKKGCKEILEIQQAVLRKKFETPVEEVSEETAPEKGAEKEVLEPSPVAAIVEETPEEAEEPEVEISEEVEAEILASEVIPDFEDELEEEIEEELEESEEDLETEEEEFEEEALEEEAEPEEDLEEDLEEDLGEELEEEEEELEEEEFEEEALEEETELEASLECAPELKEFDEIEARLEKEDASIEAEEEIEPEAEEATEEGLEEEAEIEETAASEEENIEAEAEAEEEAEPEVEAEEISTEAEEAEEEPEEEKSEGPWKVVKDPSEAGTRGEKDE

SEQ ID NO: 20677 - protein, 423 aa, Gibberella zeae PH-1
MDVDMIHDEEDDQGERLINEEYKTWKKNSPFLTALTWPTLTVQWFPDVKEPEGKNYKIHRLLLGTHTSDESPNYLQIADVQIPKVVAPNPDDYDEERGEIGGYGKSGDVAAIKCDIVQRIEHPGEVNKARYQPQNPDILATLCVDGKILIFDRTKHPLDPTSTGKVNAQIELVGHEAEGFGLNWNPHEEGCLASGSEDTTMRLWDLKTLKADSRILNPSRTYRHHTQIVNDVQYHPISKNFIGSVSDDQTLQIVDIRHSETNKAAVVAKRGHLDAINALAFNPNSEVLVATASADKTIGIWDLRNVKEKVHTLEGHNDAVTSLAWHPTEAGILGSASYDRRIIFWDLSRVGEEQLPDDQDDGPPELLFMHGGHTNHLADFSWNPNEPWLVASAAEDNLLQIWKVAESIVGKDDGDLPIDELDR

SEQ ID NO: 20678 - protein, 266 aa, Methanosarcina mazei Go1
MKKMSEIIATLKKDYIYNLMIKDKRQDGRGFKDFRELKLETNVISKAEGSAKVTLGNTQVLVGVKLQTGTPFPDSQDEGVIITNLELNPIASPEFEPGPPREDAIEMARVVDRGIRESGAIDIKKLCITVGESVWIVFIDVHILNNDGNIIDASCLAAIAALMTTMVPNEQQGLGENVPLAMKEMPVGITLAKIGSKLMVDPSLDEEAVCETKLTIVSSSDGSVAGMQKMGPVPLTEAELFEAIDMAIEKAAEIRGLYLEGLAKSE

SEQ ID NO: 20679 - protein, 454 aa, Glycine max
MASRIVQQQQARGEAVVGGGKQQKKNGVADGRNRKALGDIGNLANVRGVVDAKPNRPITRSFGAQLLANAQAAAAADNSKRQACANVAGPPAVANEGVAVAKRAAPKPVSKKVIVKPKPSEKVTDIDASPDKKEVLKDKKKEGDANPKKKSQHTLTSVLTARSKAACGITNKPKEQIIDIDASDVDNELAAVEYIDDIYKFYKLVENESRPHDYIGSQPEINERMRAILVDWLIDVHTKFELSLETLYLTINIIDRFLAVKTVPRRELQLVGISAMLMASKYEEIWPPEVNDFVCLSDRAYTHEHILTMEKTILNKLEWTLTVPTPLVFLVRFIKASVPDQELDNMAHFLSELGMMNYATLMYCPSMVAASAVLAARCTLNKAPFWNETLKLHTGYSQEQLMDCARLLVGFYSTLENGKLRVVYRKYSDPQKGAVAVLPPAKFLLPEGSASQHS

SEQ ID NO: 20680 - protein, 707 aa, Pseudomonas syringae pv. tomato str. DC3000
MNLMHKALGYQSLGDIVHDQTFLEVTGVGPDFFLKMESLNPAGSIKLKTAVGLVNDVQARGLLGPQTTLIESSSGNLGVALAMICAERGIPFTCVVDPNSSSHNIRMMRSYGAQVIQVEIPDANGGFLGTRIALIREKVASDPRYVWLNQYENAANPRAHARTTAHSISRHFGHVDYLFVGAGTTGTLMGCLQHFQRHHPTTKIIAVDSVGSVTFGTPASRRFIPGLGTSQRPPIFNGDGIHALEMVPEANAVAMCRILARSKGMLVGGSTATVIAAVHAWRERIEPGSVVVALSPDWGERYLDTLYDDQWVEQRFGREVLSMTLTDLSNSKNTPLCGREIARESGGSLVTPSRASSRPQGVCSTCEVAAGRLAQAAFHVVDGEVTARLLAADPLACIDDVQAAYLAHEAGRTVNPDSYFLRFPEVPANRIIALPASLSGDQPVSGIKWISSFPGNVDTGLQRASAVLILNDPVTGYAFACLEASRISAMRTAASAVLGARWMNRQQRYVRRMAFIGAGFIARTILDMFVSDGWAMDSVSVFDQHEDSALALISHAAGRHRLNGEQTDLHACLQADVVVFATTAPRPYVLEPVFRPGQVVLNISLRDLGPEVIAQADNILDDVEHCLKAQTSPDLAVRHYQHRSFITGTLAQLMTGQVELSPDRASIFSPFGLGVLDLAVGQRVYRQALAEGSALPVPRFFFESNRW

SEQ ID NO: 20681 - protein, 125 aa, Escherichia coli
MSKQQIGVVGMAVMGRNLALNIESRGYTVSIFNRSREKTEEVIAENPGQKLVPYYTVKEFVESLETPRRILLMVKAGAGTDAAIDSLKPYLDKGDIIIDGGNTFFQDTIRRNRELSAEGFNFIGT

SEQ ID NO: 20682 - protein, 155 aa, Dehalococcoides sp. CBDB1
MGKEFSGVLNGQGLKIALVVSRFNEFITSKLLSGAKDSLERHGVSADNTDVAWVPGAFEIPLVAQKLAKSGRYDAVVCLGAVIRGSTPHFEYVSSEVSKGIARVGLDAGLPVIFGVITADSIEQAIERAGTKMGNKGFDAATQAIEVANLMKNLT

SEQ ID NO: 20683 - protein, 266 aa, Physcomitrella patens subsp. patens
MDRYQRVEKPRPEIPISENEIRITTQGKMRNYITYATTLLQDKGSSEIVLKAMGRAINKTVTIAEIIKRRIAGLHQNTSIGSTDITDLWEPIEEGLLPLETTRHVSMITITLSTKELEKSSIGYQPPLPADQVKPLVEFDYEGDGSPRGGRGRGRGRGRGRGRGNDVENSEYNGLDGGWGRGRGRGRGRGRGRGAYRGRGRDQDAGGFDEPNADGPPRGRGTDFPQETSYSGRGRGRGRGRGQGRGQGRGFRTDGPTQEQPQSGAA

SEQ ID NO: 20684 - protein, 492 aa, Coprinopsis cinerea okayama7#130
MQGLNTQNIRKTSSRVNINQSRQPSGPSPAATAQGAAKSPDYVYFDRNPSTCFSEESQIRAKSAQLKLENYYKVAVESAVERNARLQEDTLISDSRKNRQLQQLGKKESTFLRLRRTKIGLNDFRTVKVIGKGAFGEVRLVQKTDTGKIYAMKLLRKNEMLKKDQLAHVRAERDVLAESDSPWVVSLFYSFQDPTYLYLVMEFLPGGDLMTMLIKYDTFSEDVTRFYMAECVLAIEAVHRMGFIHRDIKPDNILIDKDGHIKLSDFGLSTGFHKQHDSSYYQRLLESAKNSSNNTPQSSRNSVMVNSINLTISNQDIATWKANRRKLAYSTVGTPDYIAPEIFLQKGYGKECDWWSLGAIMFECLVGYPPFCSESTHETYQKIIHWRHCLSFPSDIHLSAEALDLIQRMITSADQRLNVDQIKRHPFFYGVDWATIRQIDAPFVPRLSSITDTSYFPTDEIDQVTDDIPQDASSADKDLAFLGRPAWGETMF

SEQ ID NO: 20685 - protein, 403 aa, Dehalococcoides sp. CBDB1
MPNARVEEVIADIKAGRFVIVVDDYDRENEGDLVMASEKVTPDAINFMAKNARGLICVSLIAERLEQLKIPMMVTENTSPYSTGFTVTVEARKKVTTGISAADRAATVQVLIDPAATREDIAMPGHMFPLRAREGGVLVRAGHTEASMDLARMSGLYPSGVLCEIMNDDGTMARLPQLEQKAAEWGIKIISIKDIISYRRRTEKMVKKVTEAELPTSHGQFKAVAYKSQFDADEHIALVMGDISGPEPVLVRVHSECITGDVFGSKRCDCGEQLDMALNQIAQAGRGVLLYMRQEGRGIGLHNKLCAYALQDKGLDTVEANLELGFAPDLREYGIGAQILVDLGLSQIRMLTNNPKKVVGLEGYGIKVVETVPIIVEPNSFNRHYLETKQRKMGHILNVDKVN

SEQ ID NO: 20686 - protein, 468 aa, Escherichia coli
MSKQQIGVVGMAVMGRNLALNIESRGYTVSIFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELATTFTEWNEGELSSYLIDITKDIFTKKDEDGNYLVDVILDEAANKGTGKWTSQSSLDLGEPLSLITESVFARYISSLKDQRVAASKVLSGPQAKLAGDKAEFVEKVRRALYLGKIVSYAQGFSQLRAASDEYNWDLNYGEIAKIFRAGCIIRAQFLQKITDAYAENKGIANLLLAPYFKNIADDYQQALRDVVAYAVQNGIPVPTFSAAVAYYDSYRAAVLPANLIQAQRDYFGAHTYKRTDKEGAFHTEWLD

SEQ ID NO: 20687 - protein, 321 aa, Myxococcus xanthus DK 1622
MRPPCRPLPADGRFLQAVGPTPLVPVRLHEEGPTIWCKLEFLNPSGSTKDRIARYMLEKAWRQGELVPGGEVIEASSGSTSIALALACAQMGLRFTAVMPEGVTGERILTIRAYGGDVVLVPREAGVHGAIVKAEELARERKAFAPRQFENLDNAEAHRVWTGQEILSQIPGGLVHGVVSGVGTGGTVVGLYQAFAEAGCPVTAFVARPIAGLGCDIECCSFSPRVPGVVDGMSRLYREADMPGRVEIDVSDDVAMSTARALIRRGFPVGPSSGLNYVAAVEAAKRLGPGAQVVTVFPDRMERYFSTELIQPKPVPARGAA

SEQ ID NO: 20688 - protein, 272 aa, Dehalococcoides sp. BAV1
MEMTQSSNHIVVIKLGGSVLDSKDTSLKDIATLKQLGLKPVLIHGGASTVSAWSAKLGLETRLVNGERVTDDATLDVVAAILAGLVNKEIVAALLDMGIKAAGISGVDSATITGQIRATETGYLGDVVQVNTELITALLDANITPVISPVSFHQTNRPSGSRRLLNINGDPVAGEIASALQAERLVFLTDVPAVKGKNGEALGEISADHAAELLASGTASGGMIPKLRSCLKATLAGSSACIIDGRKPHMLIRELTEGNCGTTVTGQHLRRS

SEQ ID NO: 20689 - protein, 398 aa, Dehalococcoides sp. BAV1
MDNWQELEHKYYMQTFYRAPITIVKGQGAKVWDDKGKEYLDFVAGWAVNSLGHCHPAVVKAVTEQAATLIQTSNNFYTIPQLNLAKLLIDNSCLDRIFFCNSGTEASEGAVKLARRYGKLKLKGAYEVITATGSFHGRTLAMVSASGQSKYQEPYTPLPTGFVNVEYNNPKAIKVAITDKTCAVMLEPIQGESGVNVPDAGYLKEVRKICDEAGILLILDEIQTGIGRTGKLFAYEHFGIEPDIITLAKGLASGVPIGAFMAKESASVFAKGEHGSTFGGNPLACAAGYATMKFILDNHISEHAAAMGKYLIKGLEKLKAKHSIIQGYRGCGLLMALDFKADIAKELVSNCLSEGLLLNAVKPNALRFMPSLNITEADIDEALSKLDNVLTHSESAGV

SEQ ID NO: 20690 - protein, 287 aa, Cryptococcus neoformans var. neoformans JEC21
MSRPEEISPPEIFYGDTEAAKYTANTRIKNIQSQMTERALQLLALPEDQSAYVLDIGCGSGLSGELLDEEGHVWVGVDIAPSMLEVALEREVEGDLFLQDIGQGFGFRPGTFDGAISISVIQWLLNADSSSHSPPQRLNRFFTTLHACLRNPSRAVFQFYPSSDDQVTMITTAAQRAGFGGGLVVDYPNSRKARKMYLCLMVGQQEIPKALDGDEMDVDEETIGKRRDEIKNERRRRREARRKTKKGNKDVKAKEWILKKKDLYRTRGKEGVPRDSKYTARKRKTYF

SEQ ID NO: 20691 - protein, 519 aa, Coprinopsis cinerea okayama7#130
MDYQPVAVKKHLKPAASKHSPESRHWRQFKHPVFVKEYAPITSIHFSPSKPHRYAVTAATRVQIYAPRTQKITKTISRFKDVARSGNIRADGKLVVAGDDSGLIQIFDINSRAILRTLDSHKQPVHVTKFSPLESTRVLSCSDDNTVKFWDLTSQTAISTFDEHTDYVRTGQVSTSNPHLILTGSYDGTARLFDSRTGQSEMVMGESITANLKAPVEQVLMFPSGTVAVSSAGPILRVWDLVAGGRCIKAMSNHQKTVTALALNPSANRLLSGSLDHMLKVYDVSDYRVVHTMRYPAPLLCLAISPDDSHIVGGMSDGTLSIRRRQKKGKEIATFGPESLDLMYLGEGVTKSKAKSKALKDVDELRVSESRRQKRLKNYDKYLKNFKYSAALDSVLRKNVPPATVFSLIQELIHRDGLKVALAGRDDVLLEPVLQLLIKHVADPRFGNTVCYVAGIVLDMYRPVIGQSPLIDSLFLRLRKKLAMELRFQKELLKAKGAISMILTSALGNPEPVDSARAA

SEQ ID NO: 20692 - protein, 483 aa, Burkholderia vietnamiensis G4
MSSGVRHDYAPLRLYIDGRFHDADGRRTQPVVDPGTTRVLGELPHATAHDIDAAVQAAHRAFVTWRHESPLVRSDLLRRAAALARERAETIGRHITMDQGKPLREAIAEVVSAAEQLEWHAEEGRRTYGRVVPARSPDVMQTVLREPIGVCAAFSPWNFPFSQAMHKIAAALASGCTLVLKGPEESPSAIVALAQLFHDAGLPPGCLNIVWGVPGDVSKQLIEAPQVRKISFTGSVPVGKQLAALAASLMKRMTMELGGHAPVLVCADADVERAAAMLAAYKFRNAGQVCVSPTRFFVQRAAFDRFVCAYLDAVGTIRVGYGLDAGVTMGPLAHARRVDEIDAFVADATAKGAQIATGGMRLPGPGHYFAPTVVLGPTRDTRLMNDEPFGPIVGIVPFDDLDDALAEANRLPFGLASYAFTTSARNAHRISRALEAGMVNINHFGMGPAEIPFGGVKDSGFGSEGGMEAFDGYLVTKFVTQMN

SEQ ID NO: 20693 - protein, 176 aa, Dendrobium grex Madame Thong-In
LPSLNAGGARLMKSTGTIGNRVASINVENAETNRRALRELLFCAPGALQYLSGVILFEETLYQKTAGGKPFVEVLNEGGVLPGIKVDKGTVELAGTNGETTTQGLDDLGKRCAKYYEAGARFAKWRAVLKIKSHSAFPAFYQSECLWTSSHAIICQENGLEAKHGHQKKRISLSII

SEQ ID NO: 20694 - protein, 231 aa, Prochlorococcus marinus str. MIT 9215
MKKIVADAAIKEVESDMILGLGSGSTAALMIKSLADEIRSGKLQNIRGVATSFQSEVLALELDIPLIDLASVSQIDLAIDGADEVDPRFQLIKGGGACHVREKLVASKANRLLIVVDETKLVQNLNQTFPLPVEVLPNAWKQVEEVISEMKGSSSLRMATKKAGPIVTDQGNLILDVFFDGGIKNPKDIELSLNNIPGVLENGLFVDLTDKVLVGKIENNIPVVYSPSKFG

SEQ ID NO: 20695 - protein, 456 aa, Salmonella enterica subsp. enterica serovar Paratyphi A str.
MTTRLTRWLTALDNFEAKMALLPAVRRYGRLTRATGLVLEATGLQLPLGATCIIERQDGPETKEVESEVVGFNGQRLFLMPLEEVEGILPGARVYARNGHGDGLQSGKQLPLGPALLGRVLDGGGKPLDGLPAPDTLETGALITPPFNPLQRTPIEHVLDTGVRAINALLTVGRGQRMGLFAGSGVGKSVLLGMMARYTRADVIVVGLIGERGREVKDFIENILGPDGRARSVVIAAPADVSPLLRMQGAAYATRIAEDFRDRGQHVLLIMDSLTRYAMAQREIALAIGEPPATKGYPPSVFAKLPALVERAGNGIHGGGSITAFYTVLTEGDDQQDPIADSARAILDGHIALSRRLAEAGHYPAIDIEASISRAMTALITEQHYARVRLFKQLLSSFQRNRDLVSVGAYAKGSDPMLDKAITLWPQLEAFLQQGIFERADWEDSLQALDLIFPTV

SEQ ID NO: 20696 - protein, 313 aa, Frankia sp. CcI3
MRDIAVFSGSAHPSLAEEICTHLDVPLHRVRVQRFANDCLEVQLPANCRERDVFLIQPLVAPVQENLVELLLMLDAARGASAARTTVVLPHYAYARSDKKDAPRISIGGRLVADLLVTAGANRVLAMTLHSPQVHGFFSVPVDHLHALRELAAHFRHYELSNTTVVSPDLGNAKEAAAFARMLGVRVAAGAKQRFADDRVSISTVIGDVAGRDVIVLDDEIAKGSTVLELLERLRELNVRSVRVACTHGLFAAGALKRIGDQPEVAEIVCTNTVPIPAGDRVPKLKILTVAPALAEAIRRIHNGESVSALFDA

SEQ ID NO: 20697 - protein, 375 aa, Nicotiana tabacum
MADANMGAGGGQFPDFPSVLTHGGQYVQFDIFGNFFEITTKYRPPIMPIGRGAYGIVCSVLNTELNEMVAVKKIANAFDIYMDAKRTLREIKLLRHLDHENVIGLRDVIPPPLRREFSDVYIATELMDTDLHQIIRSNQGLSEDHCQYFMYQLLRGLKYIHSANVLHRDLKPSNLLVNANCDLKICDFGLARPNIENENMTEYVVTRWYRAPELLLNSSDYTAAIDVWSVGCIFMELMNRKPLFGGKDHVHQIRLLTELLGTPTEADLGFLQNEDAKRYIRQLPQHPRQQLAEVFPHVNPLAIDLVDKMLTFDPTRRITVEEALDHPYLAKLHDAGDEPICPVPFSFDFEQQGIGEEQIKDMIYQEALSLNPEYA

SEQ ID NO: 20698 - protein, 257 aa, Glycine max
DIYKFYKLVENESHPHDYIDSQPEINERMRAILVDWLIDVHTKFELSLETLYLTINIIDRFLAVKTVPRRELQLVGISAMLMASKYEEIWPPEVNDFVCLSDRAYTHEQILAMEKTILNKLEWTLTVPTPFVFLVRFIKAAVPDQELENMAHFMSELGMMNYATLMYCPSMVAASAVFAARCTLNKAPLWNETLKLHTGYSQEQLMDCARLLVGFHSTLGNGKLRVVYRKYSDPQKGAVAVLPPAKLLSEGSASQHS

SEQ ID NO: 20699 - protein, 672 aa, Geobacter sulfurreducens PCA
MAQVVFSSWGRTIVDNRKGGEAQDVSFRLPTTLDGERQIAAFMGWDGIILYDLKVDVPAMAAEYMKRVQTQYCCGKCTPGKKGTKVLADVLAAIIEGRATEADLDTIDDLADLLTNCKCTLCQSSTIPVLDAVKHFREDFLAYITGIRKPANVHRFIDKYTAPCMDRCPAHIDIPAYIEAIKEYRFDESLDIIRDNMPLPSVCGRVCPHPCETHCRRKNVDDSVNIMVLKRSASDYEWMHNAAPPMQPKPQKNKKVAIVGAGPAGLACAYYLALEGYPCTIYEALPEGYGGGMIAVGIPPYRQPRHLLQRDIDIISSMGVDIIYDTRIGKDISLEELKQKFDAVFLAPGAHRSKPMGVEGEDKGYKGFLKGGIDFLREAYMGRPTGMGKKVVVVGGGNTAIDCVRVALREGAEESTLLYRRSRKEMPADVWEVDGADEEGVRFEFQVLPTRVLVDENEQVTGVECVRMALGEPDASGRRRPEPVPGSEFVVECDTVIPAIGQDPDLSFIPDNLGIDITKWNTVVTKYVPLKDAAGKDLKDGMGNPLARVLITDLEGVFAGGDAEIGPLTVVACIGNAHRAARVIQRWLEEGKAYLTEDELMEDILTNMPVYDKNEKVPWLDSRERAHQAEVHGQERASKGNYQEVELGFVDTQAVEEAERCLRCYRVAMAAI

SEQ ID NO: 20700 - protein, 128 aa, Brassica napus
  misc_feature (10)..(10): Xaa can be any naturally occurring amino acid
LGHRARKDFXILHQEVNGSKLVYLDSAATSQKPAAVLEALQNYYEFYNSNVHRGIHYLSAKATDEFELARKKVARFINASDSREIVFTRNATEAINLVAYSWGLSNLKPGDEVILTVAEHHSCIVPWQ

SEQ ID NO: 20701 - protein, 439 aa, Methanosarcina mazei Go1
MVSDPDGGLNEKTEKNSEYNSQKASGQGTEKDIEPDDGTHASLYQESLAMHRRLGGVLEVASKVRLRTIHDLGVAYTPGVAEPCRKIRENRDLAYLYTLKKNTVAVVTDGSAVLGLGNIGPYAALPIMEGKAIIFKEFAGIDAFPICLGTQDTEEVIKAVKNMAPAFGGINLEDISAPRCFEIEARLREELEIPVLHDDQHGTAIVVFAGLLNALKIVKKDLAELKIVISGLGAAGVAILKFLVRAGANPAKILACDSQGIVYEGREKGMNTIKDEISRITNPERLKGELKEVFPGADLFIGVSVGGIVTGSMVRSMAKDAIVMAMANPVPEIMPEAAKRAGARIVATGRSDFPNQLNNCLSFPGIFKGALGTCARKITPEMEMAAAHALANVVTSGELSEDHIIPDPLDKHVVPAVAKAVASASLESCAARKRLEETF

SEQ ID NO: 20702 - protein, 431 aa, Arabidopsis thaliana
MEVGFKALLDDLDVLEKSLSDPALINKLRSHVENLATLSKCNPHRRSKVKELSSEVVDSNPYSRLMALQRMGIVDNYERIREFSVAIVGIGGVGSVAAEMLTRCGIGRLLLYDYDTVELANMNRLFFRPDQVGMTKTDAAVQTLAEINPDVVLESFTMNITTVQGFETFTSSLTNKSFCPSKEGGSGVDLVLSCVDNYEARMAVNQACNELRQTWMESGVSEDAVSGHIQLLVPGETACFACAPPLVVASGIDERTLKREGVCAASLPTTMGVVAGLLVQNSLKFLLNFGEVSPYLGYNSLKDFFPTMKMRPNPQCSNVACLERQKEYMLAKPERDAAAKAKMEADASTTIDEGPLHDDNEWNISVVDDENEKDTTKAASSSDTLPEGLTRELPVADEYEKAIAIASGSGETEEEDDLEDLKKQLEALNAA

SEQ ID NO: 20703 - protein, 341 aa, Daucus carota
APSMTTPEPASKRRVVLGEISNNSSAVSGNEDLLCREFEVPKCVAQKKRKRGVKEDVGVDFGEKFDDPQMCSAYVSDVYEYLKQMEMETKRRPMMNYIEQVQKDVTSNMRGVLVDWLVEVSLEYKLLPETLYLAISYVDRYLSVNVLNRQKLQLLGVSSFLIASKYEEIKPKNVADFVDITDNTYSQQEVVKMEADLLKTLKFEMGSPTVKTFLGFIRAVQENPDVPKLKFEFLANYLAELSLLDYGCLEFVPSLIAASVTFLARFTIRPNVNPWSIALQKCSGYKSKDLKECVLLLHDLQMGRRGGSLSAVRDKYKKHKFKCVSTLSPAPEIPESIFNDV

SEQ ID NO: 20704 - protein, 190 aa, Rickettsia prowazekii str. Madrid E
MFIQTEETPNPDAIKFFPGQEISVDQPVFFSELAEVKGRSALAESLFHINNVKSVFLGSDFITVTKQARGNWQVIKPEILMVIMDHFISGFPVFNENTKIDDEKHNLDMLSEIEKQIIETIETRVRPFVTQDGGDIIYKGFESGVVKLALRGACLGCPSSTITLKNGIESMLKHFIPEVQEVKAVEEDFK

SEQ ID NO: 20705 - protein, 181 aa, Glycine max
  misc_feature (142)..(142): Xaa can be any naturally occurring amino acid
MMNSIFGKRKTPAELLRENKRMLDKSIRDIERERQGLQTQEKKLITEIKKTAKQGQMGAVKVMAKDLIRTRHQIEKFYKLKSQLQGVSLRIQTLKSTQAMGEAMKGVTKAMGQMNRQMNLPSLQKIMQEFERQNEKMEMVSXEVMGDAIDDALERDEEEEDTEDLVSQVLDEIGIDINQEL

SEQ ID NO: 20706 - protein, 185 aa, Triticum aestivum
  misc_feature (2)..(2): Xaa can be any naturally occurring amino acid
  misc_feature (10)..(10): Xaa can be any naturally occurring amino acid
QXGSRLVAAXYVLYSSATIFCISFGAGTHGFTLDRSTGEFVLTHPSMQIPPRGQIYSVNDARYFDWPEGLKKYIDTIRQGKGQHPKKYSARYVCSLVADFHRTIIYGGVAMNPRDHLRLVYEANPLSFLAEQAGGRGSDGKTRILSIQPVKLHQRLPLFLGSMEDMLELESYGDVQQKVNPGYDV

SEQ ID NO: 20707 - protein, 456 aa, Prochlorococcus marinus str. MIT 9211
MNLLKDTFDLIVLGAGSGGLAAAKRAASHGARVAIVEGDRVGGTCVIRGCVPKKLLVYGSQYDEYLKDSHYFGIEISRSSIDSSVLLNNVRREVDRLNRLHVELLEKSGVEIISGWGSITSPTSISVISSDKSKKNKEIHARNILIAVGGRPVRPDIPGAALGWVSDDMFLQKNWPEKVVIVGAGFIACEFSCIMNGLGVEVVQLVRGNTLLKGFDQELSLFLEENMRKEGIDLQFQKTLSALEGCQGDLKVLLQCNEAIDCGGVLFATGRKPFLDGLNLDKIGIVQEAERIKVDSGNATNIANIFAIGDVAGHVQLTPVAVEEGRVLADNLFSGTHRKVKYNLIPKAVFSKPEIASIGLSENEALDKFGGGNVQVYRSKFRPMSQSLQKSERRCLLKLVVDVKTDKILGCQMAGEHSAEIIQMASIAISMGATKLDFDQTMALHPTIAEEFVTMR

SEQ ID NO: 20708 - protein, 1037 aa, Zea mays
MSDVSLDLGGIRAGPVERDIEQAITALKKGAYLLKYGRRGKPKFCPFRLSNDESVLIWFSGKEEKHLRLSHISKIIPGQRTICKDKDEAEVWFAGLKTLISRCHQRKWRTESRSDLLSSGATSPRTYTRRSSPLSSPFSSNDSIHKDGSDNYRLRTPYGSPPKNGLEKAFSDVMLYAVPPRGFFPSDSNAGSVHSMSSGHSDNTNGHPRGVPMDAFRASYSSAVSSSSHGSGHDDGDALGDVFIWGEGTGEGILGGGGSRVGSSSGAKMDCLVPKPLEFAVRLDVQNISCGGRHAALVTKQGEIYSWGEESGGRLGHGVDCDVSQPKLIDALSHMNIELVACGEYHTCAVTLSGDLYTWGDGTFKFGLLGHGNDISHWVPKHLFTFGDGSFGVLGHGDRESISVPREVESLKGLRTVRAACGVWHTAAVVEVMAGNSSSSNCSSGKIFTWGDGDKGRLGHGDKGPKLVPTCVAALVEPNFCQVACGHCLTVALTTSGHVYTMGSAVYGQLGNAQADGMLPVRVEGKLHKNFVEEISCGAYHVAVLTSKTEVYTWGKGANGRLGHGDTDDKNTPTLVEALKDKQVRIVVCGINFTAAICIHKWVSGVDQSMCSGCRQPFNLRRKRHNCYNCALVFCHSCSSKKSLKASLAPNTNKPYRVCDTCYSKLTKGLETDMHSSAKRAATVPGVSDANEEDLETRSNAQLSRLSSMESFKHLDSRYSKKNKKFEFNSTRVSPVPNGSSHWSGLNISRSFNPVFGSSKKFFSASVPGSRIVSRATSPISRRASPPRSTTPTPTLGGLTSPRVVPNDGKPTNDALSQEVLNLRSQVESLARKSQLLEVELERTTKQLKEAISIAGEETAKCKAAKEVIKSLTAQLKGMAERLPGGAAKNTKLPPLPGIFIPSDIPSMPTESEGSPSSSGEQIINGHNGLLTSNGQSSIRNKTSHPEVGKNGGRLPDAESCHDAEWVEQDEPGVYITLTALPGGARDLKRVRFSRKRFSETQAEQWWQQNRARVYQQYNVRVIDKSTASVNSDIAAN

SEQ ID NO: 20709 - protein, 183 aa, Methanosarcina acetivorans C2A
MSESSIKIENVVASTKLAEEFDLTVIESEFEGAEYNKQKFPGLVYRVSDPKAAFLVFTSGKVVCTGAKNVADVHTVIGNMAKKLNSIGIKTMENPQITVQNIVASADLHTILNLNAIAIGLGLENIEYEPEQFPGLVYRIDEPKVVVLIFSSGKLVVTGGKSPEDCERGVEVVRQQLDNMGLL

SEQ ID NO: 20710 - protein, 128 aa, Dendrobium grex Madame Thong-In
IMLSDIFFFGGPFSGAAGTKKQKYEKISERKVSTSIEALCRGYPSEFASYFHYCRSLRFDDKPDYAYLKRIFRDLFIRLGFQFIMCLIGPFLNISSPKLILLKPSAKLLGLGLACHQPLDTQHLVRVN

SEQ ID NO: 20711 - protein, 1441 aa, Coprinopsis cinerea okayama7#130
MPSRSTYEVGRDRNVAPGRSLREGDWGTSGSHDRYGYDLYPPEHDAYDDPLRRDAGAWGGGNDGYSSRGAHHYGSSSHYKPPVDPYMEPNPYLPRSPTHFTERSPLGYDDPQSYYYEQWRGRDPRPSPSDEKMDYNQIDKRGAQGWRRSSGGGKGGQPKFQSDSGWSGRKKSKEWGNSNQQRYDEKQPEPLYSSVEDRSWEPADSWKSSNRHEGGASTSKHQQHHTPGRPGTQQQSKSSRKEKKSGKQKKEWKNEDLNLNKFGFKEETSPVSLKVPVARLFALAPFILPLEVLLSRGKAKAERIQPNASHRSPSPYERPRAVHRLPTANSSALHTAPATGKSKKAGKQRNGHKNARGSTGKQPARYPEDDVAADSLSMPPPPPPSRPKQSRQQTPDWRDEHTPLLNPNPNGLPPKPISLPEKPTRIVPQRNAGFKPIGQSNSALKMFFPGDEDEADYISSSNLTKDARTEPTPTKGFTRQTLLDDTRNGREAENPHQYGNDPPPISRPPASWDPYASTYPVDPRVPTQSYTNGLTPHLPEPPPHIPHRTGQTQSYWKSPAVSPPPESDASRWSGVPVPPVHPNLPPTYTASVPPRPGYELPYRPPVPVDNAPVSHTTKSTPQPSPIPISDPSPAWQASASASGVATPVAPEQPESKDLYVILNQVGEGTFGKVYKARNTVAKVHVALKRIRMETERDGFPVTAMREIKLLQSLKHPNVVQLYEMMVSNGSVFMVFEYMDHDLTGILSQTQFKFSDSHLKSLCHQMLAGLAYLHHKGVIHRDIKGSNILLNNRGELKLADFGLARFYQKRRRTDYTNRVITLWYRPPELLFGATVYGPEVDMWSAGCIMLELFTKKPVFQGNDEINQLHVIFKILGTPTTERWTGLNNLPWFELIKPKESLPNRFRDLFQKWMSPAALDLAERLLTYDPELRVSAQEAMEAPYFTQERPFAERPAGALYDYLVTEAGIERTDKNNVVKGDLGLYRQTDSPAKHKKAKANLELANKYFKLRYEELFQLIREEELKFKTVVTELEDIRAGKWDDRIKAQLTGMSEPPPPQGEDSQRKEETLAQEASVASSSKPAPPTEATEAVDEDATEPDADLAQRVLPSTSPSLMAEKQEEEEEEEAEPDREEDEEGDKLDETPDKGDHIVQESEEKENEVEMEETEGLLDASSEKDDNVEAEAQAEAETEAEQPKEAEIEDDESSGEEPPQTVRRSTRRKGSISAAPPVSARTRTRRRQVQDHEASPPPESEAANETEGAAADTPRTEDNIPSSPFEPASSRTREGKRKASFVEAMENAGRESKRLREDSESRGSRSGARSEEQVALKRFQNVIGLVHSQISQHRNGTIFHNPIKHSEAPDYHDIVKKPMDLKTIKARVKDGLVSNSLEFQRDIYLMFANAMMYNRPGSDVHTMAEDMMFDAEKQIQSFRQTEGLVRGVHR

SEQ ID NO: 20712 - protein, 454 aa, Burkholderia vietnamiensis G4
MDYQKRQKRFWHPMSSAAAGHTTPTVIIARGDGNYVYDVEGHRMLDGVGGLWNVNVGHNRPEVKAAIARQMDELSYYQTFDGVAHPRVYDLADRLCAMFEQEDMQRVMFGSGGSDAIETALKMARQYWVAAGEPSRTKFLSLRNGYHGVHMGGTSIGGNGVYHYNHGPLLPGCVLLDTPWLYRNPWNCDDPDQLVEHCIRQLEDTIAFHGQQTIAAFVAEPVQGAGGLIVPPASYWARVRNVCDRHGILLIADEVVTGFGRTGSMLGSRGWGVAADILCVAKGISAGYVPLGATLYNGRIAQAIEHGAGFSHVVMHGYTYSGHPLACAASLAVLDIVEAEDLPGNAARMGQRLLEQLLPLTRDFETVGDVRGKGLMLALDLVTDKASRTPLDPGKGFAARVADAARKRGVLVRAIANKIVMSPPLTLQPKETDLIAHALRDALQECCADARAIA

SEQ ID NO: 20713 - protein, 481 aa, Burkholderia vietnamiensis G4
MMKIQNLIGGRHCDASTGRTFDKLAPATGDRICTVPASSADDVDRAVRAAHDALHDDAWARAGGAARARWLYRLADLVERESEALESLLAVEQGRPPAEMRMMDLPMTIDTLRYFAGWADKLEGRTIPTDGFMGRPTLSYTRRAPVGVAGQIVPWNAPLMIAVWKLAPALAAGCPVVIKPSEDAPLAVARLGKLACEAGLPAGVVNIVHGMGAEVGAALVAHPLVSKISFTGSTEVGRTIACDAARTFKRVTLELGGKAAQIVFADADLDRAIPSLVAGMFANQGQTCAAGSRVLAHRSIADALEARLADAARTIRVGPPTEAGVQMGALINPRHLARVRAHVAAALAEGAVMLAGDEQVPPRGCFMRPTILGGVHPGMRIAREEVFGPVGMVMPFETEDDAIRIANDTPFGLSASVWTQDVGTAHRVAERLDVGAVAINAWSPIDARLPWGGTRQSGIGRDLSKAALDSYLEEKIVTAAL

SEQ ID NO: 20714 - protein, 565 aa, Aspergillus nidulans FGSC A4
MSRRPNPAQAAQNQQTIKALLKLEPNKVCADCKRNKHPRWASWNLGIFICIRCSGIHRGMGTHISRVKSVDLDAWTDEQLQSVVRWGNARANKYWEAKLAPGHVPPEAKIENFIRTKYESKRWVMDGPMPDPSTLDAGDDDVPLAVVQEKAKIERSASQRVAPARQPAVQHRPQASIDLFDDDGVAPPVRPSTTEPSIRAPPKQPQAAPKPTRPGDSLLGLDFFGSAQPAANSRPASVASTPAGGMSRPDLKQSILSLYSKPQPTAHERTSSFGDLASPPPQSTSSSNLGGLTDAFSGLSFPTSPPAQRPAEKPSPFAGLTSFANSKSAPAAPKVTSPTASIGSTGGGLFDSLTSPTAPSAKPQSRTTSISSNSNDFGFSSFQSPPPPKANPPSASLSNDLFGLSSPPISAAPIPPPARSPPPVAAPQPDISSAFNLSQPAPKPVAPPQPLTTTTSIPTLSAAAIDPWGSNAWSTPEPAAPAAPQPSSMMKLPDTLTANDVGAGWGAPSAAASKPTPPTVAEDEDFGGWASAAPISSTSTTNVNAPPKPAGGFSGSDDLFSNVWE

SEQ ID NO: 20715 - protein, 650 aa, Listeria innocua Clip11262
MEIFELILLMLSAVFLSNVLSRFLPSIAVPLIQVLLGIILAIPLGDHTMDINPELFLLLFMAPILFNDGARTDKKSLWKNRKAILSLSIGLVFVTVGVLGAFIHYLIPAIPFAAAFALAAALAPTDAVAVGALAEKVRVPHKIMHILEGESLINDASGLVSFQFAVLALVTGTFSFMSAGTSFLLLSLGGIALGVVLSLLKIMLMRGLRQLGIENMTSFMLMEILLPFLIFMVAENIGVNGILAVVSGGMVHSFSYKRINPEMAQLNLLSKNTWSVIIFSLNGLVFVLLGTQLPQIMTAIWEDTGIHKSMLFLYIFGITFLLLALRFLWILFFRNYEENPHADLVSRLKNTFLYTVAGVRGTITLVSALSLPFVLGQGNAFPERDLLIFIAAGVIITTLLLANFTLPLFAAKKDVVVADHTTAIALLRDVVGQLQRYKTDENEVEMNNVLKMYNGRIFSLMEHKEVSATEKELRRLTQEWQLENTRRLVFERKIDTGVGLSLMMRLGKRLYVQTRAQKYRARMRYRQLLSHSIRDFRIVPLSFEERRKERAKLQTENNQFVVQKLNELDKNEFNPEVISLYLMNFERALGSGKHKKETDNEELQTTIDLASQIERETIQHYFEKGTITRKEMKVYRDNLLAIEASFQLEF

SEQ ID NO: 20716 - protein, 364 aa, Pseudomonas syringae pv. tomato str. DC3000
MSEQELKALRVRIDSLDEKVLELISERARCAQEVARVKMSSLAEGEVPVFYRPEREAAVLRRVMDRNRGPLSNEEMARLFREIMSSCLALEQPLKVAYLGPEGTFTQAAAMKHFGHAVISLPMAAIDEVFREVVAGAVNFGVVPVENSTEGAVNHTLDSFLEHDMVICGEVELRIHHHLLVGESTKTQSISRIYSHAQSLAQCRKWLDAHYPNVERVAVASNAEAAKRVKGEWNSAAIAGDMAAGLYGLTRLAEKIEDRPDNSTRFLIIGNQEVPPTGDDKTSIIVSMSNKPGALHELLVPFHENGLDLTRIETRPSRSGKWTYVFFIDFVGHHQDPLVKAVLEKISSEAVALKVLGSYPKAVL

SEQ ID NO: 20717 - protein, 269 aa, Vitis vinifera
MEDAMEDDLVLDIDGSDIENPLAVVEYIDDIYHFYRKTESLSCVSPTYMSFQFDINQKMRAILIDWLIEVHYKFELMDETLFLTVNLIDRFLERQTVSRKKLQLVGMTAMLLACKYEEVCVPIVEDLIVICDKAYTRTEVLDMEKVMVNTLQFNMSVPTPYVFMRRFLKAAQSDRKLCLVEYEMLKFPPSLLAAAAVYTAQCSVLKSSQWSKTSEWHTAYSEDQLMECSRMMVTFHQKAGTGKLTGVHRKYSTHKFGYAARSEPAQFLL

SEQ ID NO: 20718 - protein, 324 aa, Nostoc punctiforme PCC 73102
MDIKNGFVGAVGNTPLIRLNSFSEETGCEILAKAEFLNPGGSVKDRAALYIIEDAEKKGLLKPGGTVVEGTAGNTGIGLAHICNAKGYKCLIIIPDTQSQEKIDALIALGAEVRRVPAVPYKDPNNYVKLSGRVAAELENAIWANQFDNLANRHAHYETTGPEIWKQTDGKIDAWTASTGTGGTYAGVALYLKEQNPGIKCVVADPLGSALYSYVKTGEINIKGNSITEGIGNGRVTANMEGAPADDAIQIDDKEALRVVYQLLRKDGLLMGGSTGINVGAAVALAKQLGPGHTIVTILCDSGSRYQSRIFNPEWLASKGLSID

SEQ ID NO: 20719 - protein, 219 aa, Malva pusilla
MTGEVVLLDFWPSPFGMRSRIALAEKGINYEYKEEDLRNKSPLLLQMNPVHKKIPVLIHNGKPICESLIQVQYIDEVWHDKSPLLPSDPHQRAVARFWADFVDKKMYEQGSRVWKTKGEEQATAKKEFIESLKLLEGELGASLTFGGENLGYVDGVLVPFYSWVYAYEKCGNFNIEPECPKLIAWAKRCMEKESVAKSLPDQEKVYDFVLQLKKIYGIE

SEQ ID NO: 20720 - protein, 153 aa, Streptococcus mitis
EHFIRGQYRSGKIDGMKYISYRSEPNVNPESTTETFASGAFFVDSDRFRGVPFLFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 20721 - protein, 517 aa, Vibrio vulnificus CMCP6
MTKNIHDQRILILDFGSQYTQLVARRVREIGVYCELWSWDVEEADIREFNPDGIILSGGPESVTEDNSPRAPQYVFDSGVPVLGVCYGMQTMAEQLGGKVSTSDEREFGYAAVKVSGESAIFKDLEATQDVWMSHGDKVVEIPAGFTKVGETDTCPYAAMANEEKKYYGVQFHPEVTHTKNGLQMLENFVLGICGCERLWTSESIIEDAVARIKEQVGDDEVILGLSGGVDSSVVAMLVHRAIGDKLTCVFVDNGLLRLNEGQQVMDMFGDKFGLNIIKVDAEERFLKALEGKSDPEEKRKTIGHVFVDVFDEESKKLKNAKWLAQGTIYPDVIESAASKTGKAHVIKSHHNVGGLPDDMEMGLVEPLRELFKDEVRKIGLELGLPYEMLYRHPFPGPGLGVRVLGEIKKEYCDLLRRADAIFIEELHAADLYNKVSQAFTVFLPVRSVGVMGDGRKYDWVVSLRAVETIDFMTAHWAHLPYDFLGKVSNRIINEVNGISRVVYDISGKPPATIEWE

SEQ ID NO: 20722 - protein, 69 aa, Glycine max
MADWGPVVIAVVLFVLLSPGLLFQLPGRSRVVEFGNMQTSAISILVHTIIFFGLITIFLIAIGVHIYTG

SEQ ID NO: 20723 - protein, 498 aa, Hyphomonas neptunium ATCC 15444
MREVHHFIDGKSVAGTSGRFGEIFDPNTGKVQGKVALATKAEMGAAVDAASAALPGWASMNPQRRARVMFEFKRLVEANMDELAHMLSSEHGKVIADSKGDVQRGLDVVEFACGIPHLLKGEYTEGAGPGIDVYSMRQPLGVCAGITPFNFPAMIPCWMSAVAIACGNTFILKPSEKDPSVPMRLAELMMEAGLPKGVLNVVNGDKEAVDAILTHPDIKAVSFVGSSDIAQYVYSTGTAHGKRVQAMGGAKNHGIILPDANLEQAVKDIVGAAYGSAGERCMALPVAVTVGKKTGDEFVERMIEAARGLKVGISTDAEAHYGPVVSAAHKAKVENYIQMGIDEGANLLLDGRGLTLQGNEGGYFIGPNLFDNVTASMQSYKEEIFGPVLQVMRVETLEEAAALPSNHQYGNGCAIFTSNGRAAREFAAQVNVGMVGVNVPIPVPVAYHTFGGWKRSAFGDTNQHGPEGVRFWTKIKTITQRWPEGDIGDQAFVIPTMG

SEQ ID NO: 20724 - protein, 442 aa, Arabidopsis thaliana
MSSSSRNLSQENPIPRPNLAKTRTSLRDVGNRRAPLGDITNQKNGSRNPSPSSTLVNCSNKIGQSKKAPKPALSRNWNLGILDSGLPPKPNAKSNIIVPYEDTELLQSDDSLLCSSPALSLDASPTQSDPSISTHDSLTNHVVDYMVESTTDDGNDDDDDEIVNIDSDLMDPQLCASFACDIYEHLRVSEVNKRPALDYMERTQSSINASMRSILIDWLVEVAEEYRLSPETLYLAVNYVDRYLTGNAINKQNLQLLGVTCMMIAAKYEEVCVPQVEDFCYITDNTYLRNELLEMESSVLNYLKFELTTPTAKCFLRRFLRAAQGRKEVPSLLSECLACYLTELSLLDYAMLRYAPSLVAASAVFLAQYTLHPSRKPWNATLEHYTSYRAKHMEACVKNLLQLCNEKLSSDVVAIRKKYSQHKYKFAAKKLCPTSLPQELFL

SEQ ID NO: 20725 - protein, 149 aa, Ehrlichia ruminantium str. Gardel
MPNNKIKMLVVVSQFYPEITELMLNAAVAVFQEHTEPVEYDVVYVPGSFEIPAAITFAILSDKYHYDGYVALGCVIKGETDHYYYVSKGVTLSLSEIATNHAVPMGFGVITAETKELALARADMNKKNVGGKAAKAALAMVTLHKKFLR

SEQ ID NO: 20726 - protein, 336 aa, Burkholderia mallei ATCC 23344
MSFNLHNRNLLSLIHHNARELRYLLDLARDLKRAKYSGTEQPRLLRKNIALIFEKTSTRTRCAFEVAAYDQGANVTYIDPASSQIGHKESMRDTARVLGRMYDAIEYRGFSQEIVEELAHHAGVPVFNGLTDEYHPTQMLADVMTMREHSDKPLHDIRYAYLGDARNNMGNSLLLIGAKLGMDVRIGAPKSLWPAADFIAQCEAFAAESGARLTLTEDPYEAVKGVDFIHTDVWVSMGEPVEAWDERINALLPYQVNRKLIESTGNPRTRFMHCLPSFHNCETKVGKQIAERYPHLQDGIEVTDEVFESPRCIAFEQAENRMHTIKAVLVSTLGGI

SEQ ID NO: 20727 - protein, 443 aa, Geobacter sulfurreducens PCA
MKFADLNLPEQVMQGVADAGFSDCTPIQEKTLPLSLGGKDVAGQAQTGTGKTAAFLISLFTKLLRSGRGGERRHPRAIILAPTRELVVQIEKDAQVLGAHCGFTIQAIYGGVDYMKQKNALKEGADVVVGTPGRLIDYLKQKVYSLKEIEMLVIDEADRMFDMGFIADLRFILRRLPPYDKRQNLMFSATLNQRVMELAYEFMNVPEKVAVTPEQMTAERVEQVLYHVGRKEKFPLLLGLLRKEGMERTMIFVNTKREAEFLDERLNANDFPCRVISGDVEQRKRLKILEDFKSGKLPIMIATDVASRGLHIDGVSHVINYDLPQDAEDYVHRIGRTARAGAEGKAISMADEDGAFHLEAIHEYIKDKIPVEWAEDDLFVHDFKRVKPRPKGQETRAKGPTRHGRKHPEAEKKEPEGEKKKRSRPRRKKNPAAGEGGTPPAAE

SEQ ID NO: 20728 - protein, 324 aa, Oryza sativa Indica Group
MKVGRGSRGGGGRDGGGVVEEERSGGVEAAPPVKRRRVAVAPSAGAGGSRRVQAEASPLQRLFRACRAVFRGTGTVPAPGEVDLLCSMLDKMKPEDVGLRADQEFFTARDDDEGIPLIKNTTLYECDNFTMIIFFLPRNAIIPLHDHPGMTVFSKLLIGSLHIRSYDWVDPEPALSCSSSSGDQLRLAKRVVNGVFTAPCDTSVLYPTTGGNMHRFRAIAPCAILDILGPPYSTEDGRDCTYYRAIPYSRHSVKNGAADQLTGVDEEGHRLSWLTETIPRMLRMRQIRIVKYMVGIRLINRITFLRRQLLPHFQIDHVSRPRKI

SEQ ID NO: 20729 - protein, 534 aa, Bradyrhizobium japonicum USDA 110
MPLHSSIDPSSSDFARNSEAMRSLVADLREKLSQVAGGGGEASRNRHTSRGKMLARERVDLLVDPGTSFLELSPLAAYGLYGGDVHSASVVTGVGRISGRECVIVANDATIKGGTYYPMTVKKHLRAQDIARQNNLPCVYMVDSGGAFLPLQDEIFPDERHFGRIFYNQAQMSSQGIPQVAIVMGSCTAGGAYVPAMSDESIIVRNQGTIFLGGPPLVKAATGEVVTAEELGGADVHSRQSGVTDHYAQNDAHAIGIARRIVGTLKPSSRPNLNMHPPRDPLFAAEEIYGVVPVDGRKPFDVRDIIARVVDGSEFDEFKKLYGTTLVCGFAHIWGYPVGIIANNGILFSESSLKGAHFIELCCQRGIPLVFLQNITGFMVGKKYEAGGIARDGAKLVTAVATASVPKFTVVIGGSYGAGNYGMCGRAYSPRFLWMWPNARISVMGGEQASMVLSQVRRDNIEARGDSWSKDEEDKFREPIRAQYEGQGHPYYATARLWDDGVIDPADTRLVLGLGLSAASNAPIEPTKFGLFRM

SEQ ID NO: 20730 - protein, 338 aa, Frankia sp. EAN1pec
MTTTVPEAIERGRALAVPALRATVDRLHPRLRHVVAYHRGWVDAAGEPVPGNGGKLVRPALALLSAEAAGAPAEVGLPAAVAVELVHDFSLLHDDLMDGDRERRHRATAWTVFGADGAILAGDALLGLATQVLLEVEGEPGRRAAVILGAGVQDLVRGQAEDLLFESRSDVSVAETLHMEDGKTGALLACSASLGAVLAGAPDEVVDGLAEYGSRLGTAFQLIDDLLGIWGDPAVTGKPVLNDLRSRKKSVPVVVALEAGGDDADELRAFLTEEGEASEDDLHRIAALVERAGGRDWTTAEADRQLKACENALRSISIPASAEAELLAMARFVTERDR

SEQ ID NO: 20731 - protein, 265 aa, Rickettsia prowazekii str. Madrid E
MTVNKESLCYYIFNHIYMYNTNFGFKKVDYTKKQWLINNIFSRVADKYDLMNDLMSIGLHRLWKDEFIMQIPNLNSNILDVASGSGDIALKLAKKAKDRGNNISLILSDINEEMLNNAKKKSIDLNLFQNIKFIVANAEELPFSDNSFDYYTIAFGIRNVPDINKALKEAYRVLKPMGKFVCLEFSKVKEGILKDFYKFYSFNIIPSIGQIIAGNKEAYEYLVESIALFPSQDDFRIMIKESGFEEVHYKNLSGGIVAIHSAYKI

SEQ ID NO: 20732 - protein, 364 aa, Dehalococcoides sp. CBDB1
MTNTAYMVLEDGTVFTGKSFGAETEAIGEVVFNTSMNGYQEMLTDPSYTGQIIVPTYPLIGNYGINPFDNESACIRATAFAVHQECRQPSHYQSTQTVHSFLEKAGIPGISGLDTRAITRKLRLAGVMRGMVTSTKTPEEALKIIRNTPDYGQIDFVRKISTPSPYEWQKEKPSFAGFHVAVLDCGLKYSILNQLKSHGCKVTVLPCTTSPKEIDTLNPDGIVLSPGPGNPELLDYLITTVRHVCEKYPVMGICLGNQLIGRAFGAKTFKLKFGHRGGNHPVKDLESGRVYITSQNHGYSIDPVTLKNDLKVSHLNLNDGTVEGLRHRELPVFSIQYHSEASPGPMDSTYLFKQFVEMIKQTKK

SEQ ID NO: 20733 - protein, 340 aa, Methylococcus capsulatus str. Bath
MHKITLIPGDGIGPSIVDAAVKVIEATGVQVQWDTQSAGMAAVEKFGTPLPDATLDSIRANRICFKGPLTTPVGGGYRSVNVTLRQAFNLYANVRPAISFEGTDTAFSDVNLVTVRENTEGLYAGIEHFIKVDEEKIAAESIAVVTRKGSERIIRYAFDYARRARRKKVTLVHKANILKCTSGLFLEIGREIAKEYPDIEFDDRIVDACSMQMVMQPQRFDVLVTTNLFGDILSDLAAGLIGGLGLTAGANIGTDAALFEAVHGSAPDIADKGIANPTAMIMAGAMMLEHIGEPDAARRIERAVREVIEDGRSVTPDLAKDSPCGTAQMAEAIVERVRQA

SEQ ID NO: 20734 - protein, 153 aa, Aspergillus nidulans FGSC A4
MAPPPVNKSEDEWRAVLSPGKQACPAHSKSPPWAMAAGCSIEMESEYDSHYPSKGVYTCAGCHAPLYKASHKFKSGCGWPAYFDSIPGAVQRHVDNSFGMERTEITCTNCGGHLGHVFKGEGYPTPTDERHCVNSISLKFTENEEGEGAKAKA

SEQ ID NO: 20735 - protein, 320 aa, Leifsonia xyli subsp. xyli str. CTCB07
MAWLVTGGAGYIGAHVVRAFLAEGIDVVVADDLSSGHREFVPAGVSFYRGTILDGTLLEAVFSENRISGVVHVAGYKYAGVSVQRPLHTYEQNVTATAVLLAVMQEAGVGSIVFSSSAAVYGTPEVELVTEDTPKNPESPYGESKLIGEWLLRDQGVARGLRHTSLRYFNVVGSGDPALRDTSPHNLFPLVFDALVAGRTPRINGDDYATPDGTCVRDYIHVADLAVSHVAAAKRLEAGEDIRAVYNLGSGDGVSVGEIMATVAEVTGIDFTPEMGPRRPGDPARIVASGELAARDLGWKMSHSLAEMVRSAWEARQAAS

SEQ ID NO: 20736 - protein, 348 aa, Dehalococcoides sp. CBDB1
MKQGVIEHYRKYLPVTDKTPSLTLGEGDTPLVRCPKLEKELGVGELYFKLEGCNPTGSFKDRGMVMAVAKAIEDGFKAVVCASTGNTSASATAYAAASGLESIIIIPSGKIALGKLAQAIVYGAKIIQIKGNFDQALQIVFKLTEKHKVALVNSVNPYRIEGQKTAAFEIVDALGKAPDYLFIPVGNAGNITAYWKGFKEYHQLGKAASLPKMMGFQAEGAAPIVRGHAIAEPETLATAIRIGNPASWKKAEEARDESVGLIDMVSDAEIMAAYHKMASAGIFGEPASAAPLAGLIKRIKGGQDFSASQIVCVVTGNGLKDSDIAIKGAGGFSETEASLGAVEKVLGW

SEQ ID NO: 20737 - protein, 579 aa, Fusobacterium nucleatum subsp. nucleatum ATCC 25586
MKRKFILVGIIVIAFSVISYGKVSSNSVKNSNVENWKPYDANGEMIRTDRGATGKIGVVSTSKVEASRIGADILKKGGNAIDAAVAAGFALGVVEPNSSGLGGGGFMLIRIAKTGETVFIDFRERAPQKASPEMWTVDANGKVVGNKKVEGGKAAAIPGEVAGLLYALEKYGTMSREQVIRPAVNLAKNGYYVTPTLSNDMKSEFDKLEKYPESAKIYLNKEGLPYEVGDKFTNKDLAKTLEIIIKKGKDGFYKGEVAQAIVKTLNKYDGLYTMEDLANYKPLIRKPVKGTYRGYEIISSPSPSSGGAIVIEILNILENFNVSELDVNSPEYLHLFSEAYKLAYADRAKYMGDTDYTPVPMKGFVSKKYAKEISKDIDMKVSHESKAHDPWQYESEDTTHYSIADKEGNMVAITKTVNGLFGNSVVVDGYGFVMNNEMDDFVVGAGHPNSVAPGKTPLSSMSPTIVLKDGKPFMVLGSPGATKIISTVSQVISRVIDHKMSIQDAIDTPRLWDNTSNVINIESRISDETAKKLEAMGHKVNKTSDWDRGMGSVQGVLYKNDGTLEGGADPRRDGKALGL

SEQ ID NO: 20738 - protein, 306 aa, Thermococcus kodakarensis KOD1
MIESFREAFGRALVELGEENPNIVVLDADVKSSTKTAYFERAFPERFIQVGISEQDMVSMAGGLAIGGKIPVVSAFAAFLMRAWEQIRNTIARDNLNVKLIPTHSGFSDHMDGSSHQCLEDIALMRVLPNMTVVVPADAPSVPVLLKQVIELEGPVYMRLGRDHAPRVYDSPKLKLGKASVLRKGSDVLLVAAGVMVSVALETARKLEERGISAGVVDMHTIKPLDEETLLRLAAKVDLVVTLEEHSIHGGLGGAVAEVLSEKMPKRLIRIGTTEFGRSSRDYFSLLERYGLTAESVVKKVEVMLT

SEQ ID NO: 20739 - protein, 402 aa, Physcomitrella patens subsp. patens
MASPVATAQVVGNAFVNQYYNVLHQSPQVVHRFYTDASHMTRAEAGAGGAVDVAHTQDQIHHKVMSSDYSEFKAEIKTVDSQDSLSGGVLVLVTGSLSTKPTGKRNFVQSFFLAPQEKGYFVLNDVFRYLDDEEQQQTKSVPSLANGVAEGAYSHQQAPEPEEKHTGQVPVEDNTSPVIEEPESPMVQTTPVRDNPVPVQEPESVGEQPKKSYASIVSFCHFFRQESSLRVIGAPPPPKAPQPVAERPAASSAPAPVVAAPSHDNHEDAAPVETEADGRSVYVKNLPMNYTASELEQVFKNFGPVKPNGVNVRSQKQQGVCYAFVEFEEATAAQSAIEASPVQINGRPVYIEEKKPMGRAPRRLNDTRSDRPYRGDGIRGRGSYSGRNPGRGSSHDTRERDG

SEQ ID NO: 20740 - protein, 570 aa, Debaryomyces hansenii CBS767
MSDRYRPPSGPRSTRGYEDRRNPNPTSSNNNNSNSNNRNYKSSYGQRDTYTPSGPKRYQERDNYRPNSSANERSESYQPSKFRPSGPSGYRGNDRDFHFRPGSKRPHPSESKGYRGGDDYRKRQDRTDFNGPAPGPSSYRDKSSTYRNPRYDNNSYKPKVNLKNLPKGPRSGNVNDSRAKPRPYLKDEEAAPPIKLSKSQIYLIRITRPSEIYKRVQQVGEGTYGKVYKATNSITDEYVALKKLRLESEREGFPITAMREIKLLQSFDHENVVGLLEMMVEHNQIYMIFDYMDHDLTGLLTHPDLKLTESHRKFIFKQLMEGLQYLHKKRVIHRDIKGSNILLDNIGRLKIADFGLARTMNVLNDGEIPDYTNRVITIWYRPPELLLGSTDYGREVDIWGVGCLLIELYSKIAAFQGFDEIGQLYKIFNVMGTPNIENWPDMENLPWFEMLKPKINKASTFKNEYESIMSEQSFDLAVKLLTLNPKKRLTAREALEHPYFTEDPKPEPLHFLKDVKGEWHEFETKKRRRKERKRLQDAKNASSQNIAQLNNGPSMDSVPDSVVPPDGPKD

SEQ ID NO: 20741 - protein, 496 aa, Arabidopsis thaliana
MAKPEEVSVPIFTSLEPVYGEGSLLQEATQRFDVLKANFNDVFGASPQLFARSPGRVNLIGEHIDYEGYSVLPMAIRQDTIIAIRKCEDQKQLRIANVNDKYTMCTYPADPDQEIDLKNHKWGHYFICAYKGFHEYAKSKGVNLGSPVGLDVLVDGIVPTGSGLSSSAAFVCSATIAIMAVFGHNFEKKELAQLTCECERHIGTQSGGMDQAISIMAKTGFAELIDFNPVRATDVKLPDGGSFVIAHSLAESQKAVTAAKNYNNRVVECRLASIILGVKLGMEPKEAISKVKTLSDVEGLCVSFAGDRGSSDPLLAVKEYLKEEPYTAEEIEKILEEKLPSIVNNDPTSLAVLNAATHFKLHQRAAHVYSEARRVHGFKDTVNSNLSDEEKLKKLGDLMNESHYSCSVLYECSCPELEELVQVCKENGALGARLTGAGWGGCAVALVKEFDVTQFIPAVKEKYYKKRVEKGVVKKEDMELYLFASKPSSGAAIFNL

SEQ ID NO: 20742 - protein, 515 aa, Geobacillus stearothermophilus
AAPFNGTMMQYFEWYLPDDGTLWTKVANEANNLSSLGITALWLPPAYKGTSRSDVGYGVYDLYDLGEFNQKGAVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKSWGKWYVNTTNIDGFRLDAVKHIKFSFFPDWLSYVRSQTGKPLFTVGEYWSYDINKLHNYIMKTNGTMSLFDAPLHNKFYTASKSGGTFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIAWSITTRPWTDEFVRWTEPRLVAWP

SEQ ID NO: 20743 - protein, 153 aa, Thermococcus kodakarensis KOD1
MPNIAILVGEAFTGYATIDLEPDEREKVESLLRAFGECLLVDEEHMDAITGLSGSGPAYVSVFVESMIYGGLRVGLLREVAKIAALQTLLGTAKLLLNYEGHPAEIRDMVTTPGGTTIDGIFELEEGKIRTAIMKAIDAATKKSRILSTRTLP

SEQ ID NO: 20744 - protein, 508 aa, Burkholderia vietnamiensis G4
MGELASIGNARIADSDLHEPGRGGAAAAVVPVILAGGAGTRLWPMSREQHPKQLTQLVGDESLLESTLRRVRGLSATFELAAAQVVCGDAHRHITVRQLAASELRAQVIVEPARRDTAPAMTLAAELARVRHGDAVLAVMPADHAIADTAAFERAMETALRYAQLGCLATLGVRPTHADSGFGYLRTGMPVALDGAAGAFALDAFVEKPAPEIAAHYVASGSHWWNSGIYVVRASVWLRAIAALAPEIHHACVAAIRDGAAAADCFHPAAQPFAACPSNSIDYAVMERLSSLAEPPAAVAVPLDAGWSDLGSWDAVWAALDKDANGNAGRGRVMFEDAAACYAHSEGRLVACVGVSNVAVVETPDAVLVVNREQVQGVKSLVARIKAERGAEADTHRLVRRPWGCYDSVDRGERFQVKRIVVDPGARLSLQMHHHRAEHWTVVKGTAAVTRGDEQFLLGENESMYIPMGVRHRLENPGRLPLEIIEVQTGSYLGEDDIVRFDDAYGRV

SEQ ID NO: 20745 - protein, 229 aa, Arabidopsis thaliana
MDANTKTILFFVVFFIDLFSPNILFVYAREIGNKPLFTYKQKTEKGPAEWGKLDPQWKVCSTGKIQSPIDLTDERVSLIHDQALSKHYKPASAVIQSRGHDVMCHWHSPSEHTINGTSYDLELHMVHTSASGKTTVVGVLYKLGEPDEFLTKILNGIKGVGKKEIDLGIVDPRDIRFETNNFYRYIGSLTIPPCTEGVIWTVQKRFKCLLPNLILISNFSWIFSYYYVI

SEQ ID NO: 20746 - protein, 397 aa, Coprinopsis cinerea okayama7#130
MLGSRSLTSVVAQSAFKKPYTLRGYASASPTAAFAGQKGPNGKYTVTLIPGDGIGPEISQSVKDIYSAANVPIQWEEVSVTPILKGGKTVIPDAAIQSVKKNTVALKGKSPHLFSAVSNRLTSSIRIRPARNTNVVGKGHVSLNLTLRRTFNLFANVRPCASIKGFKTAYDDVNTVLIRENTEGEYSGIEHEVVDGVVQSIKLITWDASERVARYAFHYAQASGRKRVTAVHKANIMKMSDGMFLSACREVSKEFPDVVYDEDLLDRVCLKVVTNPQPYSDRVMVMPNLYGDILSDMCAGLIGGLGLTPSGNIGRDASIFEAVHGSAPDIAGKGLANPTALLLSSLMMLRHMNLNEYADKIEKAALTTIAEGKSITGDLGGKASTREYTDAIIQKLL

SEQ ID NO: 20747 - protein, 358 aa, Oryza sativa
  misc_feature (256)..(256): Xaa can be any naturally occurring amino acid
  misc_feature (275)..(275): Xaa can be any naturally occurring amino acid
  misc_feature (298)..(298): Xaa can be any naturally occurring amino acid
MGAKTPYVVIVIVELIYTGRYIISKAAFNQGMNTFIFIFYRQAAASVLLLPLAIVLERRNAPPMSLRLFIKFFLCALFGSTGTLNLYNMGLKYTTSTVASAAGSSIPVMSFFLALLLRQEMIRLRSLPGSAKAAGVGLCLAGVLVIALYTGPTISPLIHHRVFAGGGHEASASGSGRTRWIVGTVLILLSNVTWLLWSMLMAPVLREYPNKLLATTWQCVISAAQSLAVAAVAAARDPAAWRLRLDTGLLAVAYSXGVVVTAVAFYLMAWCIGEXRGPVFLAMVTPLAFVFTGLWCIXFFLGKTVPAGSAPPGGALHGWLGILHPGFGGEKNKERKKKNPPPPPPPPPPPPPPPPPPP

SEQ ID NO: 20748 - protein, 533 aa, Mycobacterium abscessus
MVQVLPDRVDDTAPGYLKNREGLSAQLDTIAEQLALVNGGGGAKYVARHRKRGKLLVRERIELMLDPDTAFLELCPFAAWGSKFPVGGSVVVGIGVVEGIESMIIAHDPTVRGGASNPYTFRKVFRGMAIARENRLPIINIVESGGADLPTQAEIFVPGGQLFHDLTQHSAAGLPTLALVFGNSTAGGAYVPGMCDYVVMVRNRSKVFLGGPPLVKMATGEVSDDESLGGADMHARTSGLADYMAEDEQDAIRIGRRIMARLNWRKSGPGPTTPPHPPVHDPDQLLGIASVDPKVPFDPRDVIARVVDGSTFDEFKPLYGTSLVTGWASIHGFPVGILANARGILFSEEAEKGSQFIQLANQIDTPLIFLQNTTGFMVGAEYEQGGIIKDGAKMINAVSNSTVPHVTITMGASYGAGNYGMCGRSYSPRFLFAWPNSKSAVMGPAQLAGVLSIVARESAADRGLPFDEEADAQMRAAVEEQIERESVALANSGRLYDDGIIDPRDTRTVLGFCLSVIHNGEVRGQRGYGVFRM

SEQ ID NO: 20749 - protein, 328 aa, Salmonella enterica subsp. enterica serovar Paratyphi A str.
MPLHHLTRFPRLELIGAPTPLEYLPRLSDYPGREIYIKRDDVTPIAMGGNKLRKLEFLVADALREGADTLITAGAIQSNHVRQTAAVAAKLGLHCVALLENPIGTTAENYLTNGNRLLLDLFNTQIEMCDVLTDPDAQLQTLATRIEAQGFRPYVIPVGGSSALGAMGYVESALEIAQQCEEVVGLSSVVVASGSAGTHAGLAVGLEHLMPDVELIGVTVSRSVAEQKPKVIALQQAIAGQLALTATADIHLWDDYFAPGYGVPNDAGMEAVKLLASLEGVLLDPVYTGKAMAGLIDGISQKRFNDDGPILFIHTGGAPALFAYHPHV

SEQ ID NO: 20750 - protein, 162 aa, Brassica napus
ESIGTSTNDKGSNGDILHGNDEHGSQDDRGSDSTLSSPGSQGNDEFGVTKDPSAEATSSGFVVKESAKEISDVERGTNDKNNVVEKPPTSSNENSTETFKNVASQDPCVKEIAPVVDSVSKVVISEKSEHAETSTHSHLVKQKSDGTSREVETVRESEAPVS

SEQ ID NO: 20751 - protein, 391 aa, Vibrio angustum S14
MTDTRYSLDDIRQNVSRIDNALLELLAERRALSLEVAKSKISTAKPVRDQTREHELLLKLIESGKLHQLDAQYVTQIFHTIIEDSVLFQQAYLQKLANPDSANPTARVAFLGAKGSYSYLASRNYFSRKQTNLVELSCSTFRDIFNTVETGNADYGVLPIENTSSGSINEVYDLLQHTSLSIVGEITQPIEHCLLTAVDTKLEHIDTLYSHPQPHQQCSEFLHSMGSIKQEYCSSTAEAMEQVAELKQPNVAAIGNASSGELYGLTSIKSDIANQQENFTRFIVVARKPVDVTSLIPAKTTLIMSTAQKAGSLVECLLVLKNLNINMSKLESRPVIGNPWEEMFYVDVEVNLKSDVMQQSLEELTRLTRFIKVLGCYPSENVAPTEVELLD

SEQ ID NO: 20752 - protein, 288 aa, Bacillus cereus G9241
MTRVAINGFGRIGRMVFRQAIKESAFEIVAINASYPSETLAHLIKYDTVHGKFDGTVEAFEDHLLVDGKMIRLLNNRDPKELPWTDLGVEVVIEATGKFNSKEKAILHVEAGAKKVILTAPGKNEDVTIVVGVNEDQLDITKHTVISNASCTTNCLAPVVKVLDEQFGIENGLMTTVHAYTNDQKNIDNPHKDLRRARACGQSIIPTTTGAAKALAKVLPHLNGKLHGMALRVPTPNVSLVDLVVDVKRDVTVEAINEAFKTVANGTLKGIVEFSEEPLVSIDFNTNT

SEQ ID NO: 20753 - protein, 389 aa, Methanosarcina mazei Go1
MTFPMYSDRINALPPYLFAAIDEARDELIAKGVDVIDLGVGDPDLPTHPHIVEAMQKAVCDPGTHQYPSYAGMPEFRKAAAEWCRKYKGIEIDPATEVLSLIGSKEAVAHIPLAFVNPGDVVLYTEPGYPVYKIGTLFAGGEPYPLPLKAENSFLPDLDSIPEDVLKKSRLFFFNYPNNPTAATADMAFFEKVVKFCKKHDIIAVHDNAYCQMAYDGYEAPSFLAAEGAMDIGMELYSHSKTYNMTGWRLGFAVGNKDLIKGLGKVKSNVDSGVFDAIQIAGIAALSSPQDCVNETNKIYEERRNALIEGLTAMGLEVKPPKATFYIWAPVPKGFTSISFAKLLLEEAGIVATPGVGFGDAGEGYIRFALTKPVERIKEAVERMKKLQL

SEQ ID NO: 20754 - protein, 469 aa, Enterobacter gergoviae
MSAEHVLTMLNEHEVKFVDLRFTDTKGKEQHVTIPSHQVNAEFFEEGKMFDGSSIGGWKGINESDMVLMPDASTAVIDPFYEEPTLIIRCDILEPGTLQGYDRDPRSIAKRAEEYLRATGIADTVLFGPETEFFLFDDIRFGASISGSHVAIDDIEGAWNSSTKYEGGNKGHRPGVKGGYFPVPPVDSSQDIRSTMCMIMEEMGLVVEAHHHEVATAGQNEVATRFNTMTKKADEIQIYKYVVHNVAHRFGKTATFMPKPMFGDNGSGMHCHMSLAKNGTNLFSGDKYAGLSEQALFYIGGVIKHAKAINALANPTTNSYKRLVPGYEAPVMLAYSARNRSASIRIPVVTSPKARRIEVRFPDPAANPYLCFAALLMAGLDGIKNKIHPGEAMDKNLYDLPPEEAKEIPQVAGSLEEALQALDADREFLTAGGVFTNDAIDAYIALRLEENDRVRMTPHPVEFELYYSV

SEQ ID NO: 20755 - protein, 141 aa, Vibrio vulnificus CMCP6
MALERTFSIIKPDAVERNLIGEIYHRIEKAGLRIIAAKMVHLNDEQASGFYAEHEGKEFFPALKEFMTSGPIMVQVLEGENAIARYRELMGKTNPEEAACGTIRADYALSMRHNSVHGSDSPASAAREIAFFFPESEICPR

SEQ ID NO: 20756 - protein, 319 aa, Gibberella zeae PH-1
MAASIIRMRSLAASRQVRCFSSSPRQYAAAEVKKLGVIGAGQMGLGIALVAAQRAQVPVTLIDTTDKALEKGIAFAEKLLAKDVSKSRITQEQADKARSLLSTSTKMEDLSSADMVIEAIPELPKLKFDIFSKLAQICPKHAILATNTSSISITRIAAATTTDPTDTSASSRVVSTHFMNPVPVQKGVEIISGLQTSQDTLDTAIEFCKRMGKITSVSADSPGFLANRILMPYINEAIICLETNVGDRDSIDAIMKNGTNVPMGPLQLADFIGLDTCLSIMKVLYEETADSKYRPSVLLKNMVSAGWYGKKSGKGFYDY

SEQ ID NO: 20757 - protein, 70 aa, Zea mays
MTRWPDDNSFYEAEITDYDASKDIYTLVYDINTADETWEWVDFKEGQTHHSCSAAVLLLVDALSAICFGR

SEQ ID NO: 20758 - protein, 341 aa, Yersinia pestis CO92
MKALSKLKAEEGIWMTDVPQPELGHNDIMIKIRKTAICGTDVHIYNWDEWSQKTIPVPMVVGHEYVGEVVAIGQEVKGFNIGDRVSGEGHITCGHCRNCRGGRTHLCRNTVGVGVNRPGSFAEYLVIPAFNAFKIPDNISDELAAIFDPFGNAVHTALSFDLVGEDVLVSGAGPIGIMAAAVCKHVGARHVVIADVNEYRLDLARKMGVTRAVNVSKENLNDVMTELGMTEGFDVGLEMSGAPPAFRSLLNSMNHGGRIAMLGIPPSDMSIDWNQVIFKGLFIKGIYGREMFETWYKMAALIQSGLDLTPIITHRFPIDEFQQGFDAMRSGKSGKVVLSWD

SEQ ID NO: 20759 - protein, 446 aa, Frankia sp. EAN1pec
MTQASSAHPENREHVFYSWAAQETTHPLVVAGAEGSWFWDKGGTRYLDFSSQLVNANIGHQHPAVVEAVVAQARELTTVGPQHAHAVRSEAARLIAERAPGDLDQVFFTTGGAEATENAVRLARLATGRNKILAAYRSYHGSTGGSITLTGEPRRWASEPGIPGVVHFFGPYPYRSSFHAADAAQEGERALAHLAEVIELEGPSAIAAVILEPVVGTNGILVPPDGYLAGVRELCDAHGILLIADEVMSGFGRCGEWFAIDHWNVVPDLICFAKGVNSGYVPLGGVIISQRIADLFARRPYPGGLTYSGHLLACAAAVASIRAFESEDILGRARALGSEVIGPQLAKIAARHPSVGEVRGLGVFWAVELVRDRVTREPLVPFNAAGAAAAPMAAVTAACRERGLWPFTHFNRVHVVPPCTTSPEDVSLGLSILDEALAVADGCYTG

SEQ ID NO: 20760 - protein, 515 aa, Yersinia pestis CO92
MSSTKKPLVLTILDGYGHREEQQDNAILNAKTPVMDVLWQQQPHTLIAASGLDVGLPDGQMGNSEVGHVNLGAGRIVYQDLTRLDKEIKEGDFFTNPTLTAAVDNAVKTGKAVHIMGLLSAGGVHSHEDHIMAMVELAAKRGATAIYLHAFLDGRDTPPRSAESSLKRFTAKFAELGNGRIASIIGRYYAMDRDNRWDRVQLAYDLLTQAKGEFTADNAVAGLQAAYARGENDEFVKPTVIQATGEADAAMNEGDTLIFMNFRADRARQITRTFVNAEFDGFKRDKVVNFGDFIMLTEYAADIKVACAYPPASLTNTFGEWLMKHDKTQLRISETEKYAHVTFFYNGGVEEPFKGEDRILINSPKVATYDLQPEMSSAELTEKLVSAIGSGKYDVIICNYPNGDMVGHTGDYDAAVKAVETLDNCIEQVVAAVKAADGQLLITADHGNAEQMRDPATGQAHTAHTSLPVPLIYVGNKAVKAVEGGKLSDIAPTMLSLMEMEIPQEMTGKPLFIVE

SEQ ID NO: 20761 - protein, 361 aa, Stevia rebaudiana
MALVNPTALFYGTSIRTRPTNLLNPTQKLRPVSSSSLPSFSSVSAILTEKHQSNPSENNNLQTHLETPFNFDSYMLEKVNMVNEALDASVPLKDPIKIHESMRYSLLAGGKRIRPMMCIAACEIVGGNILNAMPAACAVEMIHTMSLVHDDLPCMDNDDFRRGKPISHKVYGEEMAVLTGDALLSLSFEHIATATKGVSKDRIVRAIGELARSVGSEGLVAGQVVDILSEGADVGLDHLEYIHIHKTAMLLESSVVIGAIMGGGSDQQIEKLRKFARSIGLLFQVVDDILDVTKSTEELGKTAGKDLLTDKTTYPKLLGIEKSREFAEKLNKEAQEQLSGFDRRKAAPLIALANYNAYRQN

SEQ ID NO: 20762 - protein, 318 aa, Corynebacterium glutamicum ATCC 13032
MTNLTSTHEVLAIGRLGVDIYPLQSGVGLADVQSFGKYLGGSAANVSVAAARHGHNSALLSRVGNDPFGEYLLAELERLGVDNQYVATDQTFKTPVTFCEIFPPDDFPLYFYREPKAPDLNIESADVSLDDVREADILWFTLTGFSEEPSRGTHREILTTRANRRHTIFDLDYRPMFWESPEEATKQAEWALQHSTVAVGNKEECEIAVGETEPERAGRALLERGVELAIVKQGPKGVMAMTKDETVEVPPFFVDVINGLGAGDAFGGALCHGLLSEWPLEKVLRFANTAGALVASRLECSTAMPTTDEVEASLNQKV

SEQ ID NO: 20763 - protein, 440 aa, Debaryomyces hansenii CBS767
MGSCTSKQLDNTKPSEAPKVNNKRHDQKQSLNSNKNNINASKDHNTSTDSSNELHSSTYPEKSANETSNAISSSAGSEKEVKVLLLGSGESGKSTIVKQMKILHQNGYSTEELYEYKPFVYKNVLECIKSVINAIIDLEPDLIHKQNETGADDNIGNNTVAPDNQEDRIQQFSGTKDANRKHVLDYDMLNEVLDYEVNINVDESFNPDIAGKIIHIYKTPEVQKFIRYQQGNFYLIDSTNYFLNDLERISKVDYCPSVNDILRTRKKTSGIFDFKFQMSGGLNIHMFDVGGQRSERKKWIHCFDNVTSIIFCVALSEYDQVLLEENSQNRLEESLILFDSVVNSRWFARTSIVLFLNKIDVFAEKLPYSPLENHFPDYTGGNNINKAAKYILWRFNQVNRSGLSIYPHVTQATDTSNIQLVFAAIKETILENSLKDSGLL

SEQ ID NO: 20764 - protein, 604 aa, Triticum aestivum
MARGGQGQGGGGVEEREVVNVVDQDGREEEVRRALPMMPVRVLLAEGDDSTRHVISALLRKCGYHVSAASDGVKAWELLKEKSFKIDLVLTEVELPLMSGFLLLSTIMEHDACKNIPVIMMSSNDAVSMVFKCMLKGAADFLVKPIRKNELRNLWQHVWRKQLANGEIDVQQIQQEENVAEQHGQKTEMTKAEHSIQNVVRRNRDCSEQESDAQSSCTRSEPEAESKHTNSFLEFKQITERQSSTDPKNTLENRDPENPSDNKRKKASTDIEVVHIIDDEPKPSTPMEVDIVRTNPQGNGDKWFSIPAHQLELSLRRSDYGRSEDQEKNDTRTLNHSTSSAFSLYNCRPISSFGNAGDAQPCSTSATHADLQNKNGDSAAPFQDKADPICHPIRVVALPVPVGGLTFDGQPFWSGAPVAPLLYPQSGPPIWNGRTPVSQEVDTQATSSQQSDPTEMDCQQTESTQRQEVLPSPTANEKHLHVEIPSDSNPQQVSPMASESGTGSSTVLNNSGNALSGSACGSSSNRIATPTEQCNASDGATENPSMEGSHQLSQREIALNKFRLKRKERCFEKKVRYQSRKLLAEQRPRVKGQFVRQEQNIQAS

SEQ ID NO: 20765 - protein, 339 aa, Yersinia pestis CO92
MNTNPASMAVIGAGSYGTALAITLARNGHQVVLWGHDPKHIQQLQQDRCNRAFLPDAAFPDTLRLETDLACALAASRDVLVVVPSHVFGAVLHQLKPHLRKDARIVWATKGLEAETGRLLQDVAREVLGEAIPLAVISGPTFAKELAAGLPTAIALASTDVQFSEDLQQLLHCGKSFRVYSNPDFIGVQLGGAVKNVIAIGAGMSDGIGFGANARTALITRGLAEMTRLGTALGADPSTFMGMAGLGDLVLTCTDNQSRNRRFGIMLGQGLGVKEAQDNIGQVVEGYRNTKEVLALAQRHGVEMPITEQIYQVLYCHKNAREAALTLLGRTKKDEKIGI

SEQ ID NO: 20766 - protein, 155 aa, Staphylococcus haemolyticus
ELTTGPEIVEQFEGKQIDAFLAGVGTGGTLSGAGKVLKEKYPNIEIVAIEPEASPVLSGGEPGPHKLQGLGAGFVPDTLNTDIYDSIIQVGNDIAMETSRRVAKEEGILAGISSGAAIHAAIQKAKELGKGKTVLTVLPSNGERYLSTPLYSFDD

SEQ ID NO: 20767 - protein, 506 aa, Debaryomyces hansenii CBS767
MKINLKEVTENLKESEKKPALSKRTQDQVDLTSKYNDEFYEKYANEYIEFTYANPTIFHVVDYFAEKLNNEGFKYLPEKKSWESLKPGKYYTIRHGAALGAFIVGKNWTAERGVGVIGSHIDSLTVPLKPNSSKEKIDGYELLGVAPYAGTLNDLWLDRDLGVGGSLLVRDSASKRVNQQLVDSTPHPIARIPTLAPHFGAASARPYNKETQAVPVIGYSGSDDEEEEATDEEKSSPLYGRHPLKLLRYISSLAGVEVSEILQWDLQLYDVQKGTRGGLNKEFIFSPRIDDRICSFAAIHSLLESNHDALVESDSFSLVALFNHEEIGSGSATGAKGGITDLIISRVLASQYFNPDDSHTQEQLELAYANSIILSADVNHLLNPNFASEYLDHHKPVPNKGITIAVDPNGHFATDAPGLALAEELARLNNDSLQYFQIRNDSRSGSSIGPLISLQTGARTIDLGISQLSMHSIRATVGFKDIGLGIKFFNGFFSNWRKTYDGYSTL

SEQ ID NO: 20768 - protein, 347 aa, Thermococcus kodakarensis KOD1
MYRVAVIPGDGIGPEVIDGAVRVLKAVTGRVRFEYYEGGVDVFQECGSPIREEDLEEIRRSDAVLFGATTTPFDLPGYRSLILTLRKELGLYANLRIIPDLRTGREIVIVRENSEGLYFGIGAVVNGRAVDVRLITREGAERIARFAVEQAKARGSFITFVHKANVLTGDKFFRRIVREVAGEEGVEVRDAIIDSFTIKLVRNPWEHGVILSENLFGDILSDLATVHAGSIGIVPSGNYGDGIALFEPVHGSAPDIAGKGIANPIGAILSGAMLLDYLGLDGSLIRAAVRGYVVNGELTPDMGGRARTEDVVRGIIGEIEDLLSMDEVWRDEIRLSRLESDISRMAG

SEQ ID NO: 20769 - protein, 485 aa, Agrobacterium tumefaciens str. C58
MTSPLQHLQQSGRLKKFYIDGKWVLPSGSDKVAVINPATELEFAEIALGNDEDVALAVAAARGAFAGWARTGPADRSELLNRVHQLMQQRLELLAQALTMEMGAAINYARSVQVPLAAEHIKVARDNAASYSFLSQRGHTAILREPIGVCGLITPWNWPLYQITAKVGPALAAGCTVVLKPSELSPLSALLFAEIIEDAGFPPGVFNLVNGEGTIVGAGLSAHPDVDMISITGSTRAGILVAQAAAPTVKRVAQELGGKSPNIILADADMTRAVPLGVAAAFRNLGQSCSAPTRMIVPRSHQKHIEELAAAAALEIVVGDPLSEHTTHGPVANHAQFDRIQRMISIGMDEGAKLVVGGTGRPDGLDTGFYVRPTIFSDVDPKMQIAQQEIFGPVLSIISYDTLEEAIEIANDTVYGLGAHVQGTDLQTVRIVAEQIRSGQVHLNYPAWDPNAPFGGYKQSGNGREYGTEGMEEYLEIKSILGFYP

SEQ ID NO: 20770 - protein, 464 aa, Listeria innocua Clip11262
MLYSKENKESYLEPVFGSSAEDRDIPKYTLAKEPLEPRIAYRLVKDELLDEGSARQNLATFCQTYMEDEATKLMSETLEKNAIDKSEYPRTAELENRCVNIIADLWHAPKDQKFMGTSTIGSSEACMLGGMAMKFAWRKRAEKLGLDIYAQKPNLVISSGYQVCWEKFCVYWDIDMRVVPMDKDHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIYNDGSHLPIVCYKLKDDANVKWTLYDLADRLQMRGWQVPAYPLPKNLENIIIQRYVCRADLGFNMAEEFIQDFQASIQELNNAHILFHDTQQSGVHGFTH

SEQ ID NO: 20771 - protein, 273 aa, Vitis vinifera
MLANLQVSRPQPWNHRSPLLIQCALSKQGQLFLSSVARDPSASNRLICKFIASSSKSIALNALSHLLSPTTTHPYLSSLALPLYSRISEASWFSWNPKLIADVIALLYKQGQLKEAETLVSETLIKLGSRERDLVSFYCNLIDSHSKHSSNQGVFDVISRLSRIVSESSSVYVKERAYKSMISSLCAVGLPLEAENLIEEMRVKGLKPSVFEFRSVVYGYGRVGLSEDMQRILLQMGNEGFELDTVVSNMVLSSYGAYNKQSEMVPQNFSANH

SEQ ID NO: 20772 - protein, 107 aa, Vitis vinifera
MVLAELMEWDCSEGKLDLHGMHLGSAYLIMLQWREELRYRLNAAEYVMPVEITVVCGSGKHSSVRGESPVKRMVREMMTRTRSPMKIDRKNIGCFVAKAKVVKNWLC

SEQ ID NO: 20773 - protein, 812 aa, Cryptococcus neoformans var. neoformans JEC21
MAPKQRRATNSKAKATPTSVTSPPDQSSPVRSRGGSSSLSPIRSPQENSDLEDNNERHPGTNGSGLKAEDEGSTDLLDRDGDLEEVHACPDSITFRYPSSVPDFTILSPREKAFKVARFLHCTAPSCACTGLEPPAGRTIRITKHDSSNEDEDDEDEDDDVSMEDSENPLDFEDKKDEWRTKEGWWRICGKCGHGWESGGHVWADDVPPKERTRRGKVVGRIEEILEDENKLVEFPTPQPESISSLLKQLHEFVPPPAGKTTISALPPPVDLSTPDDDTQEDNSDGERPRKRRRQASESTHSDIEGEQHRGQGKKKQGKGPAKGAKPRVPRTVVRGAHGFIPMATDPDGNQHVEGHLPISAGGTGADETFEEEEEEEEELSTAKRPELDETERRRRTEIKVKEKEREEELVSRLAAGVNPEDAGGAVEIWEGIELQKLPLRPAAIEQANREIMLPVVSSRNPTPVATILLVGLKNVFQRQLPKMPREYITRLVLDKNHISMAIVKRGYRVVGGICYRPFEARGFAEIVFCAVDSSEQIKGYGSHLMNSLKDHVRKAHPTINVFLTYADNYAVGYFKKQGFTKEISYPRERWVGYIKDYEGGTIMQGRMLPKVKYMEVHQMLADQKAAIIAKIKTLTKSHIIHPGLQIFKERQPDEEIKLTKEQVPGLGKLYLYISLCTHQRADTAIAESGWNPDLDDIVRQPKRNPYHVLLQHVLNDLQNEPSAWPFVKPVDSSVVADYYDVIKDPMDLSTMEYKLENNHYESIEGFVADVKLMCANCRQYNGEKSTYTKQANLLEKALDRILKKRKSVLAD

SEQ ID NO: 20774 - protein, 409 aa, Pseudomonas aeruginosa UCBPP-PA14
MAIEIKAPTFPESVADGTVATWHKKPGEAVKRDELIVDIETDKVVIEVLAEADGVLAEIIKNEGDTVLSNELLGKLNEGGAAAPAAPAAAAPAAAPAAQAAAPAAAGGDDAILSPAARKLAEEAGIDPNSIAGTGKGGRVTKEDVVAAVEAKKNAPAALAKPAAPAAEAPIFAAGDRVEKRVPMTRLRAKVAERLVEAQSAMAMLTTFNEVNMKPIMDLRSKYKDLFEKKHNGVRLGFMSFFVKAATEALKRFPGVNASIDGNDIVYHGYQDIGVAVSSDRGLVVPVLRNAEFMSLAEIEGGIANFGKKAKEGKLTIEDMTGGTFTISNGGVFGSLLSTPIVNPPQTAILGMHKIQERPMAVNGQVVILPMMYLALSYDHRLIDGKEAVSFLVAIKDLLEDPARLLLDV

SEQ ID NO: 20775 - protein, 477 aa, Zymomonas mobilis subsp. mobilis ZM4
MLKKYFGSRKKFRSLSSQQSHPHKKDQALSRNLSWPHLIALGVGAIVGTGIYTLVGVGADRAGPAVVIAFIIAGLICATAALGYAELSTLIPEAGGAYTYAYMAIGRHMAWIVGWSLILEYSLASSTVAVGWSAYLVGWLHSFGINLPAALLAGPHDGGIINLPAVIVALSIALLLTAGAKESATLTLALVILKLSALVLFVVLTMPAFHFEYYHPFMPYGFVSHISPDGKVRGVMAAAAILFFAFYGFDTVATAAEETKNPKRDLTIGIIGSMTISVLIYIGVAACLLGAAPFSEFIKSGEPLALILRNLHHETAAKWIAAAALVALPSVIMAMIYGQSRVFFVMARDHLLPPFLAKVNKHGTPSQVTLFTGIVIALIAGFFRLDELAELANAGTLVAFIAVGLSLIILRVREGERTRRFSCPFPFVIGSVTVIGCLYLFTSLPLHTTIRFLLWNAIGLVFYGSYNLYKRKKQKSL

SEQ ID NO: 20776 - protein, 388 aa, Pseudomonas aeruginosa UCBPP-PA14
MNLHEYQGKQLFAEYGLPVSKGFAVDTPEEAAEACDKIGGSEWVVKAQVHAGGRGKAGGVKLVKSKEDAKAFAQQWLGKNLVTYQTDANGQPVSKILVESCTDIDKELYLGAVVDRSSRRIVFMASTEGGVDIEKVAHDTPEKILKVTIDPLVGAQPYQGRELAFQLGLKGDQIKQFTHIFVGLAKLFQDYDLALLEVNPLVIKKDGNLHCLDAKINIDSNALYRQPKLRAMHDPSQDDAREAHAQKWELNYVALEGNIGCMVNGAGLAMGTMDIVNLHGGKPANFLDVGGGATKERVTEAFKIILSDSNVKAVLVNIFGGIVRCDMIAEGIIGAVKEVGVKVPVVVRLEGNNAELGAKVLAESGLNIIAATSLTDAAQQVVKAAEGK

SEQ ID NO: 20777 - protein, 498 aa, Mycobacterium abscessus
MDAVEAAQRPGGTMTNHLLAPAHHVKERLSSVIMVPAPHAVDDRWRRWSRDWPVRELAPAPAGSGLKAVRGDAGLPFVGHTLDYIRFGSDFSRERYDRLGSVSWMGAFGTKMVVIAGPDATREAFTSEAKAFSQDGWSFLIDAFFHRGLMLMSFDEHLMHRRIMQEAFTRPRLTGYVEQVTPCVRSAVPAWPVGPSVRIYPLLKELTLDIATDVFMGGRGKDESDAVNKAFVATVRAASSLVRAPLPGTRFRAGVQGRRVLEDYFFRHLPAARAGETEDLFAALCQATTEDGERFSDEDVVNHMIFLMMAAHDTSTITTTAVTYFLAKYPQWQEAAAAEAAAIGDGLPDIEALEKMTVIDRVIKEALRLLAPVPLVMRKTVRDVAIDGYHIPSNTLCAITPAVNHFDRTIWNDPERFDPSRFDEPRREDQHHRFAWVPFGGGAHKCIGMQFGTLEVKAILHRMLRSFTWKVPENYHVRWDNTSLPIPVDGLPLEMKRR

SEQ ID NO: 20778 - protein, 471 aa, Xanthobacter autotrophicus Py2
MADSYDIIVIGGGPGGYVAAIRAAQLGFKVAVVEKSHLGGICLNWGCIPTKALLRSAEIYHYMEHAKDYGLSAEKIGFDAAAVVKRSRGVSAQLAGGVAFLLNKNKVDVIWGKATFTAPGKIKVEASQNPPKGAKGGGDYTAKHIIVATGARPRALPGLEPDKKLIWTYFDAMVPEKMPKSLLVMGSGAIGIEFASFYRTMGTEVTVVEVLPQILPVEDEEIAAVARKRFEKLGMKILSGAKVTGVTKHADSITAHVEDAKGAKHDITVERMISAVGVVGNVEGLGLEAIGVKIERGCVVIDGYGRTNVPGVYAIGDIAGPPMLAHKAEHEGVICVETIKGLHTHPMDKNKIPGCTYCTPQIASVGLTEKKAKEAGREIKVGRFSFIGNGKAIALGEPDGLVKTIFDAKTGELLGAHMVGAEVTELIQGFVVAMNLETTEEDLIHTVFPHPTLSEMMHESVMSAYGRAIHS

SEQ ID NO: 20779 - protein, 307 aa, Geobacter sulfurreducens PCA
MPLLTNDKVIEQIGNTPLLRLAKLERKGSAAVFGKAEFFNPGGSIKDRICLAMIEAAERDGTLKPGATVVEPTSGNTGIGLSMICAVKGYKLILTMPDTMTVERRRLLAAYGAELILTPGAQGMRGAVMKAEELAAQPGHVMMHQFKNPANPDIHRRTTGPEIVETLSGTTIDAFVAGVGTGGTITGVGEVLRTHNSSVRVVAVEPADSPVLSGGQPGPHKIQGIGAGFVPDVLNTKVYDEIITVSNDDAYATVRDLAREEGILVGISSGANVFAALQVAAKLGPGKNVVTILCDTGERYLSTGVFD

SEQ ID NO: 20780 - protein, 669 aa, Myxococcus xanthus DK 1622
MHGAALQPRLRQGMEGGANSPSFPSGDACSGPALPPRCHCASCVEPPRPQPPLSSPTCAGSCHCARPRAPPSAGRIAPLRARGDSLIGTRSRHEAGLASRLCALVLLDPSSETDMHRSPGSILPSRGASPRPFLPVNVLLVSVLLALGSGCGDSEPDKTNDCPNPSVGCGQQDSGTPDAGAPDAGNPDAGIPDAGDPDAGNPDAGHPDACNPDAGNPDGGGPLPTVPTLIESSQSAHQVSAGQTVTFHVTGRDDLACPLQFSWDASSGTLGSPETSAATSDVTWTAPHCVLWSSEVTITLTVTNNARLSTSKSFTVSAPRCPGPVVSGGVSHSLAIRGNGTLWSWGHNSFGQLGDETNATRHAPVQVPGLTDATAVAGGHAHSLASRADGTVWAWGLNGGALGDGTTSTQYAPVQVSGLTGAISVAAGSSFSLALDADGTVWAWGMNGSGELGDGTTTDRLTPVRVSGLSNITALAAGTGHSLALGADGTVWAWGLNFHGELGDGTTVSRPLPVQVPGLTGVIAVAAGMYHSVALRNDGTVWAWGWNLKGELGDGTTTQRESPVQVPGVTGAIAVAAGGYHSLALLSDNTLRAWGKNEDRQLGDGTNTDRHTAVQVSGLTGVTSVFAGGGHSLILRNDQAVWAFGSDVSGQLGDGNTPSGHGPVQVSLP

SEQ ID NO: 20781 - protein, 358 aa, Glycine max
MSHFKGKYHDELIANAAYIGTPGKGILAADESTGTIGKRLASISVENIESNRRALRELLFTAPGVLQYLSGVILFEETLYQSTAAGKPFVNVLKEAGVLPGIKVDKGTVELAGTNGETTTQGLDGLGQRCAKYYEAGARFAKWRAVLKIGPNEPSELSIHENAYGLARYAVICQENGLVPIVEPEILVDGPHDIHKCAAVTERVLAACYKALNDHHVLLEGTLLKPNMVTPGSQSAKVSPQVVAEHTVRALQRTVPAAVPAVVFLSGGQSEEEASVNLNAINQVNGKKPWSLSFSFGRALQQSTLKAWGGKEENVKKAQEALLVRAKANSEATLGTYKGNSQLADGASESLHVSNYSY

SEQ ID NO: 20782 - protein, 464 aa, Hyphomonas neptunium ATCC 15444
MTKVIMSDFQSLGLTGRILTSLTKAGYTAPTPIQEQAIPLVIQGRDIVGLAQTGTGKTLAFAAPILDRLSRNASPAPVRGTRVLVLAPTRELAGQIATSFGTYGAGLNLRVVMVCGGAKIGGQIRQLERGAHILVATPGRLIDLMEQRAVSLDKVETLILDEADQMLDLGFIHALRAIAKNVPSKRQTLFFSATMPKAVESLAATFLRNPAEVSVAPPATTAGRIEQRVCFVEQPEKASLLIEKIRDPELRSAIVFTRTKHGADGVVKRLAKADIDSVAIHGNKSQSQREKALEAFKAGRVPILVATDIAARGIHVDALTHVINYDLPDVPEQFVHRIGRTARAGNSGVAISFCSRDERPTLRAIEKLTGLKLAPNGVSLPDEPLRKPGKPQGNRSGNGGGRGGARSGGGYQGQSSGSQSGGSHSGRPHRKGPPGGGANASGQNSQRSSNGAARPRRFKERADA

SEQ ID NO: 20783 - protein, 356 aa, Glycine max
MKKGNLGLGLKLSVPVSDQSNFARFLTESGTFKDGDLLVNRDGVRIVSQNDVEAPPPIKPTDNQLTLADIDVIKVVGKGNGGVVQLVQHKWTSQFFALKVIQMNIEESMRKQIAQELKINQQAQCPYVVVCYQSFYENGVISIILEYMDGGSLADLLKKVKTIPEDYLAAICKQVLKGLVYLHHEKHIIHRDLKPSNLLINHIGEVKITDFGVSAIMESTSGQANTFIGTYNYMSPERINGSQRGYNYKSDIWSLGLILLECALGRFPYAPPDQSETWESIFELIETIVDKPPPIPPSEQFSTEFCSFISACLQKDPKDRLSAQELMAHPFVNMYDDLEVDLSAYFSNAGSPLATL

SEQ ID NO: 20784 - protein, 182 aa, Brassica napus
MSQDHDETENKSYADAVGGDGDDAGETVKGETTNGDRKTDSVKVDEEDGSESLYSLVCITIGSILFPDSKTGYASSSPLLQRIRNSFAENGPKLREASKKTSREILQWTRRGSYLRALLVITMGTIGLVTTMALVVFALFFVAATFNAIIISLLVSLAVAGGFLALFFLSLAGIYIGALSVA

SEQ ID NO: 20785 - protein, 504 aa, Corynebacterium glutamicum ATCC 13032
MSEPQTISHWIDGAISPSTSGKTAPVYNPATGQVTANVALASQEEIDATIASATKAAKTWGNLSIAKRQAVLFNFRELLNARKGELAEIITAEHGKVLSDAMGEILRGQEVVELATGFPHLLKGAFNENVSTGIDVYSLKQPLGVVGIISPFNFPAMVPMWFFPIAIAAGNAVILKPSEKDPSAALWMAQIWKEAGLPDGVFNVLQGDKLAVDGLLNSPDVSAISFVGSTPIAKYIYETSAKNGKRVQALGGAKNHMLVLPDADLDLVADQAINAGYGAAGERCMAVSVVLAIESVADELIEKIKERIDTLRIGNGAGDEQGEPHLGPLITDVHRDKVASYVDIAEADGAKIIVDGRNCAVDGHEEGFFFGPTLIDDIPLTSRAYTEEIFGPVLSVVRVASFDEAIELINSGEFGNGTAIFTNDGGAARRFQHEIEVGMIGINVPIPVPVAYHSFGGWKNSLFGDAKAYGTQGFDFFTREKAITSRWLDPATHGGINLGFPQND

SEQ ID NO: 20786 - protein, 273 aa, Yersinia pestis CO92
MSSEELEQVWSNIKSEARALAECEPMLASFFHATLLKHENLGSALSYILANKLANPIMPAIAIREVVEEAYRSDAHMIVSAARDILAVRLRDPAVDKYSTPLLYLKGFHALQAYRIGHWLWAQDRKALAIYLQNQVSVAFGVDIHPAATIGCGIMLDHATGIVIGETAVVENDVSILQSVTLGGTGKTSGDRHPKIREGVMIGAGAKILGNIEVGRGAKIGAGSVVLQSVPAHTTAAGVPARIVGKPESDKPSLDMDQHFNGSIQGFEYGDGI

SEQ ID NO: 20787 - protein, 292 aa, Methylococcus capsulatus str. Bath
MSKKHPIIAITGSSGAGTTTVKCAFEHIFFRLGLKPLVIEGDSFHRYDRVEMRAQIDKARREGRHFSHFSIEANILDELENVFRHYGETGTARRRFYVHNEAESQRLGGYKPGTFTPWEEVPAGTDLLFYEGLHGGVITDRINVRKYVDLLVGVVPIVNLEWIQKIHRDTAERGYKPEDVTETILRRMDDYVKVITPQFSQTDINFQRVPTVDTSNPFIARDIPTPDESFVIIRFKEPGKFNVDFPYLLAMLQNSFMSRHNSIVIPGGKMGLAMEIIFRPILERMMADREKG

SEQ ID NO: 20788 - protein, 330 aa, Escherichia coli
TIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 20789 - protein, 402 aa, Bordetella bronchiseptica RB50
MRKAAVIGGSLGGLFAANLLLRAGWDVHVHERVHDELDGRGAGIVTHPELLDVLRRIGVAPTESIGIEVARRVTLDLDGSVLASRALPQLLTAWGRLFSILRTRFPAERYHRGQALESLEQDERRALLRFADGARAEVDLVVAADGLRSTLRQALLPQARPAYAGYVAWRGLVDEASLSERTRRELCPYFAFGLPAHEQMIAYPVAGTGSGAQDAARRFNFVWYRPADEHTTFRDMVTDAQGQAWMDGIPPPLIRPEIVAQARQAAAQVLAPQFGEVVAKTANLFFQPIFDLESPRLALGRVALLGDAAFVARPHCGMGVTKAAGDARALAYALAGTPDIGAALQAYEDERLPFGKFIVGHARDLGRYMQAQLRDDAEREMAERYRTPEAIMRETAVAPAWR

SEQ ID NO: 20790 - protein, 330 aa, Escherichia coli
TIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDTETGYSNKVLDLIAHISK

SEQ ID NO: 20791 - protein, 261 aa, Corynebacterium diphtheriae NCTC 13129
MLALLRFVANLTSMTTGKLILLRHGQSEWNASNQFTGWVDVNLTEKGEAEAKRGGELLKAQGVLPSVVYTSLLRRAIRTANIALNAADRHWIPVVRDWRLNERHYGALQGLNKAETKEKYGDEQFMAWRRSYGTPPPELEDSSEFSQANDPRYANLDVVPRTECLKDVVERFVPYFKEEILPRVKNGETVLIAAHGNSLRALVKHLDNISDADIAELNIPTGIPLVYELDEAGTVLNPGGTYLDPEAAAAGAAAVAAQGAK

SEQ ID NO: 20792 - protein, 505 aa, Agrobacterium tumefaciens str. C58
MHEPLTAAEYKAIASDLQFPANAFIDGAFRPAGSGKTFKTINPATGETLADISACDVSDVDYAVGKARAAFDDGRWRLLPPGERKAILLTFAKLLEQHRHELAVMESLDSGKPVSECQTVDIPDTIHTIRWHAELIDKLYDNTAPVGSNALALVVREPVGVVGCVLPWNFPLLMLAWKIGPALASGCSVIVKPAEETTLTTLRVAELAHEAGIPAGVFNVVPGGGKEVGEPIGMHMDVDMVAFTGSTPTGRRFLRYAADSNLKRIVLECGGKNPAVVLDDAEDLDLVAEQVVNGAFWNMGENCSASSRLIVHAKIKDELLQRIGAYMREWRMGDPLDPQNRVGALVSKAHFDKVHSFLEDVKAENLTIVHGGKTEKGIFIEPTVVDAVPPASRLFREEIFGPILSVTTFNTLAEAVALANDTNYGLAASVYTGSLRKAIKLSREIRAGVVTVNCFGEGDATTPFGGYKESGFGGRDKSIFAHDNYCELKTIWIDVSDRSVDETVR

SEQ ID NO: 20793 - protein, 171 aa, Picea sitchensis
MPNPKVYFEMTVGGAPVGRIVMELFADVRPKTAENFRALCTGEIGVGKSGKPLHYKGSSFHRVIPGFMCQGGDFTAGNGTGGESIYGSKFPDENFVKKHTGPGILSMANAGKNTNGSQFFVCTAKTEWLDGKHVVFGQVVEGLDVVKVIEGVGSSSGRTSKPVAIADCGQL

SEQ ID NO: 20794 - protein, 270 aa, Corynebacterium diphtheriae NCTC 13129
MFAMTSIAVIGGGKIGEALISGLVASGMSPKDIHVTNRNAERAQELKERYGVLTFLENIAAVDDVDMVFLCVKPQQVIPVVEEIADVVDNNTSTTIVSMAAGVTNAMIEESLAAGSPVIRVMPNTPMLVGKGMSVVAPGRYADEDTVASLTQLLEAVGSVEVIEESSMDAVVALSGSSPAYLFLMVEALIDAGVFLGLPRDKAKNLAVSSFAGAATMLEQTGEEPAVLRANVSSPGGTTIAAIREFEESGLRAAVYRAATAAATRNSSLG

SEQ ID NO: 20795 - protein, 170 aa, Triticum turgidum subsp. durum
MASSATSVAPFQGLKSTDGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 20796 - protein, 453 aa, Listeria innocua Clip11262
MKVIKFGGSSLASGIQLNKVFQLVAEDSERKIVVVSAPGKRFKDDTKVTDLLIDCAAKALLGEDTSELFEAVIARYAGIALDTGMDDAIITQIRADLQKTISSDKSDPDKFLDRMKASGEDNNAKLIAAYFKFKGLNANYVNPKDAGLFVTDEHASAQVLPESYDRLFALREREGIIVFPGFFGYTKDGEISTFSRSGSDITGAIVANGAQAELYENFTDVDAVYAVNPAIVKNPKKVLELTYREMRELSYAGFSVFHDEALIPAFHAGIPVHIKNTNNPDSCGTRVVHERENNNGPVVGIASDDGFCSIYISKYLMNREIGFGRKVLQILEDAGLNYEHMPSGIDDLTIIIRENQFGEDTERTIMTRLKEELNADQVIMQHGISLIMVVGEAMRHNVGITSRASKALSDAKVNIEMINQGSSEVSIMFGVKEEQENTAVRALYNEFFSEVLV

SEQ ID NO: 20797 - protein, 169 aa, Triticum aestivum
  misc_feature (9)..(9): Xaa can be any naturally occurring amino acid
MAPTVMASXDTSVAPFQGFKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGC

SEQ ID NO: 20798 - protein, 430 aa, Exiguobacterium sibiricum 255-15
MKLCTIGLGYIGLPSSAMFADHGTDVVGVDIDPRIVKMLNAGDIHIEEPGLEDVIKRVVANGKFRATLTPEPADVFLIAVPTPNLNDTYKSCDLKYVLSAVQNMLPHVQKGNVIIVESTIAPRTMDDHVRPLIEAAGFVIGQDVFVVHCPERVLPGQILHELIHNNRIVGGLTLACADAGAAVYKTFVQGEIVKTDAKTAEMSKLMENTFRDVNIALANELTQVCHKLEINVLDVIEMANMHPRVNLHHPGPGVGGHCLAVDPYFIVAKAPSLARIIHTARETNVNMPHFVAEQAERLVASHVRPKIAVFGVTYKGNVDDMRESPAVDVIEQLIDRGMDVAVCDSHVERSISSRFELVDEIDAIQGADLALVLVDHDEFKQFDSRRLANQMRTPVLFDTKGIVQPLEDITVLNFGNLHTYQTTEVDAKAI

SEQ ID NO: 20799 - protein, 194 aa, Listeria innocua Clip11262
MTYPQLSKEVAPNEIEAEMITNRGTIRIKLFPEIAPKTVENFVTHSKNGYYDGLIFHRVIPEFMIQGGDPDGRGTGGESIWGESFEDEFSTEAFNLRGALSMANAGPNTNGSQFFIVQKPDMPADMLGQMEQAGFPVEIIEAYKQGGTPWLDGRHTVFGHVIEGMDVVDEIANLPTGMQDKPVNDVVIEKINIK

SEQ ID NO: 20800 - protein, 399 aa, Mycobacterium abscessus
MPGDHPGQFARPPCAVGTTTSEASLDRRDFNMKTRAAVLWGLEQKWEVEEVDLDPPGPGEVLVRLAATGLCHSDEHLVTGDLPIPLPVVGGHEGAGTVVECGEGVEDLSEGDSVILTFLPSCGRCSYCARGMGNLCELGAALMMGPQIDGTYRFHARGEDVGQMCLLGTFSEYTVVPQASVVKIDGGIPLDRAALIGCGVTTGYGSAVRTGEVRAGDTVVVVGAGGIGMNAIQGARIAGALAIVAVDPVNFKREQASGFGATHTAASMDEAWSLVSDMTRGKLADVCILTTDVAEGSYTAEALALVGKRGRVVVTAIGHPDESSISGSLLEMTLYEKQIRGALYGSSNAPHDIPRLVELYSAGLLKLDELVTREYSLDQINEGYQDMRSGRNIRGLVRF

SEQ ID NO: 20801 - protein, 372 aa, Vitis vinifera
MARRALPIVKQLVGRSSFDPHPLLGLGSRSVTYMPRPGDGSPRAVTLIPGDGIGPLVTGAVEQVMEAMHAPVYFEKYEIHGDMKTVPPEVMESIHKNKVCLKGGLSTPVGGGVNSLNVQLRKELDLYASLVNCCNLPGLPTRHNDVDIVVVRENTEGEYAGLEHEVVPGVVESLKVITKFCSERIAKYAFEYSYLNNRKKVTAVHKANIMKLADGLFLESCREVAKNYPSIAYSEIIVDNCCMQLVSKPEQFDVMVTPNLYGNLVANTAAGIAGGTGVMPGGNVGADHAIFEQGASAGNVGNEKIAQQKKANPVALLLSSAMMLRHLQFPSFADRLETAVKTVISEGKYRTKDLGGTSTTQEVVDAVIAALD

SEQ ID NO: 20802 - protein, 374 aa, Coprinopsis cinerea okayama7#130
MLRSALASTVRPAFARPPTKYGGSYTVTLIPGDGVGAEITDSVKEIFEYVNAPIEWEQYDVSGMSSAGEALFKQAMESLKRNKVGLKGILFTPISQSGHISWNVAMRQQLDIYASVVLCKSLPGVPTRHNNVDFAIIRENTEGEYSGLEHQSYPGVVESLKVSTRAKTERIVRFAFDFALKNGRKVIQKKSSSKEPHAHFGTQKVTCVHKANIMKLGDGLFLNTFRRVAEEYKSSGIEYNDMIVDNTAMQLVARPQQFDVMVMPNLYGAIVSNIGAALVGGPGIVPGCNVGREYALFEPGCRHVASDIMGTNTANPTAMILSATMMLRHLGLNEIANNIASATFGVINEGKVQTVDMGGSATTSELTAAIIKKL

SEQ ID NO: 20803 - protein, 257 aa, Cryptococcus neoformans var. neoformans JEC21
MGVDNETEGARIALGSKEEWGVRMACRVAADILKRAGHRIVKPGITTAQVDKAIHEMIIEHGAYPSPLGYSNYPKSCTTSINNVIVHGIPDNRPLHPQDIINIDLTIYLDGYHGDTSATFVLPEVDKLGRELVSATQEALDLGIRVCKPGVQISEIGKVIGEFSKRHGFSVNSQISGHGIGKVFHQPPWIFHDVNSEPGKMMPGDCFTIEPCLVQGVNSRGDIWDDGWTLATRTGARAAQFEHQVLITDDGVEILSI

SEQ ID NO: 20804 - protein, 417 aa, Ralstonia solanacearum GMI1000
MLAQPPGPLRPIRSMPNTVNPRLSSLQPYPFEKLKALVKDVTPSPAHAPISFGIGEPKHPTPALVKDALTASLAGLANYPTTAGSDALRQCIAAWLERRYGLPKVDAATEVLPVNGSREALFAFAQTVIDGSKPGARVLCPNPFYQIYEGSALLAGAQPLFANSNPARNYAPDFDAITPEEWRNVQLVFVCSPGNPTGAVLTLEDWKQLFALSDRYGFVIASDECYSEIYFDEANPPLGALQAAHQLGRGFERLVMFSSLSKRSNVPGMRSGFVAGDAKLIKAYLLYRTYHGSAMNPAVQSASIAAWNDETHVRENRAQYVRKFQSVTPMLAEVLDVALPDAAFYLWANVKRTGLSDTAFARELLAAKNVAVLPGSYLAREAHGVNPGQDYVRIALVAGVDECLDGARRIVEFCQQR

SEQ ID NO: 20805 - protein, 176 aa, Glycine max
MSVKLNCVGGGETHNVFVYGSLLADEVVHTLLKRVPPTAPAILHDYHRFKIKGRVYPAILPVQNNKVNGRVLLGISGVELDILDEFEDVEYTRTDVEVSLKDKSEKLQVCAYVWSNPNDPNLNAEWDFEEWKQVHLNDFVKMTGGFMQELELPESKPRVQTYETFYKQENDKPLEP

SEQ ID NO: 20806 - protein, 97 aa, Streptococcus pyogenes MGAS315
MEEYVDRGIFDKEPFQTFDQKGIGRLFSTAVSLARSVKPDLKLGICGEHGGDPTSIAFCHSQGLTYVSCSPFRVPLTRLAAAQAAIKASGHSLTQDK

SEQ ID NO: 20807 - protein, 597 aa, Oryza sativa
  misc_feature (131)..(131): Xaa can be any naturally occurring amino acid
MATAAAAGEGGSGRRYWRWSKADFFPEPSFASWRSYGGALAATVPRLVDRVGSRSSEAAEAGTLRAVSENPLRRCLSWLDLAFLGFGSVVGSGVFVLTGQEARFDAGPAIPLAYAAAGFSALLSSFCYAEXLPRRSPSAGGSFSYLRVELGDIAAFLAAGNILLEAVVGAAGLGRSWTSYLAALLGRDTDSLRIHVPALAEGFNLLDPIAVVVLVSTSAVAMSGARLTSTLNSLASVVGIAIIAFVLAAGFSHFDAGNLAPSFFPFGAAGVFRAAGVVYWSYTGFDMVATMAEETKNPGRDVPLGLISSMSSITVVYCLMSLALVGMQRYTEIDANAAYSVAFAAAGMRWARYVVALGALKGMTSGLLVGALGQARYTTQIARTHMIPPYFALVHPTTGTPIYATVAVTLGAACVALFSSLDVLASVSSISTLFIFALVAVALLVRRYHVAGATTPGQLRTFLAFLALVVLSSIGVSAYYNSRYARRWPGYAAFGCGWAAGAAGLAACAEKQRAPRVYGAPLVPWLPAMSIATNLFLMGSLGTAAYARFGICTAAMLVYYVLFGVHATYDVAHADDAAADNLEHGKIAAAPAPTTPA

SEQ ID NO: 20808 - protein, 312 aa, Pseudoalteromonas tunicata D2
MSVICFGEVLIDFLSDGKIPESFTKYAGGAPANVAVAISKLQGESFFCGMVGNDMFGHFLLEQLQCYGVNTQWVKVTSVAKTALAFVSLDEQGERTFSFYRPPAADLLFRNTDFSPELFKQAKVFHLCSNSLTEKSIYHASLAGVKMAKNAGLTISFDINLRLNLWPSTRYTAERIWHIIGNADIVKFAQEELEFLCNNSNKPSTLEQTIARCFEQGVKLVIVTNGAKPISVYTDNQMSEVAIKPMPASDTTAAGDSFIAGVLFDLVKRQIAIDGAQLNDYLPSIAFGAQCAAITVTRFGSFTALPTAQDLN

SEQ ID NO: 20809 - protein, 475 aa, Yersinia pestis CO92
MKNKIWKLCILVMIPLVIWFIPPPEGLTELSWRLSGFYLAAICGLILKPFSEAVVLLGVVGFAGFFLNNTSQILVGYATSTVWLVFAAFGISISFVKTGLGRRIAFHMIRFCGSTTLRLGYVTAFLEFVISPVTPSNTARSGGIVFPIILSVVKALGSEPGDTAKKAGSYLMSNIYFVMKVSSFMFITAMAPNLLAADFAAKILGIHLDWGVWALAMVVPGLLLLLIVPAVGYYLDKPELKKVDNKKIADEGLAELGPITRNEKLLVGIFISALLGWALPSLLGQLFGITLKIDATAVAIMAMALCILLGVIKWDDVLQNKGAWNTLLWFGGIIGLASALSKEKVFDWLANLIQNNVDFGHNPFIALTIIGFLSIIIRYFFASASSYAIAMLPVFLTVGKVAGADPMALALVLAATNSYGGALTHYGGGSAPIIFGAGYNNVKQWWASGAVIATVCFIVTMTVGYVWWQFLGFVK

SEQ ID NO: 20810 - protein, 212 aa, Oryza sativa Japonica Group
MRVMVALRLKGVEYELLQETMGKKSELLLASNPVHKKIPVLLHRGKPISESLVIVQYVDEVWPPPASILPRDDPYAAAIHRFWGQYIDDMVSTLASMQFPPRIRILRGTVPGDKDEASDEMTTALLYLEEAFVECSKGKQYFGDDSIGYLDIALGSHLGWIRAVERIAGVELLGGAKVPNLAAWADRFCGHPAVVDVMPDVDILVEFTAKLI

SEQ ID NO: 20811 - protein, 255 aa, Yersinia pestis CO92
MRHPLVMGNWKLNGSTHMVNELIAGLRKELSTVDGCGVAIAPPAIYLNQAKHELAGSRIALGAQNVDVNLSGAFTGETSAEMLKDIGAQYIIIGHSERRTYHQESDELIAKKFGVLKEIGLIPVLCIGESEAENEAGQTEAVCAKQLDAVLNTLGVKAFEGAVIAYEPIWAIGTGKSATPAQAQAVHKFIRDHIAKQDAAVAAQVIIQYGGSVNDKNAAELFTQPDIDGALVGGASLKADAFAVIVKAAAKAKKA

SEQ ID NO: 20812 - protein, 399 aa, Ehrlichia ruminantium str. Gardel
MSFLSKRMECIKPSPTLEIASQAQKLKMLGRDIISLSAGEPDFDTPEHIKQAAINALNLGKTKYTAVDGIIELKKAIISRLKQDHNLIYDVSQISVGNGAKQCIYNLFMSTLNDGDEVIIPAPYWVSYPDIVKIAGGNPVIIDCSNTSKLSAELLENAITDKTKWLILNSPNNPSGLVYTYDELKDIAQVLLKYSNVHIMTDDIYSKIVYDDLKFFTIAQVEEDLYSRVFLVNGVSKAYAMTGWRIGYIAGASEVIKAISVIQSQSTTNPNSVAQFAAVEALTGDQKFLEERNKVFIERRDIMLDMINNTPLLSAEKPQGAFYVFISCKELIGRTTKSGFCITSAMDFTKYLLEDYNIAVVPGEAFGVQGFFRVSYATSTQCVSEACDRILTACNELIY

SEQ ID NO: 20813 - protein, 438 aa, Corynebacterium diphtheriae NCTC 13129
MSVLVVGMSHRSAPVALLEKLSMDDGVRTNTVSDLVARPSLAEAMIVSTCNRLEVYAMTSSFHTGVNDVVEVLHDMSGVDMEELRGYLYVRYADAAAEHMMEVTSGLDSMVVGEQQIIGQVRTAYHSATEAGTVGPALHGLVQASLHTGKRVHTETDIDDAGASMVSFACDEALAQMSATNFAGCRALVLGAGAMASLAATHLGRLGIEHITVANRTFERAQRLADHAVEAGVAASAIEFERRMDVLCDVDVVVSATGANTFTIEAANIPAAHGDLMMIDLSLPRDISDDVAEVPGVHLVNIEKLRDVASSGEAKDHAAQRIVAEELEAYTSAQRIRDVAPAVAALRRHASSLIDSELARLSTRVPSMDEDDFSEVQRTVRRVVDKLLHQPTVRVKELAAQSGTVSYDTAIQELFGLAVEATPVAVNVDELPERINKR

SEQ ID NO: 20814 - protein, 567 aa, Prochlorococcus marinus str. MIT 9211
MPTNPSAFLSPATQTFAQFSKLANYSFINSLQADPQATTDGIDHHPRQVFSGHYVPVNPTAIPDPEYIAHSKSLFNELGLNHELAFDKQFRSLFSGDITVAQEPMRQVGWATGYALSIYGTEYVQQCPFGTGNGYGDGRAISVFEGLFKGRRWEMQLKGGGPTPYCRGADGRAVLRSSVREFLGQEFMQALGVPTSRSLTLYVSKTEKVRRPWYSQDSSSIDPDIVVDNPVAITTRVAPSFLRVGQLELFARRARNDEHQGALSELKMIVKHLIDRNYQQEIDPNLCFAEQIVELAHLFKGRLISLVANWIRVGYCQGNFNSDNCAAGGFTLDYGPFGFCELFDPRFQPWTGGGEHFSFFNQPVAAEANYHMFWAAIRPLLSTNTEALRRLDQVREGFSEAMNQEIEKMWLKKLGLASYDSTLVDELLELMVLSKVDYTIFFRKLSHIPEHLTPLKESFYSPSSEQIDAQWRGWLQRWRGGIKSCGDLTLTSTAMKLINPKYTWREWLVEPAYTRAERGDYSLIKELQTVFSNPYDDQCSIVASKYDRLKPTKFFNTGGVSHYSCSS

SEQ ID NO: 20815 - protein, 622 aa, Bradyrhizobium sp. ORS278
MLSITDISIRLAGRLLIDQSSVQIPPGARVGLVGRNGTGKSTLFKAIRGELSLENGSISLPPRWRVGSLAQEAPSGPESLIEVVLRADLERDALLREAETAEDPNRIAEIQTRLVDIDAHSAPARAAAILSGLGFSATDQARACSEFSGGWRMRVALAATLFAAPDLLLLDEPTNYLDLEGTLWLEDHLAHYPRTVIVISHDRDLLETSVDQILHLDRGKLTLYRGSYSSFEEQRATREMLDAKAVKRQEAERARLQAFVERFKAKASKARQAQSRVKMLERMKPITALVTQDVHEISFPAPEKLLSPPIIAVDNASVGYDPAQPVLNRVTLRIDNDDRVALLGANGNGKSTLVKLLAGRLAPFSGKVTRADKLSIAYFAQHQLDELDETGSPYTHVRKLMGDAPESKVRARAGAIGFSGKAADTSVKSLSGGEKARLLLGLATFFGPNMIILDEPTNHLDIDSRAALAEAINEFPGAVIMVSHDRYLIEACADRLWVVADRTVKSYDGDLDDYRRMVLSSRSGAAARETDRPQVTEKVERPRSDNRRGALKQKITAAEAEIVRITDIIAKIDSALSLPDIFTRDPKQAAQLSKARANAADALARAEEQWLEASTLYDEAIS

SEQ ID NO: 20816 - protein, 321 aa, Streptococcus pyogenes MGAS315
MKKILVLHTGGTISMQADNSGRVVPNQDNPMTKIHAAAQDIQLTVSDFLNLPSPHITPHHMLSIYHHIQERTDVFDGIVITHGTDTLEETAYFLDTMALPTNIPVVLTGAMRSSNEVGSDGIYNYLTALRVASSDKAKEKGVLVVMNDEIHAAKYVTKTHTTNISTFQTPTHGPLGIIMKNDLLFFKTAEPRIRFDLRCISGTIPIIKAYAGMGDGSILSLLTPGSIQGLVIEALGAGNIPPLAVGEIEHLITLGIPVVLVSRCFNGMAEPVYAYEGGGAMLQEAGVMFVKELNAPKARLKLLIALNAGLTGQELKDYIEG

SEQ ID NO: 20817 - protein, 275 aa, Ralstonia solanacearum GMI1000
MAVTLKTAEDIAHMRVACRLASEVLDYITPFVKAGVSTGELDRLCHAYMRDVQGTVPAPLNYAPPGYPPFPGAICTSVNDVICHGIPDDKKILKNGDAINLDITVITPEGYYGDTSRMFIVGEGSILAKRLAQVTYECMWKGIAVVRPGARLGDIGHVIQQHAEAAGYSVVREYCGHGIGQVFHEDPQILHYGRPGTGLELKAGMIFTIEPMINAGKRDIRTMPDQWTVKTRDRSLSAQWEHTILVTEAGYDVLTVSAHTPAPPAFVSDGTPATA

SEQ ID NO: 20818 - protein, 285 aa, Oryza sativa
  misc_feature (209)..(209): Xaa can be any naturally occurring amino acid
NQRPYVMSEEACIKPDDSSGLCTLLMSGYLRAHNLSVNQLVHLSGVGDFQLGQIDILKDPFPINERKNSNAMVSEDSGIQIVDTFVPDPSSQEPLLVENTPDPLEGEQTWPTEAEMEEAYLNNKQRKLKRKLPRGTSEYQAAWIVDDTDDEDGDSENDNQDGAGMVIDEQDHSDNGGDGSDMDVVSHFTEKFDEETIGGTEMADDENLXPKESLPQDYARIFAFDNFTRTQKHVLAKMAERDEGTLKDCAQRGSFVRLHLKNVPTEIASKLVHPSRRLPVVVSGL

SEQ ID NO: 20819 - protein, 314 aa, Rhodopseudomonas palustris CGA009
MPAKLDPDAAAVYKAFQDAGRPAYETLTAAEARAYYSAARLVSNPDPADMASVRSIAIPGPAGDIPARLYTPNKLRQDEGLAPALVFFHGGGWVIGDLDTHDVVCRGIAHDGELLVISVDYRLAPEHKFPAAIDDAIAATRWIADNARKLGIDPEQLSVGGDSAGGNVSAVVALHARDHGGPLLAGQVLIYPATDFSMRHPSHSEPETSVLLTHSVIRWFRDHYLSRAQDADDWRASPARAETLAGLPPAFVITAGADPLRDEGDEYARRLADAGVPVVHRTYPGQFHGFFTMGKLLPQANVAMREIGDWLKAL

SEQ ID NO: 20820 - protein, 219 aa, Kluyveromyces lactis
IDDEHRVRVFYDKRIGQEVDGESVGDEFKGYVFKIAGGNDKQGFPMKQGVLLPTRVKLLLAKGHSCYRPRRNGERKRKSVRGAIVGPDLAVLALIITKKGEQEIEGITNDTVPKRLGPKRANNIRKFFGLTKEDDVRDYVIRREVTKGDKSYTKAPKIQRLVTPQRLQRKRQQKSLKIKNAQAQREAAAEYAQLLAKRLSERKAEKAEVRKRRASSLKA

SEQ ID NO: 20821 - protein, 223 aa, Brassica napus
  misc_feature (71)..(71): Xaa can be any naturally occurring amino acid
  misc_feature (215)..(215): Xaa can be any naturally occurring amino acid
MDRPAVSGPMDLPIMHDSDRYELVKDIGSGNFGVARLMRDKQSNELVAVKYIERGEKIDENVKREIINHRXLRHPNIVRFKEVILTPTHLAIVMEYAAGGELFERICNAGRFSEDEARFFFQQLISGVSYCHAMQVCHRDLKLENTLLDGSPAPRLKICDFGYSKSSVLHSQPKSTVGTPAYIAPEVLLKKEYDGKLADVWSCGVTLYVMLVGAXPFEDPDEP

SEQ ID NO: 20822 - protein, 319 aa, Chlamydomonas reinhardtii
MSRANAGALLRRASGLLNAMQGPSKEAAAVTLSQCAAIHYATNPTLTAGAWARSGGVASTSAAVDTAAQRVAPWRSPAGQSRGMFIQTQPTPNPNSLMFVPGKPVMQSGTMEFGSAREGMKSPLAKKLFAVDGITSVFFGSDFVTITKKDEYSWPVLKPDVFAAIMEFYASGEALISDADALAASDTAIHPDDSEVVAMIKELLETRIRPAVQEDGGDIVFKGFEEDTGMVQVKLVGACSTCPSSTVTLKNGIENMLMHYIPEVKGVMEAPPDESDEEGVKAFAEFEKKIGAASDEEEGEAKPAAPPKEQNPMAAHLSN

SEQ ID NO: 20823 - protein, 491 aa, Corynebacterium glutamicum ATCC 13032
MASTFIQADSPEKSKKLPPLTEGPYRKRLFYVALVATFGGLLFGYDTGVINGALNPMTRELGLTAFTEGVVTSSLLFGAAAGAMFFGRISDNWGRRKTIISLAVAFFVGTMICVFAPSFAVMVVGRVLLGLAVGGASTVVPVYLAELAPFEIRGSLAGRNELMIVVGQLAAFVINAIIGNVFGHHDGVWRYMLAIAAIPAIALFFGMLRVPESPRWLVERGRIDEARAVLETIRPLERAHAEVADVEHLAREEHAVSEKSMGLREILSSKWLVRILLVGIGLGVAQQLTGINSIMYYGQVVLIEAGFSENAALIANVAPGVIAVVGAFIALWMMDRINRRTTLITGYSLTTISHVLIGIASVAFPVGDPLRPYVILTLVVVFVGSMQTFLNVATWVMLSELFPLAMRGFAIGISVFFLWIANAFLGLFFPTIMEAVGLTGTFFMFAGIGVVALIFIYTQVPETRGRTLEEIDEDVTSGVIFNKDIRKGKVH

SEQ ID NO: 20824 - protein, 242 aa, Zea mays
SADSLHYSAAAARQVYMAKETGTNEIVALKKIRMDNEREGFPITAIREIKILKKLHHQNVIKLKEIVTSPGPERDEQGRPIDGNKYKGSIYMVFEYMDHDLTGLADRPGMRFTVPQIKCYMKQLLTGLHYCHVNQVLHRDIKGSNLLIDNEGNLKLADFGLARSFSSDHNGNLTNRVITLCCYRKVLIVFLDCGCRPPELLLGSTKYGPAVDMWSVGCIFAELLNGKPILPGKNEFFPLTNL

SEQ ID NO: 20825 - protein, 465 aa, Azoarcus sp. BH72
MKPDLTSQLVQSPPGDLVAPPRFTSVEQAQEYLRARGVSYVLAQFVDIHGVAKAKSVPVSHLPSVVSSGAGFAGFAIWGVGIEPHGPDFMAVGDLSTLSVVPWQPGLARIVCEGHVDGKAWDYDSRVTLRKQVARLAERGWTLFTGLEPEFSLLRRGEDGSLLPADPSDTLDKPCYDYKSLSRTREFLERLSNDMRASGIDVYQIDHEDANGQFELNFTYADCLTSADHFVFFKMAASEIANELGYICSFMPKPFANRPGNGMHMHVSIGDGQRNLFEDKSDPRGLNLSQLAYHFLGGLLAHAPALTALCAPSVNSYKRLVVGRSLTGATWAPAYVSYGDNNRSSMIRVPKGRLELRLPDGSANPYLATAAVIAAGLDGIERRLDPGDPHNVNLYEWSPQQLADAGIGLLPQSLILALDSLEADSVICDALGPVAKEFLKLKRMEWVEYQRHVSEWEIKQYLEFY

SEQ ID NO: 20826 - protein, 188 aa, Pseudomonas syringae pv. tomato str. DC3000
MPMNIPNLITVLRVLLIPIFILLFYMPYHWSYMAASAVFAFAAATDWLDGYLARRLEQSTPFGAFLDPVADKLMVAVALVLLVQAHANLWLTLPAAVIIGREIVISALREWMAEIGARAQVAVSNMGKWKTAAQMLALVILLGNPPAVTFWVIFGYALLLVAAGLTLWSMVQYLRAAWPHLKTTAEKK

SEQ ID NO: 20827 - protein, 506 aa, Corynebacterium glutamicum ATCC 13032
MADPQGFIKYSRREPAHRPVPLRLMDHSEVYEKAPAGQIEEQAARCMDCGVPFCHEGCPLGNIIPEWNDLVRQGRWKEAYDRLHATNNFPEFTGRLCPAPCEGACVLGINDDSVTIKNVELEIVEKAFREGWVQPVIPSMSTGLSVAVVGSGPAGLAAAQQLTRAGHSVTVFERDDRLGGLMRYGVPEYKMENRWIDRRIEQMEAEGTTFQVGTSPRAAELALFDAILLATGTPVARELSVPGHDLNGIHAAMDYLTAQNRINEGDGEVSPINAKGKKVVIIGGGDTGTDCFGTALRQGAESVTQFDIRPRAPFQRADSTPWPMYPNLFRTATAHEEGEYIITGDESADEIAALGLAERAAGSTLGERKFAVNTVEFHGNNGHVTGLTGNQIRVVNGKREPIEGTEFPFEADLVLVALGFTGAEQGGLAHELGVGFDDRGRILRDSEYRSPTNSRVYIAGDNGRGQSLIVWAIAEGRACAAAIDADLMGETALPVAVAPQDVPLAV

SEQ ID NO: 20828 - protein, 694 aa, Bordetella bronchiseptica RB50
MSVAIAMRGDIGVVTLDSAPVNALGRTLRHGLAQCLEQVYARPDVRALLLVSARPGIFSAGADIKEFDQAGSDQDAGLAELIDRIENAPVPVVALLDGAALGGALELALGCHYRLASPRASLGLPEIKLGLLPGAGGTQRLPRLVGARQAVEMVLGGEPVGGETALRYKLADALLSADDTLEQALAWMRNAPGGLARRRVASLPALAPASIAEAARAAAIRPVGSAAAREAALACLAAAQGPFDAGRALERESFARLRDGAEARALRYAFFAERPRPPAGDVSARRIEQVAVVGAGTMGTGIVICLADAGLPVIWHDVDADRLAQGRAQVCQHFERLAARKRLTSRQAEQRVAAVATTGEMAGIAQADLAIEAVFEDMAVKCAVFRELDRVLKPGAILGTNTSTLDVDRIAHSTRRPQDVVGLHFFSPAPVMPLLEIVRGAATHADVVAAAQGLARRLRKTAVVAGVCDGFIGNRMWHQYLRQAALMVHEGAMPMEVDAALRDWGFAMGPFQVADLAGLDVGDSIRLRQRSEMPHRPWPDWLDRVSAAGRLGLKGGSGIHAYPDGGRQPRRDAEVEAMIAAASREAGVSRRAIAADEIVERCLHALVVEAARLLEEGIAASATDVDAVFLAGYGFPRWRGGPCHSADAMGLPAVVAGLRRRAATAEPEFWQPPGLLVRLAAQGGRLQDHGQEGA

SEQ ID NO: 20829 - protein, 153 aa, Campylobacter jejuni RM1221
MENNLQVNIFCIQKSDEFKTWSEKYSKLISKYATLKEINVFNKKIALAQNLNAIEAKKSYEEAFMPYKKGYCIALDEKGKDLTSIEFAKLIQDKNELSFFIGGAYGLREEFNQSLDFRLSLSKLTLAHQFVKTLLLEQIYRAFCINNNHPYHK

SEQ ID NO: 20830 - protein, 186 aa, Streptococcus agalactiae NEM316
MSLVGKEIIEFSAQAYHDGKFITVTNEDVKGKWAVFCFYPADFSFVCPTELGDLQEQYETLKSLDVEVYSVSTDTHFVHKAWHDDSDVVGTITYPMIGDPSHLISQGFDVLGQDGLAQRGTFIIDPDGVIQMMEINADGIGRDASTLIDKVRAAQYIRQHPGEVCPAKWKEGAETLTPSLDLVGKI

SEQ ID NO: 20831 - protein, 190 aa, Kluyveromyces lactis NRRL Y-1140
MGNKTSTLSKNDLTSLKQSTYFDRREIQQWHKGFLRDCPNGQLTREEFIKIYKQFFPFGSPDEFATYVFSVFDKDNNGSIDFKEFITALSTTSRGSLEEKLVWAFQLYDLNHDGVISYEEMLTIVSSIYKMIGNMVKLSDDEATPELRVEKIFRLMDKDKDGCITLDEFRDGSKVDPSIVGALNLYDGLV

SEQ ID NO: 20832 - protein, 443 aa, Agrobacterium tumefaciens str. C58
MNWSLPVNIMANGPATAPDQKTRLKSIIGGSAGNLVEWYDWYVYSAFTLYFAPVFFPSGNQTAELLSAAAVFAVGFLMRPIGAWFMGTYADRKGRKAGLTLSVTLMCLGSLLIAVTPGHETIGIAAPAILVFARLLQGISVGGEYGASATYLSEMAGKSRRGFFSSFQYVTLISGQLLALAVLLVLQRVLTPEQLGSWGWRIPFFIGGMLAIAVFYIRRGLAETQSFENAKAGEADKPKSSGWALFKHYPREALMVMALTSGGTLAFYAYTTYLQKFLVNTSGFSKESATEITTAALFVFMLCQPLAGALSDRVGRKPLMVGFGILGTLFTYLIFSTLATTTDPIMAFVLVLVGLLIVTGYTSINAVVKAEMFPAHIRALGVALPYALANTIFGGTAEFVALKFKQIGHENWFFWYVTIMIALSLVVYVKMRDTRDHSHIHED

SEQ ID NO: 20833 - protein, 140 aa, Bradyrhizobium sp. ORS278
MAIERTFSIIKPDATERNLTGAINALIEKAGLRIVAQKRIRMTRDQAETFYAVHKARPFFGELVDFMISGPVVVQVLEGEGAILKYRDVMGATDPSKAAEGTIRKAHAKSIGENSVHGSDAPETAAIEIAQFFAGNEIVG

SEQ ID NO: 20834 - protein, 519 aa, Zea mays
  misc_feature (24)..(24): Xaa can be any naturally occurring amino acid
  misc_feature (121)..(121): Xaa can be any naturally occurring amino acid
MAATVRRAASSVLSRFLLTKPSPXSPASAAGNKSALLGAGAAALHRFSTAPASAAAAAEEPIQPAVEVKHTQLLINGNFVDAASGKTFPTLDPRTGEVIARVAEGDSEDIDPAVRSGIRRXTHASGDNDTTLAQAAGAEVPMVARCVRYYAGWADKIHGLVAPADGAHHVQVLHEPVGVAGQIIPWNFPLLMFAWKVGPALACGNTVVLKTAEQTPLSALYVANLLHEAGLPEGVLNVVSGFGPTAGAALCSHMGVDKLAFTGSTGTGQIVLELAARSNLKPVTLELGGKSPFIVMDDADVDQAVELAHQAVFFNQGQCCCAGSRTFVHERVYDEFVEKSKARALKRVVGDPFRDGVEQGPQIDGEQFNKILRYVQSGVDSGATLVAGGARVGDRGFYIQPTVFADAKDEMKIAREEIFGPVQTILKFSGVEEVIRRANATPYGLAAGVFTRSLDAANTLSRALRAGPVWVNCYDVFDATIPFGGYKMSGVGREKGIYALRNYLQTKAVVPPIKNPAWL

SEQ ID NO: 20835 - protein, 264 aa, Kluyveromyces lactis NRRL Y-1140
MCNIQMDLWTELFLLNASSKFDFDDKNNASNGNAWYKDRSDTQEKIVPKGFNDEESFDTSGGSSFIESLMSNMDGFFSTASTIMESLSPLKEYTTDYSKIENRESVYGIPHGSKFFVIKSFNERNVKLALQNSVWSSTRKGNRRLEREYHSLAPGAKLFLLFSVNKSGKFCGIAEMCSDLIENDPRANIWETHTDSYTFPHLFQIKWWYVNDVKVRRFNHLVWETDGEQKSLGHGRDTEIVPFNIGHEIVAIFHNSYTKSSLLF

SEQ ID NO: 20836 - protein, 406 aa, Coprinopsis cinerea okayama7#130
MTSRNVKGRNGAAPPKIVTAKLENDPNHHLTGPFLPQTPLGSPTPERSSSPVVGWKPTKPAPWLAWATEPVIALKLLLIPVVLYFNWEFVARYVSPPLSNPFGPFFLLSGYVEGSKPDDPRYAKSWLDFLFLGFYIVFWSMVRQTIAVNIARPIARYFGLRKEAKIDRFGEQLYAMIYFAICGAWGYRVMKQLPTYWYQTEHFWIDYPHWDMKGELKRYYLMQFSYWCQQFIVLLLGLEKPRKDYWELVAHHFVTMWLVGWSYGLNFTIIGSAVYMSMDIPDSFLAASKLLNYMQWNRAKIVSFVTFIAVWTYFRHYLNLKILWSCLFETQLVPESSKIWSFENGTYMVNWMPFMVFGSIFALQILNLFWYYLMWRILIRAIITREADDDRSDDEGDDDDEPDKED

SEQ ID NO: 20837 - protein, 192 aa, Triticum aestivum
MESSSSSLLLSSYTGGNKRAREADLDAASSAEAEAAKRMRPEDLLDLLDDDADAAAAGDLASVMRSLEEEICAGDLAPPQPELGFLLEASDDELGLPPAAAAASSSSDDAGGWEPEEPAGVFGEQIWGFEDEIDGAYAFGGVASSPEAAAAAAAAAAEWGDDGFDAGLFGFGDESFGPSDLAVLRQETMPAV

SEQ ID NO: 20838 - protein, 446 aa, Kluyveromyces lactis NRRL Y-1140
MASNGTGGLPPIDFEKVRNDSDGSVTGMAKGLFNQFIEGNPYFAAGGGLMVLGTSLALLRRGVISTSRLAYHQLIVDLEIPSKDKSYLWFLQWMSRYPHRSSRHLSVETNYLQHNNGSVSTEVNFVPGVGNHLIRYKGAFMLIKRERSGQIANITNGTPFETVKLTTLYRDRHLFQELLMEAKDLAVKAQTGKTVIYTSWANEWRPFGQPKAKRNLKSVILDNGLKESILNDVNDFLQNGKWYYDRGIPYRRGYLLYGPPGSGKTSFIQALAGELDYNICIMNLADPNLTDDRLNYLMNNLPERSLMLLEDIDAAFVKRSKNDEGFVNGVTFSGLLNALDGVASSEEIITFMTTNHPEKLDPAVMRPGRIDYKTYVGNATEYQIKQMFLRFYPEEKELCEQFVQKAVELDTPISTAQLQGLFVFNKQNPKNAVLMVESLRYPNHVF

SEQ ID NO: 20839 - protein, 370 aa, Exiguobacterium sibiricum 255-15
MHVEKRDYYEVLGVARDASAAEIKRAYRKLARTYHPDVNKEADADQKFKELSEAYEVLSDDNQRARYDQFGHQDPSQGGGGFGGAEGFGDIFDMFFGGGRRQDPNAPRKGQDLQYVEEIDFMEAFSGVEKVITIPVEEDCGTCHGSGAKPGTHPETCKRCGGSGHINVEQNTMFGRVVNQTTCSTCHGRGQIVKEPCETCRGAGRVRKNKDVRVKIPAGIDNGQQIRLAGKGEAGVNGGPFGDLYVVVRVREHELFERVDDHIVMDMPLTFAQATLGDEIEVPTVHGKVSLKIPAGTQTGSRFRLRGKGMPNVRSGHHGDQYVNVVIITPKNLTDRQKELLREFNEISDEKGVEEQHEGVFSRIKTFFTG

SEQ ID NO: 20840 - protein, 312 aa, Arabidopsis thaliana
MGKMIVSMDQDIRLDTTRARLSNLLKRHRELSDRLTRDSDKTMLDRLNKEFEAARRSQSQEVFLDGEEWNDGLLATLRERVHMEADRKADNGNAGFSLVCHPEERITYRVGNKVICCLDGSRIGIQFETSTAGETYEVYHCVLESKSFLEKMIVLEHTIPFFLPLSDLENDLLFSNAKKFIDNVGDLLQAYVDRKEQVRLIKELFGHQISEIYHSLPYHMIEFSMDDCDCKFVVSLRYGDLLCELPTKVRILVWPMHHLSKKQCTSPGSPAIPVRLPFAEDAFRIQSLPEAYAEIMPNMPNEIRQLFQTSPS

SEQ ID NO: 20841 - protein, 460 aa, Lactobacillus acidophilus NCFM
MSKYQSVNPYTNEAFASYDNPTSKQIDEAINLAHALYKKWRHEEPASRAEILHDIANALKEHEDELAKMMTLEMGKLLSESKEEVELCVSICNYYADHGPEMLKPTKLNSDLGNAYYLKQSTGVIMACEPWNFPLYQVIRVFAPNFIVGNPILLKHAHNVPGSAALTAKIIKRAGAPEGSLINLYPSYDQLADIIADPRIQGVALTGSERGGSAVAEAAGKNLKKSTMELGGNDAFIVLDDADPQVLRNVLNDARTYNDGQVCTSSKRIIVEKSRYDEVLHELKNVFSNLKAGDPLEADTTLPPMNSEKAKEKLEAQVKEAIDAGAKVFYQYPEIDSKGAFFRPTILTDIAKDNPVFDKEVFGPIAEVFVVEDDNAAIQLANDSSYGLGSSVIGSDIDRAKKVSAQIETGMTVINGRWITSGELPFGGIKKSGYGRELSGLGLMAFVNEHLVIDVTKNNQ

SEQ ID NO: 20842 - protein, 159 aa, Alkaliphilus metalliredigens QYMF
MNITVISVGKLKEKYLKQGIAEYDKRLSRYCKLNFIEVADEKAPENLSEAEEIMIKDKEGEAILKSIKDGMFVIALDLAGKMLSSEALSEKIDKLALQGNSHITFVIGGSLGLSQGVLKRADFKLCFSPMTFPHQLMKLILLEQVYRAFRISKNEPYHK

SEQ ID NO: 20843 - protein, 325 aa, Cucurbita pepo
MALLFFLALLFGASYAQLTETFYDQTCPRLPNIVRQEVKRAIETDIRAGAKLIRFHFHDCFVQGCDGSVLLEDAPGIDSELNGLGNLGIQGLEIVDAIKAAVESECPGVVSCADVLALAAKQSVDVQGGPSWRVLFGRRDSRTANRTGADELPSPFETLEPLKQKFEALGLDSTDLVAPSGAHTFGRSRCMFFSGRFSNFNGTGQPDPALDPAYRQELERACTDGETRVNFDPTTPDTFDKNYYTNLQANRGLLTSDQVLFSTPGADTIEIVNRLGSREGTFFRQFRVSMIKMGNIRPLTGNQGEIRRNCRGVNELGGEAGHDVM

SEQ ID NO: 20844 - protein, 492 aa, Arabidopsis thaliana
MSDFSSSVKLKYVKLGYQYLINNFLTLLLIPVIATVAIELLRMGPEEILSVLNSLHFELLHILCSSFLIIFVSTVYFMSKPRTVYLVDYSCYKPPVTCRVPFSSFMEHSRLILKDNPKSVEFQMRILERSGLGEETCLPPAIHYIPPTPTMESARNEAQMVIFTAMEDLFKNTGLKPKDIDILIVNCSLFSPTPSLSAMIINKYKLRSNIKSYNLSGMGCSASLISVDVARDLLQVHPNSNAIIISTEIITPNYYKGNERAMLLPNCLFRMGGAAILLSNRRSDRWRAKYKLCHLVRTHRGADDKSYNCVMEQEDKNGNVGINLSKDLMTIAGEALKANITTIGPLVLPASEQLLSLSSLIGRKIFNPKWKPYIPDFKQAFEHFCIHAGGRAVIDELQKNLQLSGEHVEASRMTLHRFGNTSSSSLWYELSYIEAQGRMKRNDRVWQIAFGSGFKCNSAVWKCNRTIKTPTDGAWSDCIERYPVFIPEVVKL

SEQ ID NO: 20845 - protein, 515 aa, Coprinopsis cinerea okayama7#130
MSFSNSPPPFEWSHLWRPAIVNPVNLKSYTIPFFNLRDPYAQSFHLSWLGFFVAFLSWFAFPPLIPEAIKNDLKLSHAEVANSNIVALLATLGVRFAVGPLVDRYGPRKVMAWLLILGAIPSGLAGTAHNATTLYVIRFFIGILGGTFVPCQAWTSAFFDKNCVGTANALVGGWGNMGGGATFAIMTSLYTALRQAGLTEHVAWRVSFASVPAPVLLTVAAMTLVFGQDHPAGKWSERHNIPAINMADGEGTQFSDEKHPTKEKDLEKKGSQIEVNVHEVQDDEPSPKARAPVIQSTVDVAVNQNLTFASAMKILTNPLTWLPALAYLTTFGFELALDAKMADVLWEIFNERIDGFDQETAGFYTSVFGFLNLVTRPLGGYIGDVVYRKFGTKGKKWWTLICGVIMGVSTIAGGFYLADYKEPEIPDLAVIMGVFSVAAIFSELGNGANFALVPHCNAYNNGVMSGIVGSFGNLGGIIFALVFRFQPEQGKAWWIMGIICLVLNLVLIPVPVPEF

SEQ ID NO: 20846 - protein, 130 aa, Chlamydomonas reinhardtii
MAGRGKGKTSGKKAVSRSAKAGLQFPVGRIARYLKKGKYAERIGAGAPVYLAAVLEYLTAEVLELAGNAARDNKKNRIVPRHIQLAIRNDEELGKLLGEVTIASGGVLPNIHAVLLPKKTKGGKGSEEAA

SEQ ID NO: 20847 - protein, 91 aa, Zea mays
PRTRGRTRGRTRFRTFGRTRGRTRGGTRWILRNYLCQSAIDAAEQGDYEEVRRVLRVMHYPYDEQPGMEKYARLPPAWAYRPGVCMLSCSS

SEQ ID NO: 20848 - protein, 474 aa, Hyphomonas neptunium ATCC 15444
MKHECCAPNCEYDLAVIGAGSAGFSAAITAAEGGVRVALIGHGTIGGTCVNVGCVPSKTMIRAAEAVFSAQSAHRFPGLRGEAQVSDWAALIAAKEDLVASLRQKKYANLLPGYHGVTYIDEGPARLVLGGVEVGGRKIKVSKVIVATGGRSAVPDVAGISEVPTLDSTALLELKALPESLIFLGGGYIGVELAQMMARLGTRVTIVCRSRLLPRAEPEVSEALAKALRAEGISVVEKVTYDAARLDGSRTVVTVTVNGAARDLAADHLVLSTGRIPNTDGLGLKEMGVETDQRGAIIVGDDMATTRSGVYAAGDVTDRDQFVYMAAYGAKLAARNAVLGGKECYDNAAMPWVVFCDPQIAGVGLTEAQAYAAGYDVKTSVLPLENVPRALAARNTTGLIKLVADRANDRLLGGVIMAQEGADSIQTLSLALKFGMTTKALGETIFPYLTTVEGFKLAAQTFDKDVAKLSCCAG

SEQ ID NO: 20849 - protein, 306 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 20850 - protein, 418 aa, Brassica napus
MPKHYRPAGKKKEGNAARYMTRSQALKSLQVNLNLFRRLCIVKGIFPREPKKKVKGNHHTYYHVKDISFLQHEPLLEKFREIKTYQKKVQKAKAKKNEELARLLLTRQPTYKLDRLIRERYPTFIDALRDLDDCLTMVHLFAVLPASDRENLEVKRVHNCRRLSHEWQAYISRTHALRKVFVSVKGIYYQAELEGQKITWLTPHAIQQVFTNDVDFGVLLTFLEFYETLPAFTNFKLYHSLNVKYPPILDSRLEAWAADLYALSRYIDASSRGMTVEPKADASSSSQSNDRAESELRLAQLQHQLPSSEPGALMHLVADKEVEEDEETRACKSLFKDLKFFLSREVPRESLLLVLPAFGGTVSGEGEGAPFKEDDESITHHIIDKPSAGHRYLSREYVQPQWIYDCVNARIILPTGKV

SEQ ID NO: 20851 - protein, 518 aa, Pycnoporus coccineus
MSRFQSLLSFVLVSLAAVANAAIGPVADLTLTNAAVSPDGFSREAVVVNGQTPGPLIAGQKGDRFQLNVIDNLTNHTMLKTTSIHWHGFFQHGTNWADGPAFINQCPIASGHSFLYDFQVPDQAGTFWYHSHLSTQYCDGLRGPFVVYDPNDPQASLYDIDNDDTVITLVDWYHVAAKLGPRFPLGADATLINGLGRSPGTTAADLAVIKVTQGKRYRFRLVSLSCDPNHTFSIDGHTMTIIEADSVNTQPLEVDSIQIFAAQRYSFVLDASQPVDNYWIRANPSFGNTGFAGGINSAILRYDGAPEVEPTTTQTTSTKPLNEVDLHPLTPMAVPGRPEPGGVDTPLNMVFNFNGTNFFINDHSFVPPSVPVLLQILSGAQAAQDLAPSGSVYVLPSNSSIEISFPATANAPGAPHPFHLHGHTFAVVRSAGSSEYNYDNPIFRDVVSTGTPGDNVTIRFQTNNPGPWFLHCHIDFHLDAGFAVVMAEDTPDTAAANPVPQSWSDLCPIYDALDPSDL

SEQ ID NO: 20852 - protein, 486 aa, Azoarcus sp. BH72
MSAPTSYPSRNFIAGEWRAAISGATFAKLAPTSGAVLAEVANSSAADVDAAVAAARVQFDGGEWSRLPGAERGRLLNKLADLLARDAERFAHILAMEQGRPLMEMRMLDLPMSIDTLRYFAGWADKLEGRQIPTAGFMGRPTLNYTIREAIGVAALIVPWNAPLMIGIWKLAPALAAGCTVVLKPSEDAPLALTALAGLAAEAGFPAGVFNLVNGMGPEAGATLVKHPGVDKISFTGSTEVGRIIAREAAPLFKRLTLELGGKAPQIICADANLDAAIMGVAMGLFVNQGQTCAAGTRILVHRSRYDDVVGALAGAAKSVTLGDPLDANTRMGALINARHRDRVAALIQSGIAEGAALVAGGEALPENGFFVRPTVFAGGTPQMRIMREEIFGPVGVVVPFDSDEEAVQLANDTPFGLSASLWTQDIARAHTLAPKLRVGAVAINGWSPLDARLPWGGYKDSGVGRDLSRTALDAYTEEKVVSVVM

SEQ ID NO: 20853 - protein, 494 aa, Methylococcus capsulatus str. Bath
MTLQQPPQALPCHFVIFGATGDLAALKLLPALYRLDVGGHLPAGMSIIALGRRPWSEADWLQHLEESIRRRTGEQFNARVYRRFAARFAYVAGDLHDPAIYQTLSDRLCADQSCAHAAFYLSLKPSDFGEVIQRLEQAGLNRPRGLHRIVVEKPFGEDIDSARQLNRLLHDAFDEEQIYRIDHYLGKETVQNLLVFRFANTLIEPLWNRNYIDHVQISVAEQAGVSTRADYYDKAGALRDMLQNHLLQLLTLVAMEPPPALEADALRDEKVKVLRSIRPIEDQVINAHAFRAQYGPGSIDGVPVPGYQDEAGVAPHSIAETFVAAKFYVDNWRWRGVPFYLRTGKRLAQQLSLVAIRFRHPPQQLFRETPLEFIEPNWVLLSLQPSESMHIELHSKQPGLGMDTRIIRLDASYRRGREKTLEAYETLLLDIMEGDRSLFLRFDEVEWAWRVVDPILRHWTRQRDFIHTYPAGSWGPLEADRLFDKLEQSWRNQL

SEQ ID NO: 20854 - protein, 518 aa, Pycnoporus coccineus
MSRFQSLLSFVLVSLAAVANAAIGPMADLTLTNAAVSPDGFSREAVVVNGQTPGPLIAGQKGDRFQLNVIDNLTNHTMLKTTSIHWHGFFQHGTNWADGPAFINQCPIASGHSFLYDFQVPDQAGTFWYHSHLSTQYCDGLRGPFVVYDPNDPQASLYDIDNDDTVITLVDWYHVAAKLGPRFPLGADATLINGLGRSPGTTAADLAVIKVTQGKRYRFRLVSLSCDPNHTFSIDGHTMTIIEADSVNTQPLEVDSIQIFAAQRYSFVLDASQPVDNYWIRANPSFGNTGFAGGINSAILRYDGAPEVEPTTTQTTSTKPLNEVDLHPLTPMAVPGRPEPGGVDTPLNMVFNFNGTNFFINDHSFVPPSVPVLLQILSGAQAAQDLAPSGSVYVLPSNSSIEISFPATANAPGAPHPFHLHGHTFAVVRSAGSSEYNYDNPIFRDVVSTGTPGDNVTIRFQTNNPGPWFLHCHIDFHLDAGFAVVMAEDTPDTAAANPVPQSWSDLCPIYDALDPSDL

SEQ ID NO: 20855 - protein, 500 aa, Rickettsia prowazekii str. Madrid E
MLSTSPSRSFKNKFRAAFWPVHNYELGKFIPISALMFCILFNQNILRILKDSILISEISAEIAGFAKVYCVTPVAALFVIIYAKMINHLTFEKIFYYLSAFFISCFILFAFVIYPNIHIFHVHPDTLSDWMNKYPHFKWYISLVGNWGYIVYYSLAELWPNIFYVLLFWQFTNELTTTEEAKRFYTLFSLFGNSSLILVGFLMMNLSSEDTIIKKFISISDSKITLVQVSTTIIAIVAIICCLLVRFISKYIFTNPLFYHKTKSSRSTAQRMGLIKSFKYIVKSKYLWLLLICSAAFGFAINLVEAVWKAKIKELYPTVNTYAEFNSLYILWTGVAIIVMTIIGNNVMRMHNWFVAAVISPVIIMVTGVLFFGLIVFDQQILSLFDGAILMSPLALAVSIGGIQNILAKGTKYSIWDTSREMLYIPLDDELKTKGKAAVDVISAKVGKSSSGLVQSIIFTLVPNATFTSISPILMVVFTFVCFAWIYAVRKIYFEYQKIA

SEQ ID NO: 20856 - protein, 323 aa, Leifsonia xyli subsp. xyli str. CTCB07
MATSVTKAVIPAAGLGTRFLPATKAMPKEMLPVVDKPAIQYVVEEAVEAGLHDVLMITGRNKNALENHFDRNAELEDTLTKKGDTDRLRKVNYSTSLADMHYVRQGDPKGLGHAVLRAKMHVGREPFAVLLGDDIIDARDDLLRRMLRVQHEHNTTVVALMEVDPDSIHLYGAAAVEPTGEDDVVRITGLVEKPDKEDAPSNYAIIGRYILRPEVFDVLERTEPGRGGEIQLTDALQAMAHAPDWTGGVYGVVFRGRRYDTGDRLDYIKAIVQLAADRDDLGPELRPWLREFAGGLADTPDEALDEMPAEPAPSLGSTTDANA

SEQ ID NO: 20857 - protein, 349 aa, Oryza sativa
  misc_feature (249)..(249): Xaa can be any naturally occurring amino acid
MMGDFLSRVLLLAFGYAYPAYECYKTVELNKPEIEKLIFWCQYWILVALLTVLERFGDFAISWLPLYSEAKLMFFIYLWCPRTKGTSYVYETFFRPYISQYENDIDCSILDLRVRAGDMLVVYWQKVAIIGQTTFFNILKYASAQSPAHSSRSRSAQQQSYPQKQQQAQPQQPKQSLPQQQQKQSLPQQQQQQMPHEKPTTLRRAASAAARTGGIMQQSEDTKIAYSNPKTRRLLPTKSAPTASTRSTXVAATKPVEDLKSSGMKLATEEAPSPSSNAAMPGSEPSAPPLPKSAEDDMSIDEVDIPIEDMDEPVATPEETPMEEAIRVTRGRLRKRIAAVSTADGGAAN

SEQ ID NO: 20858 - protein, 347 aa, Coccidioides immitis
AEKIAKFPGTKGPDGKYTVTLIEGDGIGPEISQSVKDIFSAAKVPIKWEPVDVTPILKDGKTAIPDEAINSVKKNYVALKGPLATPVGKGHVSLNLTLRRTFNLFANVRPCRSIAGYKTPYDNVNAVLIRENTEGEYSGIEHVVVDGVVQSIKLITREASERVLRFAFQYAQEVGKPKVRAVHKATIMKMSDGLFLRTAKEISKEFPDIEFDAELLDNTCLRMVTDPAPYNDKVLVMPNLYGDILSDMCAGLIGGLGLTPSGNIGNECSIFEAVHGSAPDIAGRALANPTALLLSSIMMLRHMGLNDHAKKIETAIFETLAEGKTLTGDLGGKAKTHEYAGAIIKRL

SEQ ID NO: 20859 - protein, 527 aa, Marchantia polymorpha
MANGGEGSPMHPSPSEQHSMLHGERVAVQINSRRRLPDFLQSVNLKYVKLGYHYLITHLVILLFIPLLLAVTLEVGRMGPEEMWQLWVNLQFNLVSVLICSALLVFGVTVYVMSRPRPVYLVDYACHLPAENTRVKFSLFMDHSEKSGFFDERALEFQRKILERSGLGEETHLPVSLHRLPANANMAEARNEAEEVMFGALDELFEKTKVKPKDIGILVVNCSLFNPTPSLSAMIVNKYHMRGNIRTYNLGGMGCSAGVISIDLAKDMLQVHGGTYAIVVSTENITQNWYYGNRRSMLIPNCLFRVGGAAILLSNKRSEKRRAKYQLVHTVRTHKGADDKCFRCVYQEEDEKNFMGVSLSKDLMAIAGDALKTNITTLGPLVLPLSEQLLFFGILVARKVFNMKVKPYIPDFKLAFDHFCIHAGGRAVIDELEKNLQLTKDHVEPSRMTLHRFGNTSSSSIWYELNYIESKGRMKKGDRVWQIAFGSGFKCNSAVWQAVRTLKPPARGPWTHCIDSYPVKIPEVYKF

SEQ ID NO: 20860 - protein, 168 aa, Picea sitchensis
MGTQIAKLSLLHHLLMQPARSSFLRHICAATNASDKTTEAVVNVNPKAQPLADTELYTSIIEVVRDASEVRQLKKGAHEVFKTLHRGLADFVIIAADTQPLDIVLHLPTLAKTKKIPYVFVPSKQELGRACGVVISPVVACAVMSTHIGSGLDARISKLKVAIQNLHM

SEQ ID NO: 20861 - protein, 380 aa, Zea mays
  misc_feature (12)..(12): Xaa can be any naturally occurring amino acid
MATAGKVIKCRXAAVTWEAGKPLSIEEVEVAPPQAMEVRIKILYTALCHTDVYFWEAKGQTPVFPRILGHEAGGIVESVGEGVTDVAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 20862 - protein, 375 aa, Coprinopsis cinerea okayama7#130
MSDNPSFVLKGINDVVFEQRPIPEVTGDEVLVAVKKTGICGSDVHYLLEGRIGDFVVKSPMVLGHESSGVVAKVGPKVKHLKVGDRVAMEPGATCRACEACKLGKYELCPDIIFAATPPYDGTLARYYKLPADLAYPLPDNVTLEDGAMMEPLSVGVHSVANLGNFRAGQSIAVFGCGPVGLLCMAVAKALGASRVIAIDIVPARLDFAKQYAATDSFLPPKPLEGESKVDYSRRNAAALKEALGIAERGASAIDLVIDASGAEVSIQTALHVVKSGGTFVQVGMGNPNVTIDIGVLITKELNYKGSFRYGPGDYPLAINLVAAGKVDLKPLVTHRYKFEDAITAFNATKNGKSEDGKGVIKVVISGPDVDINSN

SEQ ID NO: 20863 - protein, 257 aa, Zea mays
  misc_feature (86)..(86): Xaa can be any naturally occurring amino acid
MDEWTRQAEVLVRQSESWIRQQPPEQIYVAATVVAVTILLLIVASYLKSSKPSTIVLSGLSGSGKTTIFYQLRDGSSHQGTVTSMXEENSDTFVLHSEQERKGKVKPVHIVDVPGHARLKPKLDEVLPKAAGVVFIVDAQDFLSSMQAAAEYLYDILTKASVVKKRIPVLIFCNKTDKVTAHSKEFIKKQLEKELNKLRESRNAISSADISDEVQLGVPGEAFNFSQCQNKVAVAEGAGSTGNVLAVEQFIREHVRG

SEQ ID NO: 20864 - protein, 225 aa, Aspergillus nidulans FGSC A4
MPSPTDPALQFDSIEDTIKAFSNGEFIVVLDSQDRENEGDLIIAAESITDAQMAFLVRYTSGLICAPITPEIAERLQLPQMVLENTDPKGTAYTVSIDSADPSITTGISAHDRALACRTLASPSARPQDFRRPGHIIPLQAKAGGVRQRKGHTEAAVEFCRLAGKAPAGVIAELVEDGEVVEGVAEIRGNNGMMRRDGCLKFGKKWGLKLYDRNIAYYILINWFI

SEQ ID NO: 20865 - protein, 795 aa, Ralstonia solanacearum GMI1000
MTNLSMDGAYVLPFEQLRMTDVEVVGGKNASLGEMISQLDSAGVRVPGGFATTALAFRDFLQHNNLTERISQRLASLDVDDVKALAAAGKEIREWVATAPFQSRLEQEIREHFERVSKREGAEASFAVRSSATAEDLPDASFAGQQESYLNVSGIDDVLDKIKHVFASLYNDRAISYRVHKGFAHDVVALSAGIQRMVRSDCGASGVMFTIDTESGFQDVVFITSSYGLGETVVQGAVNPDEFYVFKPTLAAGKYPIIRRSIGSKLIKMEFTQAGEEGRVKTVDVPGELRNRYSLVDEDVVELAKYAVIIEKHYGRPMDIEWGKDGKDGKIYILQARPETVKSQSVGKVEQRFRLKGSAPVLTTGRAIGQKIGTGPVRVINDPAEMERVQPGDVLVADMTDPNWEPVMKRASAIVTNRGGRTCHAAIIARELGVPAVVGCGDATDLLKDGTLVTVSCAEGDEGKIYDGLLETEITEVRRGEMPPIDVKIMMNVGNPQLAFEFAQIPNGGVGLARLEFIINNNIGVHPKAILDYPQVDSDLKKAVESVARGHASPRAFYVDKLAEGIATIAAAFYPKPVIVRLSDFKSNEYKKLIGGSRYEPDEENPMLGFRGASRYIAEDFAEAFEMECRAMKRVREEMGLTNVEIMVPFVRTLGQAAMVVDLLGKYGLKRGENDLRLIMMCEVPSNAILAKEFLEYFDGFSIGSNDLTQLTLGLDRDSGMELLARDFDERDPAVKFMLSRAISTAKSMGKYVGICGQGPSDHPDFAEWLAKEGISSISLNPDSVIDTWQKLGSA

SEQ ID NO: 20866 - protein, 330 aa, Geobacter sulfurreducens PCA
MRAMLFEEVGKPLRPVRVPVPEPGPGEVLLKVHACGICRTDVHIVDGELTEPALPLIPGHQIVGSVAKLGEGVERFREGTRVGVPWLGATCGACRYCRSGRENLCDHARFTGYQRDGGFAEFTVADARFCFPIPGGYPDLQAAPLLCAGLIGYRSLVMAGEGERLGIYGFGAAAHIVTQVARFRGWRVYAFTRPDDRAGQAFAREMGAVWAGASHERPPEELDAAIIFAPAGELVPAALRAVGKGGVVVCGGIHMSDIPPIPYDILWGERSIRSVANLTRRDGEEFLALAPKVPVRTEVTAYPLSAANEALDDLRRGRLRGAGVLVIDEG

SEQ ID NO: 20867 - protein, 145 aa, Triticum aestivum
  misc_feature (79)..(79): Xaa can be any naturally occurring amino acid
  misc_feature (83)..(83): Xaa can be any naturally occurring amino acid
  misc_feature (98)..(99): Xaa can be any naturally occurring amino acid
  misc_feature (113)..(113): Xaa can be any naturally occurring amino acid
  misc_feature (118)..(118): Xaa can be any naturally occurring amino acid
  misc_feature (122)..(124): Xaa can be any naturally occurring amino acid
  misc_feature (126)..(127): Xaa can be any naturally occurring amino acid
  misc_feature (131)..(131): Xaa can be any naturally occurring amino acid
LVPNSARELLVHFDVVIFEFNLIDTAYKKIIIDITNKMGNGMADYALNAEHNINGINTIEDYENYCHYVAGLVGDGLTXLFVXSGFANPALLQCPKLXXSMGQFLQKTNIIRXIREDXDDKXXXWXXREIXSNHVEKFDGLIPAP

SEQ ID NO: 20868 - protein, 208 aa, Chlamydophila pneumoniae AR39
MRNNKRVEEEVFMTLSLVGKEAPDFVAQAVVNGETCTVSLKDYLGKYVVLFFYPKDFTYVCPTELHAFQDALGEFHTRGAEVIGCSVDDIATHQQWLATKKKQGGIEGITYPLLSDEDKVISRSYHVLKPEEELSFRGVFLIDKGGIIRHLVVNDLPLGRSIEEELRTLDALIFFETNGLVCPANWHEGERAMAPNEEGLQNYFGTID

SEQ ID NO: 20869 - protein, 308 aa, Hordeum vulgare subsp. spontaneum
MATAGKVIKCKAAVAWEAGKPLSMEEEEVEVAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCSISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 20870 - protein, 306 aa, Hordeum vulgare subsp. spontaneum
MATAGKVIKCKAAVAWEAGKPLSMEEVEVAPPQAMEVRDKILYTALCHTDVYFWEAKGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 20871 - protein, 82 aa, Glycine max
MKLNISFPATGCQKLIEVDDERKLRTFYEKRMATEVAADALGEEWKGYVVRISGGNDKQGFPMKQGVLTHGRVRLLLSKGHS

SEQ ID NO: 20872 - protein, 888 aa, Geobacter sulfurreducens PCA
MAGKYVYFFGNGQAEGKAEMKNLLGGKGANLAEMTAIGLPVPPGFTITTEVCTYYYANNRSYPPTLAAEVADNLKKVEALMGRTFGDRNNPLLVSVRSGARASMPGMMDTILNLGLNDETVQGIIAQSGDERFAYDAYRRFVQMYSDVVMGMDKDLLEHLLEQKKEEKGVHLDTDLTAADWKELVGKFKAKIRETLGKEFPEDPQEQLWGAVGAVFGSWMNQRAITYRRLNNIPADWGTAVNVQSMVYGNMGNDCATGVAFTRDPSTGENYFYGEYLVNAQGEDVVAGIRTPQPINRANSKDTTLPAMEDVLPECYQQLVQIRGILEKHYRDMQDIEFTIEKGKLFMLQTRNGKRTAKAAIKIAVDMVREGLIDEKTAVLRVSPSQLDQLLHPSLDPKAQKRVIAKGLPASPGAASGEVVFTADEAEAAARLGLKVILVRVETSPEDIHGMHAAQGILTARGGMTSHAAVVARGMGKCCVAGCGDIKVDYAGSQFATAKGQVVKKGDVITLDGSTGEVMLGEVPTVPPQLTGDFGTLMEWVDRFRKLKVRTNADTPNDSRVAREFGAEGIGLCRTEHMFFEADRIAAVREMILAEDVEGRKKALAKILPMQKGDFVGIFREMKGLPVTIRLLDPPLHEFLPHEDKDIDALAKTMGVTPQSLRAKVDYLHEFNPMLGHRGCRLGLTFPEIYDMQVQAIMEAACELTKNEGFSIVPEIMIPLVGVVTELARLRENTVRVCEEVVAAYGVKVEYLIGTMIELPRAALTADEIAREAEFFSFGTNDLTQTTFGLSRDDAGKFLPFYVETGLLEDDPFVSLDQNGVGLLVKMAVEKGRATRPGIKLGICGEHGGDPSSVIFCHQIGLDYVSCSPFRVPIARLAAAHAALEEGK

SEQ ID NO: 20873 - protein, 306 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEDVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTLAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 20874 - protein, 86 aa, Escherichia coli
MTNVKYIQRGIDENLANSALIKLNQIGSLSETFDAVQLCHDNNWGTFISHRSGETVDSFIADMTVAMRAGHLKTGAPCRGERIEKI

SEQ ID NO: 20875 - protein, 235 aa, Burkholderia mallei ATCC 23344
MTLPMTQDELKRLVGEAAARYVTENVPQGAVIGVGTGSTANCFIDALAAVKDRYRGAVSSSVATTERLKSHGIKVFDLNEIESLQVYVDGADEIDGSGAMIKGGGGALTREKIVASVAETFVCIADASKRVAVLGQFPLPVEVVPMARTAIGRRLAALGGVPVLRVKQDGAPYVTDNGNEILDVKGLRIDDPRALEAAINGWPGVVTVGLFAQRGADLCLLGTERGVETLRYAAH

SEQ ID NO: 20876 - protein, 283 aa, Oryza sativa
  misc_feature (235)..(235): Xaa can be any naturally occurring amino acid
MARSPAARKPSAAQTVAVTLALALASAGLLFLLFHLSPSSPTPHPHPHRRLRLRGARASPSPRGQIPFDPVIAGLERRRDDREWERLAAAGLHAPGFEAAPVPEDYIDGGGGFGADPDEDYINDAARFNLTRRVEALFPKIDVDPADGAVTPAELTAWNLASARREVMHRTARELDLHDRDHDGRIAFSEYERPSWAWRFDDHNSSNDGVGWWKEEHFNASDMDGDGFLNLIEFXRLLTSSRYYKPKANKLVVQRRSQVHLSLQTLFPYTSASSYSICILLLL

SEQ ID NO: 20877 - protein, 349 aa, Pisum sativum
GSYADELVKTAKTIASPGRGILAMDESNATCGKRLDSIGLENTEANRQAWRTLLVTVPTLGEYISGAILFEETLYQSTVDGRKIVDVLVEQNIIPGIKVDKGLVPLAGSNNESWCQGLDGLASRSAAYYQQGARFAKWRTVVSIPNGPSALAVKEAAWGLARYAAISQDNGLVPIVEPEILLDGEHGIDRTFEVAQKVWAEVFYYLAENNVQFEGILLKPSMVTPGAESKDKASPTKVAEYTLNLLHRRIPPAVPGIMFLSGGQSEVEATLNLNAMNKSPNPWHVSFSYARALQNTALKTWGGLPENVKAAQEALLFRAKSNSLAQLGKYIGDGESEEAKKDCCQGYSY

SEQ ID NO: 20878 - protein, 398 aa, Bradyrhizobium japonicum USDA 110
MAKSQRTAVVLVAAGRGLRAGAGGPKQYREIGGQPVIYRAMEAFSRHPDVFAVQPVVNPDDSAMFTAAVAGLKHEPPTNGGATRQASVLAGLEALAKHQPDIVLIHDAARPFVSDGVISRAIDAASRTGAAIPVVPVTDTIKLTGASGNVEDTPDRARLRIAQTPQSFRFDVILEAHRRAAKDGRSDFTDDAAIAEWAGLTVATFEGDVANMKLTTPEDFVREEARLAAQLGDIRTGTGYDVHAFGEGDHVMICGVRVPHSKGFLAHSDGDVGLHALVDAILGALADGDIGSHFPPSDAKWKGASSDQFLKYAIERVAQRGGRVANLEVTMICERPKIGPLRDTMRARIAEISGVDISRVAVKATTSERLGFTGREEGIAATASATIRLPFNEKTWSV

SEQ ID NO: 20879 - protein, 408 aa, Listeria innocua Clip11262
MIDIQKIRADFPILAQEINEKPLAYLDNAATSQKPKQVIAALTHYYEFDNANVHRGVHTLAARATDAYESARGKVAKFIHAREVAEIIFTRGTTSAINLVVDSYAEANIEAGDEIVISYLEHHSNLIPWQQLAKRKGAVLKYIELEEDGTISVEQAKKTIDEKTKIVALAHVSNVLGTITPIKEIAAIAHQFGAVILVDGAQAVPHMEVDVVDLDADFYAFSGHKMMAPTGIGALYGKRELLDAMEPTEFGGEMIDFVELYDSTWKELPWKFEAGTPIIGGAIALGAAIDYLAEVGLANIHAHEQALASYAIEEMSKIEGITIYGPKDASKRCGLVTFNLEGAHPHDIATILDEDGIAIRAGHHCAQPLMKWLDVSSTARASFYIYNTKEEIDALIDGLKLTKEYFGL

SEQ ID NO: 20880 - protein, 394 aa, Methanosarcina acetivorans C2A
MSMTIGLAGKPNAGKSTFFKAATLADVEIANYPFTTINANHGVTYVRAECPCKEKEKTCGKCVDGVRLVPIDIIDVAGLVPDACKGKGLGNTFLDELRQAQAIIHVVDASGGTDAEGNPVEIGDHNPLDDVAFLNREITMWLYGILERNWVKLSRKIQAEGLKLEIVISEQLAGAGIKESHVNAALIDTGLARVDHVKWTEEDMIRLCDAMREISKPLLIAANKADIAPRENLDKLKELDRIVVPTSAAAELALKSAAKSGIIRYAPGDRDFELLTEDLTKAQKKGLEAIHKVIERLGTTGVQGCINRTVFELLDLIVVYPVEDEGKWSDKVGNMLPDAYLMKRGSTCHDLAYQIHTEIGDRFLYAVDARTRLRLGEKHELKNGDVIKIVSTAK

SEQ ID NO: 20881 - protein, 400 aa, Campylobacter jejuni RM1221
MFDEIRFNTIERLPNYVFAEVNAIKMAARRAGEDIIDFSMGNPDGKTPQHIIDKLCESANKDKTSGYSTSMGIYKLRLAICNWYKRKYNVNLDPENEVVATMGSKEGFVNLARAIINPGDVAIVPTPAYPIHTQAFIIAGGNVAKMPLAYNEKFELDENQFFENLHKTLNESIPRPKYVVVNFPHNPTTVTCEKSFYERLIATAKKERFYIISDIAYADLTYDDYKTPSILEIEGAKDIAVETYTLSKSYNMAGWRVGFVVGNKRLVSALKKIKSWFDYGMYTPIQVGATIALDGDQTCVDEIRATYDKRMHILLEAFENAGWKLQKPRASMFVWAKLPESKRHLKSLEFSKQLLQRASVAVSPGVGFGEAGDEYVRIALIENENRIRQAARNIKKYLKE

SEQ ID NO: 20882 - protein, 446 aa, Rickettsia prowazekii str. Madrid E
MALIIQKFGGTSVANVERIKKLVPIIKAEIAKNNQVIVVVSAMAGVTNQLVTLCNEVSSLNKRSQFAEYDVALSSGEIVTASLLALALQEEEIKAQSLLAWQLPIRTNNNYSKALVEFITTDLLEKYLQLKIIPIIAGFQGINKSNRVTTLGRGGSDTTAALIAAAMKADRCDIYTDVDGIFTADPRIIPNAKRIKEIDFLEMLELASSGAKVLHPRAVELVMRYKIDMRVLSTFSPNTEGTLITSKDTIPLVKSTYMEESALNTKHSTKIDIPEDASGSTYKLPIELALQNRYNMENCVVRCITSNKNLLKVSVNSISLSFLQVANMITYNNNCIEFMQEIENNIEYNFITNLTDKNNLQTLLTKCKNNKQIQDFTFDTEIATISLIGYGIKNDCKLLTMILSQLTQDNINVHMMQLSEVKITLLINDKDVEKTIFNLYNLFKIS

SEQ ID NO: 20883 - protein, 491 aa, Bradyrhizobium sp. ORS278
MTVHFPFQNSYVALPDNFFARVAPTPVAAPRLIKLNRPLAEELGLNPAELETPEGAEILAGKTVPEGAEPIAMAYAGHQFGHFVPQLGDGRAVLLGEVVDRNGVRRDIQLKGSGPTPFSRRGDGRAALGPVLREYIVSEAMAALGIPTTRSLAAVVTGEQVYRGTALPGAVLTRVATSHIRVGTFQYFAARQDVEAVRRLADHVIGRHYPDLAGTERPYHALLAAVISRQAKLIADWLLVGFIHGVMNTDNTSVSGETIDYGPCAFMDAYDPKQVFSSIDEFGRYAFANQPRIAMWNLTRLAECLLPLFGDDKDQAIKEAETALDGFAAQFTEAHQAGLRRKLGLFTQRDGDQPLAQALFDAMALAKADFTLTFRRLSDAAGSGDLSVVRALFEDPTGFDEWAARWQQRLAVEPQTPAERRAAMRKVNPAFIPRNHRIEAVITAAVENDDYAPFEELHAVLAKPYDDQPDRADYAEPPQPEERVLQTFCGT

SEQ ID NO: 20884 - protein, 430 aa, Mycobacterium smegmatis str. MC2 155
MADHVAMTQLEVADYDLGLRGKLVRSSKTHGASGLAFCTILYGLSLIDDVTDTPFSNAANGYPDAQLVPDETTRVALPWRHGTDAVIAELVDEQGRPLEVSPRAVLAGLAARYGELGLAPVLGYEYELWIFRDGEGTSPPILGGRPAHGRTENAYSLTRCAEINDIATEFVNRMDQIGIEVEMFHAELGPGFFEFTLAPETALRATDNAARARQYLRDLCAERGLHASFMAKPFADKSGAGGHVHSSLTRDGNNVFSDGAGALSAEGSRYLAGLLAGMADTSLMLNPHVNSYKRIDPEMFTPALANWGYDDRGTSARVILPDAKSARVEHRRPGADASPYLVAAALLAAGLRGLQEELPLPERDAEPTELPGDLAGALAHFENSTWLPDLLGKAFCTSYAATRRAELQRYEQWLRTTITDWELHRHLEHQ

SEQ ID NO: 20885 - protein, 518 aa, Pichia angusta
MLRTSLRSLAKPASRVSLRYYSSYPLSTTVTLPNGKSYEQPTGLFINNEFVPSKQHKTFEVINPATEEEICHVYEARKEDVDVAVDAAEKAFKGSWSTADPAIRGKALWNLAELLEAHKDTLAAIESLDNGKALQLAQGDVALVINYIRSCAGWADKLTGQYIDTGDTHHTYTKREPIGVCGQIIPWNFPLLMWSWKVGPALAAGNTVVLKTAESTPLSALYASQLVKEAGIPAGVVNIVSGFGKITGDAIASHPKIKKLAFTGSTATGRHIMKVAADSNLKKVTLELGGKSANIVFDDADVKTAISALVAGIFYNSGEVCSAGSRVFVQEGIYEEILREFKAAAETLKVGDPFDLSTFQGAQTSQMQLNKILGYVDIAHQEGGRLITGGERLGNKGFFVKPTIFADVTPDMRAYKEEIFGPFAVITPFKTADEVIELANDSEYGLAAGVHTKSLDTATYVSNKLEAGSVWINTYNDFHQMVPFGGYKQSGIGREMGAQALDNYTQWKAVRIGLQKPT

SEQ ID NO: 20886 - protein, 631 aa, Kluyveromyces lactis NRRL Y-1140
MSPVQLDEKSLRTKSPRSDSPVHGQSTVVKNIPFGHYVFERLLNSGAKSIFGVPGDFNLPLLEYLYDEDLVANGLQWIGTCNELNGAYAADGYSRYTNKLGCVITTYGVGELSALNGVAGAFAEDVKVLHIIGVSPSRFRENEQFRSHNVHHLVPAIDSQQPPNHQVYFDMVKDRVCCSSAFLDDINTAADRLDQVIVDICKNSKPGYVFIPVDFADKLVSNKNLIQNPIIDMDTVIESYKDENATKIAGDRLLQWIYESNAPSVFSDLLVDRFNLRKELRQFIETADVWNYNTAMGKSTLDERNPKYLGLYKGAETGKEMQATVDSSDLILHFGPAKNEINCGYYSFHFNENARIIELSNNIIQFIDIKDKNASTVEEANFVSVLKYVNDNLDKSKLSFSYPPVPKSNHSCEYDNNDSITQKSLKEIIPNYFNDGDVLIVETGSFQFGVPNMQFAREMKYITQSFYLSIGMALPAALGVGCGMRDYPRSHIVDQALVPKDYIPRLILCEGDGAAQMTIQEFASYIRYKIPMEILVWNNNGYTVERAINGPTRSYNDIAPFKWTALLNVFGDFENKFNESVTVEKNDELVQLLNKWKSCKERANIKLAEVMLPVMDIPQELNAMLVNGKPN

SEQ ID NO: 20887 - protein, 550 aa, Xanthobacter autotrophicus Py2
MATNNLAKIEKAPKSNLSGLNLLHDPVRNKGTAYTRDDRRQLGLEGLLPHAVETLDRQVERVLDHLDHVKDELDQYSYLMDLEARNETVFYKAVMSDPKRFIPILYDPTVADACEAFGNLYRRPRGMYITRHMKGRMAEVLRNWPQKDIRFVCVSTGGRILGLGDIGANGMGIPIGKLQLYTACAAVPPDVLLPVLFDIGTSNEHLRADPFYLGTREAPVSEAELDELTEEFVQAVNEVFPGCCVHFEDWKGTDAIRMLDRYKDKILCYNDDIQGTASVALAGIAAAMKQTGGKLKDQRILFLGAGSAGLGISKLIAAELQTLGLSAEEARKRVRLFDVNGLIESSRTDLTETQKLWAQNEKPTNNFLEVIESFKPTVLIGVSTKPRAFTKEVIEAMSRLNDRPVIFALSNPTHKAECTAEQAYTWSKGKALFAAGVQFDEVAYDGKTYRPGQANNFYIYPAIGLATYAARPKLLNDECFIVAAHATADQVGPSLQAKGMLFPSQEHILETEVTTATRIVEYMFDAGLATVERPREIRSWVESLLYAPAY

SEQ ID NO: 20888 - protein, 445 aa, Glycine max
MATIKAVKARQIFDSRGNPTVEVDVILSDGSFHRAAVPSGASTGVYEALELRDGGSDYLGKGVLKAVENVNSIIAPALLGKDPTKQTEIDNFMVQQLDGTVNEWGWCKQKLGANAILAVSLAVCKAGAAVKKIPLYKHIANLAGNKTLVLPVPSFNVINGGSHAGNKLAMQEFMILPVGASSFKEAMKMGVEVYHHLKAVIKKKYGQDATNVGDEGGFAPNIQENQEGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRSERLAKYNQLLRIEEELGSAAVYAGAKFRAPVEPY

SEQ ID NO: 20889 - protein, 2554 aa, Arabidopsis thaliana
MERHCVLVATFLLMLHIVHAQDQIGFISVDCGLAPRESPYNEAKTGLTYTSDDGLVNVGKPGRIAKEFEPLADKPTLTLRYFPEGVRNCYNLNVTSDTNYLIKATFVYGNYDGLNVGPNFDLYFGPNLWTTVSSNDTIKEIIHVTKTNSLQLRPMKKNMYVTQGESLNYLFRVYISNSSTRIRFPDDVYDRKWYPYFDNSWTQVTTTLDVNTSLTYELPQSVMAKAATPIKANDTLNITWTVEPPTTKFYSYMHFAELQTLRANDAREFNVTMNGIYTYGPYSPKPLKTETIYDKIPEQCDGGACLLQVVKTLKSTLPPLLNAIEAFTVIDFPQMETNGDDVDAIKNVQDTYGISRISWQGDPCVPKLFLWDGLNCNNSDNSTSPIITSLDLSSSGLTGSITQAIQNLTNLQELDLSDNNLTGEIPDFLGDIKSLLVINLSGNNLSGSVPPSLLQKKGMKLNVEGNPHLLCTADSCVKKGEDGHKKKSVIVPVVASIASIAVLIGALVLFFILRKKKSPKVEGPPPSYMQASDGRSPRSSEPAIVTKNRRFTYSQVAIMTNNFQRILGKGGFGMVYHGFVNGTEQVAVKILSHSSSQGYKEFKAEVELLLRVHHKNLVGLVGYCDEGENMALIYEYMANGDLKEHMSGTRNRFTLNWGTRLKIVVESAQGLEYLHNGCKPPMVHRDVKTTNILLNEHFQAKLADFGLSRSFPIEGETHVSTVVAGTPGYLDPEYYKTNWLTEKSDVYSFGIVLLELITNRPVIDKSREKPHIAEWVGVMLTKGDINSIMDPNLNEDYDSGSVWKAVELAMSCLNPSSARRPTMSQVVIELNECIASENSRGGASRDMDSKSSIEVSLTFDTELSPTARQENHGETLCVRYHFCANTSSCSSSKSNRVDCGLSPPESPYNAPQTGLTYTSDTGLINTGKTGRIAKDFEPFVDKPALTMRYFPDGIRNCYNLNVTRDTNYLIKATFVYGNYDGLNVDPNFDLYLGPNLWTTVSSNDTTEEIIHVTKFNSLQICLVKTGISIPFINVLELRPLKKNVYATQSGSLKYLFRMYVSNSSRRIRFPDDVYDRKWYPIFQNSWTQVTTNLNVNISTIYELPQSVMSTAATPLNANATLNITWTIEPPTTPFYSYIHFAELQSLRANDTREFNVTLNGEYTIGPYSPKPLKTETIQDLSPEQCNGGACILQLVETLKSTLPPLLNAIEAFTVIDFPQMETNEDDVTGINDVQNTYGLNRISWQGDPCVPKQYSWDGNPHLLCTDGLCVNKGDGHKKKSIIAPVVASIASIAILIGALVLFFVLKKKTQSKGPPAAYVQASNGRSRRSAEPAIVTKNKRFTYSEVMQMTNNFQRVLGKGGFGIVYHGLVNGTEQVAIKILSHSSSQGYKQFKAEVELLLRVHHKNLVGLVGYCDEGENLALIYEYMANGDLKEHMSGTRNHFILNWGTRLKIVVESAQGLEYLHNGCKPLMVHRDIKTTNILLNEQFDAKLADFGLSRSFPIEGETHVSTAVAGTPGYLDPEYYRTNWLTEKSDVYSFGVVLLEIITNQPVIDPRREKPHIAEWVGEVLTKGDIKNIMDPSLNGDYDSTSVWKAVELAMCCLNPSSARRPNMSQVVIELNECLTSENSRGGAIRDMDSEGSIEVSLTFGTEVTPLARKKNNGETFCVYCHLFADISSCSSSKSNSVDCGLSLLESPYDAPQTGLTYTSDADLVASGKTGRLAKEFEPLVDKPTLTLRYFPEGVRNCYNLNVTSDTNYLIKATFVYGNYDGLNVGPNFNLYLGPNLWTTVSSNDTIEEIILVTRSNSLQVCLVKTGISIPFINMLELRPMKKNMYVTQSGSLKYLFRGYISNSSTRIRFPDDVYDRKWYPLFDDSWTQVTTNLKVNTSITYELPQSVMAKAATPIKANDTLNITWTVEPPTTQFYSYVHIAEIQALRANETREFNVTLNGEYTFGPFSPIPLKTASIVDLSPGQCDGGRCILQVVKTLKSTLPPLLNAIEAFTVIDFPQMETNENDVAGIKNVQGTYGLSRISWQGDPCVPKQLLWDGLNCKNSDISTPPIITSLDLSSSGLTGIITQAIKNLTHLQILDLSDNNLTGEVPEFLADIKSLLVINLSGNNLSGSVPPSLLQKKGMKLNVEGNPHILCTTGSCVKKKEDGHKKKSVIVPVVASIASIAVLIGALVLFLILRKKRSPKVEGPPPSYMQASDGRLPRSSEPAIVTKNRRFSYSQVVIMTNNFQRILGKGGFGMVYHGFVNGTEQVAVKILSHSSSQGYKQFKAEVELLLRVHHKNLVGLVGYCDEGDNLALIYEYMANGDLKEHMSGTRNRFILNWGTRLKIVIESAQGLEYLHNGCKPPMVHRDVKTTNILLNEHFEAKLADFGLSRSFLIEGETHVSTVVAGTPGYLDPEYHRTNWLTEKSDVYSFGILLLEIITNRHVIDQSREKPHIGEWVGVMLTKGDIQSIMDPSLNEDYDSGSVWKAVELAMSCLNHSSARRPTMSQVVIELNECLASENARGGASRDMESKSSIEVSLTFGTERRFFQTLPTNATFGTLL

SEQ ID NO: 20890 - protein, 627 aa, Coprinopsis cinerea okayama7#130
MIPPVASDPDPTTQIPWPSGRNRAQDADQGDAFPDQASNGVTTVNRDGPSSRSKKTTGKRAQIAWTVELGYGTPFLLGLGLPEHLTALVWLAGPISGLVAQPVIGALSDSSTSKYRRRFWIVLSTVALVLSTLVLAYCEPLAAVVVDLLAVGQGDWDDRRNKIVTNTAIGFAVVSFYILDFALNGLQASLRNLLLDVTPPNQLNEGNAWHSRMTNAGNIVGFGFGFMPLAELPIIRLLGGSQFRKFCIICIVILVITVWMTCWFHEEEERPAHQQRRRRGFGEVLDNIYKSMINLPRPIRRVCYVQLFAFMGWFPFLFYSTTYVGQVMAHEIGKEPDHEYATRLGERAMLIYSIVGVIAGMILPHVATRDRRLLASKTFESPDEELNTLRKMVRQWRVEAARQGKPLRLPVMPFLLRNIWSAAMIFFALLMFSTIFVKTVFEATIFISLVGICWAVAMWVPFTIIMELLKETPPPPPPQSRRPSHVRNLSTPARRPSVINPTSERQPLLRRRSYDEFDSALDADSESGPLPGGTVLGIHNLAIVMPQFLVALATNVIFRLADGQMPVEGERGTYYGKNGVAWVLRFGGFCTLLGAVVARMVPPTTTEREMRRRLGEMKLLGEETSNP

SEQ ID NO: 20891 - protein, 590 aa, Glycine max
MTEERNVRKTRVVDVVLDCVIPYIDDPKDRDAVSQVCRRWYELDSLTRKHVTIALCYTTTPARLRRRFPHLESLKLKGKPRAAMFNLIPEDWGGHVTPWVKEISQYFDCLKSLHFRRMIVKDSDLQNLARDRGHVLHALKLDKCSGFTTDGLFHIGRFCKSLRVLFLEESSILEKDGEWLHELALNNTVLETLNFYLTDIAVVKIEDLELLAKNCPNLVSVKLTDCEILDLVNFFKHASALEEFCGGTYNEEPERYSAISLPAKLCRLGLTYIGKNELPIVFMFAAVLKKLDLLYAMLDTEDHCMLIQRCPNLEVLETRNVIGDRGLEVLGRCCKRLKRLRIERGDDDQGMEDEEGTVSHRGLIALSQGCSELEYMAVYVSDITNASLEHIGTHLKNLCDFRLVLLDHEEKITDLPLDNGVRALLRGCDKLRRFALYLRRGGLTDVGLGYIGQYSPNVRWMLLGYVGESDAGLLEFAKGCPSLQKLEMRGCLFFSERALAVAATQLTSLRYLWVQGYGVSPSGRDLLVMARPFWNIELIPSRKVATNTNPDETVVVEHPAHILAYYSLAGQRSDFPDTVVPLDTATCVDT

SEQ ID NO: 20892 - protein, 547 aa, Ralstonia solanacearum GMI1000
MPILSLHNMHDKVLILDFGSQVTQLIARRVREAHVYCEIHPNDVSDAFVREFAPKAIILSGSHASTYEDQDLRAPQAVWDLGVPVLGICYGMFAMTVQQGGKVEASAHREFGYAEVRAHGHTRLLDSIEDFRTPEGHGMLKVWMSHGDKVTEMPPGFKLMASTPSCPIAGMADEARGYYAVQFHPEVTHTVQGRALLERFVLEIAGAKPDWIMRDHIEEAVKSIREQVGDEEVILGLSGGVDSSVAAALIHRAIGDQLTCVFVDHGLLRLNEGQMVLDMFEGRLHAKVVHVDASEQFLGHLTGVTDPEAKRKIIGREFVEVFQAEAKTLTNAKWLAQGTIYPDVIESGGAKTKKATTIKSHHNVGGLPETLGLKLLEPLRDLFKDEVRELGVALGLPPEMVYRHPFPGPGLGVRILGEVKREYADLLRRADAIFIEELRGTKATAQDAVAGLCTEDQVGKSWYDLTSQAFAVFLPVKSVGVMGDGRTYDYVVALRAVQTTDFMTAHWAHLPYALLGRVSNRIINEVRGINRVVYDVSGKPPATIEWE

SEQ ID NO: 20893 - protein, 272 aa, Triticum aestivum
  misc_feature (92)..(92): Xaa can be any naturally occurring amino acid
  misc_feature (112)..(112): Xaa can be any naturally occurring amino acid
  misc_feature (119)..(119): Xaa can be any naturally occurring amino acid
  misc_feature (176)..(176): Xaa can be any naturally occurring amino acid
  misc_feature (205)..(205): Xaa can be any naturally occurring amino acid
  misc_feature (220)..(220): Xaa can be any naturally occurring amino acid
  misc_feature (243)..(243): Xaa can be any naturally occurring amino acid
MAYFGGERGGDRGGERGGFGRVFGRGGCGDRGGRRGGRRGPRQEEEKWVPVTKLGRLVKEGRFTKMEELYLHSLPIKEHQIVEQLCPGLKDXVMNIPPVQNMTRVGQRTRFXAFVVVGXDCNGHVVFGVKCALEVATGIRVAIILDKVSIVPVRRGYWGNKIGLPHTVPCKVSGKXGSVTVRMLSVPRVFGMVAVCVLQRVLQFXAGIEDVFTSSCVSTXTLGNFDKATFDCLMRNYGFLTPXDFWRETPLSRAPFHEVPDLFGETDLGPFV

SEQ ID NO: 20894 - protein, 335 aa, Pseudoalteromonas tunicata D2
MAKQIITVIKGDGIGPSIIDSALEILNAAGCDFEYEFVDAGLTALENTGELLPQATIDAIAKNKITLKGPLTTPVGEGFTSINVTLRKKFNLYANVRPVVSFEGTKARYEDIDIITVRENTQGMYSGLGQVVSEDGSEAEAMSKITREGAQKIAVFAYELARRENRKKVTIVHKANILKSTSGLFLKVAREVAALYPDIETAEMIVDAACMKLVMTPEEFDVIVTTNLFGDILSDLCAGLVGGLGMAPGANIGEDAAIFEAVHGSAPDIAGKNLANPTSVILASIQMLEHLGMGDTAERIRNAVADVIKTGDRTTRDLGGNHGTTDFTQAVIERL

SEQ ID NO: 20895 - protein, 165 aa, Pseudoalteromonas tunicata D2
MKRILAILLENEPGALSRIVGLFSQRAYNIDSLTVGTTDDSSLSRITITTQGDDRIIEQITKQVNKLVDVLKVIDLTDTNHIERELVLIKVRAADEQARAAVTRVSDVFGGSIIDMGKTTYSLQLVGSTDKLASFIDTLRNETEIVEVVRSGAVGFIRGDKALRV

SEQ ID NO: 20896 - protein, 115 aa, Pseudomonas aeruginosa UCBPP-PA14
MNYRGSCHCGTIAYEVEGDLDQVIQCNCSLCSRRGWLLWFVPRDRLALKTPASAMHTYTFNTHRLQHHFCPTCGCAPFSEGIGPDGQAMAAVNARCLEDIDANALPVQHYDGRNA

SEQ ID NO: 20897 - protein, 339 aa, Burkholderia mallei ATCC 23344
MSASPALSPRRVSVAPMMDWTDRHCRSFHRTISRHAWLYTEMVTTGALIHGDVARHLAFTPDEAPVALQLGGSEPADLAHSAKLGERWGYDEINLNCGCPSERVQRGAFGACLMNEPQLVADCVKAMRDAVSIPVTVKHRIGVDAVEDYAFVRDFVGTVAAAGCDVFVVHARNAILKGLSPKENREIPPLKYDYAYRLKRDFPQIEIVINGGVTTLDEVEQHLRHVDGVMLGREAYHNPYVLAGIDARFYGASAPAPTREEVEAKLVEYCAAELARGTYLGAIVRHALGLYRGVAGARGWRRVLSDNKRLGRGDLSIFDEARTHLPRPEEFFEKKALQS

SEQ ID NO: 20898 - protein, 123 aa, Zea mays
  misc_feature (21)..(21): Xaa can be any naturally occurring amino acid
AQYYQLILLVYEGYKNIVESXQYNATALNQGLDKTDKFNIESKDNGVPLLGLSLKDRSRHSEFEILDLLRRFGWIVPGYTKPPDAHHVTVLRLFIREDFSRTLTERLVLDIEKVLHELDALHA

SEQ ID NO: 20899 - protein, 302 aa, Leifsonia xyli subsp. xyli str. CTCB07
MTTEDTFETAERAAAIAKAAALIESLPWLKTFHDRIIVVKFGGNAMVSEELQRTFAEDMVYLRYAGLLPVIVHGGGPQISAMLDRLGIQSEFRGGYRVTTPEAMEVVRMVLTGQINRDIVAAINKHGPLAAGLSGEDAALFQGRKRGAVVDGEAVDLGLVGDVIGVNPEAVLAQIDAGRIPVVSSIAPDIDEPGQSLNVNADAAAAALAVALRAAKLVILTDVAGLYSDWPNRDSLLSKITARELRELLPGLESGMIPKMAACLAAVDGGVEKAEIIDGRIEHSILLEVFTQSGIGTEVAPV

SEQ ID NO: 20900 - protein, 158 aa, Zea mays
ELATSLLAKGKEKGVSLMLPTDVVIADKFAPDANSQIVPASAIPDGWMGLDIGPDSVASFNAALDTTKTVIWNGPMGVFEFDKFAVGTEAVAKKLAELSGKGVTTIIGGGDSVAPVEKVGVADVMSHISPGGGASLELLEGKELPGVVALNEAAPVTV

SEQ ID NO: 20901 - protein, 403 aa, Leifsonia xyli subsp. xyli str. CTCB07
MSGDPNGRIDGAEWKPRYAEVMMRTLAMPKLLLERGQGCRVWDVDGNEYLDFLAGIAVNSLGHAHPALVEAVSSQVATLAHVSNYFSTAPQLELAERLRAITGAGEQGRVLFANSGAEANEAAFKLARLNRGPHGVRTRVLALRGAFHGRTMGALALTGKPPMREAFEPLPGGVEHIDSTIDALEHAIDDRVAALFVEPVKGEAGVLALPDGFLRRARELTEQHGVLLILDEIQTGVGRTGAWFAYQHEGILPDAVTVAKGIAGGIPIGALVTFGWASDLFTQGQHGSTFGGNPLATAAGNAVLAEIERAGLVENAARRGGELRAIIRSYDSPLIGEVRGAGLLVGIGLTGGEANRLADAALAQGLIVNAPNESSIRLAPPLIVGGAELAEFRERFGRALAAL

SEQ ID NO: 20902 - protein, 312 aa, Leifsonia xyli subsp. xyli str. CTCB07
MTRHFLRDDDLSPAEQVEVLDLAAKLKRDRFSARPLAGPQTVAVMFDKTSTRTRLSFATGIADLGGNPLIIQAGESQVGAKESLADTARVMERMLAAIVWRTFAHSGLEELVDGTRIPVVNALSDDVHPCQTLADLQTVRERKGRTAGLTMSFFGDGASNMAHSSLLGGVTAGMRVRIAAPAGYTPDPRFVADAEAIAARTGGSVLVTADPGEAAAGADVIVTDTWVSMGKEDEKAERIAVFGDYAVNAGTLRLADPAAIFLHCLPAYRGLEVSAYVIDGPQSVVWDEAENRLHAQKALLTWLLAKNREDAV

SEQ ID NO: 20903 - protein, 398 aa, Dehalococcoides sp. BAV1
MTSQVGTDKGFISERAKELKPSGIRKFFDLAAKMGSGAISLGVGEPDFTTPWHIRESAIYALEKGYTMYTSNAGLLELRQEISKYLYQTYGLEYNPETEVLITVGSSEALDLVMRATLNPGDEVLMTDPAYVAYPSCVFMSYGNPVQIPTFEANNFEISAADIAPRITPKTRSILLGYPSNPTGAVMPKAKLAEIAKLACEKNLLVVSDEIYDKIIYSGFEHTCFATLPGMRERSVIINGFSKTYAMTGWRIGYAVGPAAIIQAMTKIHQHTMLCAPIAAQKAALEALRNGQDDVRLMVEEYDRRRRFIVKNFNDMGLSCFEPKGAFYTFPSVRKTGLSSNEFAEKLLMEEKVAAVPGTAFGESGEGYLRCCYATSLKDIEEAMKRFRHFLKHNCPQM

SEQ ID NO: 20904 - protein, 770 aa, Bradyrhizobium sp. ORS278
MSSSYSEDLRSAALAYHRLPRPGKLEIQASKPLANQRDLALAYSPGVAAACTEIANNPAEAASLTARANLVAVVSNGTAVLGLGNIGPLASKPVMEGKAVLFKKFAGIDVFDIEISADTIDRVVETVAALEPTFGGINLEDIKGPECFEIEARLKERMKIPVFHDDQHGTAIIVGAAIKNALSLAGKQLSEVKIVTSGAGAAAIACLNLLVSMGAQRKNIWVCDIDGVVHEGRNTLMDPWKAVYAQKTDKRTLAEVIGGADIFLGLSAGGVLKPELLKQMAEKPLIMALANPNPEIMPEEARAARPDAMICTGRSDFPNQVNNVLCFPFIFRGALDVGATAINEAMKQAAVDAIALLAQDPPSDAVNRGFDTGETQGFGPGSLIPSPFDPRLILRIAPAVAKAAMESGVATRPITNFDEYTALLERFAFRSGLIMKPVFAKAKAQPVRVIYAEGEDERVLRATQVVLEEKLARPILVGRPSVVEARIKRFGLSIKAGRDFDLVNPEDDPRYRSYVQSYIEIAGRRGVTPDAARTVVRTNATVIAALAVVRGEADAMICGVEGRYMSHLRHVREIIGFMPGVSDYAALALTITSKGAYFIGDTQVRPDPTAEELAEMASLAANHVTRFNIKPKIAFVSHSDFGSYDTDSSRKMRRATALLKQHRPDLEADGEMQGDTALSATARKAILPHSDLDGSANVLIMPNLDAANVAYQMIKVLADAVPVGPILIGPARPAHILTPSVTARGILNMTAVAAVEAQERAGRAQPTLFA

SEQ ID NO: 20905 - protein, 386 aa, Alkaliphilus metalliredigens QYMF
MNISLAIGIVFLAGAAGGKLARYVKLPSVTGNLLAGILVGPSVMGLVSVEEMYQLAPINELALGVIALSIGAELHWGTMRKLAKDAAKVFMVEALLTLVLVFGSLYLFGLPFRYALIFGVISIATAPGAIIACIRETPSKGDFSRVLLSVVAMDNLFSITLFGIIISFMQVGLAATDTGNTPAIVMASRDIGIALLLGIGAGVFLVATSHKAKSDTRILVSVLGVILVTVGLSNQWGTPALLAAITAGTVYINFSGKPQRISRSLMNVEDPILLVFLTLAGAKLDLSVLPAVGQIGLVYIGARFVAKLVGSRVGTALTKFPMSWKRNLGRALTPQAGVAIGLAIIAEQKSIFAPDTIMPVVLTAVVVFELIGPILVRKALCDVDEA

SEQ ID NO: 20906 - protein, 383 aa, Exiguobacterium sibiricum 255-15
MEIFLYAGLILIGLFVVSYFSERFHLPSILAFILIGIILGLYYDLPEELKLGGEAGIIVLFFLLGLKFSVADLLIQFRNIWKAGLIDLLLSFGGTFLLTLAFGFSVPEAFLIGCVLYATSSSISARLLDREPDKHKDVNRFVLSLLIFEDLAAPLLLTSAPFVLGAQEFTFVKVGTIFLGFIFLFSALIFLTVFIRQKSRVVDSLYRHPDAGIGIIGLILTFSGIGIMFGLSEVLGAFIVGILLTEIKETRYLKRLVTPFQDLLLPLFFISFGMSFELTEGLPLDWFFVALVVWGLLSKFLVGFLGGRAFGLSNYHAIESGFCLGPRGEFSILFITLASGAFVTLTGLYIFVSAFLGIMLFRISTGLTDRTHATAQKIKQKIK

SEQ ID NO: 20907 - protein, 479 aa, Mycobacterium smegmatis str. MC2 155
MSEQTLPEAEHLSRQLSNRHIQLIAIGGAIGTGLFMGSGKTVSLAGPSVIFVYMIIGFMLFFVMRAMGELLLSNLEYKSFADFAADLLGPWAGFFTGWTYWFCWIVTGVAEVVAIAGYVAFWWPDLPLWIPALVTVAVLITLNLATVRAFGETEFWFAMIKIVAILALIVVGLVMVLSHFRAPGGAVASLSNLWDDGGFFPTGPMGFVAGFQIATFAFVGIELVGTTAAEARDPERNLPRAVNSIPVRVMLFYVAALVIIIAVTPWREISPDRSPFVAMFSLAGLGIAASVVNFVVLTSAASSANSGIYSTSRMVYGLSCGGDAPASFGRLTSRRVPANALFLSGVVLLSSVVMVAAGDSIIAAFTLVTTISSLCFMFIWTIILSSYLVYRRRRPQQHSASPFKMPGGVVMCWVVLAFFVFLVWAFTQKSDTLQALLVTPAWFVVLGIAWAFLRRRLGHKAREAAFRAALEAESADSAD

SEQ ID NO: 20908 - protein, 438 aa, Desulfococcus oleovorans Hxd3
MNDITNRHSAYKAVSPNTILLTGINHQTAPVEVREKVSFSPQEVPEALDALVAEPAILELILISTCNRTELLLTTNDPAAARKSATDCLARRKGLSPEQLAPYLYLHAADAAVRHIFRVASGLDSMIMGEPQIFGQVKEAYRLAVERKTSGVILNRLIHKTFLVAKRVRSETGIGDSAVSVSYAAVELAKKIFGVLEDKSVLLIGAGEMAELAVEHFAGHRVKTIFVANRTFERAVELARRYQGRAVSFPEIPDMLGTVDIVVSSTGAPDFVVTKDQVRQVMRGRRNNPIFFIDIAVPRDIDPAVNRVENAYVYDIDDLQAVIDENISQRRHEAIRAERIVDEAVITFRTWYESLDVVPTIVALRDKLSEMAHGEARKTLASTLKHLPPEEQDTIHKMTEAIVNKLLHDPTTFLKQVEEKKDKARYLDIVRRLFKIES

SEQ ID NO: 20909 - protein, 573 aa, Pseudomonas aeruginosa UCBPP-PA14
MPLARWVPGLDSLLHYRRAWFRPDVQAGLSVAAIQIPTAIAYAQIAGFPPQVGLYACILPMLIYALIGSSRQLMVGPDAATAAMVAAAITPLAAGDPQRLVDLSMIVAIMVGLFSIVAGLARAGFIASFLSRPILVGYLNGIGLSLLVGQLGKLFGYEAATSGFVAGILALLENLLHIHWPTLILGSLSLLLMVLLPRRFPQLPGALCGVLLASLAAALLGLDRYGVELLGEVPAGLPQLSWPQTSLEELKSLLRDATGITVVSFCSAMLTARSFAARHGYSINANHEFVALGLANIGAGVSQGFAISGADSRTAVNDMVGGKTQLVGVIAALVIAATLLLLNKPLGWVPMPALGAVLLLAGWGLIDVQALKGFWKLSRFEFSLCLLTTVGVLSVGVLPGIFVAVSIAVLRLLYYTYRPSDAVLGWMHGIDGQVELAKYPQATTLPGLVIYRFDAPLLFFNADYFKQRVLAVVDGSERPNAVLLNAEAMTNLDISGLATLHEVQQILKAQGVHLSLARVTGQTLDLLQRSSMLGEIKPPLVFSSVRSGVSAYRYWLRQQERLAAQAAATSGNA

SEQ ID NO: 20910 - protein, 764 aa, Kalidium foliatum
MGVVLLPDLGTEIIVPACAVIGIVFSLIQWYIVSQVKLSPDSGLGNNSKNGIAESLIEEKEGLNDHSVVAKCAEIQNAISEGATSFLYTEYQYVGIFMVAFAVLIFLFLGSVEGFSTSSQECTYDKTRRCKPALATAIFSTVSFLLGAVTSLASGFLGMKIATYANARTTLEARKGVGKAFIVAFRSGAVMGFLLAANGLLVLYIAILLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTAMLYPLLVSSVGILVCLITTLFATDFFEIKAVKEIEPALKKQLIISTAIMTVGVAIVTWVALPPSFTIFDFGSQKEVRNWQLFLCVAVGLWAGLIIGLVTEYYTSNAYSPVQDVADSCKTGAATNVIFGLALGYKSVIIPIFAIALSIFVSFSFAAMYGIAVAALGMLSTIATGLAIDAYGPISDNAGGIAEMAGMSHRIRERTDALDAAGNTTAAIGKGFAIGSAALVSLALFGAFVSRASISTVDVLTPKVFIGLLVGAMLPYWFSATTMKSVGSVALKMVEGVRRQFNTIPGLMEGTAKPDYANCVKISTDASIKEMIPPGALVMLTPLIVGTLFGVETLSGVLAGSLVSGVQIAISASNTGGAWDNAKKYIEAGSSEHARQLGPKGSDAHKAAVIGDTIGDPLKDASGPSLNILIKLMAVESLVFAPFFATHGGLLFKIF

SEQ ID NO: 20911 - protein, 253 aa, Pseudomonas aeruginosa UCBPP-PA14
MSKLLSGQVALVTGGAAGIGRATALAFAAAGVKVVVADLDSAGGEGTVEAIRQAGGEALFIRCDVTRDAEVKALVEGCAAAYGHLDYAFNNAGIEIEQGKLADGNEAEFDAIMAVNVKGVWLCMKHQIPLMLAQGGGAIVNTASVAGLGAAPKMSIYAASKHAVIGLTKSAAIEYAKKGIRVNAVCPAVIDTDMFRRAYEADPRKAEFAAAMHPLGRVGRVEEIAAAVLYLCSDHAGFTTGIALPVDGGATAI

SEQ ID NO: 20912 - protein, 297 aa, Pseudomonas aeruginosa UCBPP-PA14
MTADPILTLFLPIALGIIMLGLGLSLTPADFLRVVRYPKPVLVGLVCQIVLLPLACFLIVQGFALEAALAVGMMLLAASPGGTTANLYSHLAHGDVALNITLTAVNSVIAILTMPLIVNLSLQYFMGDGQAIPLQFGKVMQVFVIVLGPVAIGMLVRNRLPAVADRLQKPVKILSALLLLVIILLALAKDWQTFVTYAPVVGLAALAFNLLSLAVGYWVPRLLRLPKAQAVAIGMEIGIHNGTLAIALALSPSLLNNSTMAIPPAIYGVLMFFTAAAFGWWVSRGHQAAPAPVTAPD

SEQ ID NO: 20913 - protein, 286 aa, Populus trichocarpa x Populus deltoides
MSSSRSGGSGSRTRVGRYELGRTLGEGTFAKVKFARNVETGENVAIKILDKEKVLKHKMIGQIKREISTMKLIRHPNVVRMYEVMASKTKIYIVLEFVTGGELFDKIASKGRLKEDEARKYFQQLINAVDYCHSRGVYHRDLKPENLLLDASGFLKVSDFGLSALPQQVREDGLLHTTCGTPNYVAPEVINNKGYDGAKADLWSCGVILFVLMAGYLPFEESNLMALYKKIFKADFTCPPWFSSSAKKLIKRILDPNPSTVCSPSSLCINLLYTFPSLERMPYNIG

SEQ ID NO: 20914 - protein, 258 aa, Debaryomyces hansenii CBS767
MRRTALITGGARGIGEAISKRLAKDGLNVVICDLQNQNKAAMKTIQEINQFGGNAVFYPLDVRVKSQIEKTIDNAYEKFGTFDVMVNNAGICLVNSFADITEDELEKQWAVNVKGVLFGMQAAARKFKDVQNRTGRIINAASISGQLGMPNQGAYCSTKFAVKALTQTAAQELAADGITVNSYCPGTVETEMQRGILEKEVELGISKEESRKIHYDSSAIKGTIMPDDVAGLVSFLASSNSNFITGQSIIVDGGLVYR

SEQ ID NO: 20915 - protein, 570 aa, Burkholderia mallei ATCC 23344
MDLRSKHIDAPPQHAAHFAPLDEPPAPRARRTALDALAGLSIAGLLIPEAVAYAGLANLPPQAGLIALVVGLVVYAIAGSSRFAIVSATSSSAVVLAATVMSEAGPGAAAQLMLAAALVATTGILFILAGAARLGGMSDFIARPVLRGFTFGLALTIVIKQLPKMLDVPIHHGDTLRVALDLLLGIAGCNVRSAALGATALAILFALGRRTRVPATLVVIVLGIAAGYWIDWHRYGIAVVGTIDLQNLAFGMPVLGRSGWMQTAEFGFALMLILYAESYGSIRNFALKHGDTVSPNRDLVALGCANLVSGLLHGMPVGAGYSATSANEAAGAQTRMAGLFAAAVIALIAWLLLPQLARIPEPVLAAIVIFAVSHSLHPEVFRPYWTWHRDRIVVIAALAAVIVLGVLHGLLAAIGVSLLLTLRQLSEPNVSVLGRLRGSHDFVDVSMHEDAKPIPGVLIVRPEAQLFFANAERVLTMARRLARDAQPPVHTVMLSLEESPDVDGTTIEALKTFGAECDARGWRLALVRLKPNVLRVLQRAADGGLRADALSELSVDESLQSLTAGELPRA

SEQ ID NO: 20916 - protein, 344 aa, Helicobacter pylori
MILKRVTEALEAYKNGEMLIVMDDEDRENEGDLVLAGIFSTPEKINFMATHARGGMGVSLPKDSVKKFESPPVVPVNDSNPATAFTVSIDAKEAKTGISAFERHLTIELLCKDTTKPSDFVRPGHIFPLIAKDGGVLARTGHTEASVDLCKLAGLKPVSVICEITKEDGSMARRGDKFLSDFALKHNLKILYVSDLISYRLENESLLKMFCQEEREFLKHQTQCYTFLDHQQKNHYAFKFKGATTNGLAPLVRFHPIKEDFDFLTTGAFEVFFKALEYLKHEGGYLIFMNTHSKENNIVKDFGIGALVLKNLGIKDSTLLSSSEDRQYKALSGFGLKLVETISL

SEQ ID NO: 20917 - protein, 906 aa, Methylococcus capsulatus str. Bath
MKKRVYAFSEGDGKNKRLLGGKGANLCEMTQIGLNVPPGFVITTEACLEYLADKKLPAGLMDEVREHMARLERATGKRFGDPANPLLVSVRSGSALSMPGMMDTILNLGLNHDTLQGLIRQTGNERFGHDAYRRFIQLFGKVALGVPDELFDAEFEAIKHQAGVAADIGLSAVHLADIGERFLAVVRRHTGKPFPEDVYEQLEIAIRAVFDSWMGKRAVDYRREFHITPDQANGTAVNVVTMVFGNMGDDSATGVGFTRNPGTGENEMFGEYLVNAQGEDVVAGIRTPKPVHEMATEMPALYAQLVELRDKLEAHYHEVQDFEYTIEKGVLYCLQTRNGKMNAQAMVRTSVEMCREGLITRDQALLRVNPAHLEQLLHPCLDTSHNPTPLAQGLPASPGAASGRCVFDADQAELLGRAGEKVILVREETKPEDIHGFFAAQGILTSRGGKTSHAAVVARGMGKACVAGAEGIRVDSRARLATVGEVTLHEGDIITIDGSTGRVYLGAIPTIAPTFSEHLRTLLSWADEAAHLKVKANADTPEAAKEAREFGAVGIGLCRTERMFNASDRLPVVVEMILAPDVEERKAALDKLLPMQRCDFQAIFTLMAPYPVTVRLLDPPIHEFLPDEHSLADEIDALRQFRRVAKGRAAALSALGQAVETDGVGEDAVAAVIARKERLLAKVRELHEINPMLGHRGVRLGITFPEIYEMQIRAVLEAAAECVEAGVAAAPEIMVPQVVDGAELERVRAMVDRLRQEIEASHGVRLDFKFGSMVETVRACVSADGLARTAEFFSFGTNDLTQATWSFSREDAENKFLPQYIGSGILEDNPFEVLDVVGVGAMMRMAVEKGRSVRPDLEIGICGEHGGHPGSIRFCDGIGLSYVSCSAPRVPVARLAAAHAALLNGG

SEQ ID NO: 20918 - protein, 438 aa, Aspergillus oryzae
MPITKIHARSVYDSRGNPTVEVDVVTETGLHRAIVPSGASTGQHEAHELRDGDKTHWGGKGVLKAVENVNKTIAPAVIEENLDVKDQSKVDEFLKKLDGSANKSNLGANAILGVSLAIAKAGAAEKGVPLYAHISDLAGTKKPYVLPVPFQNVLNGGSHAGGRLAFQEFMIVPSAAPSFSEALRQGAEVYQKLKTLAKKKYGQSAGNVGDEGGVAPDIQTAEEALDLITEAIEQAGYTGKMKIAMDVASSEFYKADVKKYDLDFKNPDSDSSKWLTYEQLADLYKTLASKYPIVSIEDPFAEDDWEAWSYFYKTSDFQIVGDDLTVTNPLRIKKAIETKACNALLLKVNQIGTLTESIQAAKDSYADNWGVMVSHRSGETEDVTIADIAVGLRSGQIKTGAPARSERLAKLNQILRIEEELGNNAIYAGEKFRTSVNL

SEQ ID NO: 20919 - protein, 527 aa, Corynebacterium glutamicum ATCC 13032
MSTPDIKEGSAESPGEVMVVGDRREWRRQATGIIAGLVLAALVYLLFPSNSVETVMQSSGVDPETEYTNNAMRLTAAVTILMAVWWMTEAIPLAATALIPLVAFPAFQVVDFGKAAAPYANPTIFLFLGGFLMALGLQKWNLHRRMALAVVLAVGTKPKQLVLGFMVATGFLSMWVSNTATAVVMLPIGMSVLALTAETVGGMKNQKKFATGLMLSIAYSASIGSLGTLIGTPPNALLAAYMSESHDIHIGFGQWMILGVPIAVVFTIIAWLVLTTVFKPEMKEIPGGRELIKREIAEMGPWTAPQVTVGVIFAAAALAWVFIPLTLDWTGSQLSINDSLIGIAAGLLMFIVPANFKTGERILDWRTAGELPWDVLLLFGGGLSLSAMFTSTGLSLWIGELAKGLDALPIFILIFAIAVLVLFLTEFTSNTATAATFLPIMGGVAVGIGLTAGGEQNVLLLTIPVALSATCAFMLPVATPPNAIAFGSGYIKIGEMVKGGLWLNIIAVILITIFTYFVAIPLFGIML

SEQ ID NO: 20920 - protein, 440 aa, Alnus glutinosa
MAEITHIKARQIFDSRGNPTVEAEVTTANGVVSRAAVPSGASTGVYEALELRDGGSDYLGKGVLKAVDNVNKIIGPALIGKDATEQTAIDIDFMFQQLDGTVNEWGWCKQKLGANAILAVSLAVCKAGASVKKIPLYKHIANLAGNPKLVLPVPAFNVINGGSHAGNKLAMQEFMILPVGASSFKEAMKMGVEVYHHLKAVIKKKYGQDATNVGDEGGFAPNIQENKEGLELLKTAIAKAGYVVIGMDVAASEFYEKDKDITNFKEENNDGSQKISADQLKDLYKSFVDEYPIVSIEDPFDQDDWEHYSKLTAEIGEKVQIVGDDLLVTNPKRVEKAIKEKACNALLLKVNQIGSVTESIEAVKMSKRAGWGVMAHRSGETEDTFIADLSVGLATGQIKTGAPCRSERLAKYNQLLRIEEELGSEAVYAGANFRTPVEPY

SEQ ID NO: 20921 - protein, 467 aa, Listeria innocua Clip11262
MLYSENDKRKHESYRIPLFGSEEESTSIPKYVLKKEPMEPRIAYQLVKDQLMDEGNARQNLATFCQTYMEKEAEILMAETLEKNAIDKSEYPQTAELENRCVNILADLWNAPKEMSYLGTSTVGSSEACMLGGLAMKFRWRNNAEKRGLDIQAKRPNLIISSGYQVCWEKFCVYWDVDMRVVPMDKEHLSLDVEKVFELVDEYTIGIVGILGITYTGKFDDIALLDEKVEAYNEANEHQLVIHIDGASGAMFTPFVNPELPWDFRLKNVVSINTSGHKYGLVYPGVGWILWKDKEYLPKELIFEVSYLGGSMPTMAINFSRSASQIIGQYYNFLRYGFEGYREIHEKTKKTALYLSKTVEKSGYFEIINDGSNLPIVCYKLKDDLDVEWTLYDLADQLLMKGWQVPAYPLPADLSDTIIQRFVCRADLGYNVAEEFAADFADALHNLEHARVLYHDKERNDSYGFTH

SEQ ID NO: 20922 - protein, 364 aa, Lactobacillus plantarum WCFS1
MKRYLVLEDGTIYPGTGFGATTATVGELVFNTGMSGYQESITDQSYNGEILMFTYPLIGNYGINRDDHESIKPTCKGVVVHEVARRASNWRNAQSLDDYLKQNAIPGIMDIDTRAVTKHIRTKGAMKATIVDNVLPDTVDRLKVTELNRAVVAQSSTNNAYPNPATGPNVVVVDFGLKHSILRELAKRQCNLTVLPYNTTASEIMALNPDGVMLTNGPGDPKDVPGALEMIREVEKHVPLFGICLGHQLFALANGADTFKMKFGHRGFNHPVREIATGRIDFTSQNHGYAVDRDSLAQTDLLITHEEINDGTVEGLRHRDYAAFSVQYHPDAAPGPHDADHIFDEFIDLMAANQATQKGSQFNA

SEQ ID NO: 20923 - protein, 147 aa, Triticum monococcum subsp. aegilopoides
RPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESL

SEQ ID NO: 20924 - protein, 253 aa, Brassica napus
MAQQEASTSPGAEVVGRAFVEQYYHILHQSPGLVHRFYQDSSLLTRPDLTGSVTTVTTMQAINDKIMPLNYEDYTAEIDTADAQESHERGVIVLVTGRLTGKDNVRKKFSQTFFLAPQDKGYFVLNDVFRFLEEKEVVTTQARSVTIKDVQAPVAPESVVVSHEAEVEVEPEPVATIEEEDVENVAEVYDDPGEKDEGVVVDVEPIDPPAQIIHREILSVSNGDPPTYASILKLMKSSPAPPTHVARNQPRAA

SEQ ID NO: 20925 - protein, 517 aa, Mycosphaerella graminicola
MGLLQEVLAQFDAQFGQTSLWKLVGLGFLAFSTLAILLNVLSQLLFRGKLSDPPLVFHWVPFIGSTITYGIDPYKFFFSCREKYGDVFTFILLGKKTTVCLGTKGNDFILNGKLKDVNAEEIYSPLTTPVFGKDVVFDCPNSKLMEQKKFVKYGLTTSALQSYVTLIAAETRQFFDRNNPHKKFASTSGTIDLPPALAELTIYTASRSLQGKEVREGFDSSFADLYHYLDMGFTPINFMLPWAPLPQNRRRDYAQKKMSETYMSIIQKRRESKTGEHEEDMIHNLMQCKYKDGNAIPDKEIAHMMIALLMAGQHSSSATESWITLRLASRPDIQDELLQEQKDMLGVNADGSIKELTYANLSKLTLLNQVVKETLRIHAPIHSILRKVKSPMPIEGTAYVIPTTHTLLAAPGTTSRMDEHFPDCLHWEPHRWDESPSEKYKHLSPTTALGSIAEEKEDYGYGLVSKGAASPYLPFGAGRHRCIGEQFAYVQLQTITATMVRDFKFYNVDGSDNVVGT

SEQ ID NO: 20926 - protein, 346 aa, Xanthobacter autotrophicus Py2
MRVGINGLGRIGRLSLRAAMGAAQRPDNDPRGNNRLDIVHLNEIKGGAEAIAHLLEFDSVQGRWRAPISHDEGSVRIGDKAMSFSAHAAPTDIPWGDLGVDVVLESTGKFLTPQVLEGHLKRGAKRVIVAAPVKDPSVLNVVVGVNENLYDREKHPIVTAASCTTNCLAPVVKVVHEAIGIRHGQITTIHDPTNTNVVVDAPHKDLRRARSAMLSLQPTTTGSATAIALIYPELKGKLNGHAVRAPVLNASLTDCVFELNRETTAEEVNALFTEAAAGALNGILGFEPRPLVSADYARDTRSAIVDGPSTLVTDGTLLKVYAWYDNEMGYACRMVDLACHLERVGL

SEQ ID NO: 20927 - protein, 381 aa, Alkaliphilus metalliredigens QYMF
MIYLDNAATTYPKPEAVYEAVLNHMKNAGANPGRSGHKLALEAGRGIFTVREQLSELFNIDNPMQIIFTANATEALNLAIKGALNKGDHVITSSMEHNSVLRPIKALEEIGIENTIIQCDRTGYLNIEDVKRALRKNTRMIAITHASNVTGTIQSIEAIGKIARESKALFLVDAAQTAGVYEIDVKKMNIDLLAAPGHKGLMGPQGTGFLYIREEVEVRHFKEGGTGSKSEELIQPTILPDRYESGTLNTPGIVGLGAGIQFILQEGLDKIRRHEEELTQYFIKRLKEVEMVKIYGPQDATKQAAVVSINIGEEDSSEMAYIFDQMFEIAVRSGLHCAAMAHKTIGTFEQGTIRFGMGYFNKEEEIDVVIEAIKTICEQLE

SEQ ID NO: 20928 - protein, 265 aa, Triticum aestivum
MAQAQATRGDPMKAQQEQPEPIQYGHVFAVTGDLAVQAIAPRDAEAMRTAEESVQGVQVPQASGGGFSAAVAMETAAAYNQAVGAVRPGQASEAATKQGITVTQTAVPGGRIVTEFVAGQVVGQYSVADQAMMQQQQQQVEEDASKVTIGEAMEAAALSAGDRPLEEADAAAIRAAETQALGADTVMPGGLADQAWAAASANAWAERDEDKITVGDVLSDATTKLADDQPAATEDAARVVQAENYSDAGARTKPAGWRRAHTRRS

SEQ ID NO: 20929 - protein, 304 aa, Alkaliphilus metalliredigens QYMF
MDYIVYQADAFTNKRFGGNPAAVVPNAKGLEEITMQQIAKEMNLSETAFVFPMDERGDQYEVRFFTPQKEVALCGHATVATFHVLYEKGYIKRQSRPTILKQRTKAGLLKVYLDVSQGKLQKVMMEQALPEIINHEFNQVELCNILGIKVADMGINEIKVKPQIISTGLRDIIVPIKSLEVLKKMKIDMEKLSQYSKKVGVVGLHAFTLETMDKRNTAHCRNFAPAVGINEESATGTANGALAVFLAANEIISIKEEKNLIFEQGYFMDRPSTIHCTIKRDQDNYSVNVGGQAVIVLEGVLKFP

SEQ ID NO: 20930 - protein, 680 aa, Brucella suis
MQEIAEAIREGASAYLTRQYSTIAIVGIVVFLLAWYLLSLNAAMGFLIGAVLSGVTGFIEMHVSVRANVRTAQAVSLSLAGGLELAFKSGAITGLLVAGLALLGVSVYYFVLTVWLGYAPADRTVIDSLVSLGFGASLISIFARLGGGIFTKGADVGGDLVGKVEAGIPEDDPRNPATIADNVGDNVGDCAGMAADLFETYAVTVVATMVLGAIFFHGSDALTNVMLYPLMICGACVITSIVGTFFVKLGVNGSIMGALYKGLIATGLLSIVGLGVANTLTVGWGEIGTVAGKSITGTNLFVCGLIGLIVTGLIVVITEYYTGTNKRPVNSIAQASVTGHGTNVIQGLAVSLESTALPAIVIVGGIISTYQLAGLFGTAIAVTAMLGIAGMIVALDAFGPVTDNAGGIAEMAGLDPEVRKATDALDAVGNTTKAVTKGYAIGSAGLGALVLFAAYSNDLAYFAANGQIYPYFADMGPVSFDLSNPYVVAGLIFGGLIPYLFGGMAMTAVGRAGGAVVQEVRRQFREKPGIMTGKERPDYARAVDLLTKAAIREMIIPSLLPVLAPIVVYFGVLLISGSKAAAFAALGASLLGVIINGLFVAISMTSGGGAWDNAKKSFEDGFTDADGVKHMKGSEAHKASVTGDTVGDPYKDTAGPAVNPAIKITNIVALLLLAVLAHMA

SEQ ID NO: 20931 - protein, 478 aa, Ralstonia solanacearum GMI1000
MQQRDTLFINGQWVAPQGKGTIDVIHSTTEAVMGTIPEGSAADAEAAVAAARAAFDGWAATPAPKRAEIIQKIADGLKARSEALAQLIAGEVGMPIKLARAIQVGSPVFNWGHFARLLGAFPFEARVGNSLVVREPVGVVGAITPWNYPLHQITLKVAPALAAGCTVVLKPSEVAPLNAFVLAEVIEAAGLPPGVFNLVTGYGPVVGEVLASHPEVDMVSFTGSTRAGKRVAELASQTVKRVALELGGKSASVVLDDADLAAAVKGTLSACFLNSGQTCSAHTRLLVPRARYEEVKALAKQFAATYVPGDPAQETTRLGPLISAVQRDRVLGYIRKGLEEGAELIAGGPEKPEGVSTGYFVRPTVLGNVKPSDTVAREEIFGPVLTILCYDDEEEAIRIANDSIYGLAGGVWSGDEARAMRVARRIRTGQVDINGGPFNMLAPFGGYKQSGNGREQGQYGLEEFLEYKALQLKPAQAT

SEQ ID NO: 20932 - protein, 664 aa, Sinorhizobium meliloti
MQEVAGFIREGAQAYLTRQYTTIAIVGVVVFIAAWLLLSGAAAIGFLIGAVLSGAAGFIGMHVSVRANVRTAQAASVSLASDIDIAFKSGAITGMLVAGLALLGVSVYYFVLIVWLGYAPADRAVIDSLVALGFGASLIAIFVRLGGGIFTKGADVGGDLVGKVEACIREDDPCIPATIANNVGHNVCGCAAMAADLFETYAVTVVATMVLASIFFAGAPVLATVMTYPLAICAACIITSIIGTFFVKLGANASIMGALYRGLIVTGALSILGLGAATSLTIGWGSIGTVAGMDITGWNLFLCGIIGLIVTALIVVITEYYTGTNKRPVNSIAQASVTGHGTNVIQGLAVSLESTALPAIVIVGGIIATYQFAGLFGTAIAVTAMLGLAGMIVALDAFGPVTDNAGGIAEMSHLPPEVRKSNDALDAVGNTTKAVTKGYAIGSAGLGALVLFAAYSNDLAYFAANGDKHPYFADVGTISFDLSNPYVVAGLIFGGLIPYLFGGIAMTAVGRAGSAVVEEVRRQFKEKPGIMEGKDRPDYGRAVDMLTKAAIREMIIPSLLPVLAPIVVYFGVLLISGSKASAFAALGASLLGVIVNGLFVAISMTSGGGAWDNAKKSFEDGFVDRNGTRHMKGSEAHKASVTGDTVGDPYKDTAGPAVNPAIKI

SEQ ID NO: 20933 - protein, 531 aa, Mycobacterium tuberculosis CDC1551
MTVLQSTLDPNASAYDEAAATMSGKLDEINAELAKALAGGGPKYVDRHHARGKLTPRERIELLVDPDSPFLELSPLAAYGSNFQIGASLVTGIGAVCGVECMIVANDPTVKGGTSNPWTLRKILRANQIAFENRLPVISLVESGGADLPTQKEIFIPGGQMFRDLTRLSAAGIPTIALVFGNSTAGGAYVPGMSDHVVMIKERSKVFLAGPPLVKMATGEESDDESLGGAEMHARISGLADYFALDELDAIRIGRRIVARLNWIKQGPAPAPVTEPLFDAEELIGIVPPDLRIPFDPREVIARIVDGSEFDEFKPLYGSSLVTGWARLHGYPLGILANARGVLFSEESQKATQFIQLANRADTPLLFLHNTTGYMVGKDYEEGGMIKHGSMMINAVSNSTVPHISLLIGASYGAGHYGMCGRAYDPRFLFAWPSAKSAVMGGAQLSGVLSIVARAAAEARGQQVDEAADAAMRAAVEGQIEAESLPLVLSGMLYDDGVIDPRDTRTVLGMCLSAIANGPIKGTSNFGVFRM

SEQ ID NO: 20934 - protein, 133 aa, Populus trichocarpa x Populus deltoides
MATITASTATSSIVRAALAHRPSVGVSSSHVLGLPAIAKKGKVSCSMEGKPTVEEKSKGMSASLMAAVCAATISSPALALVDERLSTEGTGLPFGLSNNLLVWILLGVFAFIWSLYFVYTSSLDEDEDSGMSL

SEQ ID NO: 20935 - protein, 283 aa, Yersinia pseudotuberculosis IP 32953
MQTVKLNNGIAMPLLGFGVFQMTNTAECERAVIDAIETGYRLIDTAASYQNETQVGNALKLSGIARDELFITTKLWLQDTSYEGAKAQFERSLNRLQLDYVDLYLIHQPYGDVHGAWRAMEELHQAGKIRAIGVSNFHPDRLADLMAFNKIIPAVNQIEVNPFNQQLHAVPWMQSRGIQPEAWAPFAEGRNGLFQNPVLTAIGEKYGKSVGQVVLRWIFQRGIVSLAKSVRKGRMEENINILDFELSAEDMLQIAALDTATSAFFSHRDPAMVEWLTGRKLDV

SEQ ID NO: 20936 - protein, 397 aa, Prosthecochloris aestuarii DSM 271
MQKKTLSDISCKGKRILMRVDFNVPLDLNGTITNDKRIIEALPSIRQVLETGGRLILMSHLGRPKGKVTPELSLAPVARRLSELLDTDVVMANNCIGTEAMQQALALQDGEVMMLENLRFHPEEEKNDPEFARELASMGEIYVNDAFGTAHRAHASTEGICHYVPISVAGFLIEKELRYLGNALANPERPFLAILGGAKISGKIDVLDNLFDKVDTILIGGAMIFTFFKAQGYQVGTSLVEEDKIELAKHLLEKAAAKNIRMLLPEDVIAASAFSADAETATVPIDSIPETMMGLDIGPKTIDTYSREILKARTIVWNGPMGVFEIDAFATGTIAIAHALADATAKGAISIIGGGDSAAAVMKAGLESGITHISTGGGASLEFLEGKELPGIAALND

SEQ ID NO: 20937 - protein, 172 aa, Triticum aestivum
  misc_feature (22)..(22): Xaa can be any naturally occurring amino acid
  misc_feature (117)..(117): Xaa can be any naturally occurring amino acid
  misc_feature (126)..(126): Xaa can be any naturally occurring amino acid
  misc_feature (132)..(132): Xaa can be any naturally occurring amino acid
  misc_feature (145)..(145): Xaa can be any naturally occurring amino acid
KCSENPFALLTTFNEVDMTNLXVSPQLGVKLGLMSCFVKAAVSALQNQPIVNAVIDGDDIIYRDYIDVSVAVGTSKGLVVPVIRDTEGMNFADIEKGINSLAKKATEGALSIDEMAXGGTFTISNXGGVLWXVLISTPINQTPPXVSKFLGMQFLLSKRPWWLLDGLQSKAN

SEQ ID NO: 20938 - protein, 317 aa, Pseudomonas syringae pv. phaseolicola 1448A
MNADELLDPAYRWFMDEPSSNWTLHTLADIRARVSASWATAATKRGEQHWTSSDSDNGVRLCLYRPDLSLSHSGLPVILYIHGGGFVLGSPEMADDYLAELAVELKAIIVAVDYRLAPEHPFPIPLEDCYAALEWIFSHGPTLGMNTGNLVIMGHSAGGGLAAALALLARNKGLRTLAGLVLIYPMLDHRTGAPDAPPANPTTGTFSWSRQANHFCWESLRGAYALDDDRKTLFSPALATDLSDLPPTFICVGALDLFLEEDLAFALTLSRSGVPMELHVYPGVPHMFDKLPGEQTAQATQDIARAVRRMIAAGLCD

SEQ ID NO: 20939 - protein, 183 aa, Ajellomyces capsulatus
MGMAFSKLFDRIWGKKEMRILMVGLDAAGKTTILYKLKLGEIVTTIPTIGFNVETVEYKNIQFTVWDVGGQDKIRPLWRHYFQNTQGIIFVVDSNDRDRVVEAREELQRMLNEDELRDALLLVFANKQDLPNAMSPAEITQQLGLQSLTRRAWYIQSTCATTGDGLYEGLEWLANALKKAGHE

SEQ ID NO: 20940 - protein, 78 aa, Mesorhizobium loti MAFF303099
MSDTAERVKKIVIEHLGVDADKVTEQASFIDDLGADSLDTVELVMAFEEEFGVEIPDDAAETILTVGDAVKYIDKASA

SEQ ID NO: 20941 - protein, 364 aa, Pseudomonas syringae pv. phaseolicola 1448A
MNNKKLRIAAIAGDGIGLEVLPEGVRVVQAAAAKHGLELEFEYFEWASCDYYLKHGKMMPDDWFEQLKGFDSIFFGAVGWPEKVPDHISLWGSLLKFRREFDQYANIRPVRLFPGVPCPLANREPDDIDFIVVRENTEGEYSSLGGIMFENTENEFVLQESVFTRRGVDRILRFAFEMASKRERKHVTSATKSNGMAISMPYWDKRTEAMASQYPDISWDKQHIDILCARFVLQPERFDVVVASNLFGDILSDLGPACAGTIGIAPSANLNPERNFPSLFEPVHGSAPDIFGKNIANPIAMIWSGALMLEFLGQGDERFTAAHDEIITAIEQVIASGDVTPDLGGKHSTQEVGAAIAGRVSAAQ

SEQ ID NO: 20942 - protein, 225 aa, Yersinia pestis CO92
MKKYLIAPSILSADFARLGEDTAKVLAAGADIVHFDVMDNHYVPNLTIGPMVCKALRDYGITAPIDVHLMVKPVDRIVPDFAKAGATYITFHPEASEHVDRTLQLIKESGCKAGLVFNPATPLSYLDYVMDKLDVILLMSVNPGFGGQSFIPETLNKLRQVRKLIDDSGYDIRLEVDGGVKVENIRQIAAAGADMFVAGSAIFNQPDYAAVIDAMRNELAMAANG

SEQ ID NO: 20943 - protein, 129 aa, Halobacterium sp. NRC-1
MPTVEYLNYETLDDQGWDMDDDDLFEKAADAGLDGEDYGTMEVAEGEYILEAAEAQGYDWPFSCRAGACANCASIVKEGEIDMDMQQILSDEEVEEKDVRLTCIGSPAADEVKIVYNAKHLDYLQNRVI

SEQ ID NO: 20944 - protein, 540 aa, Kluyveromyces lactis NRRL Y-1140
MVDDIVRSSSPQRDSSVEDVYSDLYSTFSQMTTTTANDIEQRPYPFTWRTGIMFVSSTIGGMLFGYDTGVISGVLIAMNPKDLNFHSLEIWQKEIITSITCAGSFIGSIIAFPLADRCGRKHTLTVCCIIFAASSMLMAVSYTFEMLVTGRLVVGIAVGIAAQCIPIYLTEISPAKIRGTMLTLNSISITGGQFAAYVIAYFMIDNDHPQSTAAWRYLFALGSIPAIVFLLTLDFIPESPRWLLSKSRLVEAELALHKVYPAATVPEIRHKLRKLTSDLNKLRYHNDETDPLLFPVNKRRSVASTRTGRSSLGATYYNEQLGKKRHRWEGKSKRALIIGCVLMFFQQTSGFNAFMYYSATIFEQVGFTNPLVPAIIVAFTNFSFTLLAMKLIDTMGKRTLLLMTIWIMTVGLLLCSVGFELNNLALLVVSVIVYVGAYATGMGVVPWSSVEFLPLNRRAVGGSMISCTNWLTNSVLSLTYLTITDRIGNENTMLLFALFTIFNWLFVYIWYPEVKGLSLEEIGQVFENGVDVHFIYRNYH

SEQ ID NO: 20945 - protein, 147 aa, Triticum monococcum subsp. aegilopoides
RPKGVTPKFSLAPLVPRLSELLGIEVKKAEDVIGPEVEKLVADLANGAVLLLENVRFYKEEEKNDPDFAKKLASLADLFVNDAFGTAHRAHASTEGVTKFLKPSVAGFLLQKELDYLDGAVSNPKRPFAAIVGGSKVSSKIGVIESL

SEQ ID NO: 20946 - protein, 307 aa, Bacillus licheniformis ATCC 14580
MNVIKDITELIGKTPLLQILDFRIPKGVNIYAKLEMMNPGGSIKDRLGEVLIAEAIGSGKLKPGGTVIEATAGNTGIGLALAARKHGIRPVFCVPEHFSMEKQSIMKALGARIVHTPRSAGMKGAIEKALELEKEIPDSYCVLQFKNPVNPLAYYKTIAPEIWNDLGGRIDVFVAGAGSGGTFAGTAKFLKEKNPSIKTVIVEPEGSILNGGEPHGHKTEGIGMEFIPEYMEESYFDEIYTVLDEDAFRLVKEAAEKEGLLIGSSSGAALFAALKEAEKAKAGTNIVTIFPDSSDRYLSKKIYEGGI

SEQ ID NO: 20947 - protein, 325 aa, Arabidopsis thaliana
MQIGQALAAAKEGESQMIVMMGNNLSLTSIILNGDPSIEHKGKLTCLDEQVKISQFYHCEGLLLCILKDDSRFVVCNPYLEQTRWIEPRYSHRPYGMDRFSYALGYVNTDSCRSYKLLRFIDYYYNAPEKQFFWYEVYDFDSDLWTTLDVTPHWRIAFCNTGVPFKGNTYWCAAERNVDVDEVLANRLICFDFTKEKLAVLLQHDESNPYELDLWITTKIETEEVLWSKFLRVETAGFNSYVPFISGSFFIDEEKKVAFGFDERNRQRVIVIGEAGYLRGLDLVGDFGDQSCKPDLCSYVPSLVQIKQPEGGEREEESEYGEASI

SEQ ID NO: 20948 - protein, 460 aa, Legionella pneumophila subsp. pneumophila str. Philadelphia 1
MNMIKSLLYLSTKIFKMVNTDQLIAKDLKHIWHPCSQMKDFETFPPIVVNKAQGSYLYTNKGPVIDAISSWWCKSLGHGHPAVIAAIKNQLDCFEHVISANTTHPAAVELAEKLSEITGKQHVFFASDGSSAVEIAMKLAIHASQIKGHKNKNQFIALKNGYHGETIGTMSVSDLGLYKTPYASFGVQCHYIDDIPYVSGLKDPLWTNCDAYWNKVVQQLNKICDKVCAILLEPIIQGAGGMLCYSADFLSKISSWAKEKDIYLIADEIMTGIGRTGEWLACDHARIQPDLICLSKGLTSGSIPFSCVMIDSTLFDLFYDDYHTGKSFLHSHTYSGNPLAIVAALATIKTIEQDNLLMHSQELGKIMFSYLQDIARDSRKLVNVRGVGAVVAADFIESSQARIGFKIYQEAIKQGALIRPIGNTLYWLPPLNTDKEIIGKLAEITLNSIEKAYNKAQGYE

SEQ ID NO: 20949 - protein, 337 aa, Agaricus bisporus
MVNVGINGFGRIGRLVLRNALQMQILTVVAVNDPFLDVEYMAYLFKYDSVHGRYQGKVETKDGKLIIDGHKIAAFAEREPANIKWADCGAEYIVESTGVFKTEELAKEHLKGGAKKVVITAPGSGVPTYVVGVNLDKYDPKEVVISNASCTTNCLAVLAKVINDKFGIVEGLMTTVHATTATQKTVDAPAKKDWRSGRSVTNNIIPASTGAAKAVTKAIPDLEGKLTGLAFRVPTLDVSVVDLVVRLEKETSYDDVKKAMRDAADGKHPGIEKGIVDYTEEDVVSTDFVGSNYSMIFDAKAGIALNSRFMKLVAWYDNEWGYARRVCDEVVYVAKKN

SEQ ID NO: 20950 - protein, 218 aa, Mycobacterium smegmatis str. MC2 155
MSNIHPSLDARLQPQARYILPSFIEHSSFGVKESNPYNKLFEERIIFLGVQVDDASANDIMAQLLVLESLDPDRDITMYINSPGGSFTSLMAIYDTMQYVRADIQTVCLGQAASAAAVLLAAGTPGKRLALPNARVLIHQPALSGVIQGQFSDLEIQAAEIERMRTLMETTLARHTGKDPAQIRKDTDRDKILTAEEAKEYGIIDTVLQYRKLSAQTS

SEQ ID NO: 20951 - protein, 1038 aa, Aspergillus nidulans FGSC A4
MDDSEAQATASGSIGQFSFAPATQTTVVTTTTTTTTTFPPLFIKPPRAVRELDPKLYPLASSATPSALKNIRFEVGGKSVVFNEPDDTTATIEAIHERNDVLRASNGVIRSVTSFNSEDNQSLSRFAASRVSNHPSPVPTSSKRRPLPLADSWQGHSKTQSTRIPSEPLVCSRSSGSTSSHPRAAGLATPETESSSFSSQDSTTSRRRIRSANFPRKETLLRSPLSSEVESQGDRPNLHARKDPSRSRTLVSERNRHPSRPSVSDSAESAIHEDQDLEVTQSQDTLFNKDVLSQNRSIDSASQLTLVDNVLAQDMCLPSPSLSPVAAMNAMHAESSFDSAEDPEDETDSSFEQVDSQLSESLSRKALTAPVPAPAGKNFENVTSNTRVPAASSLMDIPNVVSFFDSMPEEMKTYLMYQLLKRCPKPTLHFVADVVNPALKCDFLTLLPPELSLNIVKYFDVQTMCRAAQVSKKWRHIINSDEKSWKELLDRDGFTLPEGELQRAIREGWGWQFPNGLEDYEKDLSLSSSISEPSGSALSPLAGPSDRSTAVNRRPKRKANTRVSSRKLAKRKISSSGTDQSDSSDWKKDVSVAEGPYAAANAAAAAVPYPDIGLPSLRGLHLYKSLYQRHYCMRKGWMKPGVKPRHIAFRAHDRHVVTCLQFDTDKILTGSDDTNINVYDTKTGVLRATLEGHEGGVWALEYYGNTLVSGSTDRSVRVWDIERARCTQIFHGHTSTVRCLQIVLPVEVGKKADGTSDMMPKEPLIITGSRDSNLRVWKLPKPGDPGYYQSGPHVDDTDCPYFVRVLTGHQHSVRAIAAHGDTLVSGSYDCTVRVWKISTGETVHRLSGHSLKVYSVVLDHKRNRCISGSMDNMVKVWSLETGSILYNLEGHTSLVGLLDLKCDRLVSAAADSTLRIWDPETGQCKSMLSAHTGAITCFQHDGQKVISGSDRTLKMWDIRTGECVRDLLTNLGGVWQIKFNERRCVAAVQRDGMTYIEVLDFGASRDGYSEDQLGRRIVVNRSGQEVSDSDEDYDLSDA

SEQ ID NO: 20952 - protein, 338 aa, Agaricus bisporus
MVKVGINGFGRIGRIVLRNALQFQDIEVVAVNDPFIDLEYMAYMFKYDSVHGRFKGTVEVKNGSFVVDGRPMKVFAERDPAAIPWGSVGADYVVESTGVFTTIDKASAHLKGGAKKVVISAPSADAPMYVCGVNLDKYNPKDTIISNASCTTNCLATLAKVIHDNFGIVEGLMTTVHATTATQKTVDGPSHKDWRGGRGVGNNIIPSSTGAAKAVGKVIPSLNGKLTGLSMRVPTQDVSVVDLVVRLEKPASYEQIKEVMRKAAEGEYKGIIAYTDEDVVSTDFISDNNSCVFDAKAGIQLSPNFVKLIAWYDNEWGYSRRVCNLLQYVAKEDAKAGI

SEQ ID NO: 20953 - protein, 650 aa, Coprinopsis cinerea okayama7#130
MASPTSSTPSTPVSSSPDSFSPPRTPPNLHQNSIDPSTKWLVQKFGGTSVGKFPVKIATDVVASYLDNHKLAIVCSARSGSTKALGTTSLLLKAATEALKRQPRKASTSSSKSNGTTSPTSPGTGANTPIHSGYRGLFGRTYYYTSDGDGSQSPPTSPKPRSKSSRSSSPQRKNGLFGFTPINGDEAKKTNLPEFHATVDLIREEHFKAARTSIEDPEILAELEEEIEKDCEWLRSFLYAAKIIDEISPRSKDNIIGLGEKLACKLMAAILRDQGIDAEYVSLEDIVPESYVTDDSDSSSEGKILGQDFYDDLAKAIAERIEQCGRRVPVVTGFFGPVPGSLLAQIGRGYTDLCSALLAAGLGASELQIWKEVDGIFTADPRKVPTARLIPIISPDEAAELTYYGSEVVHPFVMEQAIRKKIPIRIKNVENPSGGGTVIHPDPDADSVHPTDPLQRGSSPVPEPASPSTLTTYTTTHMTSSQRSSSRASSVSSLSSFTTFAASSLTGGYGFDDPQNRRLPTAVTIKENIMVVNVHSNRKSVSHGFLAGIFGTLDRFGVVVDLISTSEVHVSMAIADGMGKRVVDKFVNELKRFGTVSVGRDMAILSLVGKQMRNMVGIAGKMFTTLADGNVNIEMISQGASEINISVFDD

SEQ ID NO: 20954 - protein, 332 aa, Aspergillus nidulans FGSC A4
MKLSVNTCRSCRPTLYSRISYRTTTTTAPSPTTWQSPSQLQIQKVPPLRDLTPGHISYYWDTSTPTKLQLAYADKLFAPSRHSPKKLWSAAKFRTTPLSSIEPEVAFLGRSNVGKSSLLNAVMGKEMCWTSSKPGRTREMNAFGIGGTKGGESKIVLLDMPGYGKASRTEWGVEIMKYLQGRKQLRRAFLLIDSEHGIKPTDAAILSLFRQYAIPHQIILSKVDKLLFNKRPKPTSIPSAAKLTGLRTTLEKLRPVVQPDSRTARTEGPGALGELLTCSADTPIGEGRFLGVSAIRWAIISAAGLDGTVEARAELGHPELLSADSELVGGVA

SEQ ID NO: 20955 - protein, 264 aa, Streptomyces purpurascens
MSSRFTPTSRVAVVTGATSGIGLSVTRSLAAVGHRVFLCARDADRVALTVKELRAEGHDVDGAACDVRDVAQIESLVSAAVERYGPVEVLVNNAGRSGGGPTHTIADELWDDVMATNLDSVFRVTRAVLTTGRMREGGWGRVVNIASTGGKQGVVLGAPYSASKHGVVGFTKALGLELAKTGITVNAVCPGYVETPMAVRVRQGYAAAWETSEEEVLDRFQAKIPLGRYTTPDEVAGMVGYLLTDAASSVTAQAINVCGGLGNY

SEQ ID NO: 20956 - protein, 265 aa, Populus trichocarpa x Populus deltoides
MSHPEITNRWSLQGTTALVTGGTKGIGYAVVEELAALGACVHLCARSQGQIDACLRQWKERGLKVSGSVCDVSSQADRERLIKEVSSLFGGKLNILINNAGTNVYKPTLEYTAEDFSFMMNTNLQSAFHLSQLAHPLLKASGAGRIVFVSSICGVTSVNIGYPIYSASKGAINQLTRNLACEWAKDNIRVNSVAPWFINTPMNEDSLQNENVVKELAYRTPMGRAGEPGEVSSVVAFLCLPGPSFTTGQVICIDGGMSVNGFSMG

SEQ ID NO: 20957 - protein, 408 aa, Zymomonas mobilis subsp. mobilis ZM4
MSPRLHRLSNGLAIALQPMSGVETMAVGLYSNVGARSEPNHYSGLAHMVEHMVFKGAAGRNARMIAEAAENCGGQLNAWTARDHTVFQARMLSEYWDLGLELVADLVRSPTLDGEELEREKGVVLSELGESYDTPDDIIHDYLQSVAFKDQALGRPVLGNETSIKAIDRPALSQWVKQYYQPEGFVLAAAGKIDEDAFLKMAESRFSDWGKGQPLAVEKAKFTTGRYDDHRDSDQTHIALGYRGFSYQDIRSHASALLASILGGGMSSRLFQILREEEGLVYSVYSWSQSWIETGIFGIYCAADKKDASKALTLIRQIMADTVESVSEEELQRAKAQARAGLLMNLEGVAARCDHLGRQIQIHNRIVNPSEVVEWIDAVSLDDIRSVGQYSLSQGEALASVGDGLTIS

SEQ ID NO: 20958 - protein, 270 aa, Populus trichocarpa x Populus deltoides
MGIVEEAHNAKILGSGEQVIVLAHGFGTDQSVWKHLIPHIVDEYKVILYDNMGAGTTNPDYFDFNRYSSLEGYAYDLLAILEELKVESCILVAHSVSGIIGAIASISRPDLFSKIVMLSASPRYLNDVDYYGGFEQEDLDQLFEAMQNNYKAWCSGFAPLAVGGDMDSVAVQEFSRTLFNMRPDIALSVAQTIFQSDMRSILHMVTVPCHILQSMKDLAVPVVAAEYLHQNLGGESIVEVMSSDGHLPQLSSPDIVIPVLLKHIRYNIAS

SEQ ID NO: 20959 - protein, 327 aa, Pseudoalteromonas tunicata D2
MGLLINGQWHDKWYDTASHQGEFKREEAKLRHWVTHDGSAGPSGNAGFEAQAGRYHLYVSLACPWAHRTLIFRQLKGLTDLISVSVVSPDMLEKGWSFATDNHSSGDALFQFDNLFQLYCKNNPAHSGRVTVPVLWDKVKNCIVSNESSEIIRMFNSAFDHLTGNKLNFYPDNLTSEIDTINEFIYHNINNGVYRCGFATTQQAYEQAFDALFNALDKVEERLSSQRYLCGNVITEADWRLFTTLIRFDAVYVGHFKCNLRTIESYPHLSAYTRELFQIDGVAETVDFYHIKRHYYFSHAHINPTQVVPKGPEIDYFKAHHRDELIG

SEQ ID NO: 20960 - protein, 526 aa, Oculimacula yallundae
MGILDTVTVPLAQQVSQRGLGVVIAAGFAAFLVVSVVLNVLSQILFKNPNEPPVVFHFFPIIGSTVTYGIDPYKFFFDNKAKYGNIFTFILLGKKTTVYLGRDGNEFILNGKIKDVNAEEIYTVLTTPVFGKDVVYDCPNSKLMEQKKFMKIGLTTDAFKTYVPIIQNEVETFIKRSPEFKGHSGTVNIPAQMAEITIYTASHALQGKDCRDKFDSSFAELYHALDMGFSPINFMLHWAPLPHNRARDHAQRTVAKTYMEIMEARRKDKKSLDNMDIMSQLMRSTYKNGVPVPDMEIAHMMIALLMAGQHSSSSSSSWIMLRLASRPDIMEELYQEQLEVLGSDLPPLQYEDLAKLTKHQNVLKEVLRLHTPIHSIMRKVKTPMPVAGTKFVVPTSHVLLASPGFSSRDDTYFPDAMKWEPHRWDPESGGVLGTDVEEESFDYGYGLISKGAKSPYLPFGAGRHRCIGEQFANVQLITITAVMVRYFKFKNLDNSGKVVETDYTSLFSRPLAPAVVEYERREKVKV

SEQ ID NO: 20961 - protein, 435 aa, Pseudoalteromonas tunicata D2
MPSYANRYISNLTRETYALILAGGRGSRLHELTDWRAKPAVYFGGKFRIIDFPLSNCINSGIRRVGIATQYKSHSLIRHVNRAWGHFKKELGESVEILPASQRYGDEWYCGTADAVFQNMDIIRHELPKYVMILSGDHVYRMDYGALLAKHVETGADMTVCCIEVPCEEAAGTFGVMTVDNDKRVMRFDEKPADPSEIPGKAGQCLASMGNYVFNTEFLFEQLKKDSERAGSGRDFGHDIIPAIIEEHNVFAFPFSDPSHDSQPYWRDVGTLDSFWEANMELVTPEPQLDLYDARWPIWTYQEQLPPAKFIFDDDDRRGMAVDSTVSGGCIISGSTVRKSLLFSKVHIHSYCLIEEAVLLPGVVIGRHCKIRRAIIDRSCEVPENTVIGFDREQDQANGFRVSNKGIVLVTRDMLIAYVAKQAKREQALEESEVV

SEQ ID NO: 20962 - protein, 526 aa, Oculimacula yallundae
MGILDAVTVPLAQQVSQRGLGVVIAAGFAAFLVVSVVLNVLSQILFKNPNEPPVVFHFFPIIGSTVTYGIDPYKFFFDNKAKYGNIFTFILLGKKTTVYLGRDGNEFILNGKIKDVNAEEIYTVLTTPVFGKDVVYDCPNSKLMEQKKFMKIGLTTDAFKTYVPIIQNEVETFIKRSPEFKGHSGTVNIPAQMAEITIYTASHALQGKDCRDKFDSSFAELYHALDMGFSPINFMLHWAPLPHNRARDHAQRTVAKTYMEIMEARRKDKKSLDNMDIMSQLMRSTYKNGVPVPDMEIAHMMIALLMAGQHSSSSSSSWIMLRLASRPDIMEELYQEQLEVLGSDLPPLQYEDLAKLTKHQNVLKEVLRLHTPIHSIMRKVKTPMPVAGTKFVVPTSHVLLASPGFSSRDDTYFPDAMKWEPHRWDPESGGVLGTDVEEESFDYGYGLISKGAKSPYLPFGAGRHRCIGEQFANVQLITITAVMVRYFKFKNLDNSGKVVETDYTSLFSRPLAPAVVEYERREKVKV

SEQ ID NO: 20963 - protein, 229 aa, Triticum aestivum
MMKYLSSQIFRQASSIKQVKARQIFDSRGNPTIEADVITDLGVFRAAVPSGASTVKYEALELRDGNKAEYMGKGVTKAVKNVLDVISPALKGWDPVRQTDIDNLMVKELDGTSNEFGYCKNKLGANAILSVSLAVARAGAAARNVPLYEHVKSLTQLKGKSKYVLPTPSFNVINGGKHGGNGLAMQEFMILPTGATSFTHAMRAGSEVYHHLMKIIKKKYGLKCYNVGD

SEQ ID NO: 20964 - protein, 535 aa, Azoarcus sp. BH72
MSTIKSSINTRAADFQANAASLRGLVEDLRAKAAEVSLGGGEAARAKHTARGKLLPRDRVDHLLDPGTPFLEVGQLAAHGMYDNEAPSAGVITGIGRVQGVECMIVANDATVKGGTYYPMTVKKHLRAQEIAEQNNLPCVYLVDSGGAFLPRQDEVFPDRDHFGRIFYNQANMSAKGIPQIAVVMGSCTAGGAYVPAMSDETVIVKNQGTIFLGGPPLVKAATGEVVSAEDLGGGDVHTRLSGVADHLAENDAHALYLARRIVSNLNRTKPVNLALGQGEEPLYDPEEIYGIIPTDTRKPFDVREIIARVVDGSRFDEFKARYGTTLVCGFAQLYGYPVGIVANNGILFGESAQKGAHFIELCGQRGIPLLFLQNITGFMVGRKYENGGIAKDGAKMVTAVATVQVPKITTLIGGSFGAGNYGMCGRAYSPRFLWMWPNARISVMGGEQAASVLATVRRDGIEAKGGSWSKEDEDAFKSPIREQYEVQGHPYYATARMWDDGVVDPAQTRRILGLSLSAALNAPIQPTRFGVFRM

SEQ ID NO: 20965 - protein, 139 aa, Triticum aestivum
LCASSRGKTDKNVWDAVLKNERVMEFYKSHQQTLVNTFPEGTDSTDSVESPEKFEEASPEYALPTASPLSDFVDNAKKTMMEMVDNITNFFQDLFPNPAEAEAGPGSSSKKPSFAEMAAGGSFMALAMAVILVVLFKRA

SEQ ID NO: 20966 - protein, 508 aa, Yersinia pseudotuberculosis IP 32953
METVANFINGKCVFSCGNSITSGSPRAQTIFNSATGEPIRQVMMSTAQETEQAITAAQQAFASWSRQAPLKRARVMFRFKSLLEQHLDALAQLISEEHGKVYSDAVGELTRGLEVVEFACGIPHLQKGEHSANVGTGVDNHSLMQPLGVCVGITPFNFPAMVPMWMFPIALATGNTFVLKPSEKDPSLAVRLAQLLTEAGLPDGVFNVVQGDKTAVDVLLTDPRVQAVSFVGSTPIAEYIYQTASAHGKRCQALGGAKNHCILMPDADMDMAASAIMGAAYGAAGERCMALSVVLAVGDETADNLCARLEQQISTLRVGPGLAQEPENDMGPLISAPHRAKVLGYIDSGVAQKATLRIDGRGLKVAGHEQGYFVGPTLFDHVTPAMTIYQEEIFGPVLSVVRIADYRSAVDLINRHEYGNGTAIFTRDGGTARRFCEEVQVGMVGVNVPIPVPVAFHSFGGWKRSIFGPLNVHGNDGVRFYTRMKTITARWPEAQHDQGAAFSMPTLG

SEQ ID NO: 20967 - protein, 336 aa, Burkholderia thailandensis E264
MTIRVAINGYGRIGRNTLRAFYENGKKHDLEIVAINDLGDAKTNAHLTQYDTAHGKFPGEVSVDGDYLVVNGDKIRVLANRNPAELPWGELGVDVVMECTGFFTSKEKASAHLKGGAKKVIISAPGGKDVDATIVYGVNHDVLKAEHTVISNASCTTNCLAPLVKPLNDKIGLETGLMTTIHAYTNDQVLTDVYHEDLRRARSATHSQIPTKTGAAAAVGLVLPELNGKLDGYAIRVPTINVSIVDLSFIAKRDTTVEEVNAIMKEASEGALKGILGYNDAPLVSIDFNHNPASSTFDATLTKVSGRLVKVSSWYDNEWGFSNRMLDTAIALANAK

SEQ ID NO: 20968 - protein, 306 aa, Mycobacterium tuberculosis CDC1551
MSRPEVLTPFTAIVPAAGLGTRFLPATKTVPKELLPVVDTPGIELVAAEAAAAGAERLVIVTSEGKDGVVAHFVEDLVLEGTLEARGKIAMLAKVRRAPALIKVESVVQAEPLGLGHAIGCVEPTLSPDEDAVAVLLPDDLVLPTGVLETMSKVRASRGGTVLCAIEVAREEISAYGVFDVEPVPDGDYTDDPNVLKVRGMVEKPKAETAPSRYAAAGRYVLDRAIFDALRRIDRGAGGEVQLTDAIALLIAEGHPVHVVVHQGSRHDLGNPGGYLKAAVDFALDRDDYGPDLRRWLVARLGLTEQ

SEQ ID NO: 20969 - protein, 469 aa, Idiomarina baltica OS145
MSASKIFDAIKEHDVKFVDLRFTDTKGKEQHVTIPVSQIDDDFFEEGKMFDGSSIAGWKGINESDMVLMPDAESLVLDPFTDEMTLNVRCDILEPDTMQGYSRDPRSIAKRAEEFLQASGVADSAFFGPEPEFFLFNDVRFHTDMSGSFYKIDAEEAKWNSGREYSEGNLAHRPGVKGGYFPVPPVDSAHDIRGTMSLVMEDMGLVVEAHHHEVATAGQNEVATQFNSLTKKADEIQIYKYVVHNVAHSYGMTATFMPKPLVGDNGSGMHVHMSLAKDGQNLFAGDQYAGLSETALYYIGGIIKHARAINAFTNPSTNSYKRLVPGFEAPVMLAYSARNRSASIRIPLVSSAKARRIEVRFPDPSANPYLCFTALLMAGLDGIRNKIHPGDAMDKDLYNLPPEEAKDIPTVCHSLEMALDALDKDRDFLKQGGVMDDDMIDAYIGLKYNEVETLKKTTHPVEFDMYYSV

SEQ ID NO: 20970 - protein, 66 aa, Zea mays
SHGAFSSYETELFSGLIYRMKRQKIMLLIFVSGKIVLTRAKVRDETYTAFENIYPVLTKFRKVRQC

SEQ ID NO: 20971 - protein, 175 aa, Triticum aestivum
  misc_feature (116)..(116): Xaa can be any naturally occurring amino acid
MAPTVMASSDTSVAPFQGLKSTAGLPVSRRSNGASLGSVSNGGRIMCMQVWPIEGIKKFEILSYLPPLSTEALLKQVDYLIRSKWVPCLEFSKVGFIFREHNASPGYYYGRYWTMXKLPMFGCTDTTQVINEVEDVKKEYPDAYVRIIGFNNMRQVQCVSFIAFKPPGCEESGKA

SEQ ID NO: 20972 - protein, 516 aa, Oryza sativa Japonica Group
MAVVAAKGCKCGSFSGGQRLGGVHLPAVPAGGDDGRRAQEIKRRRRYDLREQDGRAARPAAADQKLCRFCSANGTIMSGCSLQGALVSTAIMRRNVLTRIVGTQKNNLPLPKRSAAIAAPIALLLVVGLISLYDFTFADRYPNIDAASSSSSSSSSPSPATVSKCNLTRGEWVPDGEAPYYTNLTCPFIDDHQNCMKFGKPSLEYVSWRWKPDGCELPRFDAARFLEAMRGKSMAFVGDSLARNHFKSLLCLLSKVAQPVELVGAAPEIDVTGRAVRRDFRYDSHGFTASLFWSPFLVKANLANATLGLWDLHLDTADARWAAHVAEFDYVVLSDTNWFLRPSVYYEGGRAVGRNGAAPVTNATEIAVPRAVRAAFSTALGALAAAPGTFRGKAILRSVTPAHFENGEWNTGGDCVRTRPFRRDERALGAVEAEYLAVQVDAVREAEAAVRRNGGELRLLDITEAMDLRPDGHPSRYGHPPGGSVEGSFVVDCLHWCLPGPIDLWSELLFHMLVDQ

SEQ ID NO: 20973 - protein, 213 aa, Triticum turgidum subsp. dicoccoides
FSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVP

SEQ ID NO: 20974 - protein, 368 aa, Kluyveromyces lactis NRRL Y-1140
MFRQSIVKQSCRFLATKKQPSIGRYTGKPNPKTGKYTVSFIEGDGVGPEISKSVKAIFSAAKVPIEWESCDVSPIFVNGLTTIPDPAVASINKNLIALKGPLATPIGKGHRSLNLTLRKTFGLFANVRPAKSIEGYKTTYENVNLVLIRENTEGEYSGIEHVVAPGVVQSIKLITQDASERVIRYAFEYARAVDRSKVLVVHKSTIQRLADGLFVDVAKKLSSEYPDIELQTELLDNTVLKTVQHPEAYDDVVVVCPNLYGDILSDLNSGLSAGSLGLTPSANIGHTVSIFEAVHGSAPDIAGQNKANPTALLLSSVMMLNHMGLTEHADKIEKAVLTTIASDAKNRTGDLGGSASTSSFTDAVIERL

SEQ ID NO: 20975 - protein, 110 aa, Oryza sativa
  misc_feature (52)..(52): Xaa can be any naturally occurring amino acid
  misc_feature (86)..(86): Xaa can be any naturally occurring amino acid
MAATIVCVKARQILDSRGNPTAEGYVGCSHRTFARSAVTREASTGVYEAMDXRDGGAEHLGQGVCKATNNANSSIAPNLTGKDPTXQAELDILMDEQLDSTKNERRSEQA

SEQ ID NO: 20976 - protein, 205 aa, Triticum turgidum subsp. dicoccoides
RLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVP

SEQ ID NO: 20977 - protein, 211 aa, Bacillus licheniformis ATCC 14580
MGKKPVVIGIAGGSGSGKTSVTRSIYEQFKGHSILMLEQDLYYKDQSHLPFEERLNTNYDHPLAFDNDYLIEHLNELLAYRPIKKPIYDYKLHTRSEEVVHVDPKDVIILEGILVLEDERLRDLMDIKLYVDTDADLRIIRRMLRDIKERGRSIDSVIEQYISVVRPMHNQFVEPTKRYADIIIPEGGQNRVAIDLMVTKIQTILEQNAIL

SEQ ID NO: 20978 - protein, 300 aa, Magnaporthe grisea 70-15
MSKFGVMVMGPAGAGKSTFCASLITHLRMNRRSSFYVNLDPAAESFEHTPDLDIKDLISLEDVMEEMGLGPNGGLIYCFEFLMENLDFLTEALESLTEEYLIIIDMPGQIELYTHIPILPALVKFLTQSGALDIRLCAAYLLEATFVVDRPKFFAGTLSAMSAMIMLEVPHINILSKMDLVKGQVRKRDLKRFINPDVSLLEDDPANKGNQAAAGDEDFDEEQRPPQDTDVLMRGASFRRLNKAVANLIEQFSMVSYLRLDSSDEDSVGAILSYIDDCIQFHEAQEPRELKDEEFEEAEE

SEQ ID NO: 20979 - protein, 162 aa, Triticum aestivum
  misc_feature (23)..(23): Xaa can be any naturally occurring amino acid
  misc_feature (80)..(80): Xaa can be any naturally occurring amino acid
  misc_feature (84)..(84): Xaa can be any naturally occurring amino acid
  misc_feature (88)..(88): Xaa can be any naturally occurring amino acid
  misc_feature (93)..(93): Xaa can be any naturally occurring amino acid
  misc_feature (96)..(96): Xaa can be any naturally occurring amino acid
  misc_feature (100)..(100): Xaa can be any naturally occurring amino acid
  misc_feature (103)..(105): Xaa can be any naturally occurring amino acid
  misc_feature (116)..(116): Xaa can be any naturally occurring amino acid
  misc_feature (126)..(126): Xaa can be any naturally occurring amino acid
  misc_feature (131)..(131): Xaa can be any naturally occurring amino acid
  misc_feature (134)..(134): Xaa can be any naturally occurring amino acid
  misc_feature (139)..(139): Xaa can be any naturally occurring amino acid
  misc_feature (146)..(146): Xaa can be any naturally occurring amino acid
  misc_feature (151)..(152): Xaa can be any naturally occurring amino acid
MAPAVMASSATTVAPFQGLKSTXAGLPVSRRSSGSLGSVSNGGRIRCMQVWPIEGIKKFETLSYLPPLSTEALLKQVDYXIRSXKWVXCLEFXKVXGFVXREXXXSPGLYNGRYWXQCWKLPIFGXPTPTXVLXNKVEXVKKGVPXPNVRXXGFKTPRGTTP

SEQ ID NO: 20980 - protein, 501 aa, Glycine max
MENLSNGHLESFVKIPTIKFTKLFINGEFLDSVSGKTFETVDPRTEEVIAEIAEANKEDVDIAVKAAREAFDCGPWPRMPGAERAKIMLKWSELIEQNAEEIAALDTIDGGKLFSWCKAVDVPEASNILRYYVGAADKIHGDVFKTSRDLHLYSLMEPVGVVGHIIPWNFPTVMFFAKVAPALAAGCTMVIKPAEQTPLSSLFYAHLARLAGIPDGVLNVVPGFGSIAGAAISSHMDIDAVSFTGSTETGRKIMQAAALSNLKPVSLELGGKSPVLIFDDADVDKAVDLALFGILHNKGEICVAFSRVYVQEGIYDEFEKKVVEKAKTWVVGDPFDPKVQQGPQTSKAQYDKIISYIEHGKSEGATLLTGGKPAGNKGYYIEPTIFVNVKEDMLIAQEEIFGPVMTLSKFKTIEDAIKKANNSKYGLAAGIVTKNLDIANTVSRSIRAGIIWINCFFAFDIDCPFGGYKMSGFGRDYGLEALHKFLKVKSVATPIYDSPWL

SEQ ID NO: 20981 - protein, 350 aa, Arabidopsis thaliana
MENGDIPEDANEHCPGPQSESAGKSDSCAGCPNQEACATAPKGPDPDLVAIAERMSTVKHKILVLSGKGGVGKSTFSAQLSFALAGMDHQVGLMDIDICGPSIPKMLGLEGQEIHQSNLGWSPVYVEDNLGVMSIGFMLPNSDEAVIWRGPRKNGLIKQFLKDVYWGEIDYLVVDAPPGTSDEHISIVQYLLPTGIDGAIIVTTPQEVSLIDVRKEVSFCKKVGVPVLGVVENMSGLSQPLKDVKFMKLATETGSSINVTEDVIACLRKNAPELLDIVACSEVFDSSGGGAERMCREMGVPFLGKVPMDPQLCKAAEQGKSCFEDNKCLISAPALKSIIQKVFPSTVMTE

SEQ ID NO: 20982 - protein, 337 aa, Podospora anserina
MTVKVGINGFGRIGRIVFRNAVEHPDVEIVAVNDPFIEPKYAEYMLKYDSTHGVFKGTIQVSGSDLIVNGKTVKFYTERDPSAIPWKDTGAEYIVESTGVFTTTEKASAHLKGGAKRVIISAPSADAPMYVMGVNEKTYDGKAAVISNASCTTNCLAPLAKVVNDKFGIVEGLMTTVHSYTATQKTVDGPSAKDWRGGRGAAQNIIPSSTGAAKAVGKVIPELNGKLTGMAFRVPTSNVSVVDLTCRLEKPASYETIKAALKEASEGELKGILGYTEDEIVSSDLNGNANSSIFDAKAGISLNDNFVKLVSWYDNEWGYSRRVLDLLSYVAKYDASH

SEQ ID NO: 20983 - protein, 337 aa, Schizophyllum commune
MAVKVGINGFGRIGRIVLRNALQLGNIEVVAINDPFIALDYMVYMFKYDTVHGRYKGTVEVKDGKLVVDGHAITVFAEKNPADIKWGSAGADYIVESTGVFTTVEKASLHLQGGAKKVVISAPSADAPMFVVGVNLDKYDSKYQVISNASCTTNCLAPLAKVIHDKYGIAEGLMTTVHATTATQKTVDGPSHKDWRGGRSVNNNIIPSSTGAAKAVGKVIPSLNGRLTGLAFRVPTLDVSVVDLVVRLEKEASYDEIVATVKEASEGPLKGILGFTDESVVSTDFTGANESSIFDSKAGIAISKSFVKLIAWYDNEWGYSRRVCDLLVYAAKQDGAL

SEQ ID NO: 20984 - protein, 517 aa, Mycosphaerella graminicola
MGLLQEVLAQFDAQFGQTSLWKLVGLGFLAFSTLAILLNVLSQLLFRGKSSDPPLVFHWVPFIGSTITYGIDPYKFFFSCREKYGDVFTFILLGKKTTVCLGTKGNDFILNGKLKDVNAEEIYSPLTTPVFGKDVAYDCPNSKLMEQKKFVKYGLTTSALQSYVTLIAAETRQFFDRNNPHKKFASTSGTIDLPPALAELTIYTASRSLQGKEVREGFDSSFADLYHYLDMGFTPINFMLPWAPLPQNRRRDYAQKKMSETYMSIIQKRRESKTGEHEEDMIHNLMQCKYKDGNAIPDKEIAHMMIALLMAGQHSSSATESWITLRLASRPDIQDELLQEQKDMLGVNADGSIKELTYANLSKLTLLNQVVKETLRIHAPIHSILRKVKSPMPIEGTAYVIPTTHTLLAAPGTTSRMDEHFPDCLHWEPHRWDESPSEKYKHLSPTTALGSIAEEKEDYGSGLVSKGAASPYLPFGAGRHRCIGEQFAYVQLQTITATMVRDFKFYNVDGSDNVVGT

SEQ ID NO: 20985 - protein, 254 aa, Oryza sativa
  misc_feature (175)..(175): Xaa can be any naturally occurring amino acid
MSAAATAGTYSPASAAGEKRRERKEELRRHLAEDADWPRADGRSFHDCRPAFMQTGPTTAASGSAYAEFGKTKVIVSVFGPRESKKAMLYSDTGRLNCNGTDNKEYSAMLHKALEGAVMLHTFPKTTVDVFALVLESGGSDLPIIISCASLALADAGIMMYDLVTSVSVSCFGKXIIIDPTSDEEAWQDGSLMVAYMPARKEITQLTLTGEWSDGKITNGGGALNGCPALSSGTYFRGALEKRLSTLGWGKKKF

SEQ ID NO: 20986 - protein, 211 aa, Lactobacillus plantarum WCFS1
MTFDYAHQTDWPMTSGQHQSPIDIQTQHVQSSQLSAINWRGLYQAKTITGEATTLKASGIGAAYLNDRDFAFQQIHFHTPAEHLIDGQAAPIEWHLVHQSATGQLAVVAVFGRIGKPNSSLQGLLDQFTAQTSHELTTPVNLTELLPDTGTVYHYLGSLTTPPLSETVEWYVCADTVMIGEQQLAAYQQLFAANNRKIQPLNDRPIIAERF

SEQ ID NO: 20987 - protein, 251 aa, Coccidioides immitis RS
MMVPDSLPTTKRSTLPADLRAAPVVLPPLMAQGFLPISLKLSVESTGAVSRCLITLICSTVIMGLSLRDVRTLVENEHSRQFKKFIKDNGITSYVMPIIANKDPKIFTSQNTVLEVLRILFNPDNHPVLVHCNKGKHRTGCIIACFRRAQGWSNTAAVAEYIKYSAPKTRVLDRKFIEAFDANRLCELVDRVGAQYWVPSNLSERKDLRSTPGCHLNGNPKEVGECDGASALVLPSDPQQIYGLATCKLPS

SEQ ID NO: 20988 - protein, 551 aa, Exiguobacterium sibiricum 255-15
MANQQFSSKNRAEVYNRLTREELDLLVVGGGITGAGIALDAASRGMKIGLVEMQDFAAGTSSRSTKLVHGGLRYLKQFEIQMVAEVGKERAIVYENGPHVTTPEWMLLPMHKGGTFGPFSTSIGLRVYDFLAGVKRSEWRSMLSAKETLAKEPLVKQDGLKGGGYYVEYRTDDARLTIEVMKEAVAHGARVVNYTKAEEILYENGKVVGMRVTDLATGDVHEIRAKKVVNATGPWVDELREKDGSKVGKQLRLTKGVHVVIDQSKFPLKQAVYFDTPDGRMIFAIPRDGKAYVGTTDTFFDKDTSHPKFTVEDQEYVLDAIHYMFPEVKVTAEDVESSWAGVRPLIYEQGKDPSEISRKDEVWQSESGLITIAGGKLTGYRKMGEHVVDLVAKLLKKEENVAYARCATKNMPISGGHVGGAAGYAKFLKSQAPANGLTSEEVLFLAKRYGSNVPVVLEYAAEYDAAETELPRDVYAQLHYGINHEMVARPIDFFIRRTGAVFFDIAWARQHKEAVIKEMARHLNWTAAQTAEYTKELEIEIEDAAHALVTE

SEQ ID NO: 20989 - protein, 284 aa, Oryza sativa Japonica Group
MDATAIGNGALHSNGAGADTKGKPIKCKAAVAHGPGEALVMEEVEVAPPARMEVPLKVLFTSICHTDLSAWKGENELQRKFPRILGHEAAGVVESVGEGVEDLAPGDHVVPIFTGECGACTYCESSKSNLCKTYRVNPFKSTMVTDGGTRFTMIDRSSGARNPVYHFLNTSTFAEYTVIDSACAVKINPKAPLEKMSLLSCGVSTGVGAAWNTANVSKGSTVAIFGLGAIGLAVAEGARLRGASRIIGVDINPEKFSKEYDVTELISGPIFPISDQLIEIEKFA

SEQ ID NO: 20990 - protein, 468 aa, Ralstonia solanacearum GMI1000
MAYPPIPVPADAAPSANTAWQARSRAAVWHPCTQNARLDAMPPLPIARGQGPWLIDFDGKRYLDGTSSWWVNLFGHANPHINAALKAQLDMLEHTMLAGATHRPAVELAERLVGLTGGVLGHSFFGSDGASAVEIALKMSFHAHRNAGQGARSRFVCLEHGYHGETLGALGVTDVAIFRDAYDPLILQSHRVASPDARLAGPGETGADVAERALAALRDCLSANAGTIAAVIIEPLVQCAAGMAMHDASYLRGVRALCDQFGVHWIADEIAVGCGRTGTFFACEQAGVWPDLLCLSKGISGGYLPLSIVLSRDAIYDAFNEDAPVRSFLHSHSYTGNPLACRAALATLDLFAEEDVFARNRVTAARIAQGLAPLSHDARFAHLRQAGMITAFDVHPEVAGPRFAERFALTARAHGLLLRPIGHTVYLLPPYVLTDDETDTLVERTLHTLEDTLAQATGAHEGETHAIA

SEQ ID NO: 20991 - protein, 226 aa, Triticum aestivum
MVVSPKIAPSMLSSDFANLAAEAKRMVDLGADWLHMDIMDGHFVPNLTIGAPVIESLRKHTSAYLDCHLMVTNPMDYVEQMGKAGASGFTFHVEVAKENWQELVSKIKSAGMRPGVALKPGTPVEEVYPLVEGETPVEMVLVMTVEPGFGGQKFMPNMMDKVRALRQKYPTLDIEVDGGLGPSTIEAAAAAGANCIVAGSSVFGAPESGKVISLLRTSVEKAQPTT

SEQ ID NO: 20992 - protein, 554 aa, Pseudomonas syringae pv. phaseolicola 1448A
MAYYRNPSDVTALPAWQALSKHRQSMQNFSMREAFNSDPQRFSQFTLSSAGLFLDYSKNLITTETRDLLVSLAGEVNLKDAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSSKSFNTLETLKNAQAARAWYLAQGGSEVELHRHFIAVSSNNAAAVAFGIREENIFPMWDWVGGRYSLWSAIGLPIALAIGMSNFKELLSGAYTMDQHFQSAPFEQNMPVLLALLGVWYGNFWNAQSHAILPYDHYLRNITKHLQQLDMESNGKSVRQDGTPTSTDTGPVIWGGVGANGQHAYHQLLHQGTQMIPADFIVPIVSFNPVADHHQWLYANCLSQSQALMMGKTRAEAEAELREKGMSEEEVQKLAPHKVIPGNRPSNTLVVERISPRRLGALVAMYEHKVFVQSVIWGTNAFDQWGVELGKEMGKAVYQRLTGGTEEPADDASTQGLINYFRGRHRG

SEQ ID NO: 20993 - protein, 656 aa, Yersinia pseudotuberculosis IP 32953
MSVEKQFSVSAEKTCNTENKCNTEKKFDVICMGRIAVDLYGQQIGARLEDVASFAKYLGGSSGNVAYGSARQGLRSSMLARVGDEHMGRFLREELHQVGCDTSHLTTDKKRLTALVLLSIKDRDTFPLIFYRDNCADMAITAQDFSEQYIASARCLAITGTHLSHPNTREAVLTALRYARRNGVRTVLDIDYRPVLWGLTSLGDGETRFIESHQVTAELLAVFNLFDVIVGTEEEFHIAGGSTNTLDALRGVREVSDAALVCKRGALGCSVYTEAIPQTLDEGLTVSGVRVKVLNVLGAGDAFMSGLLRGYLNDEGWPQACRYANACGALVVSRHGCAPAMPSKIELDNYLARADAVVRPDLDVHLNHLHRVTTRRRQWPELCVMAFDHRSQLEEMALQCGADLCHISTLKTLILQASREAVHTAGLQGKAGLLCDGTFGQDALNAITGAGWWIGRPIELPGSRPLAMEHGNIGSQLIGWPQEHIVKCLVFFHPEDAYSLRLEQEQKIIEVYRACCQSGHELLLEVILPAGMPRSDELYLRAISRFYNLGVYPDWWKLPPLASEGWAALNKLIERRDPHCRGVVILGFDASLEALRTGFNAAAGYPIVKGFAVGRTLFGDASLAWLKRDIDDTQLIARIRDNYLQLITLWRERGQK

SEQ ID NO: 20994 - protein, 487 aa, Pseudomonas syringae pv. phaseolicola 1448A
MKALDELIFDNRFARLGDAFSTSVLSEPIETPRLVVASQSALALLDLAPEQADLPLFAEIFSGHKLWSEAEPRAMVYSGHQFGSYNPRLGDGRGLLLGEAYNDAGEHWDLHLKGAGRTPYSRMGDGRAVLRSSIREFLASEALHALGIPSSRAGCVVSSSTPVWRETQEHAAMVLRLAQSHVRFGSLEYFFYTKQPEQLKTLAEHVLTMHYPHCQEQPEPYLAMFREIVERNAELIAKWQAYGFCHGVMNTDNMSILGITFDFGPFAFLDDFDEHFICNHSDHEGRYSFSNQVPIAQWNLSALAQALTPFISVEALRETIGLFLPLYQAHYLDLMRRRLGLTIAQEQDEQLVSQLLKLMQNSGVDYTLFFRRLGDQPAAEALRTLRDDFVDIKGFDGWAEAYLARIAGEGKGTEQERQTRMHAVNPLYILRNYLAQNAIAAAEKGDYAEVRRLHQVLCTPFTEQPGMEGYAQRPPDWGKHLEISCSS

SEQ ID NO: 20995 - protein, 321 aa, Prosthecochloris aestuarii DSM 271
MKILVIGGAGYIGSHVARAFLDSGYSVTVFDNLATGARENLFEEAQFIHGDIMQPDHLRKAMAHGFDACVHLAALKAAGQSMTDPGSYATANICGTVNILNALVEAGIQTLIFSSSAAVFGSPSFLPIDEDHPKNPENFYGFTKLEIERLLAWYDRLKGLKYGAIRYFNAAGYDVAGRITGREQNPENLLPVVMEVAAGIRPRLSIFGDDYPTRDGSCIRDYVHVNDLARAHVLAFEYILKQKRSLELNLGSERGVTVLEMIKKAREITGQPIAADIAPRRPGDPAELVASSAKALRLIGWKAEHSDVDTLISSTWSVYKK

SEQ ID NO: 20996 - protein, 417 aa, Oryza sativa Japonica Group
MAASDSDSDADAAAAAAASLLPAPIHLLPPDALHNVLLRLPLRDAVVCRPVSRLFHETLSHNFLALLPSLRLLLLRHPRPEGGGCLHAFDPDRRHWLRLPFSAFLPNQSFSPVASSPSLLYLWLESPSPSPPSLPSSSSSSSTASTAHPPKSLAVCNPFAGTYSFLPPLGSAWARHGTVLAGPGGVVLVLTELAALSYTPSGSGKWMKHPLSLPSKPRSPILASGAAAVFALCDVGTPWRSQWKLFSCPLSMLTGGWAPVERSAWGDVFEILKRPRLLAGAGGRRVLMIGGLRSSFAIDAPCSTVLILRLDLATMEWDEAGRMPPNMYRCFTGLCEAAAQGNAMPTAVAGGNNKVKVFGGDGKVWFAGKRVRGKLAMWEEDELGNSGGKWDWVDGVPGYSDGVYRGFVFDGGFTAMP

SEQ ID NO: 20997 - protein, 343 aa, Mesorhizobium loti MAFF303099
MSQPAILVTGGAGFIGSHTCKLLAAAGYLPVAFDNLCRGNRKSVAWGPLVVGDIRDRDALRAAIGTYRPISVIHFAALAYVGESVQEPADYYSTNVTGTIAVLDAARAHAIDNIIFSSSCATYGVPEALPVRETSLQNPISPYGRTKLMGEQIIGDYASAYGMKFAILRYFNACGADPDGELGEWHSPETHLVPRVLMAASGIIDEIEVFGTDYDTPDGTCVRDYIHVSDLARAHLKALQHLEGGGQNLAVNLGTGRGVSIREIIQAVGRITSRPVPAVFRDRRPGDPAELYADPGKARAHLGFVPQLSDIDTIVRTAAPFFGLRTKPMELPPSKAAASLAAG

SEQ ID NO: 20998 - protein, 461 aa, Streptomyces coelicolor A3(2)
MQFHDSMISLVGNTPLVRLNSVSKGIRATVLAKVEYFNPGGSVKDRIALRMIEAAEKSGELQPGGTIVEPTSGNTGVGLAIVAQQKGYKCIFVCPDKVSTDKINVLRAYGAEVVVCPTAVDPEHPDSYYNVSDRLVRETPGAWKPDQYSNPNNPLSHYHSTGPELWEQTEGKITHFVAGVGTGGTISGTGRYLKDASDGAVTVIGADPEGSVYSGGSGRPYLVEGVGEDFWPTAYDREVADEIVAVSDKDSFQMTRRLAKEEGLLVGGSCGMAVVAALEVAARLGEDDVVVVLLPDSGRGYLSKIFNDEWMADYGFLEDTGPSARVAEVLNHKEGGHIPSLVHMHPDETVGQAIEVLREYGVSQMPIVKPGAGHPDVMAAEVVGSVVERELLDALFAKRASLEDPLEKHMSAPLPQVGSGEPVADLMSVLGGADAAIVLVEGKPTGVVSRQDLLSFLAKVK

SEQ ID NO: 20999 - protein, 324 aa, Lactobacillus plantarum WCFS1
MKKILVLHTGGTIAMSADESGNVTPGDENPLDNYQSSFGTDIELETEDVFNVPSPHITPARMLQLKQRIDKAAHEGVDGVVVTHGTDTLEETAYFLDLTLPNELPVVITGAMRSANEIGSDGLHNLETAIQTASTPDAAEKGVLVVMNDEIHSARYVTKTHTTNVATFRTPTFGPIGLVANKGIVFFESLLRSTVCPIQTVTDNVFLIKAYAGMGPELFDAIAQPTTHGVVIEALGAGNLPPATLPAVQKLLDMQIPVVLVSRCFNGIAQDVYAYEGGGVQLKQMGVIFCQGLNGQKARIKLLVGVSAGMSTDELARFVATANS

SEQ ID NO: 21000 - protein, 449 aa, Triticum aestivum
MAFWWPLLVLAAAYALCRVLLFLIPPTVPSMEVDASDVMEEVNQNKEDSFIYVPRKGKAAQTDMVRCYEPATMKYLGYFPALTPDEVQEHVAQARKAQEIWAKSSFKQRRQFLRILLKYILEHQDLICEISSRDTGKTMVDASLGEIMTTCEKIHWLLDEGEKWLKPEYRSCGRSMLHKTAKVEFYPLGVIGAIVSWNYPFHNVFNPMLAAVFSGNAAVIKVSEHASWSGCFYSRIIQAALLAVGAPDNLVHIVTGFAETGQALVSSVDKIIFVGSPGVGRMIMQKASETLIPVTLELGGKDAFIVCEDVDLPNGGQVAVRAALQSSGQNCAGAERFYVHKDIFPPFVSRGPPLSGRYDMGAICMIEHSERLQNLVNDALDKGAEIAVRGSFGNLGEDAVDQFFPPTVLVNVNHTMKIMQEEAFGPILPIMKFSSDEEVIQTCNDSKYG

SEQ ID NO: 21001 - protein, 772 aa, Brassica napus
  misc_feature (508)..(508): Xaa can be any naturally occurring amino acid
  misc_feature (510)..(510): Xaa can be any naturally occurring amino acid
MVASAFLPELWTEILIPVCAVVGIVFSLFQWFIVSRVRVSADQGASSSSGGANNGKNGYGDYLIEEEEGVNDQSVVAKCAEIQTAISEGATSFLFTEYRYVGVFMVIFAAIIFVFLGSVEGFSTENKPCTYDDTKTCKPALATAAFSTIAFILGAVTSVLSGFLGMKIATYANARTTLEARKGVGKAFIVAFRSGAVMGFLLAASGLLVLYITINVFKIYYGEDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMCYPLLISSMGILVCLITTLFATDFFEIKAVKEIEPALKNQLIISTVIMTVGIAIVSYVGLPSSFTIFNFGAQKVVKNWQLFLCVCVGLWAGLIIGFVTEYYTSNAYSPVQDVADSCRTGAATNVIFGLALGYKSVIIPIFAIAISIFVSFSFAAMYGVAVAALGMLSTIATGLAIDAYXPXISDNAGGIAEMVGMSHRIRERTDALDAAGNTTAAIGKGFAIGSAALVSLALFGAFVSRAGVHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYL

SEQ ID NO: 21002 - protein, 339 aa, delta proteobacterium MLMS-1
MSRPIGITVSRHIMDSQRLHPEATGELTGLLYELIVAAKTISAEVNMAGLADILGMSGKTNIQGEHVQKLDEFANNTIKRRMARCGYLAAMTSEEEADIIPVVEGYEGKYTLAFDPLDGSSNIDVNVSIGTIFSVHRRLTPEDGPGEESDLLQAGRQQVAAGYVIFGSSTMLVLTTGDGVHGFTLDPSVGEFYLSHPNIRVPEKSKYFSVNEGNHCYWQEPVRRFLEHLKEEDKASGRPYSGRYIGSMVADFHRNLIAGGVFLYPRDSKDPTKPYGKLRLLYEAAPMALLIEQAGGRAITDDGREILDITPEDLHQRVPLVIGSRHDVALFEEFMNGRR

SEQ ID NO: 21003 - protein, 524 aa, Arabidopsis thaliana
METASSNFSLSQILNIEEPYSSVMLGVAALLAVVCYFWIQGKSKSKNGPPLPPGPWPLPIVGNLPFLNSDVLHTQFQALTLKHGPLMKIHLGSKLAIVVSSPDMAREVLKTHDITFANHDLPEVGKINTYGGEDILWSPYGTHWRRLRKLCVMKMFTTPTLEASYSTRREETRQTIVHMSEMAREGSPVNLGEQIFLSIFNVVTRMMWGATVEGDERTSLGNELKTLISDISDIEGIQNYSDIFPLFSRFDFQGLVKQMKGHVKKLDLLFDRVMESHVKMVGKKSEEEEDFLQYLLRVKDDDEKAPLSMTHVKSLLMDMVLGGVDTSVNASEFAMAEIVSRPEVLNKIRLELDQVVGKDNIVEESHLPKLPYLQAVMKETLRLHPTLPLLVPHRNSETSVVAGYTVPKDSKIFINVWAIHRDPKNWDEPNEFKPERFLENSLDFNGGDFKYLPFGSGRRICAAINMAERLVLFNIASLLHSFDWKAPQGQKFEVEEKFGLVLKLKSPLVAIPVPRLSDPKLYTA

SEQ ID NO: 21004 - protein, 177 aa, Glycine max
  misc_feature (125)..(125): Xaa can be any naturally occurring amino acid
  misc_feature (169)..(169): Xaa can be any naturally occurring amino acid
MASSMISSPAVTTVNRAGAGMVAPFTGLKSMAGFPTKKTNNDITSIASNGGRVQCMHVWPPFGKKKFETLSYLPDLDDAQLAKEVQYLLKKGWIPCLKFKLKHNFMYHEHNKSPKYYDKHYCTIXNLPIFNYTDTSQVFKELQHANTTYPNNFIHIIIFDNVQQVHDIXFHHYEPQS

SEQ ID NO: 21005 - protein, 962 aa, Desulfococcus oleovorans Hxd3
MRSFFHHSSFRIHHSFKRENTMNILIVDDREENRYLLERLLQGNGHTVRQAANGAEAMEILTAGGIDLVISDILMPVMDGFQLCRKVKTDETLHAIPFIVYTATYTGPQDEAFALKIGADRFIQKPCEVDVLLSAINEVMAVGGGRVAEPVQEEEALKLYSERLIRKLEQKMLQAEQELQARQEAEQALRESESRFRLLAETAPVGIIIEDRDQNVLYVSPTCISLCGYAPEETPTMEAWFSLVCPDETLRNRVRAEWAAAVETATKTGVEIQPMEFPVTCRDGTVRDIEFRMSATQDLDFVVLSDVTSRRRAEQALRESERKYRRLAENTSDVVWTADMNLNTTYVSPSVERLVGEPVGLHIQRTMEEKFPADSLNRLYAVFAKELENEKDPACDKNRSRLVEVQHFRADSSTVWVSINISFIRDTTGRPIGLQGITRDITERKQAEQALRESEERYRTILENIEAGYYEVDLAGNFTFFNQAMCQILGYAEDELLGMNNRSYMDDENAKKVFHTFNQVFTSGKTAKAFDWELIRKDNTRCFVDTSIALMRDAENNPVGFRGIARDISEWKQAEAERERLSTQLLQAQKMESVGRLAGGVAHDFNNMLSVILGYTELAMHRVPPHDPLYEDLREILSAAKRSSEITRQLLAFARKQTSSPKVIDLSDTVENMLKMLRRLIGEDIDLAWNPGPGLWTVNMDPAQISQILANLLVNARDAIGGVGKVTIETGNVSFDQDYCEDHNEFLPGDYVVLAVSDDGCGMDRKTRDRLFEPFFTTKEVGKGTGLGLATVYGIVSQNNGFINVYSEPGQGTTFRIYLPRHGGALSTAHQPGPATAPRGTGETILVVEDEAAILKLTQRVLSGLGYTVLTAETPAQALKLAMEHSDRIDLLITDVIMPEMNGRDLADRLNALQPDLKILYMSGYTADVIAHRGILEPGVHFIQKPFSNQDLAKKVKAVLGG

SEQ ID NO: 21006 - protein, 433 aa, Bradyrhizobium sp. ORS278
MAVDQAVNPAANQQLLARRHEAVVRGVSYATPLFADRALNSEVWDVEGKRYVDFAGGIAVLNTGHCHPHVVAAIRAQLDRFTHTCFQVLQYEPYVRLSERLNALAPVAGPAKSILLTTGAEATENAIKIARAATGRSGIIAFTGAFHGRTALANAMTGKVMPYKRPFGPPLPGIWHAPFPVAGSNVSVEDTLSYINFIFKADIDASQVAAIIIEPVQGEGGFHQAPPDLMRGLRRICDANGIVLIADEVQTGFGRTGKMFAMEHYDVQPDLICVAKSLAGGMPLSGVIGRSAIMDAAEPGGLGGTYGGNPLACAAALAVLDVFEQEKLVERANTIGDRLRAAITRFSRANNLVPVSGPRGPGAMVAFDILKQRGSDEPDPEMTKRVTRVAHENGLILLSCGVTASTIRILVPLTASNEIVDEGLAILEKCLAA

SEQ ID NO: 21007 - protein, 144 aa, Solanum tuberosum
MASISGTMISTSFLPRKPVVTSLKAISNVGEALFGLKSGRNGRITCMASYKVKLITPDGPIEFECPDDVYILDQAEEEGHDLPYSCRAGSCSSCAGKVTAGTVDQSDGKFLDDDQEAAGFVLTCVAYPKCDVTIETHKEEELTA

SEQ ID NO: 21008 - protein, 199 aa, Phaseolus vulgaris
EIFDRDLRWRTGVEIVPVKCESSNNFKLTREALETAYEEAEKSNIRIKGLLITNPSNPLGTVYDRQTLETAVSFINEKNIHLVCDEIYAATVFSEPGFISISEVIDNMNDVECDRNLIHVVYSLSKDMGFPGFRVGIIYSYNDAVVACARKMSSFGLVSSQTQYLIASMLSDDVFVDNFLAGSAEKLAVRHRNFTKGVP

SEQ ID NO: 21009 - protein, 564 aa, Arabidopsis thaliana
ESTLGRHLSRRLVQAGVTDVFSVPGDFNLTLLDHLIAEPELNNIGCCNELNAGYAADGYARSRGVGACVVTFTVGGLSVLNAIAGAYSENLPVICIVGGPNSNDFGTNRILHHTIGLPDFSQELRCFQTVTCYQAVVNNLEDAHEQIDKAIATALKESKPVYISISCNLAATPHPTFARDPVPFDLTPRMSNTMGLEAAVEATLEFLNKAVKPVMVGGPKLRVAKASEAFLELADASGYPLAVMPSTKGLVPENHPHFIGTYWGAVSTPFCSEIVESADAYIFAGPIFNDYSSVGYSLLLKKEKAIIVHPDRVVVANGPTFGCVLMSDFFRELAKRVKRNETAYENYERIFVPEGKPLKCKPGEPLRVNAMFQHIQKMLSSETAVIAETGDSWFNCQKLKLPKGCGYEFQMQYGSIGWSVGATLGYAQATPEKRVLSFIGDGSFQVTAQDISTMIRNGQKAIIFLINNGGYTTEVEIHDGPYNVIKNWNYTGLVDAIHNGEGKCWTTKVRYEEELVEAIKTATTEKKDSLCFIEVIVHKDDTSKELLEWGSRVSAANGRPPNPQ

SEQ ID NO: 21010 - protein, 146 aa, Vitis vinifera
  misc_feature (89)..(89): Xaa can be any naturally occurring amino acid
  misc_feature (104)..(104): Xaa can be any naturally occurring amino acid
MASNPSPVFAYVVLYVKDVAKSTAFYAKAFGCNVRRLDESHRWGELESGKTTIAFTPVHQRETDRITGAVQDPWSGRERPPVELCFAYXDVDAAYKINAKERAXQKAKSSLSELDIMDSHPILTNPFEYRDVRVCNKYSATQRIKN

SEQ ID NO: 21011 - protein, 405 aa, Vitis vinifera
MDNAANSLHLRDASFSAYLSTAEENFAVKLAESIQSPYLPLTSTQEAAYPVNLGRTMSVEEGELRVFGAEKYFNMKMDDGRRRLTTSSSLTHRQIKEDRADLHCTKPKIRPGTPSASSEASWNSHAALLPRLLRNPSPSKQRKANAKMIFAGFGCNGSCSDKKSVYVDTNAEPGGREEYYGYPIINSGLESLTVKGESVDKRAEEEGRKSLEVFGSHMLKKGDVATNLERKLSVLTWDAIPKVQTVPTTSEGTGIYEDNESDASSDLFEIENLCTRYEPSEASIEWSVVTASAADFSVTSDFDEKKQVESTENSREMNFASTPTRPSKTKSSVGKEAQRSRPTGLLGCRSDKAVRVSEPAYRTNDKVKSDPGWHHRLDSSMPLGKSQGENKVKDFEFPQAQHAFA

SEQ ID NO: 21012 - protein, 310 aa, Bacillus megaterium
MPLDPHIQIFLNQYNEMPRPSLEDVTPPQLREMEKMSLTPSKEAVKKVYNEEIELNERTLTLRVYEPEGTGPFPALVYYHGGGWVLGSLDTHDSICRSYANETNCIVVSVDYRLAPESKFPAAVNDAYDALDWISAHASQLNIDSNKIAVGGDSAGGNLAAVVSILAKQRQGPSIVHQLLIYPSVGFKNQHPASMKENAEGYLLSKDLMDWFRLQYLNNKEEEQHPYNAPVLLEDLSSLPSATIITAQYDPLRDSGKDYADALKNHGVPVTYENYETMIHGFLGFHEFVPLAQQAINKSAAQLRQVFDSI

SEQ ID NO: 21013 - protein, 898 aa, Chlamydomonas reinhardtii
MYVGASWDPYELIDRGVAAAAAMSGGARPRSTKQMPPSLDGFGWCTWDAFYSTVSARGLAEGLAALEAGGVSPQLLIIDDGWQMTDVDPPMRKTPAADLADKLHVEGEPRRLLEATQDEFFYESQEVMADAAAHMPQAAGTTLGTVMPTLANLGPQHNAPLHSHSGSVASLDTLDLTNNNTIASQSQDNTGTRPTGGQRQQQDRPAAPSSTAGMATRAQHAGASAVESSGVGVSITEAVRAREAAGASTTTQEPAVPPVAPAPAQLAVRPATAESELAAKNAATAFWLVRASQKVAGWFMGIATAGFLIFYQWVVEPAPPNSLAVRAFAAAAKGLLKPAMLSFYATASDFTRRLTSVRANGKFSHPDAGPDTDWAGVPEALGTVVAHIKRKFGVRYIYCWHGLPGYWAGVMPTDHDELGGGAGIPGLESHIRFASPTQGVLEIEPSMAWNPAVLAGIGVVADPNRLYNAMHRYLHDSGVDGVKVDCQAGVGLIGSAMGGGAALSAMYQGALEASVAHHFVGNHVINCMCHSTENLYRMTATAVARASDDFYPRDPASSHPHIAACAYNSLFLGALLQPDWDMFHSKHPAAKLHAAARAVSGGPVYVSDKPGEHDFALLHSLVLPDGSVLRASLPGRPTRDCLFVDVLRDGKSLLKVWNANSVTGVVGVFHLQGSSWDRVRRKFHVHDKAPRRLSTEVRPYDVDAFRPPSNGSAAAEAAVAASEQFAVYSRAGGVLSLLHGNEGVKVSLPSAEADVLTVSRVTRVGGNAFAPLGLTNMVNGGGAVRAVSHTFGLPAPASSVSGGASNGNGRHGGVVATRECVFTMTVRGYGELVSYCGREPDLVLLNGARLQPEVSYTYSPGVVAAGSGAAAEGGRLRVDLPRVSDLENEVQVVFRSFE

SEQ ID NO: 21014 - protein, 372 aa, Hemerocallis hybrid cultivar
STEIFSPVRIRSLAAVRQEEVKLMITGILASTSTDNSVKVNMKVVFSELMFNVIMKIIAGKRYFGVNTDSEVEEGQKFRVVFDEMFSTLEVASPQDFLPFLKWFGFKRMENRLTKLAKELDQLFQKLIEERRSERGKVQSTVIDVLLSLQETDREQYSDKLIKGMILSLIAAGTHTTAGTMEWAMSLLLNHPEALLKVRDEIDKKVGQDRLIDHSDLQNLSYLNNAIKESLRLFPTAPLLLAHESSAECTVGGFTIPSNTILFANAYALHRDPKVWTDPVSFKPERFENNGQQGSRIYVPFGLGRRSCPGEGLATQVVGLALGTLIQCFEWDRNGEEKVDMTDGSGLAMHMEKPLEAMCKPRQSIVDVINRL

SEQ ID NO: 21015 - protein, 118 aa, Triticum aestivum
  misc_feature (62)..(62): Xaa can be any naturally occurring amino acid
  misc_feature (85)..(85): Xaa can be any naturally occurring amino acid
  misc_feature (107)..(107): Xaa can be any naturally occurring amino acid
MESTFIMIKPDGVQRGLIGEIISRFEKKGFYLKALKLVNVERSFAEKHYADLASKPFFQGLXVDYIISGPVVAMVWEGKSVVTTXGRKIIGRHQPLASEPGTIRGDXAVDIGRNASWE

SEQ ID NO: 21016 - protein, 300 aa, Zea mays
  misc_feature (122)..(122): Xaa can be any naturally occurring amino acid
EHPRGGGAAPGPEAGPVGVVRALPAGPIVFLPANRISLEQLIQPIANGATVLSLDTDFDGCMRLIREVTAELPIYLANSLNSLRLEGQKTAAIEILQQFDWEVPDWVIVPGGNLGNIYAFYXGFEMCRVLGLVDRVPRLVCAQAANANPLYGYYKSGWTEFQPQVARPTFASAIQIGDPVSVDRAVVALKATDGIVEEATEEELMNAMSLADRTGMFACPHTGVALAALFKLREQRVIGTNDRTVVVSTAHGLKFSQSKIDYHDSKIEDMACKYSNPPVSVKADFGAVMDVLKKRLKGKL

SEQ ID NO: 21017 - protein, 183 aa, Arabidopsis thaliana
  misc_feature (16)..(16): Xaa can be any naturally occurring amino acid
  misc_feature (32)..(32): Xaa can be any naturally occurring amino acid
  misc_feature (44)..(44): Xaa can be any naturally occurring amino acid
MASSMLSSAAVGYLPXLKPPWSAPFTGLKSSXSFPVNPQGLQRXFTSITSNGGRVSCMKVWPPIGKKKFETLSYLPDLTDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTDA

SEQ ID NO: 21018 - protein, 503 aa, Halobacterium sp. NRC-1
MTYQHYINGEWVDGDGTETFDSRNPANGETLGTFQRGTTTDVEAAIAAADDAEDEWQSLSRIDRAEYLWDIYHELKDRHQELGEVVTKECGKEISEGKADVTEAWQMVEWAAGDARHPKGDVVPSEIPEKDAYMRRQPRGVVGCITPWNFPVAIPFWHMAVALVEGNTVVWKPAEQTPWCGQIIAEMFADAGIPDGVFNMVQGFGDAGARIVDHDDIDTVLFTGSAEVGEEVARTVADDPGKLAACEMGGKNGIVVTEKADLDIAVHAAVMSSFKTTGQRCVSSERLIVHEDLYDEFKQRFVEIAESVAVDDPLDEETFMGPAIEPAHVEKIQTYNDIAREEAENVLVDRTELGDDEIPDGHEDGNWVGPFVYEVDYDPDLRSITEEVFGPHVALIEYSGDIERAVEIHNDTPYGLAGAVISEDYRQINYYRDNAEVGLAYGNLPCIGAEVQLPFGGMKKSGNGYPSAREVIEAVTERTAWTLNNSKDIEMAQGLSADINTDE

SEQ ID NO: 21019 - protein, 443 aa, Oryza sativa Japonica Group
MQNLSLKFFPLLGPGSVDFESLVPIPSTIKVLLLQPVSNWQAKRLFPISTSLKTSISNTLESLSLVLDIITDELVAFITGSLHNLVELCLEDNPMKEPDLHNDLTNVGLQALGLCHNLAHLSLTRGKQNCSSTFRRVTDFGIMMLADGCKQLKTIRLAGFSKVRDAGYAALLQSCKDLKKFEVSTGYLSDLTCLDLDEAAPKITEVRLLCCSLLTSETAISLSSCTKLEVLDLSGCRSIADSGLASISQLSKLTLLDLAGADITDAGLSALGNGRCPMSSLCLRGCKRISNNGIASLLCGSGTINKTLISLDIGNVPRISGRAVTLIAKNCEQISSLCLRNCLLINDSSLETLGSMRHNLGKSSLRMLDLSYCSRLSRNFLGLFEPPFFRGLRWLGVGKNMLERRGCSPTVAELLERKPGLTVCGNACEMGCRNQCHPDIRRQ

SEQ ID NO: 21020 - protein, 462 aa, Chlorobium limicola
MQEGKISQIIGPVVDVDFAEGQLPSILDALTVTRQDGSKLVLETQQHLGEERVRRIAMEGTDGLVRGMSAKNTGKPIQVPVGEEVLGRMLNVVGDPIDGKGPVLSKKSYSIHRTAPKFDELSTKAEMFETGIKVIDLLEPYSRGGKTGLFGGAGVGKTVLIMELINNIAKEQSGFSVFAGVGERTREGNDLWHEMMESGVIDKTALVFGQMNEPPGARARVALTGLSIAEYFRDEEGRDVLLFIDNIFRFTQAGSEVSALLGRMPSAVGYQPTLSTEMGELQDRITSTKKGSVTSVQAIYVPADDLTDPAPATAFTHLDATTVLSRQIAELGIYPAVDPLDSTSRILDPNVIGDDHYDTAQAVKQILQRYKDLQDIIAILGMDELSDDDKLVVARARKVQRFLSQPFFVAEAFTGLAGKYVKLEDTIKGFKEIIAGRHDNLPEAAFYLVGTIEEAVAKVKTL

SEQ ID NO: 21021 - protein, 206 aa, Candida albicans SC5314
MSDPFSINGGAAVAMIGKGCIAIGSDLRLGQQSLGVSNNFEKIFSVGDKTFLGLTGLATDVISLKELFRFKTNLYKLREERNIEPSTLANLVSSSLYERRFGPWFVSPIVAGLSSKDNKPFICGFDSIGCIDFSHDFIVSGTASDQLYGMCESLYEPNLEPEDLFETISQALLNAVDRDALSGWGAVVYIVTKDKVIKRVLKTRQD

SEQ ID NO: 21022 - protein, 254 aa, Bacillus licheniformis ATCC 14580
MLHQFSRNELAIGKEGLNILKNSTVAVLGVGGVGSFAAEALARSGVGRIVMVDKDDVDITNVNRQLPALLSTVGQPKVDLMKARIADINPECDVIALKMFYTEETYEQFFAYEPDYVIDASDTIHYKIHLMKECLKRGINIISSMGAANKTDPTRFQVADISKTHTDPIAKVIRTRLRKEGITKGIKVVFSDESPIVIREDVRQVVGNDEAKIRKAQMPPSSNAFVPSVAGLIMGGHVIMELLKDIPIKRVKDK

SEQ ID NO: 21023 - protein, 414 aa, Idiomarina baltica OS145
MSDFRQKALDYHQYPTPGKISVELTKPADSAKDLALAYSPGVAEPVRAIAEDPDNAYKYTAKGNMVAVISNGTAILGLGNLGPLASKPVMEGKALLFKRFAGLDSIDIEVSHRTTQDFINTVANIADTFGGINLEDIKAPECFEIEQALIEKCNVPVFHDDQHGTAIVTAAGMLNALEIQGKSLRDAHIVCMGAGAAAIACMELLIKCGAQREHIYMLDSKGVIHTRREDLNEYKALFANNTDKRTLEEVIEGADLFLGVSGPDLLSPETLKLMADKPIVFACSNPDPEIKPELAQQTRDDIIIGTGRSDYPNQVNNVLCFPFMFRGALDVRATAINDEMKIAAVEAIRQLAKEEVPDEVKKAAGIDELTFGADYIIPKPMDPRLCQRVAKAVAEAAVESGVAKIPLPENYMQD

SEQ ID NO: 21024 - protein, 361 aa, Corynebacterium efficiens YS-314
MSLTLGIVGLPNVGKSTLFNALTRNDVLAANYPFATIEPNIGLVELPDDRLPRLAEIFGSERILPATVSFVDIAGIVKGASEGEGMGNAFLANIREADAICQVVRAFSDDNVIHVDGRVDPANDISVINTELILADLQTIEKAIPRLEKESRKDKSLVETLDEVKKAQAILEDDRTLFSAAKNGEVDLTLIRDLHLMTAKPFLYVFNSDEEVLTDEAKKEELRALVAPADCVFLDAQTETELLELDEEEAAELLESVGQTEPGLHSLARAGFETLGLQTYLTAGPKETRAWTIRKGDTAPQAAGVIHTDFERGFIKAEIVSFDDLEAAGSMAEAKAQGKVRQEGKDYVMADGDVVEFKFNV

SEQ ID NO: 21025 - protein, 204 aa, Zea mays
MTGVDDDKEFKEETVILSDDDSEVEEVKDGGEEGSDEEEEEEVDGSEGDDDEEDEDDDEVQVLQSLGGPPVQSAEDEDEEGEEDGNGDDDDDDDDDDDDDDDEDDEDGEDEEDLGTDYLVRPIGRAEDEEDASDFEPEENGVGENIDERGNDAPNDNSGGGNHLRPPPKRKKKPFFRKKKKKRYCLKKKFSPPSPKGGFFPEYL

SEQ ID NO: 21026 - protein, 502 aa, Mycosphaerella graminicola
MGLLQEVLAQFDAQFGQTSLWKLVGLGFLAFSTLAILLNVLSQLLFRGKLSDPPLVFHWVPFIGSTITYGIDPYKFFFSCREKYGDVFTFILLGKKTTVCLGTKGNDFILNGKLKDVNAEEIYSPLTTPVFGKDVAYDCPNSKLMEQKKFVKYGLTTSALQSYVTLIAAETRQFFDRNNPHKKFASTNGTIDLPPALAELTIYTASRSLQGKEVREGFDSSFADLYHYLDMGFTPINFMLPWAPLPQNRRRDYAQKKMSETYMSIIQKRRESKTGEHEEDMIHNLMQCKYKDGNAIPDKEIAHMMIALLMAGQHSSSATESWITLRLASRPDIQDELLQEQKDMLGVNADGSIKELTYANLSKLTLLNQVVKETLRIHAPIHSILRKVKSPMPIEGTAYVIPTTHTLLAAPGTTSRMDEHFPDCLHWEPHRWDESPSEKYKHLSPTTALGSIAEEKEDYGLVSKGAASPYLPFGAGRHRCIGEQFAYVQLQTITATMVRDFK

SEQ ID NO: 21027 - protein, 332 aa, Erythrobacter sp. SD-21
MRILVTGAAGFIGAAVAERLCTRGDEVLGIDSLNDYYQVSLKRDRVAHVEDGAAGRFAFKQVDFADWSALSAALEGESFDRIVHVGAQAGVRYSLENPRAYVEANLLGHLNLLEVARARGSSHMVYASSSSVYGGNEQLPFAVEDRVDHPVSLYAATKRADELMSETYAHLYGIPLTGLRFFTVYGPWGRPDMAAWLFTEAILKGEPIKVFNKGEMWRDFTYIDDIVAGVLACIDSPPANDGAPKPGGSTKAHALYNIGNHRSEKLTRVIELIEEACGRKAKVELLPMQPGDVARTYADIDAIQRDLGYQPTTRIEDGIPKFVEWYREYHGV

SEQ ID NO: 21028 - protein, 513 aa, Triticum aestivum
  misc_feature (495)..(495): Xaa can be any naturally occurring amino acid
  misc_feature (505)..(505): Xaa can be any naturally occurring amino acid
MNPQRKRIPKIEPFKHRVEVDPKFFDKSWKKLDDAIREIYNHNASGLSFEELYRTAYNMVLHKHGGRLYDKLAENLKGHLREMGKLVEAAQGGLFLEELQRRWADHIKALQMIRDILMYMDRTFIPSSKKTPVFEHGLELWRDIVVRSPKIHGRLVDTLLELIHRERMGEMINRGLMRNTTKMLMELGSSVYQDDFERPFLEVSASFYSGESQQCIERCDCGEYLKNAEKRLAEESERVSLYMDAKTADKIANVVDKEMLSIHMQRLFLMENSGLVNMLINDKHEDLTRMYDLFKRVPDGHSTIRSLMASHVKETGKILVTDPERLRDPVDFVQRLLNEKDKYDEIVSVSFSNEKTFQNALNASFEHFINLNNRSPEFISLYVDDKLRKGVKGAANEEDIETVLDKVMMLFRYLQEKDVFEKYYKQHLAKRLLSGKTSSDEAERNMLVKLKTECGYQFTSKLESMFTDLKTSQDTMQSFYANLAGDSDGPTISVXILTTGSWPTXPMRYLQSS

SEQ ID NO: 21029 - protein, 177 aa, Triticum aestivum
  misc_feature (71)..(71): Xaa can be any naturally occurring amino acid
  misc_feature (85)..(85): Xaa can be any naturally occurring amino acid
  misc_feature (138)..(138): Xaa can be any naturally occurring amino acid
  misc_feature (150)..(150): Xaa can be any naturally occurring amino acid
MAPTVMASSATSVAPFQGLKSTAGLPVSRRSNGASLGSVSNGGRIRCMQVWPIEGIKNSETLSYLPPLNTXEALLKASRYLIRSXKWVPCLEFSKVGFIFREHNASPGYYDGRYWTMWKLPMFGCTDATQVINELEEXEEYPDAYVRIIXGFDNMRQVQCVSFIAFKPPGCEESGKA

SEQ ID NO: 21030 - protein, 479 aa, Legionella pneumophila subsp. pneumophila str. Philadelphia 1
MMRLLMANKIKTDVVVLGSGPGGYTAAFRAADLDKKVVLVERFDSLGGVCLNVGCIPSKALLHIAKVVDEAHEMSEQGVAFGKPKFDNKKLVAWKNSVVAKLTGGLKALAKQRKVEVITGTGKFSGTHQILVETKEGTVEIEFDNAIIAVGSESIKLPFIPEDKRIFSSTGALELADIKGDLLVLGGGIIGLEMATVYSSLGVNVTVVEFMDQLIPNADADLVNILQKRMTKKGVKFLLKTKVTAVEAKKDGIYVSMEGEHATDKPLCFQQVLVSVGRKPNGGAINAEKAGIKVDERGFIPVDNQLRTNVPHIFAIGDVNGQPMLAHKAIPEGKVAAEVIAGKKHYFEPKCIPSVAYTDPELAWAGLTEKEAKEKGINYEKASFPWAASGRALSMGREEGMTKLLFCPETNRILGAGIVGVNAGDLIAETALAIEMCCDVEDIALTIHPHPTLSETIAQSAEAFEGTITDLYLPKKKKK

SEQ ID NO: 21031 - protein, 582 aa, Corynebacterium efficiens YS-314
MNPKRAVWERYLPGVAALVHYRRSWLRGDLLAGVTVAAYLVPQVMAYAVIAGLPAVVGLWSILLPMVIYFFLGTSRKLSIGPESTTALMTAAGVGALVGAAGGPERYAEVAAILAIAVGIVCLVGFVTRLGFLTSLLSRPVLIGYLIGIALLMIVSQLGKVTQLEVEGESTWDNVVSFAGQVGQAHLPTVLLSASVLILLFLTYWRFPKAPSALLVLLLAGAVVAIFHLERLGLDVIGEVPRGLPEPRVPDLGDLDLWALLPFAVGIAIVGFSDNILTGRAFASGRGEVIDSNQELLALGTANVATGFLQGFPVSSSGSRTVLADTAGAKTQVYSLVAMLMVVLVLLFAGPVLESFPDAALGALVIFAATRLIDVAELRRIGRFRASELFITAVTTVTVVMFGVLIGIGVAIALSLLDLIRRITTPHADILGYAPGVAGMHSMHDYPDAVPVRGLVVFRYDSPLFFANAENFLEQAEQAVVDSEQPVEWFLINAEANTEIDLTAVDMLEELRIRLEERGITLALARVKQDLHRQLEPTGFIDRIGEENIFATLPTAVREYARRYHEKHGQWPDGVPGYILNP

SEQ ID NO: 21032 - protein, 504 aa, Zea mays
MAAVPASAPAAAEAAELVPTLSSLEPVYGAGAQLDESRLRFARLGDRFHAVYGARPALFARSPGRVNLIGEHIDYEGYSVLPMAIRQDMIVAIRRANGAQVRVANVDDKYPLCVYPADPDKEIDVKNHKWGHYFMCGYKGVYEYCRSKGIDLGKPVALDVVVDGTVPQGSGLSSSAAFVCSATIAIMGILDKNFPKKEVAQFTCLSERHIGTQSGGMDQAISIMAKPGFAELIDFNPIHATDVQLPSGGTFVIAHCLAESKKAETAATNYNNRVVECRLAAIVLAIKLGMDRKKAISSVTTLSDVEGLCVSFAGREGSSDPAVAVKKLLHEDPYTAGEIEKITGEGLTSVFQGSQTSLDVIKAAKHYKLFQRATHVYSEARRVYAFRDTVSSKLSEEGKLKKLGDLMNESHYSCSVLYECSCPELEELVKVCRDNGALGARLTGAGWGGCAVALVKEPIVPQFILKLKEMYYKSRIDRGVIKQGDVGLYVFASKPSSGAAILRL

SEQ ID NO: 21033 - protein, 455 aa, Triticum aestivum
  misc_feature (92)..(92): Xaa can be any naturally occurring amino acid
  misc_feature (104)..(104): Xaa can be any naturally occurring amino acid
  misc_feature (122)..(122): Xaa can be any naturally occurring amino acid
MAARAHNVAAAQQQNRALGGVPAMGKQQKAAMAGRPDPKNTRRALGDIGNVEANNRRAPLGDIANVVNARAAEGKPQPHEPVNRPVTRNFGXAQLLKNAQEKAXIRRARPAVRRAHHVKPAXPPPPEHVIEISSDSDVTKSEAGSVSSVRKYSRKKVVTTLSHVLSARSKFAAGITEEPAIQDIDKLDGDNQLAVVDYIEDIYKFYKVAENECRASDYMDSQEEINAKMRGILIDWILEVHQKFDLMPESLYLTVYIIDMYLSLQSVLRRELQLVGVSALLIACKYEEIWAPEVNDFILISDSAYTREQILKMEKAILNRLEWNLTVPTPYVFLVRFAKAASSSDHKNDKEMENTVFFFAELALLQYGLVQSKPSMVAAAAVYAARLTLKKTPLWTDTLKHHTGFTEAQLMDAAKILVASHSTAPDSKLKVVYKKYSSEKLGGVALRPPATDLCK

SEQ ID NO: 21034 - protein, 483 aa, Burkholderia sp. 383
MNEFLRTGHYIGGEWHESHGASDATYPVLNPATGETIAKVAKGGADDTQRAIDAAAHAFPAWRALTAKERGARVKRWGELMLENRDALAELLTREQGKPLAEARGEVVYAASFLEWFAEEAKRMYGDVIPSPKPNSQIVVTREPVGVVAAITPWNFPLAMITRKAGPALAAGCTMVLKPSEETPLSAFALAVLAERAGVPAGVFNVVSGDAVAIGETLTSSSVVRKLSFTGSTRVGKLLAKQSADTLKKLSLELGGNAPFIVFDDADLDAAVEGAIASKFRNTGQTCVCVNRFLVQDGVYDAFTRKLADAVRKLRVGNALAGEVDQGPLINEAALGKVERHVADATAKGAHALTGGKRHALGGTFYEPTVLTGMTADMLIAEEETFGPVAGCFRFATEEEAVAAANDTPFGLSAYFYTRDLGRAWRVSGALESGMVGVNDGIISTEVAPFGGVKQSGLGREGSKYGLDEYVELKYTLMAGLGR

SEQ ID NO: 21035 - protein, 390 aa, Legionella pneumophila subsp. pneumophila str. Philadelphia 1
MHDGSVFYTIFLIFAGAAFFSTLVLYTKQSLLVAYITLGAILGPWGFKLVSDVTVVKQIGDIGIVFLLFLLGLHLQPQNLIHMLRKVTWIAIVSSILFAALAYGIGRWFGLTVTESLILGGAMMFSSTIIGLKLLPTTILHHQHTGEVMISVLLMQDVIAIVLLILLNSAHQDGNLSISDFILVIIALPALCLFSFLFERYILIKLLARFDRTQEYVFLLSIGWCLGISVLAQTIGLSEDIGAFIAGVALASSPISLFIAESLKPLRDFFLVMFFFSIGATFNFGFGAQVVIPAVILATLILIIKPLLFYILLARSGEKKQVAKEVGIRLGQGSEFSLLVASIALSTNLISEVASNLIQATTILTFIVSSYLVVLKYPTPIALSEKMRKD

SEQ ID NO: 21036 - protein, 166 aa, Triticum aestivum
  misc_feature (46)..(46): Xaa can be any naturally occurring amino acid
  misc_feature (75)..(75): Xaa can be any naturally occurring amino acid
  misc_feature (126)..(126): Xaa can be any naturally occurring amino acid
ISHIVSVNILSIFVLIISQSSFGFVDYYDRRYAALAIVSLNGRQLXCFLSILIIYKQILMQCPMFYINISYNTGXTRFGQPIKVNWAYASTQREDTSGHFNIFVGDLCPEVTDAALFAFFSAYSTXDARVMWDQQTGRSRGFGFVSFRNQQVVSPWQLKTLVWTQN

SEQ ID NO: 21037 - protein, 244 aa, Magnetospirillum magnetotacticum MS-1
MRKAIDAAGHPALLFVDGVSSIGSLPFKADEWKVDCAIAGSQKGLMLPAGLGVICVSPKALKAAEGQSGRNDRLARVYFDWEDQKKQNPTGYFPYTPPLPLLYGLREALACLFEEGLENVYHRHAVLGEATRQAVAAWGLKTCAKSSEWNSDTVTAILAPEGVDAAKIIKHAYVRYNLALGAGLSQVAGKVFRIGHVGDLNELSLLGAIAGAEMSLIDNGVNVTPGSGVAAASSYLREHPLSKG

SEQ ID NO: 21038 - protein, 396 aa, Populus trichocarpa x Populus deltoides
MASASLLKSSPVLDKSEFVKGQTLRLPSASIVRYRSTAPSSLTVRAGSYADELVKTAKTIASPGRGILAMDESNATCGKRLASIGLENTEANRQAYRTLLVTVPGLGNYVSGAILFEETLYQSTTDGKKMVDVLVEQKIVPGIKVDKGLVPLAGSNDESWCQGLDGLASRSAAYYQQGARFAKWRTVVSIPNGPSALAVKEAAWGLARYAAISQDNGLVPIVEPEILLDGEHGIERTFEVAQKVWAEVFYYLAENNVMFEGILLKPSMVTPGAECKDRATPDQVAEYTLKLLHRRIPPAVPGIMFLSGGQSEVEATLNLNAMNQSPNPWHVSFSYARALQNTCLKTWGGRPENVQAAQETLLIRAKANSLAQLGKYTGEGESDDAKKGMYVKNYSY

SEQ ID NO: 21039 - protein, 210 aa, Azomonas macrocytogenes
RQIVTLTYPHIGNTGTTPEDAESDRVWSAGLIIRDLPLLASNWRNKQSLGDYLKENGTVAIAGIDTRRLTRILREKGSQDGCILVGNDATAEKALELARSFPGLKGMDLAKEVSTKVPYEWCSGIWSLETDSHPQIPASQLPYHVVVFDYGVKWNILRMLVARGCRLTVVPAQTSANEVLALKPDGVMLSNGPGDPEPCDYAIRAIQEIL

SEQ ID NO: 21040 - protein, 589 aa, Phaseolus vulgaris
MSSISLKENGGEVSVNKDYSNGGGVRDLYGEDSATEDHLITPWTFSVASGCSLLRDPRYNKGLAFTEGERDAHYLRGLLPPSVFNQELQEKRLMHNLRQYEVPLHRYMALMDLQERNERLFYKLLIDNVEELLPVVYTPTVGEACQKYGSIFRRPQGLYISLKEKGKILEVLKNWPEKSIQVIVVTDGERILGLGDLGCQGMGIPVGKLSLYTALGGVRPSSCLPVTIDVGTNNEKLLNDEFYIGLRQRRATGQEYAELLDEFMRAVKQNYGEKVLVQFEDFANHNAFDLLEKYSSSHLVFNDDIQGTASVVLAGLLASLKLVGGTLADHTFLFLGAGEAGTGIAELIALEVSKQTKAPVEETRKKIWLVDSKGLIVSSRLESLQQFKKPWAHEHEPVKGLLEAVKAIKPTVLIGSSGAGKTFTKEVVETMASLNEKPLILALSNPTSQSECTAEEAYTWSKGRAIFASGSPFDPVEYEGKLFVPGQANNAYIFPGFGLGLIMSGAIRVRDEMLLAASEALAAQVSEENYDKGLIYPPFTNIRKISANIAAKVAAKAYDLGLASHLPRPKDLVKYAESCMYSPGYRSYR

SEQ ID NO: 21041 - protein, 287 aa, Populus trichocarpa x Populus deltoides
MEGKEEDVRLGANRFNERQPIGTAAQSLDDKDYKEPPPAPLFEPGELTSWSFYRAGIAEFMATFLFLYITVLTVMGVVKDQTKCTTVGIQGIAWAFGGMIFALVYCTAGISGGHINPAVTFGLFLARKLSLTRAVFYMVMQCLGAICGAGVVKGFYGKTNYELHNGGANMVAHGYTKGDGLGAEIVGTFILVYTVFSATDAKRSARDSHVPILAPLPIGFAVFLVHLATIPITGTGINPARSLGAAIIFNKDSAWDDHWIFWVGPFIGAALAALYHQVVIRAIPFKK

SEQ ID NO: 21042 - protein, 210 aa, Azorhizophilus paspali
QQIVTLTYPHIGNTGITPEDAESVRVWAAGLIIRDLPLLTSNWRSKQSLPDYLRENGCVAIADIDTRRLTRILREKGSQNGCILVGDDASEEKALELARSFPGLKGMDLAKVVSCSEPYEWRSGVWSLATDSHPEIPAGKLPYHVVAYDFGVKLNILRMLVARGCRLTVVPAQTSASKVLAMSPDGVFLSNGPGDPEPCDYAIQAIREIL

SEQ ID NO: 21043 - protein, 363 aa, Rhizobium leguminosarum bv. viciae 3841
MTSPSGDRTHKIAAIPADGIGPEVIGAGLEVLHALQQRSDGLRFEITQFDWGSDYYREHGKMMPEDGLAQLRKHDAIYFGAVGAPDIADHITLWGLRLPICQGFDQYANVRPTRILPGIPTPLRDRGVGDLDWVIVRENSEGEYSGHGGRAHRGLPEEVATEVAIFTRVGVTRIMRFAFRIAQSRPRKLLTVVTKSNAQRFGLVLWDEIAAEVSTEFPDVKWDKVLVDAMTVRMTLHPESLDTIVATNLHADILSDLAGALAGSLGVAPTANIDPERRFPSMFEPIHGSAFDITGKGIANPIASFWTACQMLDHLGEAEASARLMKAIETVCSAGISTPDVGGTATTREVTDAVIKAIFGSNA

SEQ ID NO: 21044 - protein, 210 aa, Azotobacter beijerinckii
QQIVTLTYPHIGNTGTTPEDAESSRVWAAGLIIRDLPLLASSWRNKQSLPDYLKENGCVAIADIDTRRLTRILREKGSQNGCILVGDDATEEKALELARSFPGLKGMDLAKVVSCTERYEWRSSVWNLETDSHPELPAGKLTYHVVAYDFGVKLNILRMLVARGCRLTVVPAQTPASEVLALNPDGVFLSNGPGDPEPCDYAIRAIKDIL

SEQ ID NO: 21045 - protein, 517 aa, Hemerocallis hybrid cultivar
MDRERLTAEMAFRDSSIVIKIRRKLPDFLQSVKLKYVKLGYRSTTKPPFYLLLPLLLIAASLIFRIHTTLTFPANFSIDFVTAFSSSSIALLLLGVYYTRRPRPVYLVDFACYKPEDEHKISNEGFLEMTESTTAFNDKSLDFQTKITVRSGLGDETYLPPGIQARPPKLSMAEARLEAETVMFGCLDALFESTGINPSRDIGILIVNCSLFNPTPSLSAMIVNHYKMREDVKSFNLGGMGCSAGLISIDLAKDMLQANPNSYALVLSTENITLNWYFGNDRSMLLSNCIFRMGGAAVLLSNKRKDAKRAKYRLLHTVRTHKGADDSCYNCVYQREDEGGKVGVSLAKELMAVAGDALKTNITTLGPLVLPLTEQGKFLATLITRKLLKLKGVRPYIPNFKRAFEHFCVHAGGRAVLDEVEKNLGLEKTDMEASRSVLHRFGNTSSSSLWYELAYNEAKGRVGKGDRVWQIGFGSGFKCNSAVWKAMKDVPAIDRTASGSSRMCNPWGDCIDRYPVK

SEQ ID NO: 21046 - protein, 652 aa, Hordeum vulgare subsp. vulgare
  misc_feature (557)..(557): Xaa can be any naturally occurring amino acid
MLDHLPPPRLTKGKGTEPSISAAVAGEIDPTVPWYLRVCTLTRLLRDREFLAVLRHADPSPPPQALGLPSALICCAALSLPSGVAQVHALAAKGGLVPASDSYILSALLSSYCRLGLLPCARQLLDEMPAASTPPATVLTAFNSLISGCALHALTPACFALFRRMRVHVAGLRFNAVTLLALLPVAPATVVPQLQALAAQSGLASRTTVANCLISVYGRSSPTLARQVFDEMPLATRDLVSWTAVLSAHAQGGLAVDALELYRRMRGHGVEPDALTLVGVLSSCSHLAARSVGLDVDRYVRQRLPGFRANVQLCSALINFHARCGSLPQAQQLFDEMPRKSIVSWTALITGYGMHGHGDIAINFFQRMVSQGIRPDNVSMVALLSACSHAGKYEEGCKYFFAMESTYKLRPTLEHYACMVDLLGRAGRLEEARELISSMPMPADGSVWGALLGACKIHKNVEAGEEAFKHVIMLEPSNVGYYVLMANMYTDSGQQDGVARVRAMMRERGLKKEPGRTQVVRHLLMDDDHSHPQAKRIYELVIELEQMVKEKMNVTAXNEGKLSADKKVAAPLVGTHSEKLAVPFSLLNTVDVEIVVMMNLRVCGDCHSLLKMASAIANRVFLVRDSSCFHRFEVGACPCQDYWRRNWIESSL

SEQ ID NO: 21047 - protein, 426 aa, Streptomyces coelicolor A3(2) [sequence omitted]

SEQ ID NO: 21048 - protein, 198 aa, Mesorhizobium loti MAFF303099
MAQRAFNLPNMLTYARIIAVPLVVLCFFLEGHLKSSDFARWSALVIFLLASVTDYFDGYFARAWQQTSNIGKMLDPIADKLLVATCLLLLAADTDRHAGIAGWSLWAAIIILCREILVSGLREYLAALKVSVPVTQLAKWKTTIQMVAIAFLLAGPAGDKIFPLTTQTGLVLLWIAALVTLYTGYDYFRAGLKHIMDE

SEQ ID NO: 21049 - protein, 694 aa, Oryza sativa Japonica Group
MMAAAAGEGEAEVTREVISVSTEKAFEGKALPAWSEQITVRSLVVSAVLGTFLSFIVMKLNLTSGIVPSLNVSAGLLAFFLMKTWTSALERCGVFPKPFTRQENTVVQTCVISCSSIAFSGGFGTYILGMSKKIAEGFDEAEAKTSINVEEPSLGRLIAFLFLVSFVGLFSIVPLRKIMIISYKLTYPSGSATAHLINSFHTPQGAIQAKHQVSILFKSFVGSFLWSLFQWFYAAGPGCGFSSFPTFGMVAYSRRFYFDFSATYVGVGMICPYIINFSLLVGSVVSWGIMWPYIESKKGSWYDAGLPKSSLHGLNGYQVFISIAMIVGDGLFNFFSIVLRTAYDLYLKRRGGASKQPQETPFAGATGTERQVLSFDDRRRTQVFLKDQIPTTIAAAAYVLLAAISVVAIPHIFRQLRPKHVVWAYVVAPLFAFCNAYGTGLTDWSLSSSYGKLAIFIFGANIGAKDGGVVAGLAACGLMMGIVSTASDLVQDFKTGYLTLTSPRSMFVSQVLGTGMGCIISPMVFWMFYKANNIGMEEGFPAPYAKIYRGIALLGVNGWDQLPRYCLRFCLAFFLLAIAICALKEVAKQRGWWIQDFIPSALGMAVPFFLGSFFTIDMCVGSLVLFLWSRSDPVRAHTFAPAVASGLICGDGIWSLPSSILSLANVNPPMCMRVFSTATNDKVQLFLRTLPTPP

SEQ ID NO: 21050 - protein, 170 aa, Bacillus licheniformis ATCC 14580
MDLKKYVTIVPDYPKEGVQFKDITTLMDKGDVYRYATDQIVTYAKEKEIDLVVGPEARGFIIGCPVAYALGVGFAPVRKEGKLPREVIKVDYGLEYGKDVLTIHKDAIKPGQRVLITDDLLATGGTIEATIKLVEELGGVVAGIAFLIELTYLEGRNKLDGYDILTLMQY

SEQ ID NO: 21051 - protein, 554 aa, Desulfitobacterium hafniense DCB-2
MIVFVLYSYDVCKYKNKDHKGGHKLISVNNVSLRYGGRKLFEDVSLKFTPGNCYGVIGANGAGKSTFLKILSGEVEPNSGDVTIAPGVRLSMLKQDHYQYDQYTVLDTVIMGNQRLYAIMKEKEVLYGKADFTDEDGIKAAELEHEFGEMNGWEAESEASTLLQGLGIGTELHEKAMSELTGVEKIKVLLAQALFGNPGILILDEPTNHLDIQSIRWLEEFLIGFEGTVIVVSHDRHFLNKICTHMADVDFGKIKLYVGNYDFWYESSQLALQMTRDLNKKKEEKAKQLKEFIARFSANASKSKQATSRKKMLDKLNIEDIEPSNRKYPYVGFKPEREVGNDILTVEGLTKTIDGVKVLDNVSFILSKGDKVALVGTNEGAYTALLQILAGEMEPDSGSYKWGVTITKAYFPKDNTEYFQDVDLSLVDWLRQFSADKTDTYVRGFLGKMLFSGEEALKSLKVLSGGERVRCMLAKMMLSQANVLLLDQPTNHLDLESITALNNGLTDYKSNIIFTSHDHQFIQTIANRIIQITPEEMLDVRLSYDEFLDNLAIG

SEQ ID NO: 21052 - protein, 212 aa, Triticum aestivum
MPTAHCKEIESEDDSLDDEVDAAAEDEHEAGDAVPSELSVQKAVAPLVPPKETERQLSKELKKKELEELDAVLAELGISHESSNATQDETNDKEGMGQAADGGKKEDASAPLESKTSKKKKAKKDKSSKEAEETLDQNNVVDDAAGAEPDEDVASVDVKERIKKVASMKKKKSSKEMDAAAKIAASEAAARRAKLVAAKKKDKNHYNQQPLR

SEQ ID NO: 21053 - protein, 264 aa, Erythrobacter sp. SD-21
MKLPYTHVDAFASRPFTGNQAAVMPLDAWLDDATLLAIAEENNFAETAFLVKDGSGEAEYELRWFTPTEEVRLCGHATLASGHVLLTRDGGDAVTFRTRQAGVLEVRRSEAGYELALPLIPTERGEWDEAVALLGAKPREVWLNPDGYGIYLFGSEAEVLALDPDLKGLKALGNDQFICTAFGQNTDVVSRVFVPGGGVDEDSFTGSAHACLTDFWTMKLGRESFSAFQASQRGGYAQCRKDGDKAVLGGQCVTVVEGSFYLPS

SEQ ID NO: 21054 - protein, 211 aa, Arabidopsis thaliana
CFTNFADQKFTSQNEENTKKEEEKKKETNNNNLSNMKHKKTSSHVWDCGSTLYDSFELNSFKRQLDSAISASSARTMSMSHLPDRRIPSLSSLSPEYSPPLPPPPTTSSSSSSGGKKHSNKISRSLQRFLKSVFKPKQHQSLTTPSSPVYKAVGHGGGDKDRYYVVYDKSGSLTTIPESTEKEVSPEINSLVRKTVSERFPASRVVGISCA

SEQ ID NO: 21055 - protein, 474 aa, Burkholderia sp. 383
MRTERNYVNGRFVAPESDTFIVVHNPATEAPFARVPAATPADALAAVDAAAAAQKAWRKLPSAERATYLHRFADALTARASEIGAALAQESGKSVEDASNEAVYAGQITRYHAEWARRIEGEIIPSDTPDENLFLQREPIGVVACLIPFNYPVYTLLRKVAPALIAGNTVVVRPSNHTPVSAFEIAKAAGDAGFPPGVINILTMDHATAEALCTHPAVGMITLTGSVNAGRKVLDYCKANIAKPSLELGGKTPAIIEPDADLERAAAALVASKTTHCGQLCTAIERVYVHDSVHDRFVALLKEKMAAVRIGDRAEDATRMGPLVSASARAHIHGMVERAIAAGATLETGGAIPAGPGFFYPATLLTGVRQDMEIVQEETFGPIMPVLRYSTIDEAIAQANDHQFGLSSVLYTEHYRTAMTVANAIEAGELYVNRTPADPYQGFHAGWKRSGLGGDDGKHGMLEFTQTRLVVMKY

SEQ ID NO: 21056 - protein, 180 aa, Streptococcus thermophilus CNRZ1066
MFKKENLPNLLTLARIILIPIFLLMTSLASSNVMHIAAAVVFAIASITDHLDGYLARKWHVVTNFGKFADPLADKMLVMSAFIMLVGINQAPAWVISVIICRELAVTGLRLLLVENGGTVLAAAMPGKIKTVTQMLSIILLLCHVHFVGTIMLYVALFFTIYSGYDYFKGAGFLFKDTFK

SEQ ID NO: 21057 - protein, 471 aa, Fremyella diplosiphon
MTTPQEVLKLIQDQKIQMIDLKFIDTPGTWQHLTVYYNQIDESSFTDGVPFDGSSIRGWKGIEESDMTMVLDPNTAWIDPFMKEPTLSIICSIKEPRTGEWYNRCPRVIAQKAIDYLVSTGLGDTAFFGPEAEFFIFDDARFDQTANSGYYYVDSVEGRWNSGKDEGPNLAYKPRFKEGYFPVAPTDTFQDMRTEMLLTMAACGVPIEKQHHEVATGGQCELGFRFGKLIEAADWLMTYKYVIKNVAKKYGRTVTFMPKPIFGDNGSGMHCHQSIWKDGKPLFGGDKYAGLSDMALYYIGGILKHAPALLGITNPTTNSYKRLVPGYEAPVNLAYSQGNRSASVRIPLSGTNPKAKRLEFRCPDATSNPYLAFAAMLCAGIDGIKNKIHPGEPLDRNIYELSPEELAKVPSTPGSLELALEALENDHAFLTESGVFTEDFIQNWIEYKLVNEVKQLQLRPHPYEFYLYYDC

SEQ ID NO: 21058 - protein, 710 aa, Aspergillus oryzae
MAARHSRRLLRPLLYTSAAAAAGAGVLYISYRPRNIPGSEAPAVPPPGYHEGKLVPPSFPSIKSRLEQIQDLKRSSSGDDSDVYDLLIIGAGATGSGIALDAATRGLKVAVVERDDFSSGTSSKSTKLVHGGVRYLEKAVWELDYNQYKLVKEALRERKYFLNTAPHLSSWLPIMVPVQKWWQAPYFWVGTKFYDYLAGSEGIESSYFLPKSKAIDAFPMLRKDNMIGAMVYYDGAHNDSRMNVSLAMTAALYGSTVVNHMQVTGLTKDASGNLNGARVKDIIPGKNGQEEGEFTIRAKGIINATGPFTDSIRKMDEPDVKEIVAPSSGVHVILPGYYSPSDMGLIDPSTSDGRVIFFLPWQGNTIAGTTDQPTEITTQPEPSEKDINWILSEVRGYLAPDINVERSDVLAAWSGIRPLVRDPKVKSSEALVRNHLITVSPSGLLTCAGGKWTTYRQMAEEAVDEAINVFNLKPRHVSQVPDISGVGGSGLVADGAVLDGSCQTHQVRLIGAHGYSKTLFINLIQHFGLETDVAQHLTQSYGDRAWQVAALSSPTNARFPVRGQRISALYPFIDGEVRYAVRHEYAQTAVDVIARRTRLAFLNAEAALEALPNIIDLMSEELNWDNKRKDLEWKESVSFLSSMGLPKNFLGLSRAQVEAGKVKQVDSAEHQASSRTDPPADVLNSDLHPETSVASEASSRLISSESAANK

SEQ ID NO: 21059 - protein, 416 aa, Escherichia coli
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHMGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLLKCSEFGDAIIENM

SEQ ID NO: 21060 - protein, 210 aa, Azotobacter chroococcum
QQIVTLTYPHIGNTGTTPEDAESNRVWAAGLIIRDLPLLASNWRNKQSLPDYLRENGCVAIADIDTRRLTRILREKGSQNGCILAGDDATEEKALELARSFPGLKGMDLAKVVSCADSYEWRSSVWELATDSHPEIPAGKLPYHVVAYDFGVKLNILRMLVARGCRLTVVPAQTPASAVLALSPDGVFLSNGPGDPEPCDYAIQAIKDIL

SEQ ID NO: 21061 - protein, 344 aa, Mesorhizobium sp. BNC1
MTNMMKALVKAKPEEGLWMERVPLPEIGPNDVLIKVRKAAICGTDVHIWNWDEWARKTVPVPLVTGHEFVGEVVDVGSAVTEYRIGQRVSGEGHIVCGHCRNCRAGRGHLCRNTLGVGVHRPGAFAEYISLPQHNVVAIPDDVPDEIAAIFDPLGNAVHTALSFDLVGEDVLVTGAGPIGIMGALVAQCVGARKVVITDINPGRLALAKKLGVRHVVNAREEKLTDVMRKLGMTEGFDVGLEMSGSASAFRDMIDVMNNGGKIAILGIAPTGFEIDWNKVIFKMLHLKGIYGREMFETWYKMIALVQGPLDISGLITHRISADDYREGFAAMRSGEAGKVVMDW

SEQ ID NO: 21062 - protein, 484 aa, Rhizobium leguminosarum bv. viciae 3841
MTDKQQYTYPKIGLLIDGEWIYDREALCDVENPSDESILGQVPKATARDLQNALESSARGFETWRKTPPTVRAAVMRRAAALVRERAKDIAPIFTAESGRTYAEVLAEIERSATFLDWDSEEIRRLYGRIVPTDPPIQQFVVREPVGPVAAFTPWNVPMSAPSRKISASLAAGCSIILKPAEETPATACLFAQCFLDAGLPKGVLNVVFGEPDEVSRTLVLSPITRLVTLTGSINVGKHLTRLAVETMKPVLMELGGHAPVIVDENTNADEIAQLAVNWKFRMAGQFCSAPSRFLIHRSRYEDFVSSISEKASKLKVGDGFTEGVQMGPLANRRRLAAMADLVEDAVSHGARVTTGGKRVGNRGWFYEPTVLADVPLDARVMSEEPFGPIAPCMAVDSMDEALKISNSLSMGLAAFVFTNDMERADYLSRELQVGSVALNVFTSPGGDAPFGGVRESGIGREGGTEMYHSYTVAKTIAERRVKV

SEQ ID NO: 21063 - protein, 210 aa, Azotobacter chroococcum
QQIVTLTYPHIGNTGTTPEDAESSRVWAAGLIIRDLPLLASNWRNKQSLPDYLRENGCVAIADIDTRRLTRILREKGSQNGCILAGDDATEEKALELARSFPGLKGMDLAKVVSCAESYEWRSSVWELATDSHPEVSVGKLPYHVVAYDFGIKLNILRMLVARGCRLTVVPAQTPASAVLALSPDGVFLSNGPGDPEPCDYAIQAIKDIL

SEQ ID NO: 21064 - protein, 158 aa, Oryza sativa Indica Group
MAGSGSGSGTPCASCKLLRRRCTSECVFAPYFPAEEAQRFAMVHRVFGASNVSKMLLDVPPPQRPDAVSSLVYEANARMRDPVYGCVAAISFLQNQVSQLQMQLALAHAETAALQLQLQQQHQDQDDHHHQQCILENAAAHHQLMLQEAFLKKESMWT

SEQ ID NO: 21065 - protein, 210 aa, Azotobacter vinelandii
QQIVTLTYPHIGNTGITPEDAESARVWAAGLIIRDLPLLASNWRSKQSLPDYLRENGCVAIADIDTRRLTRILREKGSQNGCILVGDDASEEKALELARSFPGLKGMDLAKVVSCSEPYEWRSGVWSLATDSHPEIPAGKLPYHVVAYDFGVKLNILRMLVARGCRLTVVPAQTSASKVLAMNPDGVFLSNGPGDPEPCDYAIQAIREIL

SEQ ID NO: 21066 - protein, 252 aa, Populus trichocarpa x Populus deltoides
MPIRNIAVGHYHEATQPDALRAALAEFISTLIFVFAGEGSGMAFAKLTDGAANTPAGLIAAAIAHAFALFVAVSVGANISGGHVNPAVTFGAFIGGNITLLRGILYWIAQLLGSTVACLLLKFTTGGLETSAFALSSGVGVWNAFVLEIVMTFGLVYTVYATAVDPKKGNLGIIAPIAIGFIVGANILAGGAFDGASMNPAVSFGPALVSWTWTNHWVYWAGPLVGGGLAGLIYEFFFIGFGSHEQLPTADY

SEQ ID NO: 21067 - protein, 354 aa, Brassica napus
  misc_feature (69)..(69): Xaa can be any naturally occurring amino acid
NPFADELIANAAYIGTPGKGILAADESTGTIGKRLASINVENVETNRRALRELLFTAPGALPCLSGVIXLFEETLYQKSSDGKLFVDILKEGGVLPGIKVDKGTVELAGTNGETTTQGLDGLGDRCKKYYEAGARFAKWRAVLKIGENEPSELSIHENAYGLARYAVICQENGLVPIVEPEILVDGSHDIHKCAAVTERVLAACYKALSDHHVLLEGTLLKPNMVTPGSDSAKVAPEVIAEHTVRALQRTVPAAVPAIVFLSGGQSEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 21068 - protein, 140 aa, Mesorhizobium loti MAFF303099
MALERTFSMIKPDATRRNLTGAITKMLEDAGLRVIASRRVWMSRREAEGFYAVHKDRPFFGELVEFMSSAPTIVQVLEGENAIARNREVMGATNPANAAEGTIRKVHALSIGENSVHGSDAPETAAQEIKYWFSDTEIVG

SEQ ID NO: 21069 - protein, 183 aa, Physcomitrella patens subsp. patens
ISYEELLHVIQTTRMVSNNEEAMRMAQVFNQAGVMLMFRDKVHLHPEKITELVASVLPLSLIGEDNPRSKELLALLKEKEEIDRKAHKQMRLVLWTVLCGIVIKLLLFFRLTFWEFSWNVMEPIAFFTTASGLVCGYTYFMVTSSNPSYQDLMQRIFQCRQRNLFQKQNFDNKRFEELRVQCE

SEQ ID NO: 21070 - protein, 220 aa, Gossypium hirsutum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRSV

SEQ ID NO: 21071 - protein, 219 aa, Prosthecochloris aestuarii DSM 271
MKSVSAMSPSLFDLSYPLRADMAVYPGTPPVVLKPLCTIELDGFAENRLEISSHTGTHIDAPAHMLSGGRTLDSYPLSSFEGRALVIDCSSLPASRITLSDLHPFATGIKGVDFVLLSTGWARFWGHERYFHDYPVLHEDAARWLSGFTLRGIGVDAISVDASDAENFPIHHILLEAGLLLIENLVSLSSLAGRSFRFTCLPLPIESAEAAPVRAVAYL

SEQ ID NO: 21072 - protein, 162 aa, Idiomarina baltica OS145
MIKENDLLPAGSLTSKGELGIQHYDPQELFAKGTHILFAVPGAFTPTCSEKHLPGYVSLANELAEQGVQSINCVSVNDAFVMKAWGDHLGIGDEVRLLSDGNGEYSQTLGLANDTGAFGGIRSKRYAMIIVDGIVEHLFVEDEKQFEVSAAKYVLNVLKSEQ

SEQ ID NO: 21073 - protein, 92 aa, Bordetella parapertussis 12822
MATPSKTATARKPNAAFMKPLTPSAELAAVIGSEAVPRTEVTKKIWDYIKKHNLQDASNKRNINADAKLRPIFGKDQVMMFELTKLVNAHLK

SEQ ID NO: 21074 - protein, 327 aa, Physcomitrella patens subsp. patens
MGYLSCRTEAATGTCESVHLKLKKQLTNKASKPRNITPRVFSFSELSEATLDFAEDRLLGKGSHGLVYKGVLKDGKEVAVKRATHARQLLQDETSFDNELEILSKIWSDRFVNLLGYTREEDEKLLVVEFMSNGTLHDNLHDNFEPALNWVMRIEFALQIARGIFTLHSASPPIIHRDIKSSNVLIDESWKARLGDFGLALRGNIEDMLKTSTPPAGTMGYLDPEYETPSDLSTKTDVFSFGILLLEMISGRNAIDLAYEPPCIHEWALPLIKQGKIDELLDKKLNAPGNMKPLKQLINVAVKCVRSSRTRRPSMSDVVEDLKGIQK

SEQ ID NO: 21075 - protein, 391 aa, Synechococcus sp. CC9311
MKAMILAAGKGTRVQPITHVIPKPMIPILQKPVMEFLLELLKEHGFTEVMVNVSHLAEEIENYFRDGQRFGVEIAYSFEGSIQDGELIGDALGSAGGLKKIQDFQTFFDDTFVVLCGDALIDLDLTEAVRRHRAKGALASLVTKTVPKDQVSSYGVVVSDDDGKIQAFQEKPSVEEALSDTINTGIYLFEPEIFEHIPSGTSFDIGADLFPTLVKQGAPFYALPMDFEWVDIGKVPDYWQAIRSVLQGEVRQVGVPGKEVKPGVFTGLNVAANWDKINVEGPVYVGGMTKIEDGATLIGPTMIGPSCYICEGATIDNSIIFDYSRIGAGVQLVEKLVFGRYCVDKEGDHIDLQEASLDWLITDARRQDLVEPSPQQKAMAELLGTDLTQAS

SEQ ID NO: 21076 - protein, 736 aa, Salinibacter ruber DSM 13855
MAKELERDLGLPSVLAISIGAMVGSGIFILPALAMKMAGPAVVLAYLLAGVLVLPAALSKAEMATAMPEAGGTYVYIERGMGPLLGTIAGIGTWFSLSFKGALALVGGAPYIVLLFDVPPQALALGIAGVLIVVNLLGVKQTGRIQVALVAVMLAAMVWFVGGSLGDVDPVRFEGFFDEGIGGLLAATGFVYVSYAGVTKVASVAEEIEHPDRNIPLGLLGSLAFTTLLYVLVVTVIVGAAPTAGLAGSSTPVADVAGSTLIQWGVLVVVAAAILALVSTANAGLLSASRYPFAMSRDKLVPDALQHVSDRFDTPTTAITVTGGVVLAMIAFVPIDDIAKLGSAFKILVFILVNLALVAFRESDLDDYEPAFRDPMYPWTQGVGVLGGLALLSQMGLVPLVGAVLITGAGALWYGAYARRRVGREGVVRDELRRRVGQQAAERTRVALDTGQRADRVVVGTTEDLRPDRETALVEVGAALTGAFEGGLTVVRFDAVPDQLPLDSAAEVQSPDDVDFETRMDRFGASVDGPFEYGEVVSHDVRHAVANFARHHAVDLLVLERTLSADRSWLDERDLDWISRHCSADLVLVEPTPLAVLDRIALVTDNGPFDPRKVELANGLAAAAGASLVLGHAVPADATEDQRATVRTYHEDLMGLCTVPVESNIVGTTTPAAMARAVSAADLVVVESDAAWWARLLDNREPQRIAGAFGGPAIVVRPQQAEGPSPVRRLLERVAF

SEQ ID NO: 21077 - protein, 396 aa, Shewanella sp. ANA-3
MFNSLVAMPADPILGLLTQYREDSHPQKVDLGVGVYKDPAGNTPILNCVKKAEKFRLDTETTKVYIGPTGSPQFNTLITELAFGSDHSAIITNRIRTVSTPGGTGALRVAGDFIKRCNPNAVLWVSDPTWANHIGLFEAAGLTVKTYPYYDYDTKSLKFDEMLSALAQIGPNDVVLFHACCHNPSGMDLTTEQWDKVVALTKEQGFTPLIDMAYQGFGDGVDIDAYGVRKMAAAVDNMILCSSCSKNFGLYRERIGSCSVVAKDANTANIAQSVLLYVVRCLYSMPPAHGAAIVETILGSAELKQEWLDELKVMRDRINGNRAILVEKLKTNGVDRDFSFIARQKGMFSFLGVNPEQVARLQKEFSIYMVGSSRISIAGISEDNVDYLAKSIAKVL

SEQ ID NO: 21078 - protein, 179 aa, Candida albicans SC5314
MTLEEFRSKICDSMGTPQRKQMCFQATPTAETLEKFPETGSLWVEFCDEASVGIKTMRNFCIHITEKNFSTGIFIYQNSMTPSANKLIPTVSPATIEIFQENDLIVNITHHELVPKHLKLNREEKKELLTRYRLKESQLPRIQREDPVARYLGLKRGEIVKIIRRSETSGRYASYRICL

SEQ ID NO: 21079 - protein, 351 aa, Thermotoga maritima MSB8
  misc_feature (1)..(1): Xaa can be any naturally occurring amino acid
  misc_feature (13)..(13): Xaa can be any naturally occurring amino acid
  misc_feature (22)..(22): Xaa can be any naturally occurring amino acid
  misc_feature (57)..(57): Xaa can be any naturally occurring amino acid
  misc_feature (193)..(193): Xaa can be any naturally occurring amino acid
  misc_feature (197)..(197): Xaa can be any naturally occurring amino acid
  misc_feature (267)..(267): Xaa can be any naturally occurring amino acid
  misc_feature (304)..(304): Xaa can be any naturally occurring amino acid
XGSDKIHHHHHHXKVVTFGEIXLRLSPPDHKRIFQTDSFDVTYGGAEANVAAFLAQXGLDAYFVTKLPNNPLGDAAAGHLRKFGVKTDYIARGGNRIGIYFLEIGASQRPSKVVYDRAHSAISEAKREDFDWEKILDGARWFHFSGITPPLGKELPLILEDALKVANEKGVTVSCDLNYRARLWTKEEAQKVXIPFXEYVDVLIANEEDIEKVLGISVEGLDLKTGKLNREAYAKIAEEVTRKYNFKTVGITLRESISATVNYWSVXVFENGQPHFSNRYEIHIVDRVGAGDSFAGALIYGSLXGFDSQKKAEFAAAASCLKHTIPGDFVVLSIEEIEKLASGATSGRVER

SEQ ID NO: 21080 - protein, 200 aa, Phaseolus vulgaris
MADQGLEGIQPVDLQRHPSGIVPTLQNIVSTVNLDCKLDLKTIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 21081 - protein, 441 aa, Oryza sativa
WDLRCYLKVSLRCNDRFIPYNTQYIGDAAAPAALVGPSLQVLTALSDQNNKRIVLALQSGLKSEILWALNALTVLSFKEKDDLRRDTTPLAKVPGLLDALLQVIDDWRDIAMPKDHTKPPRVRTLGVNTTLSGFGHENVEKVYSDTTTPSDDQTKTADSTVTKKRSAGFLFDEEGLFNVDDEGRTEKQQCAVAASNIIRNFSFMPENETVMVQHRHCLETVFQCLEDQNTEDDELITNMLETLVNLAPVLDLRIFSSSKPSFIKITEKRAVQAIMGMLASSIRVWHCAAAELIGRLIINPDNEPFLLPAIPQIYKRLVDLLSVPAVDAQAAAISALYNVAEVNMDFRLKLASERWAVDRLLKVVKTPHPVPEVCRKASMIVESLVSEPQNRMHLLVHENTFAEILTSEGKYSDTFARILYELTARPSNKVTAGQAIWGNIN

SEQ ID NO: 21082 - protein, 200 aa, Phaseolus vulgaris
MADQVLEGNQPVDLQKHPSGIVPTLQNIVSTVNLDCKLDLKTIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 21083 - protein, 272 aa, Glycine max
SYVGPPPDFGTDGRGGYFDQYGIIRDIIQNHLLQVLCLVAMEKPVSLRPEHIRDEKVKVLESVLPIRDDEVVLGQYEGYKDDPTVPDKSNTPTFATVILRIHNERWEGVPFILKAGKALNSRKAEIRVQFKDVPGDIFKCKKQGRNEFVIRLQPLEAMYMKLTVKQPGLEMSTVQSELDLSYGQRYQGVTIPEAYERLILDTIKGDQQHFVRRDELKASWQIFTPLLHRIDEGEFKPLPYKPGSRGPAEADQLLEKAGYVQTHGYIWIPPTL

SEQ ID NO: 21084 - protein, 399 aa, Erythrobacter sp. SD-21
MNIHEYQAKELLAKYGIAVPAGHAAMTVEEAVEGAKKLPGPLYVVKAQIHAGGRGKGKFKELGPDARGGVRLSKSIDDVEANAKEMLGNTLVTIQTGDEGKQVNRLYVTDGVDIEKEYYLSMLVDRATGRVAMIASTEGGMDIEDVAHETPEKITTITIDPAQGFMPHHGRAVAFALKLTGDTNKQCQKLAKQLYTAFMDLDMEMLEINPLVEDKEGNLLVLDTKMSFDGNSLYRHKDVEAMRDETEEDPAEVEASEYDLAYIKLDGNIGCMVNGAGLAMATMDIIKLNGAFPANFLDVGGGATTEKVTAAFKIILKDPAVEGILVNIFGGIMRCDTIAEGIVVAAKEVDLDVPLVVRLEGTNVEKGKDILANSGLPIVPADDLGDAARKIVAEVKKAA

SEQ ID NO: 21085 - protein, 242 aa, Zea mays
MATAGKVIKCRAAVAWEAGKPLSIEEVEVAPPQAMEVRIKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASGIIGVDINPAKYEQAKKFGCTE

SEQ ID NO: 21086 - protein, 381 aa, Zea mays
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSVMRAALECCPKGWGTSVIVGVAASGQEIAPRPFQLVTGRVWKGTAFGGFKSRTQVPWLVDKYMKKEIKVDEYITPNMNLADINDAFPLLHEGGCLRCVLAMQI

SEQ ID NO: 21087 - protein, 518 aa, Mycosphaerella graminicola
MGLLQEVLAQFDAQFGQTSLWKLVGLGFLAFSTLAILLNVLSQLLFRGKSSDPPLVFHWVPFIGSTITYGIDPYKFFFSCREKYGDVFTFILLGKKTTVCLGTKGNDFILNGKLKDVNAEEIYSPLTTPVFGKDVVYDCPNSKLMEQKKFVKYGLTTSALQSYVTLIAAETRQFFDRNNPHKKFASTSGTIDLPPALAELTIYTASRSLQGKEVREGFDSSFADLYHYLDMGFTPINFMLPWAPLPQNRRRDYAQKKMSETYMSIIQKRRESKTGEHEEDMIHNLMQCKYKDGNAIPDKEIAHMMIALLMAGQHSSSATESWITLRLASRPDIQDELLQEQKDMLGVNADGSIKELTYANLSKLTLLNQVVKETLRIHAPVHSILRKVKSPMPIEGTAYVIPTTHTLLAAPGTTSRMDEHFPDCLHWEPHRWDESPSEKYKHLSPTTALGSIAEEKEDDGYGLVSKGAASPYLPFGAGRHRCIGEQFAYVQLQTITATMVRDFKFYNVDGSDNVVGTD

SEQ ID NO: 21088 - protein, 376 aa, Aspergillus oryzae
MSSTVGKAAIAWAAGEPFSVEDVEVAPPKAHEVRIKIIHTGVCHTDAYTLSGKDPEGAFPVILGHEGSGIVESVGEGVTTVKPGDQVIALYTPECGECKFCKSRKTNLCQKIRTTQGKGVMPDGTSRFRARGKDILHYMGTSTFSQYTVVADISVVAVTTKAPTDRACLLGCGITTGYGAATVTANVEQGSNIAVFGAGCIGLSVIEGAVKNKAGKIIVVDVNDGKEQWARKFGATHFINPTKVKNGKTIQEELIELTDGGCDYTFDCTGNVGVMRAALESCHKGWGESIIIGVAAAGQEISTRPFQLVTGRVWRGCAFGGIKGRSQLPGLVDDYVAGYLKVDDYITHRESLGTINTAFQHMKSGDCIRCVLDMKV

SEQ ID NO: 21089 - protein, 226 aa, Triticum aestivum
MGTMAPSPALLPVLLLLPLLLLSVVCTAGAAPAATATVPTIPSQPGKPNSNNKQKQGGAPLGPAVRALVQSTCNATTYYDLCVAALVADPASSTADLRGLCAIAVSAAAANASATASALANTTWAASGAPEPGSDGRAQQVPALLTRTCAGKYGEAREALLEARESVGEEAYDYAFVHVGAAAEYPAVCRTMFRRKRVPYPVELARREEALEHLCTVVIDIITLLA

SEQ ID NO: 21090 - protein, 471 aa, Mesorhizobium sp. BNC1
MTVTPIIISGGAGSRLWPLSRDAHPKPFIELPDGTSLISRTYGRAARLQGVERIVTVTNRDLLFLTADVYAASDAPRRSNGYLLEPFGRDTAAAVALATLHVNEAEGPDAVLLVLPADHLIADEDAFAEAVGKAVEMAQTGRIVTFGIVPERAETGYGYIEAKGGRVLRFVEKPDAKKAADYVASGRFYWNSGMFCFPARTMLEAMEAHCPEVLVGARAAYRAARKFNADDREVFEIDRDSFAATPAISLDYAVMEKAENVGCIALDCGWSDIGSWSAVAELTPADENGNRLRGEVLLEDTSNSFVHSEHRLVGLVGVSDLLVVDTPDALLVAHKEKAQEVKRLFNRLKEQGHHAAKLHCTAHRPWGTYTVLEEGDRFKIKRIEVKPGARLSLQAHHHRSEHWVVVSGTAKIVNGDQEILLATNQSTYIPCGFKHRLENPGILPLVLIEVQSGDYLGEDDIIRFDDVYGRN

SEQ ID NO: 21091 - protein, 493 aa, Rhizobium leguminosarum bv. viciae 3841
MRSYQLFIDGQFTDGERGEHIETLDPYHGKPWAELARATRGDVDRAVKAAREALDNGPWSKLTATARGRIMRKIGDLITRDADRIAEIEARDNGKLLAEVRGQLNGVAECWYYYAGLADKIEGAWIPVEKPDTMAFTMREPIGVVAALTAWNSPIWFATVKCAPALAAGCTVVVKPSEFASASTLELAAIVKEAGMPDGAFNVVTGYGHDAGAALVEHPDVAMITFTGSDLTGAKIYETAAKQMKRVALELGGKSPNIVFEDADLDLAAAGVVSGIFGAAGQMCTAGSRLLVQKSIKDVFTTKLVDLARYIRMGDPMDPNTNVGPISTPPQFQKVLDYIEIARKDGARCILGGSRATGADLSAGQFVEPTIFSDVTNDMRIAQEEVFGPVLSIIEFDTEEDATRIGNDIAYGLVAGVWTQNIGRAMRMTKALKVGTVWVNTYRAYSFMMPFGGTKKSGLGRESGIEAINEYLETKSVFLSTATEGPTNPFIMR

SEQ ID NO: 21092 - protein, 625 aa, Mesorhizobium loti MAFF303099
MLIINDLSLRMAGRLLLDHASLTLPAGTKAGLVGRNGTGKTTLFKAITGDFPSETGSISLPKNTRIGQVAQEAPGTEEPLIEIVLKADVERTALLEEEKTATDPHRIADIHMRLADIDAHSAESRAATILAGLGFDDAAQGRPASSFSGGWRMRVALAAVLFSEPDLLLLDEPTNYLDLEGTLWLENYVSKYPHTVLLISHDRDLLNRAVNSIVHLDQKKLTFWRGGYDQFERQYTEQKELQEKGRVKQEAARKHMESFVERFRAKASKARQAQSRIKALEKMKPIAAIVNDSVRPFSFPEPVKTVASPIVALNNVNVGYTEGQPILKKMTLRIDADDRIALLGANGNGKSTFAKLLSGRLKQESGTMTVAPGLKVAIFAQHQLDDLRPEENAYEHVRRLMPEAPESKVRGRVAQFGLTTEKMNTPAKDLSGGEKARLLMGLSAFEGPNLFILDEPTNHLDIDSRESLIHALNEFPGAVILISHDRHLLEATADRLWLVKDGAVNPYDGDLEDYKTLVTGVSGDRRGKREADKASKADRRRDAAARRAAFEPLAKEIRATEALMDRIRKRIDGIEDELANPAIYEKDPSTATRLAKERSQLAQTLAGHEEKWLTMSAEYEEGTAE

SEQ ID NO: 21093 - protein, 889 aa, Streptomyces coelicolor A3(2)
MVTFAQAQERAEEWVNGELPAYQHREVRVREFDLGFVVWAEDRADGPRSDGGAQRLVIARDSGEATLWPSLPVGEVIRRYEEEYGRPEEAQAPAAAPAARVDLNQTSFLLSPPEWLQEAADRIGIPDRRRGDGEAGATGGAGGSGGALPQTQAGVPAAPAASGPSPAGGSSGSGAGWPAAGSGSSAGGSGADAGASGAPSAPGVPAGATPWAGTDTNADAGDDRSVPLPQTVFAPPLSGVDDDTPPPSTTSDAKTALMSGGSGLPPTALSPAIGDPNAPGAPAGAGTPPPAAPTAPPAQPPAGPGAPATPPRPLAPDAGDIADAATSKATPPPRRGGGSSTPPPPSAPGMPGARPGSTPAPSGPPAPGAPAGGYVPTQLVSSLGPEGPGGPGTPPPPSAPATPPAPGATPPPGTPGTPPPPPPSAPNAPGGTPPGGMHHAATMLADPGRTGGGAPQPPGPPGPPNPPGPPGPPGAPAAPGAPGAPGVPSGPGVPPPPPGAPGAQGSAGGAGGAVHHAQTVLAAPSLGGPGGIGAPPPPPGAVPPPPGQPVPGQPPAYGYPPQPTGQPTVGPGYQAVLRYRAQDGSEQQLIRRSAPGTPHPEWQMFHELRSMNVPPDQVLELHTELESCELPGAYCARMIREQWPQARITSIAPYGLDHASRQQGMGQLLAHQGELHQVADGPARPAPVRAPLPQVQPAPPVPPEAVGQELAGAFGPGVFRFEQAAVSRQGVPPVVAHTLVAAGLPMDMGPFFWAQAQPGRPVPTLAELAAERGVQPASDAGSYLVVGSDFGRAICVQYGTAAIVAVPVEAGPGGAPVPPQFVNTGLPEFARCLALLGRMWRLRFGLNQEQAGRWTVDFQAQLAALDPAALGSPESWWSVLLEQMWDGLL

SEQ ID NO: 21094 - protein, 354 aa, Picea sitchensis
MTALTRLPPLSTLHDRSHLIVRLVGWCSNLLLQRWCKSVRVEGLERLVNVIKDEKRIAQKRGVLTYANHISVLDDPTLFGSLPSELFQQSKTTRWTMGASDIMFTNSFNAYIFRSGQVLPTDRGRGVFQPALDHSIEIMQNGGWVHIFPEGYVNMSRQARVRRFKWGIGRMLLETGLGISRKLPVILPIWITGLDGMMPEPRGNPKWMPRPGADVTITFGHPINESIDPIIERAKEFALSTDMSSKENTESSHTLIRSLEGKMEGNDSLAQTYPIPEKTLFSPTTPLTPPPGGVSWPLPLEDSRSFNAIQSGLDSDQARIARSFISAELRAHLVKLGDETGSSKDLIHRLMPEE

SEQ ID NO: 21095 - protein, 556 aa, Zea mays
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHSRLDQLQLLLKGVSERGAKKIRVHILTDGRDVLDGSSVGFVETLENDLLELRGKGIDAQIASGGGRMYVTMDRYENDWDVVKRGWDAQVLGEAPYKFKSALEAVKTLRAQPKANDQYLPPFVIVDDSGKAVGPVLDGDAVVTINFRADRMVMLAKALEYADFNNFDRVRVPKIRYAGMLQYDGELKLPSRYLVSPPEIDRTSGEYLVKNGIRTFACSETVKFGHVTFFWNGNRSGYFDETKEEYVEVPSDSGITFNVAPKMKALQIAEKARDALLSGKFDQVRVNLPNGDMVGHTGDIEATVVACKAADEAVKIILDAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 21096 - protein, 327 aa, Listeria monocytogenes
MGIAVLGGAGYIGSHAVNELITRGYEVVVIDNLRTGHRESIHKKAKFYEGDIRDKAFLSSVFEKEKVDGVIHFAASSLVGESMEVPLDYLNNNVYGTQIVLEVMEEFDVKHIVFSSSAATYGEPERVPITEDMPTNPESTYGETKLIMEKMMKWCDKAYDMKYVALRYFNVAGAKADGSIGEDHKPESHLVPIILQVALGQREKLAIYGDDYNTPDGTCIRDYVQVEDLIDAHIKALEYLKNGGESNIFNLGSSNGFSVKEMLEAARTVTGKEIPAEVVPRRAGDPGTLIASSDKAREILGWEPTYTDVKDIIATAWKWHVSHPNGY

SEQ ID NO: 21097 - protein, 670 aa, Mycobacterium avium subsp. paratuberculosis K-10
MSTSEYRAVDAESDLPISAAELAALASQLYAASIRPGPDSPPQQAPVAPRGSVPDATAATSAGRTAAGTADVYPGPVPQVGGRDVYLPPPASPAPEAPPQAAPPAPRGSAPDATAATSAGRAAAGTSDVYSSWVPQLGVADIYLGAPTPAGPEAPPQSAPPAPRGQVPDTTAAATAYGADLSAFAVPTGIVSTAPGVQAGTAPPVPVVPRAATAPSWLPEAPSVADLGWSDAPAPDAPAGDEHDYHFLTKTDPVPQFRDEHEVFDVAAIRSDFPILKETVNGKPLIWFDNAATTQKPQVVIDRLSHFYAHENSNIHRAAHELAARATDAYEEARDTVAEFIGAPSSDNIVFVRGTTEAINLVAHAWGAKHLQPGDEIVITHLEHHANIVPWQLISQKTGAILKVAPIDDAGNLLLSEFEGLLGPRTKLVAASHVSNALGTVMPVDKIVELGHRYGARVLIDGAQSIQHIPIDVAELGADFFVFSGHKIYGPTGIGALYGTEEALTETPPWQGGGHMIADVTLERSLYQGPPTKFEAGTGNIADAVGLTEALRYVQRLGVERIAAYEHALLEYATPRLADIPGVRLIGTAQEKASVLSFVLAGHEPLEVGKALNAEGIAVRAGHHCAQPALRRLGLEATVRPSFAFYNTFEEIDVFLRAVRRIAEGGANVG

SEQ ID NO: 21098 - protein, 217 aa, Gossypium hirsutum
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGV

SEQ ID NO: 21099 - protein, 314 aa, Pseudomonas syringae pv. phaseolicola 1448A
MIVDALDWQPTAALQRLNLPWLQDAGVEVAILRLDLIDSLISGNKWFKLSEHLTQAVEAGAEGLISLGGAYSNHLHALAAAGRRFGFPTVGLLRGHAQQTPTVLDLQAFGMQLHWLGYAGYRARHAADFWLPWQAQYPELYPIAEGGGGLAGALGCARLREMVDSQLGHLGWDDYHGWWLAVGTGTTLAGLLLAEAGAHPVYGAMAVPDDHGVAQNIVAVLKEAAGSQVNASPNLPAACVLLEASRGGFARTDAALLDFIASSEAHTGVPLEPLYTGKALLALHDEVLAGRFKSGSRLVFVHTGGLQGRRAMGL

SEQ ID NO: 21100 - protein, 361 aa, Burkholderia thailandensis E264
MGTVQRVHGGYNAFLRINRYTMIATRILRRPRVLIVGCGDVGMRCAAQLRARHENLRVIALTSRRSRCAELRAAGVVPVVGDLDARATLERIARVAHVVLHLAPPQATGHVDRRTQALVAALASPRRPRQLAPAYGRLRAGWAAARSARPRFQASAIVPDAPSRPVVVYASTSGVYGDCGGARVDETRPVRPANPRAQRRVSAERQLRRATARGALSARIVRIPGIYAANRLPLARLEKGTPALIEADDVYTNHIHADDLASILLRAAARGKPARVVHASDDTELKMGDYFERVARAFGLRSPPRIARAEAERQLEPMLLSFMRESRRLANARMKRELRIALRYPSVDDFLRTMPAPRPVK

SEQ ID NO: 21101 - protein, 501 aa, Candida glabrata CBS 138
MDSRLARLTTLQTSAGEELRRTSIIGTIGPKTNNPETLVALRKAGLNIVRMNFSHGSYEYHKSVIDNARKSEELYPGRPLAIALDTKGPEIRTGTTTNEVDYPIPPNHEMIFTTDDKYAKACDDKIMYLDYKNITKVISAGRIIYVDDGVLSFEVLQVVDDKTLKVKSLNAGKICSHKGVNLPGTDVDLPALSEKDKADLRFGVENGVHMIFASFIRTAQDVLTIREVLGEDGKDIKIVVKIENQQGVNNFDEILKVTDAVMVARGDLGIEIPAPEVLAVQKKLIAKSNLAGKPVICATQMLESMTYNPRPTRAEVSDVGNAVLDGADCVMLSGETAKGNYPINAVTTMAETALIAEQAIAYLPNYDDIRNCTPKPTSTTETVAASAVAAVFEQKAKAIIVLSTSGTTARLVSKYRPNCPIILVTRNARTARFSHLYRGVFPFVYEKESVSDWTEDVEARLNFGIEQAIEFGILKKGDTYVSIQGFKAGVGHSNTLQVSTA

SEQ ID NO: 21102 - protein, 376 aa, Thermus thermophilus HB8
MSRVPEPSVFLVVDEAKRKARERGVGLIDLSIGSTDLPPPEAPLKALAEALNDPTTYGYCLKSCTLPFLEEAARWYEGRYGVGLDPRREALALIGSQEGLAHLLLALTEPEDLLLLPEVAYPSYFGAARVASLRTFLIPLREDGLADLKAVPEGVWREAKVLLLNYPNNPTGAVADWGYFEEALGLARKHGLWLIHDNPYVDQVYEGEAPSPLALPGAKERVVELFSLSKSYNLAGFRLGFALGSEEALARLERVKGVIDFNQYAGVLRMGVEALKTPKEVVRGYARVYRERALGMAEALKGVLSLLPPRATMYLWGRLPEGVDDLEFGLRLVERGVALAPGRGFGPGGKGFVRIALVRPLEELLEAAKRIREALD

SEQ ID NO: 21103 - protein, 535 aa, Bordetella parapertussis 12822
MMKFDWNNPYPSTRIPVFARNVVATSHPLAAQAGLRILALGGNAADAAVASAATLALVEPASNGLGSDCFALVWDGARLHGLNASGTAPAAWSPGYFQRKHQGAIPLRGWDSVTIPGCVAGWASLHDKLGSLPFADVLAPAIEYAERGFAVPPTVQRRWADQVDPLRSLPGFAEHFLPHGRAPEVGEHFVLAGAAATLRRIAASGGRDFYEGETAQKLVAHAQAHEAALTLGDLRDYAPQWVEPISQAYRGHALHQLPPNGQGLAALIALGIVEHFDLASRPAEHPDTQHILIEAMKLAFADVHAHVADAAHMRIRVEQLLDPAYLAERARLIDLRRARVYNAAQAPQGGTVYLACADRNGMMVSFTQSNYMGFGSGIVVPGTGISLQNRGCCFSMDPDHPNVVGGGKRPFHTGIPAFLTQDGAPLMSFGIMGGNMQPQGHLQALVRMLDYRQQPQAACDAPRWKWNRGLSVDIEAAMPAQVTDALRARGHIVEVAAPTDKDFGSGQFIWRLGDPAVDGYVAASDSRRDGLAAGF

SEQ ID NO: 21104 - protein, 275 aa, Shewanella sp. ANA-3
MLNTTMFNYQGKNVVVVGGTSGINLAIANAFAQAGANVTVASRSQDKIDAAVLQLKQSNPDGIHLGVSFDVRDLAAVEQGFEAIASEFGFIDVLVSGAAGNFPATAAKLSANGFKAVMDIDLLGSFQVLKTAYPLLRRPQGNIIQISAPQASIAMPMQAHVCAAKAGVDMLTRTLAVEWGCEGIRINSIIPGPIADTEGFNRLAPSAALQQQVAQSVPLKRNGEGQDIANAAMFLGSEYASYITGVVLPVDGGWSLGGASIAMTALGELAIKAQQ

SEQ ID NO: 21105 - protein, 467 aa, Xanthomonas campestris pv. vesicatoria str. 85-10
MSDVLPIILSGGSGTRLWPLSRESYPKQFLPLVGDKSMLQSTWLRAAPVAGHAPIVVANEEHRFMAAEQLQQLGVKPSAILLEPKGRNTAPAIAVAALEATRDGADPLLLVLPSDHVIQNEAAFQAAVTLAATAAEQGKLVTFGIKPTAPETGYGYIKAGAGTGASAVERFVEKPDLATAQSYLASGEYYWNSGMFLFRASRYLEELRKFHPAIADACQKAWENGKRDADFTRLDKDAFAASPSDSIDYAVMEKTADAVVVPLDAGWNDVGSWSSLRDVSKQDAQGNAHHGDVIQLDCQNTYAYGSRLIAMVGLEDVVVVETPDAVLVGHRDRIQEVKDIVSQIKTAGRSEATWHRKVYRPWGAYDSIDMGQRHQVKRITVKPGAVLSLQMHHHRAEHWIVVSGTAEVTRGEEVLLLTENQSTYIPLGVTHRLRNPGKLPLELIEVQSGSYLGEDDIVRFEDTYGRA

SEQ ID NO: 21106 - protein, 304 aa, Thermus thermophilus HB8
MRVEGAIGKTPVVRLAKVVEPDMAEVWVKLEGLNPGGSIKDRPAWYMIKDAEERGILRPGSGQVIVEPTSGNTGIGLAMIAASRGYRLILTMPAQMSEERKRVLKAFGAELVLTDPERRMLAAREEALRLKEELGAFMPDQFKNPANVRAHYETTGPELYEALEGRIDAFVYGSGTGGTITGVGRYLKERIPHVKVIAVEPARSNVLSGGKMGQHGFQGMGPGFIPENLDLSLLDGVIQVWEEDAFPLARRLAREEGLFLGMSSGGIVWAALQVARELGPGKRVACISPDGGWKYLSTPLYAEP

SEQ ID NO: 21107 - protein, 388 aa, Xanthomonas campestris pv. vesicatoria str. 85-10
MKIAVAGTGYVGLSNGVLLAKHHEVVALDIVESKVKLLNEGRSPIVDKELEAALAQGGLNFKATLDAKEAFAGAEFVIIATPTDYDPDTNYFNTGSIEVVIAKVLEINPQATMVIKSTIPVGYVAKLRAQFGTDNIIFSPEFLREGRALYDNLYPSRIIVGERSARAETFARLLQEGALKPDVPVLFTEPTEAEAIKLFANTYLAMRVSYFNELDTYALTHGLDSRQIIEGICLDPRIGSHYNNPSFGYGGYCLPKDTKQLLANYQSVPQNIIRAIVDSNTTRKDFIAADVLRRNPKVVGIYRLIMKAGSDNFRSSSIQGVMKRLKAKGVDVIVYEPTLSDPEFFRSRVVNDLEAFKREADVIISNRMADALQDVQDKVYTRDLFGDN

SEQ ID NO: 21108 - protein, 402 aa, Oryza sativa Japonica Group
MADYVYGPGRNHLFVPGPVNIPDQVIRAMSRQNEDYRSPAVPALTKTLLEDVKQIFKTTTGTPFLFPTTGTGAWESALTNTLSPGDKIVSFLIGQFSLLWIDQQQRLNFNVDVVESDWGYGADLAALDYKLRQDPSHSIKAICIVHNETATGVTNDLSAVRKILDKHRHPALLLVDGVSSICALDFRMDEWGVDVALTGSQKALSLPTGLGIVCASPKALEASKTAKSVRVFFDWKDYLKFYKMGTYWPYTPSIQLLYGLRTALDLIFEEGLENVIKRHNRLGTATRLAVEAWGLKNCTQKEEWFSDTVTAVVVPPYIDSAEIVKHAWKRYNLSLGLGLNKVAGKVFRIGHLGHLNELQLMGALSGVEMVLKDIGYPVKLGSGVAAAAAYLSNSTPLIPSRI

SEQ ID NO: 21109 - protein, 75 aa, Glycine max
CSVPSTYISFGGGRHGCLGEPFAYLQIKAIWTHLLRNFEFELVSPFPENDWNAMVVGIKGEVMVNYKRRKLAVDN

SEQ ID NO: 21110 - protein, 274 aa, Salinibacter ruber DSM 13855
MVHLKSQREIDCLRESANLVGQTLAEVARHIEVGATLRELDAVAEEYIRTQGGEPAFKGYQVGDNVFPNTLCTSVNDAVVHGIPDDYALQDGDLLSIDCGAKLNGYYGDWAYTFAIGDIAEEDAALCRATHRALLRGIEQAVADQRVGDISHAVQSHCESQGFSVVRDLVGHGVGQDLHEDPQVPNFGDPGRGRSLKPGLSICIEPMINRGTARVVTDDDGWTVRAADGLPSAHYEHMVVVRDGEPEVLSDYGYIEDVIDPPYEADALTETTTR

SEQ ID NO: 21111 - protein, 2194 aa, Medicago sativa
MSNSLSLTFTALNNPQINAISNPNARLRPLARVTRCSATCVERKRWLGTKLRSGGGLERIQLWESGGLGRLPKLRVAVKSSFSAVPDKPMGLYDPAFDKDSCGVGFVAELNGQSSRKTVTDALEMLVRMTHRGACGCEANTGDGAGILVALPHGFYQEVVDFQLPPQGNYAVGMFFLPKSDSRRKESKNIFTKVAESLGHKVLGWRSVPTDNTGLGKSAQLTEPVIEQVFLTPSSDSKVDLEKQMYILRKLSMVSITSALNLQSDGITDFYICSLSSRTVIYKGQLTPAQLGEYYYADLGNERFTSYMALIHSRFSTNTFPSWDRAQPFRVLGHNGEINTLRGNVNWIKAREGLLKCKELGLSENDLKKFLPIVDANSSDSGCFDGVLEFLLHSGKSLPEAVMMMIPEAWQNDKNMDPQRKAFYEYYSALMEPWDGPALISFTDGHYLGATLDRNGLRPGRFYVTHSGRVIMASEVGVVDIPPEDVCRKGRLNPGMMLLVDFEKQIVVNDDALKEQYSLARPYGDWLEKQKIELKDIIDSVHESDIVPPTISGVPPLSNDDVDMENMGIQGLLAPLKAFGYSVESLEILLLPMAKDGVEALGSMGNDTPLAVMSNREKLTFEYFKQMFAQVTNPPIDPIREKIVTSMRCMVGPEGDLTETTEEQCHRLSLKGPLLSTKEMEAIKKMNYRGWRSKVIDITYSKERGTKGLEEALDRICTEAHNAISEGYTTLVLSDRAFSKKHVAVSSLLAVGAVHQHLVKTLERTRVALMVESAEPREVHHFCTLVGFGADAICPYLAIEAIWRLQVDGKIPPKASGDFNSKDELVKKYFKASTYGMMKVLAKMGISTLASYKGAQIFEALGLSSEVIEKCFAGTPSRVEGATFEMLAQDALHLHELAFPSRIFSPGSAEAVALPNPGDYHWRKGGEVHLNDPLAIAKLQEAARTNSVDAYKQYSKTIHELNKACNLRGLLKFKDAASKVPISEVEPASEIVKRFCTGAMSYGSISLEAHTALATAMNTIGGKSNTGEGGEQPSRMEPLADGSRNPKRSAIKQVASGRFGVSSYYLTNADELQIKMAQGAKPGEGGELPGHKVIGDIAITRNSTAGVGLISPPPHHDIYSIEDLAQLIHDLKNANPAARISVKLVSEAGVGVIASGVVKGHAEHVLISGHDGGTGASRWTGIKSAGLPWELGLAETHQTLVANDLRGRTTLQTDGQLKTGRDVAIAALLGAEEYGFSTAPLITLGCIMMRKCHKNTCPVGIATQDPVLREKFAGEPEHVINFFFMVAEEMREIMSQLGFRTVNEMVGRSDMLEVDKEVVKGNAKLENIDLSLLLRPAAELRPEAAQYCVQKQDHGLDMALDNKLISLSNAALEKGLPVYIETPICNTNRAVGTMLSHEVTKRYNLAGLPADTIHIQFTGSAGQSFGAFLCPGITLELEGDSNDYIGKGLSGGKVVVYPPKGSNFDPKDNILIGNVALYGATRGEAYFNGMAAERFCVRNSGALAVVEGVGDHGCEYMTGGTVVVLGKTGRNFAAGMSGGIAYVLDVDGTFQSRCNLELVDLDKVEEEEDIITLRMLIQQHQRHTNSLLAKEVLVDFENLLPKFVKVFPREYKRVLASMKSDAASKDAVERAAEDVDEQDDEAQAVEKDAFEELKKLATASLNEKPSEAPKRPSQVTDAVKHRGFVAYEREGVQYRDPNVRLNDWNEVMMETKPGPLLKTQSARCMDCGTPFCHQENSGCPLGNKIPEFNELVYQNRWQEALERLLETNNFPEFTGRVCPAPCEGSCVLGIIENPVSIKNIECAIIDKAFEEGWMIPRPPVKRTGKRVAIVGSGPSGLAAADQLNKMGHIVTVFERADRIGGLMMYGVPNMKTDKVDIVQRRVNLMAEEGINFVVNANIGLDPLYSLERLREENDAIVLAVGATKPRDLPVPGRELSGVHFAMEFLHANTKSLLDSNLQDGNYISAKGKKVVVIGGGDTGTDCIGTSIRHGCTAVVNLELLPQPPPTRAPGNPWPQWPRIFRVDYGHQEAETKFGKDPRTYEVLTKRFVGDENGVVKGLEVVRVCWEKDETGKFQFKEIEGSEEIIEADLVLLAMGFLGPEATIAEKLGVERDNRSNFKADYGRFSTSVDGVFAAGDCRRGQSLVVWAISEGRQAAAQVDSYLTNEDHGIDGNQDEFVKRQQDLNKKHSKHTVMT

SEQ ID NO: 21112 - protein, 263 aa, Legionella pneumophila subsp. pneumophila str. Philadelphia 1
MIVQNIEFYQIDAFTDKVFHGNPAAVCILDDWLNDELLKAIAAQNNLAETAFIIKDDQDFHIRWFTPNGEINLSGHATLAAGFALLESNKGPSNSIVFHHSSGQISVEKRKEKFVLNFPRIGYKKTLSPDPIVSLLDQPAIEVFETDLDYLVLLEHESQIRNLQIDLFALAKLPKRGIIVTSTTTEADFYSRCFYPKHSIAEDPVTGSAHCILAPFWAEKLNKNSLYAIQGLHRKGELYCELERNRVLISGHCRWYLRGHLVI

SEQ ID NO: 21113 - protein, 228 aa, Erythrobacter sp. SD-21
MTKLILVRHGQSEWNLANRFTGWWDVDLTEKGEAEAREAGRLMQAKGVLPTVSFTSLQKRAIKTLNLALEECDRLWIPVTRDWHLNERHYGGLTGLDKQQTREKHGDEQVHIWRRSFDVPPPEMKRGSEFDLSDDPRYAGIDVPLTESLKLTIERVLPYWGEAILPRLAKGETVIISAHGNSLRALVKHLSNISDEEITGLEIPTGQPIVYEFDGATVSGERYYLKDA

SEQ ID NO: 21114 - protein, 449 aa, Arabidopsis thaliana
MKTTHFSSSSSSDRRIGALLRHLNSGSDSDNLSSLYASPTSGGTGGSVFSHLVQAPEDPILGVTVAYNKDPSPVKLNLGVGAYRTEEGKPLVLNVVRKAEQQLINDRTRIKEYLPIVGLVEFNKLSAKLILGADSPAIRENRITTVECLSGTGSLRVGGEFLAKHYHQKTIYITQPTWGNHPKIFTLAGLTVKTYRYYDPATRGLNFQGLLEDLGAAAPGSIVLLHACAHNPTGVDPTIQQWEQIRKLMRSKGLMPFFDSAYQGFASGSLDTDAKPIRMFVADGGECLVAQSYAKNMGLYGERVGALSIVCKSADVAGRVESQLKLVIRPMYSSPPIHGASIVAVILRDKNLFNEWTLELKAMADRIISMRKQLFEALRTRGTPGDWSHIIKQIGMFTFTGLNPAQVSFMTKEYHIYMTSDGRISMAGLSSKTVPHLADAIHAVVTKAV

SEQ ID NO: 21115 - protein, 458 aa, Aspergillus oryzae
MGSAAEPAYLYKNVTHDPTVPSVKSAEGIYIFLENGQKILDATSGAAVSAIGHGVGRVKKAIMSQLDQVEYCHPGFFPNTPAMDLADLLVESTGGKLSRACILGSGSEAVEAAMKLAYQYFEEQSPNTRRTRFISRHGSWHGCTLGALALGDFKPRKTRFNSILTSNISHVSACDPYHGLMENEDPETYVARLKDELDNEFQRLGPETVCAVFLEPMVGTALGCVTALPGYLQAVRDVCDRYGALLVFDEIMCGMGRTGITHAWQEDGVAPDIELVGKGLAAGYGTISGLLVNDRVLDGLRHGGGYFVHGQTYQSHPLGCAAAVEVQRIIKEENLVENCRKMGQYLGQQLKLHLGDHPYVGDIRGRGLFWAVEFMADPPTKTPFSPAFTISKRMQSRGMERGYDICLFAATGAVDGCNGDHVLLAPPYIVHKEDVDEIVSRLVRTIDSVFEDVAALVM

SEQ ID NO: 21116 - protein, 298 aa, Ustilago maydis
MDKYQRIEKVGEGTYGVVYKAKDLTPGANGRIVALKKIRLETEDEGVPSTAIREISLLKELRDDNIVRLFDIVHQESRLYLVFEFLDLDLRKYMDHVSRNRGGDGMGPEIVRKFTYQLIRGLYYCHAHRILHRDLKPQNLLIDREGNLKLADFGLARAFGIPLRTYTHEVVTLWYRAPEVLLGSRHYSTAIDMWSVGCIFAEMTLGHPLFPGDSEIDQIFKIFRALGTPTDDVWPGVQQLPDYKDSFPKWAGRPLRDAVPGLDEAGLDLLEGMLVYDPAGRTSAKRSLVHPYFRRLLT

SEQ ID NO: 21117 - protein, 784 aa, Bacillus cereus ATCC 10987
MKGVILAGGKGRRLRPLTCNTPKPMLPLLEKPVLEYNIELLRQHGIREIAITVQYMSTAIKQYFGDGSKWGVNLYYFEDSPPLGTAGSIKQAEKFLDEPFVVISGDALTDFQLSEGITFHEQKKRMVTMFVKEVENPLSFGLVVMNKEQEVTRYIEKPSWNEVVSNIVNTGIYIMEPEIFSYIPPREFFDFSQDVFPLLANKNALFAYLSEGYWLDIGTFDQYRQAQFDLLTKKLQVPIPYTEVLPMVWMGEGVTIGKGTKIHGPSFIGEGARIGAGSVIEPYSIIGKNSVVSSYSHLQKSIIFANAHIGKYCELLETTIGEHTMVEDDVTLFQKSIVADHCHIGKSTVIKQKGKLWPYKAIDSHSVVGSAGVQESEKSAGWLQKSRIVGRGNVEITPQFIVKVAMAYGSLFTKGESILIGSQEHIETTSYKNLFLHAIHGIGIHTMECKEMNESLFQYSIQDLQCAGGVFIQAEKEKEIVIKLYGKDGAQLTYKQQKAIEQVYMSESFYYVCEKEMGRNKLVHVSLHNYIEAVLERIDIEKIKKQKFHLLINKRNDMLQHLLMLFLQRLGCTVTWIYAGEQKDHVKALMKSSKANMALMFSEQGNYFELYDNHSNIYQGTDFEEIDIPDLLLESAGNIYPMSLKLGECYLLFYTQDEKKSFQARWKRDILYRIGKLFELIALQGKTFLSIVEQSPPLYLLCDEVVCSWNEKGKVMRKLLADIERKEEGIFEGVQFKYTEKEWSYIVSDTKQPKFLVYSHARNPVIARENMKNLIEKIRQYQKV

SEQ ID NO: 21118 - protein, 310 aa, Mycobacterium avium subsp. paratuberculosis K-10
MSIAENVTQLIGNTPLVRLNRVTEGAVADVVAKLEFFNPGNSVKDRIGVAMIDAAEQAGLIKPDTIILEPTSGNTGIALALVAAARGYRCVLTMPETMSVERRMLLRALGAEIVLTPGADGMPGAIAKAEELAKSDDRYFVPQQFENPANPAIHRSTTAEEVWRDTDGKVDIFVAGVGTGGTITGVAQVIKERKPSAQFIAVEPAASPVLSGGQKGPHPIQGLGAGFVPPVLAMDLVDEVIAVGNEESIALARRLAAEEGLLVGISSGAALVAALQVARRPENAGKLVVVVLPDFGERYLSTPLFADLAD

SEQ ID NO: 21119 - protein, 475 aa, Streptococcus mutans
MTKQYKNYVNGEWKLSENEIKIYEPASGAELGSVPAMSTEEVDYVYASAKKAQPAWRALSYIERAAYLHKVADILMRDKEKIGAILSKEVAKGYKSAVSEVVRTAEIINYAAEEGLRMEGEVLEGGSFEAASKKKIAVVRREPVGLVLAISPFNYPVNLAGSKIAPALIAGNVIAFKPPTQGSISGLLLAEAFAEAGLPAGVFNTITGRGSEIGDYIVEHQAVNFINFTGSTGIGERIGKMAGMRPIMLELGGKDSAIVLEDADLELTAKNIIAGAFGYSGQRCTAVKRVLVMESVADELVEKIREKVLALTIGNPEDDADITPLIDTKSADYVEGLINDANDKGATALTEIKREGNLICPILFDKVTTDMRLAWEEPFGPVLPIIRVTSVEEAIEISNKSEYGLQASIFTNDFPRAFGIAEQLEVGTVHINNKTQRGTDNFPFLGAKKSGAGIQGVKYSIEAMTTVKSVVFDIK

SEQ ID NO: 21120 - protein, 365 aa, Oryza sativa Japonica Group
MESSSPSVPFPLLQAPVESTYRACTIPYRFASDNPRKATPVEIQWIDLFLNSVPSFRQRAENDPTVPDAPAKAEKFAQRYTAMLEELKKNPESNGGPPDCILLCRLRELVLRELGFRDIFKKVKDEENAKAMSLFEGVVQRNDEIEDDGKRAENLIRGILAGNIFDLGSAQLAEVFAKDGMSFLASCQNLVSRPWVIDDLDAFQNKWTKKSWEKAVIFVDNSGADIILGILPFARELLRHGTKVILAANDMPSINDVTYPELVEIINKLKDENGKLAGVDASDLLVANSGNDLPVIDLSSVSPELAYLANDADLVVLEGMGRAIETNLYAQMKCDSIKIGMVKHPEVAQFLGGRLYDCVFKFNEA

SEQ ID NO: 21121 - protein, 229 aa, Mycobacterium avium subsp. paratuberculosis K-10
MLAAIRRDIRAARERDPAAPTTLQVIFAYPGVHAIWGHRVNHWLWRRGARLAARISAEITRILTGVEIHPGAVLGPGLFIDHATGVVIGETAEVGEDVTIYHGVTLGGSGRDTGKRHPTIGDRVIIGAGAKVLGAIKIGDDSRIGANAVVVKEVPSSAVVVGVPGQVIARTHPGPGGPDDSLMPDLVGVSLQSLLTRVTKLEAKVDGSQTGRVIRPPEAGVWYGEDFSI

SEQ ID NO: 21122 - protein, 202 aa, Oryza sativa Japonica Group
MASHLDFRYLDEGLGGERGKRKRREAEEAAAADSMDLDADADAPRPSKLRAVPSLSDPSKPASFGQPTYDGVIAGRVSGRRWKEARTRRASALAASRKPTPLEQRARDKSLKRAYQARVAELKEEIRQSKAAKRKQREEREKRKKENVLRSGTKLQRVTNPKTIQKIAKSKKRKQLKVVPDEFLGGKKSDANRRMQVPGLDN

SEQ ID NO: 21123 - protein, 324 aa, Streptomyces coelicolor A3(2)
MTGIKTTGEKKMMFFSGRAHPELAEEVAQQLGVGVVPTKAFDFANGEIYVRYQESARGADCFLIQSHTAPINKWVMEQLIMIDALKRASARSITVIVPFYGYARQDKKHRGREPISARLIADLMKTAGADRILAVDLHTDQIQGFFDGPVDHLFALPLLADYVGAKVDRSKLTVVSPDAGRVRVADRWCDRLGAPLAIVHKRRDKDVANQVTVHEVVGDVKGRICVLVDDMIDTGGTICAAADALFAHGAEDVIVTATHGVLSGPAADRLKNSKVSEFVFTNTLPSASELELDKITVLSIAPTIARAVREVFEDGSVTSLFDEQ

SEQ ID NO: 21124 - protein, 280 aa, Oryza sativa
MYNNYGNSPGMQMPPIGQMPPATGQMPSANPQPGQFGNPFYGASSGLIKTGLGAYGEKFLGSSSEFMQSNINRYFSNPQYYFHVNDQYVRNKLKVILFPFLHRGHWTRISEPVGGRLSYKPPIYDINAPDLYIPFMAFGSFIILAGFTLGFMGKFTPEAINLQFSRGLIGWALQIVILKGLLYSMGGGEVPLLDLVAYGGYLFAGLSLAVVSRLLWAYSYFVMMPWMSLCMGVFLVRTMKRVLFTEMRSSERHSTRQHYFLLFLAISQFPLFFWLGKIGA

SEQ ID NO: 21125 - protein, 90 aa, Triticum aestivum
  misc_feature (51)..(51): Xaa can be any naturally occurring amino acid
MAPTVMASSATSVAPFQGLKSTAGLPVSRRSNGASLGSDNNGGRIRCMHVXWPIGGIKKIMTLGYLPPLQIVGASWTGQLPGPFHGAAQN

SEQ ID NO: 21126 - protein, 218 aa, Gossypium hirsutum
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVD

SEQ ID NO: 21127 - protein, 311 aa, Pyrococcus furiosus DSM 3638
MITAFGEVLIDFIAAEEGDLENVKIFEKHPGGAPANVAVGVSRLGIPSFLVSKVGDDPFGRFLIRRLKEEGVNTEGVLIDNEKHTGVVFVQLKGAKPSFILYDEVAYFNIKLSEVPWEILESSKIVHFGSVLLAREPSRGTMIKVIETLKEKSLVSFDVNIRKDLWRSEEELVETLKRVLSNVDILKLSDEEFNLLKEYGLEPRGKLITAITYGAEGCRIESDEASIFVPAYKVSPVDTTGAGDAFVSALLVGLLALDKQKLEESDMFLLGKFANLVAGLSTQKRGAWSVPRREELEKYEEGRKIFSLITL

SEQ ID NO: 21128 - protein, 151 aa, Zea mays
  misc_feature (3)..(3): Xaa can be any naturally occurring amino acid
  misc_feature (26)..(26): Xaa can be any naturally occurring amino acid
  misc_feature (36)..(36): Xaa can be any naturally occurring amino acid
  misc_feature (55)..(55): Xaa can be any naturally occurring amino acid
  misc_feature (74)..(74): Xaa can be any naturally occurring amino acid
  misc_feature (91)..(91): Xaa can be any naturally occurring amino acid
  misc_feature (96)..(97): Xaa can be any naturally occurring amino acid
  misc_feature (106)..(106): Xaa can be any naturally occurring amino acid
MGXICGVGAGYVGGPTMGVIALKCPXIEVWVVDISXPRVEAWDRDTLPIYEPGLXDVVKQCRGRNLFFSTEVEXHGAEADIIFGSGNTPTXTRGLXXGKAADLTYXESAARMIADVSKADKIGGEKATGPGKTRGAIEKILTHNRRGINYQ

SEQ ID NO: 21129 - protein, 406 aa, Oryza sativa Japonica Group
MLSDQELARYVESFVRQAAAVPGAVAAAGGISAESVARQLGPQLGLDLTPKAPLIRDILLALFSPPPQGAPFTSSAPSPSASASASASAAAAGHFFSQQQQQQQLQTFLTASQQYQHRGGAGAAAAPPSAYGVAAAAAGYRYGQPFPQDEGAHLQRLVQMHHHQQQQQQQQQQQMAAAAAGVAAAPPTAVESPRPAAASKKESASTGVKRRGGPGGLNKVCGVSPELQAIVGEPTMARTEIVKQLWAYIRRNNLQDPNNKRKIICNDELRLVFETDSTDMFKMNKLLAKHIRPLEAKKDSNRDSKKLKPVDSEPISPAETDVNQLPIILSDALASFFGTGEKEMPSSEAVKRVWDHIKSNNLEDPANPTMILCDSKLKQLFGCESLTAVSVSELLSQHLFKQPNKL

SEQ ID NO: 21130 - protein, 548 aa, Burkholderia thailandensis E264
MSQAIEVKVPDIGDYKDVPVIEVLVKPGDAVEPEQSLVTLESDKATMDVPSPSAGTVKEVKVKVGDAVSQGSLIVLLDGAQAAGRPAQANGAAASAAQPAAAPVAAAPAPVAAGGGTVDVRVPDIGDYKDVPVIEIAVKIGDTVEKEQSLVTLESDKATMDVPSPAAGVVKDIKVKVGDAVSEGSLIVVLEASGAAAASAPQAAAPAQAAPAPAAAPAPAPQAAPAPQAAPAAAPAPAASGEYRPSHASPSVRKFARELGVDVSRVAGTGPKNRITKDDVTAFVKGVMTGQRAAPAAAAPAGGGELNLLPWPKVDFSKFGPFEAKPLSRIKKISGANLHRNWVMIPHVTNNDEADITDLEALRVQLNKEHEKAGVKFTMLAFVIKAVVAALKKFPTFNASLDGDNLVFKQYYHIGFAADTPNGLVVPVIRDADKKGLVEIAKEMAELSKAAREGKLKPDQMQGGCFSISSLGGIGGTHFTPIINAPEVAILGLSRGQMKPVWDGKQFVPRLTLPLSLSYDHRVIDGAEAARFNAYLGALLGDFRRIIL

SEQ ID NO: 21131 - protein, 217 aa, Gossypium hirsutum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVD

SEQ ID NO: 21132 - protein, 377 aa, Triticum aestivum
  misc_feature (326)..(326): Xaa can be any naturally occurring amino acid
  misc_feature (353)..(353): Xaa can be any naturally occurring amino acid
HYRTSLYKKAGWYRSGIPGISSTHASVCFLCAALRTAQIYDAHNPLCRDILRPNNNMDLASLTAVWWAVALLFITVLVTKISRARVTTVDLHRTTGQLPPLVNGVALLKLLPTLLNKGLPAMVNDLYVKYGSVFMVSSFGVKVTLLIGPEVTAHFFQGLESEISHGNLFEFTVPMFGEAVGYGRDTATRTEQMRFHIEALRPSRLRSHVYPMLQEVEGYFAKWGEEGIVDLKLEFEKLLMLISSRCLLGKEVRENMFDEVYTLFHEIEDNGVTLISFLFPYLPTPANRQRDKARIRLTQILSDVVDSRKNSGRVEDDTLQKLIDSXYKDGRPTTVEEVVGLIIGLLFAGKHTXSHTSTWTLFTSIQLLETALRTTQT

SEQ ID NO: 21133 - protein, 285 aa, Bacillus licheniformis ATCC 14580
MSMRVGYLGPEATFTHLAVCSCFSDADQQAFNTIPACMDAAMNGEIDLAVVPLENAIEGSVNLTIDYLIHEQPLYIVGEITAPIRQHLLVHPTRKEAWEDIQKVYSHSHAIAQCHKFLHSRFRSIPFEYATSTGAAAKYVSENPEENIGVIANEMAADTYGLDIVKRDVHDYEYNHTRFVMLHPDREASPPVNPQLKGRPKTTLLVTLPSDRSGALHQVLSAFAWRNLNLSKIESRPTKTGLGNYFFIIDIEMALDDVLIPGAIAELEALGCKVKMLGAYNAYTL

SEQ ID NO: 21134 - protein, 682 aa, Arabidopsis thaliana
MENFLALFNEGMDEEASRLEKLLPFHEHPLIPFTRFEFTKCKGCYSTDEDNTSFISKHPGCSYIYGGHRCNEPGCDVVFHEECAKPLPEIDHPYHPVHPLKLILLHTRVSNCSFCGEFFSVGYRCNKCDFQLDLICARRPALLVLAENSYLHEHPLQLSHEAHETLRDCKGCGHQHNSWKHFYTCHQCEFFISLDCIDHNSPEAYHTSHPQHPLKSLRYEVPGYADKKCLLCREEFDGIHRQLHHCGVCNFSICRSCMKNPPPVLVKSPRTHEHQLHLVPRRIDFTCNACGTLGDRSPYFCLQCNFMIHRECIDLPRVININRHDHRISYTPRLGHGDGKCRVCRKNVDGFYGAYSCSKCFDYFVHSRCATRRDVWDMIELEGTPEEEETAPFKVIDDNTIDHYGHKHNLRIYRGWNLPESVVCTACVFQICSEPFYACARKRCDFIIHEKCAKLPLKKRHVCHNQPLELSPNYGTYLLHRCSICRQLFTGFSYESKELRIDVRCATVTEPFEHKSHQHPLHYSTDHSKRCSECDGDGKLSCDDCEFGLCFKCAILPQKVMRHRYDDHPLFLSYGEMGVAGKYWCEACETTVNPEKWFYTCNECGITLHISCVIDTYAYSMPGALTWIGTFVSNHSICRPLCCVCNSRCKLPFVRTLPEDGADLYFCSLECEKKIYQERFEF

SEQ ID NO: 21135 - protein, 127 aa, Salinibacter ruber DSM 13855
MADIEELAEQLVGLTIQEANELANHLEEEYDIQPASAGVAVAADGGGGADGDAEEEEQTAFDVVLTGIGGNKIQVIKEVRSITGMGLKEAKSLVDEAPNPVSEGVSREEADDLKAQIEDAGGEVELQ

SEQ ID NO: 21136 - protein, 153 aa, Arabidopsis thaliana
  misc_feature (21)..(21): Xaa can be any naturally occurring amino acid
  misc_feature (33)..(33): Xaa can be any naturally occurring amino acid
  misc_feature (50)..(50): Xaa can be any naturally occurring amino acid
  misc_feature (124)..(124): Xaa can be any naturally occurring amino acid
AQGVFFLFPPHFVVAPKFSPXAHPKILPSPGLXDGWLGLDLWSNFFKTFXEGLGPTPTVFLDGPLGVFQMEKFWGGTKGVGDLLPGVSLKGVAPIIGGGDSVVSVEKVGVTGVFSPLSPGGGTXLGFLKEKVFPGGLPLFKPSPSLFLNFFPF

SEQ ID NO: 21137 - protein, 121 aa, Brassica napus
MAPIAVGDALPDGQLGWFDENDQLQQVSVHALAAGKKVILFGVPGAFTPTCSNQHVPGFITQAEQLKAKGVDEILLISVNDPFVMKAWAKTYPENKHVKFLADGSGAYTKALDLELDLTDK

SEQ ID NO: 21138 - protein, 288 aa, Lactobacillus plantarum WCFS1
MTKTPTITLNDGRAIPAIGFGTFQIPDDGSTYQAVKEALVIGYRHIDTAVAYFNEDEVGQAIKDSGIPRDQIWVTSKLWLQDYGFDAASRAIDRSLTKLRLDYIDLYLIHQPYGDVPGAWQAMEAAQKAGKLKSIGVSNMTPTLWQKFVPQFETIPAVNQVEFNPYFQQQPLRQLLAAQDVKLEAWAPLGQGNQALFKEPIIQQLAIKYHKDAGQIILRFEHQEGVIVFPKSVHSARIKSNRDIFDFELTSTEMAQLRALDTGKGHHDPDAPGVSEQLLHAFDVHADD

SEQ ID NO: 21139 - protein, 392 aa, Corynebacterium efficiens YS-314
MKALTWQGKRKVSVETVPDPILKAENDAIIQVTSTGICGSDLHLYEVLAPFMDEGDIIGHEPMGRVVEAGPASNLKEGDRVVIPFNISCGHCWMCKRGLFSQCEVTQVREYGSGASLLGYSRLYGSVPGGQAEYLRVPHADFGPIKVGDELPDHRYLFLSDVLPTAWQAVKYADVGEGDTLAVYGLGPIGQMCARIGRHLGARVFGIEPVPERRAMAARHGIEVFDLGDDTHDHIRDLTDGRGPDAVVDAVGMEAHGSPVGKLAHNAMSLLPDAAARKMMEHGGLDRLGALHGSIDLVRRGGTVSLSGVYGGEASPMPMLTLFDKQIQMRMGQCNVKSWIDDLLPLVEDPADPLGVDDLTTHRVSLDEAPAHYEKFQKKEDGCIKVVLDPTL

SEQ ID NO: 21140 - protein, 288 aa, Lactobacillus plantarum WCFS1
MMVPTTKLNNGVVMPQLGFGVFQVPDLNECEAAVTAALKAGYRLIDTATAYQNETAVGRAIQKSGLRRDELFVTSKLWVSEFTYERAKQGIDASLQRLGVDYLDLYLLHQPYGDVMGAWRALEEAYHAGKIRAIGVSNFYADQLKNLELTMSVQPAVNQIEVNPWYQQADEVRFNQDEHVRVEAWAPFAEGKHAIFSNPSIQTIAQAHGKTTGQVILRWLLQRGITVIPKSVHPERMAENIAVFDFELTAAEMSAMAELDQGVSQFFDHRDPVTIEQIFGASLRQLHE

SEQ ID NO: 21141 - protein, 412 aa, Medicago truncatula
MGGGHDDTTTESSDFTSEDEGTEDYRRGGYHAVRIGDTFSSGRYVVQSKLGWGHFSTVWLAWDSHHSRYVALKVQKSAQHYTEAALDEITILQQIAEGDTDDKKCVVKLLDHFKHSGPNGQHVCMVFEYLGDNLLTLIKYSDYRGMPINMVKEICFHILVGLDYLHKQLSIIHTDLKPENILLLSTIDPSKDPRKSGAPLILPNSKDKTMLESTAARDTKTSNGDFIKNHKKNIKRKAKQAAHGCAEKEASEGVDGNHETSGAVESSPNASSAREQASSSAGTSRLSDADGMKLKEQGNRRGSRTVRQKLLASADVKCKLVDFGNACWTYKQFTNDIQTRQYRCPEVILGSKYSTSADLWSFACICFELATGDVLFDPHSGDNFDRDEGTFVVKVMCWPHITATGNTDCGEF

SEQ ID NO: 21142 - protein, 269 aa, Zea mays
  misc_feature (115)..(115): Xaa can be any naturally occurring amino acid
MPRNFRKRGIEQDTDDRSDDEDTRRIALEEIKYMQKLRERKLGIPADLAAASTNGSSARGLLGTGAAVAGEAEKEDLVLQDTFAQETAVTIEDPNMLRYVETELAKKRGKMVDVXTKEEMDHVDELYTVPDHLKVKKKNSEESSTQWTTGIAEVQLPIEYKLRNIEETEAAKKLLQEKRLARKPKPDANIPSSYSADYFHRGKEYDEKLRRENPGLYKDNDSRPSGNPGGKATDTKNPDGVGAGRREAASDELMLQRFRKREKFRALRR

SEQ ID NO: 21143 - protein, 446 aa, Triticum aestivum
MAATIQSVKARQIFDSRGNPTVEVDVCCSDGTFARAAVPSGASTGVYEALELRDGGSDYLGKGVSKAVDNVNLIIAPALIGKDPTAQTELDNFMVQQLDGTKNEWGWCKQKLGANAILAVSLAICKAGASIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGEQVQIVGDDLLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPVEPY

SEQ ID NO: 21144 - protein, 263 aa, Erythrobacter sp. SD-21
MARLFIFGLGYTAGRFAQEMRGRGWQVDATGSAGNIDWMDAVSVVEHLERATHVLSSVPPDRDDGVDPVLDFYDDIFDGQWLGYLSSTGVYGDADGAWVDESSPTDGGRRSARAECDACWLEAGARVFRLPGIYGPSRSAFERVESGKAHRIDLPGQVFSRVHVDDIVAGVVAAIESGAPQGAYNLADDLPTSQNAVIEEACRLMGVSPPPLQTIEEADLSPMARGFYAENRRVANGKAKRVLDWEPRYPTYREGLAAIRAPA

SEQ ID NO: 21145 - protein, 179 aa, Glycine max
MMVGQLTATKPSRSDEVLDAEEQLRIANEIRAQFDALEPKRPIKPNRSEPDAVLQYPVAAASVNNIPELHKFQSLQSPSHAIISSAGFVDAQDEFVETQYYKELASIDKQHHTTGSGFIKAAREGGEGEYEIQLPNNHVNAAETQPRSYKSNPATNDWVPNSDEHQVFVSSKPNRSEST

SEQ ID NO: 21146 - protein, 705 aa, Magnaporthe grisea 70-15
MASPLQFATRTLKDIRVFNADPAYADLPGFEKPTGNLRCCIYSPCGRYFAWASNEVVRVTDSNDGRVLAALSIPNVYELGFSPRGTFFITWERPGKDENGDATKNLKVWRTVEDLPEGTEKQPLGRFVQKSQNGWNLQYTNDEKYCARMVTNEVQFYDSNDLATVWNKLRVEGVSDFALSPGKAHALAVFVPERKGQPAAVKVFNVPQFTAPVSQKTFFKGDKVQLKWNALGSAIIVLAQTDVDKSNKSYYGETTLYLLSVNGSFDARISLDKEGPIHDVAWSPNSKEFGVIYGFIPAKITIFNQRAVATHSFPSGPRNTIIFSPTGRFVLVAGFGNLAGQIDVYDLERDYRKICTIESGSPSVCQWSPDSRYIMTATTSPRLRVDNGVKLWHVTGTLMYNEDMVELYNVLWRPVLPEHAPTGDALQPMPAPHASAATYMSTVKTPSKPAGAYRPPGARGSVTPLHFKREDEGGAAHSVSNGVSQLNINGFGRARHQVPGADFATVPGAGVPGAEAADDDGLSKAASKNKKKRANKKAKDAAAVEGGGASLAPPNNYNSDANGGRSPERNGRNYQHSHSRSQSRNNMNGGGGGGRSRSNTHRQAMGEGGGRARSRSARPQNRLANIQVSNLQGAAQAPVHSPISETAQNPQAKKQRGLQKKIRAIEDLEMRLAGGEKLEDTQMKKIGTKATVLKELEMLEKEMMH

SEQ ID NO: 21147 - protein, 517 aa, Mycosphaerella graminicola
MGLLQEVLAQFDAQFGQTSLWKLVGLGFLAFSTLAILLNVLSQLLFRGKSSDPPLVFHWVPFIGSTITYGIDPYKFFFSCREKYGDVFTFILLGKKTTVCLGTKGNDFILNGKLKDVNAEEIYSPLTTPVFGKDVVYDCPNSKLMEQKKFVKYGLTTSALQSYVTLIAAETRQFFDRNNPHKKFASTSGTIDLPPALAELTIYTASRSLQGKEVREGFDSSFADLYHYLDMGFTPINFMLPWAPLPQNRRRDYAQKKMSETYMSIIQKRRESKTGEHEEDMIHNLMQCKYKDGNAIPDKEIAHMMIALLMAGQHSSSATESWITLRLASRPDIQDELLQEQKDMLGVNADGSIKELTYANLSKLTLLNQVVKETLRIHAPVHSILRKVKSPMPIEGTAYVIPTTHTLLAAPGTTSRMDEHFPDCLHWEPHRWDESPSEKYKHLSPTTALGSIAEEKEDYGHGLVSKGAASPYLPFGAGRHRCIGEQFAYVQLQTITATMVRDFKFYNVDCSDNVVGT

SEQ ID NO: 21148 - protein, 425 aa, x Doritaenopsis sp.
MSKMFGKEVPLSKMAVSKAHGEGSPYFAGWKAYEENPYDVVGNPDGVIQMGLAENQLSFDLLEEYLELHPEAFSWASDSSSFRENALFQDYHGLQTLRQALASFMEKIRGGRSKFDANRIVLTAGATAANEILTFILADRGDALLVPTPYYPGSNGFQLTLSSLEKAYAEAKASNFNVRGLLMTNPCNPLGTSASLSLLQDIIHFISDKNIHLISDEIYSGSVFSSTNLFSISDLITDAISEQVHIVYSLSKDLGLPGFRVGALYSYNDRVVKTARRMSSFSLVSSQTQKLLSFMLSDEEFTVRYIEKNRERLRERYELVVNGLKEAGIECLKGEAGLFCWVNMEKLMEEETKEGEAELWKVIIDDLKLNISPGSSCCCAEPGWFRLCFANMSRETLEVALKRLKDFAQKKVAAKKKKMNNVYFC

SEQ ID NO: 21149 - protein, 253 aa, Oryza sativa Japonica Group
MAVATLSSRSRRACAEAASVLLVLLVIAPSVAAGGDTNGVYEPCADAAVQRGDGFTFGVAFAARGDFFSGGVQLSPCDGRLSLASKGAKLAVFRPEVDEISLLTVNTSAAGGFDPATSGGYMVAFAGRKYAARSPPVFVSNSSYTVTSFTLVFEFNKGTLQNLYWKANGCSACSGQPSFTCVDQNCAISTANCTGKGGSVDCSPGIQLAFSGTDKHEAVLNSWYEVSKLRQYSLVGLFSNLKDSLTSQFSIFF

SEQ ID NO: 21150 - protein, 158 aa, Legionella pneumophila subsp. pneumophila str. Philadelphia 1
MNSCIIMHFKLISLECMMAKELTLSIIKPDAVAKSVIGEIYTRFEKAGLDIVAAKMTQLSREQAESFYDIHRARPFFKDLVDFMISGPVMIQVLKGENAVAKNREIMGATNPKEAAPGTIRADFADSIDANAVHGSDSLENAAREIAFFFEQHELCNR

SEQ ID NO: 21151 - protein, 302 aa, Mycobacterium tuberculosis CDC1551
MMARQRFRDQVVLITGASSGIGEATAKAFAREGAVVALAARREGALRRVAREIEAAGGRAMVAPLDVSSSESVRAMVADVVGEFGRIDVVFNNAGVSLVGPVDAETFLDDTREMLEIDYLGTVRVVREVLPIMKQQRSGRIMNMSSVVGRKAFARFAGYSSAMHAIAGFSDALRQELRGSGIAVSVIHPALTQTPLLANVDPADMPPPFRSLTPIPVHWVAAAVLDGVARRRARVVVPFQPRLLMVGDAFSPRYGDRVVRLLESKIFGRLIGSYRGSVYRHQPTESAKAQAAQPERGYSSAR

SEQ ID NO: 21152 - protein, 206 aa, Oryza sativa Japonica Group
MARLAGVAALSLVLVLLGAGVPRPAAAAAAKTQVFLSKLPKALVVGVSPKHGEVVHAGENTVTVTWSLNTSEPAGADAAFKSVKVKLCYAPASRTDRGWRKASDDLHKDKACQFKVTVQPYAAGAGRFDYVVARDIPTASYFVRAYAVDASGTEVAYGQSSPDAAFDVAGITGIHASLKVAAGVFSTFSIAALAFFFVVEKRKKDK

SEQ ID NO: 21153 - protein, 463 aa, Sinorhizobium meliloti 1021
MSAFDYDLFVIGGGSGGVRSGRLAAALGKKVAIAEEFRYGGTCVIRGCVPKKLYVYASQFAEHFEDAAGFGWTVGESRFDWAKLVAAKEQEIARLEGLYRKGLANAGAEILDTRAELAGPNTVKLLASGKTVTAERIVIAVGGHPSPHDALPGHELCITSNEAFDLPALPESILIAGGGYIAVEFANIFHGLGVKTTLIYRGKEILSRFDQDMRRGLHAAMEEKGIRILCEDIIQSVSADADGRRVATTMKHGEIVADQVMLALGRMPNTNGLGLEAAGVRTNELGAIIVDAFSRTSTPGIYALGDVTDRVQLTPVAIHEAMCFIETEYKNNPTSPDHDLIATAVFSQPEIGTVGITEEEAARKFQEIEVYRAEFRPMKATLSGRKEKTIMKLVVNAADRKVVGAHILGHDAGEMAQLLGISLRAGCTKDDFDRTMAVHPTAAEELVTMYQPSYRVRNGERVG

SEQ ID NO: 21154 - protein, 105 aa, Arabidopsis thaliana
RFSFAGDLGQSDKGTPMEQQPSGPVRRDTTLLDSSNSDFEFHISSNFDPGDSSPADEIFADGMILPVLPFQVTATSTMPKRLYKYELPPIVSAPTLSSYLPPLPL

SEQ ID NO: 21155 - protein, 231 aa, Sinorhizobium meliloti 1021
MDARQMKIKAAEAALEHVESGMRLGIGTGSTAEEFVRLLAEKVASGFQISGVPTSERTARLCLELGVPLKSLDELPELDLTIDGADEVDGKLRLIKGGGGALLREKIVASASTRMIVIADESKVVDVLGAFKLPIEINPFGQVATRLAIEKTASRLGLAGEIVVRSSGDGVFMTDGGHLILDASFGRIPDADALAVELNAIPGVVEHGLFIDVASMAIIAGPEGARTLTAS

SEQ ID NO: 21156 - protein, 425 aa, Oryza sativa
MERDTSSSDVSASHVGRARQRRRPTEATADGNRTNGPALLVNDQNKYKSMLIRTYSTVWMIGGFVLIVYMGHLYIWAMVVVIQIFMAKELFNLLRKSSEEKQLPGFRLLNWHFFFTAMLFTYGRFLSRQLVNTVTSDHLLYKVVSGLIKYQMFICYFLYIAGFVWFILTLKKKTYKYQFKQYAWTHMILLTVFAQSSFTVANIFEGMFWFLLPASLIVINDIAAYLFGFFLGRTPLIKLSPKKTWEGFIGASVTTIISAFVLANVMGRFQWLTCPRKDLSTGWLCCDPGPMFKPEHYSLGEWVPKGFPWKEVVLLPVQWHALALGLFASIIAPFGGFFASGFKRAFKIKDFGDSIPGHGGITDRMDCQMVMAVFAYIYHQSFISPQNYSVELILEQILRNLTFEEQKFLYQQLGEIYRERQLMQS

SEQ ID NO: 21157 - protein, 346 aa, Oryza sativa
MENGGGDVPENANDHCPGTQSEAAGKADACTGCPNQQICATAPKGPDPDLLAIIERMNTVKHKILVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQIAGIDGAIIVTTPQQVSLIDVKKEINFCKKVGVPVLGVVENMSGLRQAFSDMKFVKPSEAGETDATEWALNYIKEKAPELLSVVACSEVFDSSKGGAEKMCQEMEVPFLGKVPMDPQLCKAAEEGRSCFTDQKCSASAPALKSIIKKLVKTK

SEQ ID NO: 21158 - protein, 387 aa, Streptomyces coelicolor A3(2)
MGEAVAGTVGERFRELYGAEPEGVWAAPGRVNLIGEHTDYNDGFVMPFALPHQAVAAVSRRDDGILRLHSADIDADPVELRVADLAPGSDKSWTAYPSGVLWALREAGHELTGADVHLASTVPSGAGLSSSAALEVVLALAMNDLYALGLRGWQLARLCQRAENVYVGAPVGIMDQTASACCEAGHALFLDTRDLSQRQIPFDLAAEGMRLLVVDTRVKHSHSEGEYGKRRAGCEKGAALLGVDALRDVPYADLDAALERLGDEEEVRRLVRHVVTEDERVERVVALLESGDTRAIGAVLVEGHASLRDDFRISCPELDLVVDTALASGALGARMTGGGFGGSAIVLVEAAGVDAVTKAVEDAFAAAGLKAPRVFEAVPSAGARRLV

SEQ ID NO: 21159 - protein, 321 aa, Streptomyces coelicolor A3(2)
MSGKYLVTGGAGYVGSVVAQHLVEAGHEVVVLDNLSTGFREGVPAGASFVEGDIRDAAKWLDGSFDGVLHFAAFSQVGESVVKPEKYWDNNVGGTMALLEAMRGAGVRRLVFSSTAATYGEPEQVPIVESAPTRPTNPYGASKLAVDHMITGEAAAHGLGAVSLRYFNVAGAYGEYGERHDPESHLIPLVLQVAQGRREAISVYGDDYPTPDGTCVRDYIHVADLAEAHLLAVAAAAPGEHLICNLGNGNGFSVREVVETVRRVTGHPIPEIMAPRRGGDPAVLVASAGTAREKLGWNPSRADLAGIVSDAWEFAQRRAGQ

SEQ ID NO: 21160 - protein, 279 aa, Prosthecochloris aestuarii DSM 271
MMDDAKIENLGIVITGGSRGLGYALAKGFLNVGDRVVICARNPEGVDSAVSSLLQSVPDGKIFGISCDVTNPEDACRLASFAVSVLGSVDRWLNNAGTSGYRKRPLWELDERDLLETCTTNLYGSMLMSKTAVGIMRSQPVKATEVYHIFNFGFTSFGARFSRSPVPHKASKTGVAAITRHLSREIRQAGISGIGVHEVSPGLVLTDLLLRDTDDETRAFLQITADTPEVVAQRLVPKIRGVKGSNSLIRSQSLLRMAGSMAMRVISARFSPKRHRESS

SEQ ID NO: 21161 - protein, 140 aa, Glycine max
  misc_feature (79)..(79): Xaa can be any naturally occurring amino acid
MDCKKRVRDDSDESVLESPEAKRLRDDLLEFFDDADDASSSQDLDSVMKSLQEEISGVASDSGESQAQIGYLLEASESXSDSSGIGELWEFEEQIPRYDLFDLGMGFGYECDTTEYAAFGGLFDHSDLYYDSWRHETLPT

SEQ ID NO: 21162 - protein, 383 aa, Pyrococcus furiosus DSM 3638
MEFEEAFKEVYELVKPKYKLFTAGPVACFPEVLEIMKVQMFSHRSKEYRAVHVDTVKRLKNFLEAEKGEVLLVPSSGTGIMEASIRNGVSKGGKVLVTIIGAFGKRYKEVVESNGRKAVVLQKDPGKAVKPEELDDALRKNPDVEAVTITYNETSTGVLNPLPELAKVAKEHDKLVFVDAVSAMGGADIKFDKWDLDVVFSSSQKAFGVPPGLAIGVFSERFLEIAEKMPERGWYFDIPLYVKYLKEKESTPSTPPMPQVFGLNVVLRIIEKMGGKEKWLEMYEKRAKMVREGVKEIGLGILAEPGYESPTITAVLTPPGIKGDEVYEAMRKRGFELAKGYGSVKEITFRIGHMGYMTFDDIREMLDNLREVIEELKREKGIA

SEQ ID NO: 21163 - protein, 210 aa, Thermus thermophilus HB8
MKEIWYVRHGETEWNAQRRFQGHLDIPLSPVGIGQAFRLAERLSRSRISFDRLYASDLRRARQTAEPLAQVLGLPIATTPLLREIHVGELAGLTRAEAEARFPSFLAEAAEDPWNARRPGGESMADLARRLQAFLEEVPPGRHLVVTHGGVIRAALKLALDLAGDTWRRFHIQNTSITRILYPENAVLTVADAAHLEVWADWLSDEDLKG

SEQ ID NO: 21164 - protein, 136 aa, Erythrobacter sp. SD-21
MAARVRQSGAEAIAGMEARGFIFGAAVAAKLALPFLPVRKSGKLPCETISVDYALEYGSDRLELDPASVRQGQRVAMVDDLLATGGTACATAKLLRQAGAVVDHAFFVIDLPDLGGAAKLAKVGVAVAALMDFEGD

SEQ ID NO: 21165 - protein, 616 aa, Erythrobacter sp. SD-21
MEQTLVIALVGILGIGAQWIAWRTGWPAIVLMLAAGFLAGPVFGVFDPEHAFGELLEPIVAVGVALILFEGGLSLDFRELRHTGGAVARLATIGVVLGWLFGALAGIYIAGLAPEVAILFGGILVVTGPTVVIPLLRQSSIKSRPASILKWEAIVNDPTGALCAVIAYEYFRKVAESPGASLFEVVPPLIIAAILAGLIGYVAALAIAWSFPRGAVPEYLKVPVLLTAVIGVFVISNLIEHEAGLVAVTVMGVALANMNVTSLRSIHPFKENIAVLLVSGIFILLSASLSIEDVRYINWPIAWFLLALLFLVRPATILLSLLGSNIPWNERLFLAWIAPRGIVLVAISGLFALRLSDLGFTDGNLLIGLSFAVVVVTIVAHGFSVDFVAKLLKVKGVTRPGMLIVGSTPWTIALAEQMKDMKAPVLVVDPSWQRLALARQKGISFYHGEILNEATEHNLELAPYQNLVAATENEAYNALVCNEFAHEIGRDSVFQLGESADGDDRHALPASLRGRALFESGFGVEDVSERQRQGWVFRKTRLSEEFDFEKMQEKLPNAANMLLLVRDNGTIRFFTHAAKPEPRAGDVILSFSPPQTKTAGKMAAKKAGKKQGVQPT

SEQ ID NO: 21166 - protein, 456 aa, Xanthomonas campestris pv. vesicatoria str. 85-10
MAIHSSVLELIGNTPIVKAQRLDTGVCELFLKLEANNPGGSIKDRIGLSMIEAAEQRGDLKPGATLVEGTAGNTGLGLALVAQQKGYQLILVVPDKMSREKIFNLKAMGANVVLTRSDVAKGHPEYYQDLAARIAAETPGAYFINQFGNPDNPAAHEFGTGPEILAQMGGQLDAIVFGCGSSGTMTGLSRAFASASSHTELVLADPVGSILTQYIEEGTVSEKSGSWLVEGIGEDFLPDISDFSRVKKAYSISDAESFHTARELLAKEGILGGSSTGTLLAAALKYCREQTTPKRVLVFVCDTGNKYLSKMYNDYWMLDNGFLERPQHGDLRDLILRPYNKRDTVVVGPKDLLTTAYQRMKLYDVSQLPVIDEGELVGIVDESDVLLHVYGDEARFRDPISTAMVSKLDRLDVASPIEALLPVFDRGQVAIVMDGTQFLGLITRIDLLNYLRRRVQ

SEQ ID NO: 21167 - protein, 476 aa, Solanum lycopersicum
FYNFSKKLQGMAKTNGFMGHDMLAPFTAAWMIDMGPLVIDKAEGSYVYDVNGKKYLDSLSGLWCSVLGGSEPRLIEAANKQLNKLAFYHSFWNRTTKPSLDLAKELINMFTANKMGKVFFTSSGSEANDTQVKLVWYYNNAIGRPNKKKIISRKNAYHGSTYMTAGLSGLPSLHLKFDLPPPYILHTDCPHYWNYHLPGETEEEYSTRLANNLENLILKEGPETVAAFIAEPVMGGAGVIIPPATYFEKIQAVLKKYDILFIADEVICGFGRLGTMFGCDKYNIKPDLVSIAKALSGGYIPIGAVLVSEEISKVIMSQSNQLGVFCHGFTYSGHPVACAVALEALKIYKEKNITEVVNKLSPKFQEGLKAFIDSPIIGEIRGTGLVLSTEFVDNKSPNDPFPPEWGVGTYFGSQCQKHGMLVSFSGDHVNMAPPFTLSLEELDEMISIYGKALKDTEKKKKKKKKKKKKKKKKKKK

SEQ ID NO: 21168 - protein, 711 aa, Haemophilus influenzae R2866
MSRTIILIPVSTGVGLTSISLGLIHSLEQKGAKVAFMKPVSQPSTGEDKLDRTTSIIRTSTSLETAEPFMLSVAESLIGQNQSDVLLEKIVANHQQLTKNNDIVVVEGLIPTRKHGYANSINYEIAQALDAEIVLVAAPATETPTELKDRVEAAASLFGGKNNPNLLGVVVNKFNAPVDESGRTRPDLAEIFDSFQHNHISETEVNKLFAGSAIKLLACVPWNANLIATRAIDLVKHLGASIINEGEINRRIRGITFCARSLPNMVEHFRAGSLLVASADRPDVLVAAALAASNGIEIGGLLLTGGYKIDAQINKLCRPTFEKAKLPIFRIEGNTWQTALSLQSFNLEVPVDDKERIENIKQYISQHFNADFINNLVADSSRLPRLSPPAFRFQLTELARAAKKRIVLPEGDEPRTIKAAVLCAERGIAECVLLADPASVQRVAEAQGVKLGKGITIINPADVRENYVDRLVELRKAKGMTETAAREQLEDTVVLGTMMLEANEVDGLVSGAVHTTANTIRPPMQIIKTAPGSSIVSSIFFMLLPDQVLVYGDCAVNPDPTAEQLAEIAIQSADSAKAFGIDPKVAMISYSTGTSGSGADVEKVKEATRIAKEKRPDLLIDGPLQYDAAVMEDVARSKAPNSPVAGKATVFVFPDLNTGNTTYKAVQRSADLVSIGPMLQGMRKPVNDLSRGALVDDIVYTIALTAIQATQ

SEQ ID NO: 21169 - protein, 444 aa, x Doritaenopsis sp.
MSKMFGKEVPLSKMAVSKAHGEGSPYFAGWKAYEENRYDAVGNPDGVIQMGLAENQLSFDLLEEYLELHPEAFSWASDSSSFRENALFQDYHGLQTLRQALASFMEKIRGGRSKFDANRIVLTAGATAANEILTFILADRGDALLVPTPYYPGFLRDLQWRTGVTIFPVHCYSSNGFQLTLSSLEKAYAEAKASNFNVRGLLMTNPCNPLGTSASLSLLQDIIHFISDKTIHLISDEIYSGSVFSSTNLFSISDLITDAISEQVHIVYSLSKDLGLPGFRVGALYSYNDRVVKTARRMSSFSLVSSQTQRLLSFMLSDEEFTVRYIEKNRERLRERYELVVNGLKEAGIECLKGEAGLFCWVNMEKLMEEETKEGEAEPWKVIIDDLKLNISPGSSCCCAEPGWFRLCFANMSRETLEGVKRLKDFAQKKVAAKKKKMNNVYFC

SEQ ID NO: 21170 - protein, 306 aa, Pseudomonas putida GB-1
MSARHFLSLLDFTTDELLGVIRRGIELKDLRKRGVLFEPLKNRVLGMIFEKSSTRTRVSFEAGMIQLGGQAIFLSPRDTQLGRGEPIGDSAIVLSSMLDVVMIRTHAHSTLTEFAAKSRVPVINGLSDESHPCQLLADMQTFLEHRGSIQGKTVTWIGDGFNMCNSYIEAARQFDFQLRIACPEGYEPDQRFMALGGDRVQIIRDVKQAVRDAHLVVTDVWTSMGQEEETARRLAHFAPYQVTRELLDLAAPDVLFMHCLPAHRGEEISQDLLDDPRSVAWDEAENRLHAQKALLEFLVEPAYHHA

SEQ ID NO: 21171 - protein, 211 aa, Pseudomonas fluorescens PfO-1
MFRNSYIQQNSDIQAAGGLVPMVVEQSARGERAYDIYSRLLKERVIFLVGPVEDYMANLICAQLLFLEAENPDKDIHLYINSPGGSVTAGMSIYDTMQFIKPNVSTTCIGQACSMGAFLLTAGAPGKRFCLPNSRVMIHQPLGGFQGQASDIEIHAKEILFIRERLNTLMAKHSGRTLEEIERDTNRDNFMSAEAAKEYGLIDEVINQRPA

SEQ ID NO: 21172 - protein, 195 aa, Staphylococcus epidermidis ATCC 12228
MILMIDNQDSFTYNLIDYIKVQTTEEVKIISVNDLMTQHLDALNPRAIVISPGPGKPSDYPILSSVLEIFHRHVPILGVCLGFQLIIEYFGGNIIHNDKPIHGHITKIRHSNEGIFKGLPSYFNVMRYHSLMADPSTIPSALKVTALNNENVIMAVAHHKYPIYGLQYHPESILSEYGHEQLNLFLTEVGVKYAH

SEQ ID NO: 21173 - protein, 176 aa, Glycine max
MDIDLSPQLPKKVYGANGGSYYAWSPSDLPMLHQGNIGAAKLALNKNAFALPRYSDSSKVAYVLQGSGVAGIVLPESEEKVVAIKKGDALALPFGVVTWWYNKEETELVVLFLGDTSKAHKAGEFTDFFLTGSNGIFTGFSTDPKPEHRNGMALNCEEAPLDVDIKGGGRVVVLNT

SEQ ID NO: 21174 - protein, 298 aa, Crocosphaera watsonii WH 8501
MKQLSSLSSAQLSNWLMEASQEAKKGKLADYIPLLQRTDSSLLFICVVTKNNIFLTQGDSKITFSLMSIIKPFLLLYLLSELGDNFIFTKVGSEHSNYPFNSLDQLQLDQGFPRNPMINSGALTLASLLPGKDSHTRLNNLQEWLNKQSNANLFLDKLMLKSVESLPNLRNQSIIDNLTQRKHLKEPEITLDTYNKICCLSATIIDLAKLGLLLVNSPNISSKNVSIVTEIMTTCGLYEASENFAKKIGFPSKSGVSGAILSIVPKEGAIACYSPPLDAQGNSLGGLYMLQKIANYLN

SEQ ID NO: 21175 - protein, 462 aa, Xanthomonas campestris pv. vesicatoria str. 85-10
MSFESLGLAPFLLRALAEQGYETPTPIQQQAIPLVLAGHDLLAGAQTGTGKTAAFGLPLLQHLGTAPQTVNGPRKPRALILTPTRELATQVHDSLRGYSKYLRIPSAVIYGGVGMGNQLDALRRGVDLLIACPGRLIDHIERRSVDLSGIEVLILDEADRMLDMGFLPSIKRILTKLPRQDRQTLLFSATFEENIKQLALEFMRNPMQIQVTPSNTVAESITHRVHPVDGARKRDLLLHLLAQDSREQTLVFARTKHGSDKLALFLEKSGIKTAAIHGNKSQGQRMRALSDFKAGRVTVLVATDIAARGIDIDQLPKVINYDLPMVAEDYVHRIGRTGRNGSTGEAISLVAQDEAKLLRQIVRMLGRDVEIRDVPGYEPQTPIRWGNSAPGRAEQPGGERAPRKSHARRPHGDAPRQAHAHAGPKKPGGQRSGGPRQANAGAGAGRRDGGRGGNGRPANRGA

SEQ ID NO: 21176 - protein, 1380 aa, Coprinopsis cinerea okayama7#130
MDADEIFAAMGITGFGKTSQKRELDPHRFDKTKRENKQEESSKSTSQKVQQAVAGPSRAGTSNQTESGDDEDEVGPRPPPSKQTSKQASQEASDDEEDEEADEDDSPLFPITHEIVLKDHTKVVSALALDPSGARIVTGAYDYDCKLWDFGGMTAECKPFKTWEAAGSYQINDLQFSNDGTRFLVIPATTQPRLYDRDGDEQAVFIKGDPYLRDMKNTSGHVAEVMSCAWHPKDPKTFITSSADSTIRIWDAENKRKQKTVIVVKSKDRGGRTKVSVCGYSRDGTYIAGVCTDGAMHLWESNSNFARPRMSIEGAHTKGTETGSMSFSIDGRTLMTRGGPGDDTVKLWDIRAFKKPLAVHNQLPTLYPRTNAVFSPDDKYILTGVGPRGQGQPGGLLFLKKENLEVVKNLTVDSTPVRVAWHSKINQIITGLSNGKVVVLYSPETSLNGAKLVMSKGPSRKANVEDLSDALAAPTILTPHALPMFRDMDPGRGTKRKREKDRMDPRKSRRPELPVTGPGKGGRVGASATQHIVQHLVRDTTRDIDPREALLKYAEAAEKDPQWTAETGHAVPNGVHDAINGDKPAELIVKPDVNGVSQQKLNGAAHTDFSPAADSPATPVSSGPAPDVKIDLDYQEQESDVRNEPMQIKSMDDAFNKPEPQVPVVSQLPLPVDQTSVPSAPQDIKMDDQPTQSNSNDTNDAQPAHTNGDVDMKDDHDYAPPPPLSTDASMATSDRQSPVPYTPRERPGPGEEEDGQPPAKRPRVHSDADKASMTHSATPPPASAAVSNAASPIPPAPPSTAPAHNSVAPAPSTSTAVPRSPGTSTMSLAQWKYCGSCIRSLKKLKDSIPFLKPVDPVQLNIPHYPSIIKHPMDFSTIERKLNSSNPVKPDPNPDNPRYLTVEDFVSDVRLVFTNCLTFNGPDHVVTQMGKRVEQVFDKHLKGMPAAEPKHAPPPKKATPPPPPPVSAPPVVKKAPPPRRPSTSFPAPRRNDVPEPLARPKREIHPPPPKDLPYEHKVNRKPKRVVDESMAEQFKFCSKLLNDLFKKQYYNIAHPFYEPVDWVRMEIPSYPKIIKKPMDMSTMRKKLDNGEYATPQKFAEDFRLMLRNCSTFNPVGTPVCTAGQQLGRVFEEKWKALPPLRPTHVSDDDDDDDDADDSEAERQRAIALMEAQIETMKGNLEALKNAARNKERKKKKKEKKEREPPPPPPPVKAAPKPAKAPKKKSSSSKKAIADDDVLTFEQKKDLSETIGKLEGAKLEKVINIIHEGVPEIRDSTEEIELEIDLLPASVLTKLYNFVIRPLKQPPVKRNRPGKGTGTGGLKRKSMDEDVEAEKIRQLEQRMALFDNPSVSAPPAPLRRADDSDHSSDSSSGSDSSGSDSE

SEQ ID NO: 21177 - protein, 446 aa, Mesorhizobium sp. BNC1
MKVTVFGVGHVGLVQAAALAEVGNDVLCIDVDEKKVEQLQHGVIPIYEPGLERLVNENCAAGRLHFTTDAAAGINHGKVIIIAVGTPPEEDGSADLKHVLAVASTIGQNMAADKVIISKSTVPVGTCDRIRETISAALSDRGLERIAFHVVSNPEFLKEGSAVSDCMKPDRIIVGTNSPEAEAVMRELYAPFNRNHEKMILMDVRSAELTKYAANCMLATKISFMNEMANIAHRLGADIEQVRLGIGSDPRIGYDFIYPGIGYGGSCFPKDVRALIRTAEQAELEPKILRAVSDRNERQKWVLFERIRDYFGRDLSGRVIALWGLAYKPNTNDMREAPSRVLMEALWDAGAQVQAYDPHAMGECRKIYGERQGLTFCETKEATLEGADALAIATEWKSFRAPDFALIRRKLKAPVIFDGRNLYDPRMVARYGLEYCSIGRTTGNAS

SEQ ID NO: 21178 - protein, 159 aa, Staphylococcus aureus subsp. aureus MW2
MKITILAVGKLKEKYWKQAIAEYEKRLGPYTKIDIIEVTDEKAPENMSDKEIEQVKEKEGQRILAKIKPQSTVITLEIQGKMLSSEGLAQELNQRMTQGQSDFVFVIGGSNGLHKDVLQRSNYALSFSKMTFPHQMMRVVLIEQVYRAFKIMRGEAYHK

SEQ ID NO: 21179 - protein, 447 aa, Mesorhizobium sp. BNC1
MDTSVVSAENIKIRIESRAATAGIIGLGYVGLPLAVAAAKAGYAVLGFDVDQSKVEALNAGNSYIEAVPEPSLREQVAVGRFEATADFARLASCDVVVICVPTPLTKQREPDLSFVEQTASAIARNRKPGALIILESTTWPWTTETVVKNILEADGTKSGRDFFLGFSPEREDPGNASFRTVTIPKIVSGDGADAQALVEAFYGNVVERIVPVSSPRVAEAVKITENIFRAVNIALVNELKIIYDAMDIDVWEVIDAAATKPFGFMPFYPGPGLGGHCIPIDPFYLTWKAREYNVPTRFIELAGEINVAMPRYVISRLEVALDKSFAKSLSASKVLILGLAYKKNVPDIRESPAFAIMDMLKARGTTFDYHDPHVPSIPRTREHEQYYGQRSVGLDAATISSYDAVVLVTDHDDVDYGLVAAKAKLVLDTRNALGKRGFSGETVVKA

SEQ ID NO: 21180 - protein, 492 aa, Burkholderia xenovorans LB400
MKQYKNFINGRFVESDKRFAGINPATGVRFADVHEATREMVDEAVSAGHRAVRGWGSASVSDRADMLYRIADEIDRRADDFLTAEVSDTGKPVSLASKLDIPRGAANFRIFADILKTAPLDTFRTDLPGGSHAINYAVRKPLGVVGIISPWNLPLLLFSWKVAPALACGNAVVAKPSEETPGTATLLAEVMQTVGLPAGAFNLVHGFGPNSAGEFITTHPGINAITFTGESKTGTAIMHAAAEGVKPVSFELGGKNAAIIFADCDFDKTVAGMTRAAFLNSGQVCLCSERIFVERPIYDRFVKALAERAKQIKLGDPTDEATCMGPVISAAHRDKVLSYYALAREEGAEFITGGGTPSFGNQLDGGFWVEPTLLAGLPDDARCVTEEIFGPIGHVTPFDSEAEVIQRANATPYGLAATIWTSNVNKAHRVAQSMNVGVAWVNAWFLRDLRTPFGGSGLSGIGREGGLHSLNFYSELTNVCIHVDAPDGSHDR

SEQ ID NO: 21181 - protein, 385 aa, Ipomoea batatas
KIFVLTQFNSASLNRHISRTYFGNGVSFGDGFVEVLAATQTQGETGMKWFQGTADAVRQFTWVFEGAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLFRLLRWRYPTSNDFGSEILPAAVMEHNVQAYIFRDYWEDIGTIKSFYDANLALTEEFPKFEFYDPKIPFYTSPRFLPPTKIDNCKIKDAIISHGCFLRECTVEHSIIGERSRLDCGVELKDTLMMGADTYETESEIASLLADGKVPIGVGENTKIRNAIIDKNVRIGKDVVITNKDGVQESDRPDEGFYIRSGITIIMEKATIRYGTVI

SEQ ID NO: 21182 - protein, 315 aa, Ostreococcus tauri
MSTFTDLALSVERRVDGAIEKVWSEILERFHPFVIAGPLTFAYHELVYFGAWMPWLAMDRFEYFQKWKIQREKRPSAEMVMKCVVKLLKSHVFVQLPMQMMFYFVAPYFGFSLALEALPKSRDFLWQIPVFFVIEDFYFYWIHRFLHHKRVYKYVHKVHHEHKYPFGIAAEYAHPVETFFLGIGTLLGPLFFAKHMVTLWVWLFFRLLETVEDHSGYDVPWNPTNLIPFWGGAVHHDFHHKTFEGPYSSVFTWCDWMFGTDKEFRAHQPSFEVVRSRGRTRRCSEGHQTTRPWLRRAPPQKSSTSLVFFQLKESR

SEQ ID NO: 21183 - protein, 170 aa, Oryza sativa Japonica Group
MAQREKKVEEPTELRAPEMTLCANSCGFPGNPATNNLCQNCFLAASASSSSSSAAASPSTTSLPVFPVVEKPRQAVQSSAAAAVALVVERPTAGPVESSSKASRSSSVNRCHSCRRRVGLTGFRCRCGELYCGAHRYSDRHDCSFDYKSAARDAIARENPVVRAAKIVRF

SEQ ID NO: 21184 - protein, 483 aa, Pseudomonas fluorescens
MIPVILSGGSGSRLWPLSRKQFPKQFLALTGEHTLFQQTLERLVFEGMDTPIVVCNKDHRFIVNEQLANRKLECQRILMEPFGRNTAPAVALTAMMLVNEGRDELMLVLPADHVIDDQKALQRALALATVAAERGEMVLFGVPATRPETGYGYIKSTNDSLLPEGVSRVQQFVEKPDEKRAVEFVKSGGYFWNSGMFLFRASRFLEELKKHDPDIYDTCVLTLERSEQTADTVTLDDATFACCPDNSIDYAVMEKTQRACVVPLSAGWSDVGCWASLWAVNDKDIHGNVSKGDVVIQDSRNCMIHGNGKLVSVIGLDNIVVVETKDAMMIAHKDKVQGVKQMVSTLNDQGRSETQNHCEVYRPWGSYDSVDMGGRFQVKHISVKPGACLSLQMHHHRAEHWIVVSGTAEVTCDENVFLLTENQSTYIPIASVHRLRNPGKIPLEIIEVQSGSYLGEDDIERFEDIYGRSTPVERGVSVKTIAQ

SEQ ID NO: 21185 - protein, 206 aa, Zea mays
MAPAVEAVKETGTFQKVPALNERILSSMSRRSVAAHPWHDLEIGIVIEIPRGSKVKYELDKKTGLIKVDRVLYSSVVYPHNYGFIPRTLCEDSDPLDVLVIMQEPVIPGCFLRAKAIGLMPMIDQGEADDKIIAVCADDPEYRHYNDIKELPPHRLAEIRRFFEDYKKNENKEVAVNDFLPASAAYEAIQHSMDLYATYIVEGLRR

SEQ ID NO: 21186 - protein, 386 aa, Salinibacter ruber DSM 13855
MTHASSSPTRDPAKLVLSDGTVARGVALGQRGLTGGELCFNTSMTGYQEIMTDPSYYGQLMMMTQPHIGNYGASAEDMEADTPMVAGFIVRDYPRRHANTQADETLEAFMRRHGLVGIAGVDTRALVRHVRDKGVMNAVISSEALEEETLLQKARDWPSMAGRKLASEVSTDGPYTFCEGPGPRIAVYDFGVKQNILRSFRRRGCTVRVVPGDTDLSEVRAWDPDGLFFSNGPGDPRPMSDAIETVGEAIDTGLPIFGICLGHQLMSLAEGIGVYKMHVGHRGANHPVKNLDTGQVEVTTQNHGFAVDPESIAPETARVTHVNLNDDTIEGLEFKTFAGMSLQYHPEASPGPHDSHYHFNRFMELVAEERDVTLPAAATEPAVATA

SEQ ID NO: 21187 - protein, 317 aa, Salinibacter ruber DSM 13855
MSTAPASPSASTAAPAASSLVDDIGRTPLLRLDRVADDLPDSVAVYGKAEHLNPGGSVKDRPALRMIEAGLDAGAFRPEQTLIDATSGNTGIAYAMIGAAKGLDVALALPENASAERKKVLRAYGAELILTDPMAGTDGAQRRVKEIVDAHPDRYFYPDQYNNDANWRAHYDGTGTEILDQTDGAVSHFVTGLGTTGTFTGVTRRLKAHDASIRCVAVEPETALHGLEGLKHMETAIVPGIYAPDLADAHRTCSTEAAVDMTRRLAREEGLLVGPSAGANVAAALDVARSLDAGTVVTILCDTGTRYLSDDFWEEES

SEQ ID NO: 21188 - protein, 676 aa, Triticum aestivum
MDRARNFIPGPNQELLDIKPIRSLAPMFPAPMGVNINQSSTPPLVCVTPVGQFPTGFGGGNLPAFGSFATFSATANGFSQAGTSANGAIDATPISAYKTRSSGATALNGDDEPYSGNQTSASGRKAKKRSAGLSADGSDGVKAKRPKPVYKNLVAGKELAFLPASPNNPREIVEAVHMTFEALRRRHLQMDETQDASRRADLKAGAIMMASNIRANVGKRVGTAPGVEIGDIFYPRMELCIIGLHAPSMGGIDYMSAKFGADEDSVAICIVAAGGYENEDDDTDTLVYSGSGGNSRNTEERHDQKLERGNLALERSMHRKNEIRVVRGFKDPAMVAGKIYIYDGLYKIQESWTERTKFGVNCFKYRLQREPGQRDGAAIWKMTQRWIQDPSTRGRVILRDLSSGIESIPVCLVNEVDHEKGPGQFTYTNQVKYLRPVSSMTPMQGCGCQSVCLPGDANCACGQHNGGDLPYSSSGVLVCRKPIVYECGEACHCTLNCRNRVSQKGIRFHFEVFRTANRGWGLRCWEPIRAGAFICEYTGEVIDELKVNLDDSEDDYIFQTVCPGEKTLKWNFGPELIGEQSTYVSAEEFQPLPIKISAKKMGNVSRFMNHSCSPNVFWQPVQYNHGDDKHPHIMFFALNHIAPMTELTYDYGVVGEETSHRAKTCLCGSLTCRGLF

SEQ ID NO: 21189 - protein, 163 aa, Glycine max
  misc_feature (87)..(87): Xaa can be any naturally occurring amino acid
  misc_feature (149)..(149): Xaa can be any naturally occurring amino acid
HAGAGMGAPFTGLKSMVGFLTRKTNNDITFIDSNGGRMQCMQVWTRVGMKKLDTLSYLPDLDDAQWAKEVQYLLRKGWIPCLECKLXHGFVYREHNRSPGYYDGRYWIMWKLPMIGCTDASQVTKELQDAKTAYTNGLIPIFGFDNVRXVQSIIFVVYKPPSF

SEQ ID NO: 21190 - protein, 334 aa, Haemophilus influenzae R2866
MKTLSEFIVERQAEYPNAKGELSGILSSIRLLAKIIHRDINKAGLTNILGQSGIENVQGESQMKLDLFAHNTMKAALMAREEVAGFASEEEESFIAFDTERGRNAKYIILTDPLDGSSNIDVNVSVGTIFSIYRRVSPIGSPVTLEDFMQPGNKQVAAGYIVYGSSTMLVYTTGHGVNGFTYDPSIGTFCLSHENMQMPKEGKIYSINEGQYLKFPQGVKKYIKYCQEEDKATHRPYVSRYIGSLVADFHRNLLKGGIYIYPSATNYPNGKLRLLYEGNPIAFLAEQAGGVATDGYRRILDIQPTELHQRVPLFVGSEDMVKKAQEMMEEFKEE

SEQ ID NO: 21191 - protein, 277 aa, Saccharophagus degradans 2-40
MTKLTVAALIHYPVKSLAGIALTSAEITSKGIKGDREWMVVKQNGKMLTQRQAPKMVTIQPKLSDRGLELHANGLDPILVEEPTHEDALSVSIHGDKCEGYPASAAVNEWLTQAIGWETPLTLVKYTKQTARTPGSPERFGHDATYFADAAPFLIANTASLAALNSSLSEQQLPNVDMRHFRPNIVLQGLPAFAEHELPALSIGDKTFKLVDHCQRCVMITVNPDTGENLAKAIPFKQLAELNPMPNNAKAPAFGVNAILHSEISAFTIQVGDIVAV

SEQ ID NO: 21192 - protein, 249 aa, Glycine max
MKFNIANPTTGCQKKLEIDDDLKLRAFWDKRISQEVVGDALGEEFKGYVFKITGGCDKQGFPMKQGVLTPGRVRLLLHRGTPCFRGYGRRNGERRRKSVRGCIVSPDLSVLNLVIVKKGESDLPGLTDVEKPRMRGPKRASKIRKLFNLSKEDDVRKYVNTYRRTFTTKNGKKVSKAPKIQRLVTPLTLQRKRARIADKKKRIAKAKSEAAEYQKLLASRLKEQRDRRSESLAKRRSKLSSAAKQAATA

SEQ ID NO: 21193 - protein, 438 aa, Pseudomonas syringae pv. syringae
MRISIFGLGYVGAVCAGCLSARGHEVVGVDISSTKIDLINNGKSPIVEPGLEELLQKGISTGKLRGTTDFAEAIRATDLSMICVGTPSKKNGDLELDYIESVCREIGYVLRDKATRHTIVVRSTVLPGTVANVVIPILEDCSGKKAGVDFGVAVNPEFLRESTAIKDYDLPPMTVIGEFDKASGDVLQSLYEELDAPIIRKDIAVAEMIKYTCNVWHATKVTFANEIGNIAKAVGVDGREVMDVVCQDKALNLSQYYMRPGFAFGGSCLPKDVRALTYRAGSLDVEAPLLNSLMRSNTSQVQNAFDMVASYDARKVALLGLSFKAGTDDLRESPLVELAEMLIGKGFDLSIFDSNVEYARVHGANKDYIESKIPHVSSLLNSDFDQVINDSDVIILGNRDERFRALANKTPEGKRVIDLVGFMANATSEDGRAEGICW

SEQ ID NO: 21194 - protein, 370 aa, Legionella pneumophila subsp. pneumophila str. Philadelphia 1
MNIFNLPDLGEGLPDAEIHEWFVKEGDTVKADQPLVSMETAKAVVDVPCPQSGTIAKLYGKPGDVIKTGEPLVAFVSTTEKPADKGTVVGNLEESTDVSEDNFIIGSQRSSHRVKTTPAVRLLAKKLGVDLSSLKGSGDNGVITREDVQNQANINSQPPAGFEHLRGVRRAMLNSMVQSHAEIVPVSIFDEADIHIWKPNTDITVRLIRAIIHASKKEPALNAWFDTKHAARRCFKEVHLGIAMDNEEGLFVPVIHDAEKYSDSELRKIIDEFKESVRNRAVSADKLKGATITLSNFGKFSGRFASPIIVPPMVAILAVGRLYKAAVINDEDKIEAHKMLPLSLSFDHRAITGGEATRFLGAVIESLQQA

SEQ ID NO: 21195 - protein, 714 aa, Legionella pneumophila subsp. pneumophila str. Philadelphia 1
MIKKIHRWLPLLVLIGLLVLFFSLHLDKYLSFNALRENHALLIAWTQTHYFIAPLIFIVFYTTAVAISIPGAVLLTLTGGFLFGVFWGVLFVVISATLGATILFFAVRTALGDWFAQKASGWIERMRQGFQHNAFSYLVTLRLIPLFPFWAVNIVPALLNIRAKTFITATFIGIIPGTTVYVMVGNGLSQIFAANQTPNLGIIFELQILGPLLALAVLSLMPVLYQFSTRKHQNHHSFSDISRVINCDLAIIGGGAGGLSLASGCSQLGLKVVLVESGKMGGDCLNYGCIPSKSLLAAAKTFYYAKHATHFGVHTEAIKINFQQVMQHVHQIIDNISEHDSVQRFESLGVQVIKQVGKFLNPDTLQAGDSIIKAKRFVVATGSSPFIPPIPGLDAVSYFTNETIFDLKEQPEHLIVIGGGPIGCELAQAFAMLGSKVTLLEGLNLLPKDDPDCVAVLRTQMKSMSIVIHEQIEITQINSHPDTGISVCFEFQNTQFTITASHLLIATGRRANVKPLDLEKAGVKLTSKGVEVNKYLQTSNKKIYALGDVTGLYQFTHMASYQASIVLRNIVFKLPSKVDYRAIPWVTYTDPELAHVGIGVSDALKHPDAQIIEWPFVDNDRAQTERSLNGKIKIITDKKARILGVTIVGPHAGELILPWVMAIREKKNLRSFTDVIVPYPTLSEISKRVAGSFYAPKLFSNKTRMLVRWLQKIG

SEQ ID NO: 21196 - protein, 67 aa, Zea mays
MTTSRRLADRKISRFEKNITKRGSVPETAKKANDYPVGPILLGFFVFVVVGSSLFQIIKTASNAGLF

SEQ ID NO: 21197 - protein, 627 aa, Staphylococcus epidermidis ATCC 12228
MEAYKIEHLNKSYADKEIFNDLNLSISEHERIGLVGINGTGKSTLLKVIGGLDEDFTADITHPNQYRIRYSSQKQDLNGHMTVFEAVLSSDTPTLRIIKKYEEAVNRYALDQSDSNFNKMMEAQEEMDQKDAWDYNAEIKTILSKLGIHDTTKKIVELSGGQQKRVVLAKTLIEQPDLLLLDEPTNHLDFESIRWLINYVKQYPHTVLFVTHDRYFLNEVSTRIIELDRGKLKTYPGNYEDYIVMRAENELVEQKQQEKQKALYKQELAWMRAGAKARTTKQQARINRFNQLESDIKTQHTQDKGELNLAYSRLGKQVYELKNLSKSINNKVLFEDVTEIIQSGRRIGIVGPNGAGKTTLLNILSNEDQDYEGELKIGQTVKVAYFKQTEETLDRDIRVIDYLREESEMAKEKDGTSISVTQLLERFLFPSATHGKKVYKLSGGEQKRLYLLRLLVHKPNVLLLDEPTNDLDTETLTILEDYIDDFGGSVITVSHDRYFLNKVVQEYWFIHDGKIEKIIGSFEDYESFKKELERQAMLSKQTEQQNKHKHQPKKKTGLSYKEKLEYETIMTRIEMTETRLEDLEQEMINASDNYARIKELNEEKEQLEATYEADITRWSELEEIKEQ

SEQ ID NO: 21198 - protein, 332 aa, Zea mays
MDHRQDAGDGEEERQQQQQQQLGDLETDKEPVQKQGQLSPSSSWRAAAAASIRESLSRSLSSLSHQQEEKDDDEVELRWAAVGRLPTMDRLHTSLQLHAGQRQVVDVRRLGAAERRMVVDALVANIHRDNLRLLRKQRQRMDRVGVRPPTVEVRWRDVRVEAECQVVHGKPLPTIWNAVVSGLSRPRVRILHGVSGVAKPSRLTLLLGPPGCGKTTLLKALAGKLRATGLKVTGEIEYNGVELNNGFVPEKTAAYIDQYDLHVPEMTVRETIDFSARFQGVGNRAEIMKEVIRREKEAGITPDPDVDTYMKAISVEGLERSMQTDYIMKPSV

SEQ ID NO: 21199 - protein, 133 aa, Brassica napus
SLSKLNNPYIVECEDSWVDEDNNACIFTAYCEGGSMANAIKKARGKLFPEERIFKWLAQLLLAVNYLHSNRVLHMDLTCSNIFLPKHDHVQLGNYGLAKLINPEKPASLVPGIANSMCPEVLEDEPYGYKSDI

SEQ ID NO: 21200 - protein, 519 aa, Mesorhizobium sp. BNC1
MTITHPDTVLIIDFGSQVTQLIARRVREAGVYSEIAPFQSAEEAYLRLKPKAVILSGSPASTVEIDSPRAPDVIFQSGVPVLGICYGEQTMCAQLGGKVESSDHREFGRAFLEIEEDCGLFAGIWAPGTRHQVWMSHGDRVTALPPGFKVVGTSAGAPFAAIADDKRKYYGVQFHPEVVHTPDGAKLLANFVHRIAGLKGDWTMAAYREQAVDAIRAQVGSGKVICALSGGVDSSVAALLTHEAVGEQLTCILVDHGLMRKNEAAEVVSMFREHYNVPLVLVDASDRFLSALEGETDPEKKRKTIGRLFIEVFEDEAKKLGGADFLVQGTLYPDVIESVSFTGGPSVTIKSHHNVGGLPERMNMKLVEPLRELFKDEVRVLGRKLGLPDHFIGRHPFPGPGLAIRCPGGITREKLEILRAADAIYLDEIRKSGLYDAIWQAFAVLLPVQTVGVMGDGRTYEYVCALRAVTSVDGMTADFYHFDMEFLGRAATRIINEVRGINRVVYDVTSKPPGTIEWE

SEQ ID NO: 21201 - protein, 420 aa, Aspergillus oryzae
MASAGAGLSKRGASNVDAIMPGIRAALLERTRPTVPRIDLSTAENWLLRNEVIELTKDAIRDGLKPHHLSYPNEFAGDADLIKALAAFVNEYFHPHIPVEPDHIATAPGAATCLNTFLYNLCEPGEGILVPAPFWNGFDWLFTARSSAVPVMVHVERSADTLTAKLIPALEKAYEESKIPIRGLLLTNPQNPYGQCYPRSVMEDCIRFCHSKGIHYISDEVYALSNFENPELPDAPPFVSALQIDVKGIGCDLSRVHTFWSTSKDFGSSGFRVGCSITQANEAMHVALALASNTESSSLSAVASTALLTSPRLPELLQLNAQRLQEAYCLMTNFLKKHQIEYIPANSAPFLFARVAPQAQTWEDEKAVIAQLKEAGVNVSGGKAYHVNEDQKGWARLTFALETSRAEEAIKRMETVLGKQ

SEQ ID NO: 21202 - protein, 360 aa, Oryza sativa
MAQPQRPLQVPDITKSTHSGGNTVLAYASSAMQGYRSTMEDAHATIENLDAPTNTSFFGVYDGHGGSAVARYCANHLHNKVLEQEDFSSNLANALRQSFFRMDEMLRNQAASKELTEYGSGNEYWRTAGRSWLRCAPCVQGPVYCGPLAEGCTACVVLIRNTQIVVGNAGDARCVISRNGQAIALSNDHKPNFPEETQRIVAAGGSVSFSRGSHRVNNGIAVSRAIGIAYMFVGGDLSYKNNKKLRPEQQLLTCSPEIRADQLTDDTEFLVIACDGVWDVLANQAVVDFVRLHLNNGVELSVICESLLQEAITRDPPSTDNMSVILVRFLHPEGNRGARAATSSTSTGTVPSRHSKSISL

SEQ ID NO: 21203 - protein, 1024 aa, Microcystis aeruginosa PCC 7806
MKPDWDHFFNEDLEQLLESLEDKDTDGDETLDELSFLFEQTSPPAARYGASLDQTLSFLPLEPELAELFSDSINWEETATNDLHSTRGTDPKSEPEDGDDLESLLLENATVQDSEAIITISNPNFYDSLEDLEAFLEKPTPPAQSPLPDIFESLEVLLSESTAGKPVAATEPLQRLESLEITLESSPEPEFKDLEKLLEETNPPVGLNNLRPLVGKAFEQTMRVPIKQLDNLSNLIGELVVKRNRLEQEQDRLRLFLDNLLNQVQHLSDVGVRMQDLYERSLLEGALLASRNTGGAIGYGGVQGKNQGNSAMTGELDALEIDRFTDFHLLSQEMIELIVRVRESASDLQFVLDETDQVTRSLRQATTQLQEGMTKSRMVPFSQTADHLPRAIHDISLKLHKQAKLKVEGGGVLIDQMILENLNSPMIHLVNNAITHGIESPEERLAKGKPVHGTISVRAFLQGNQTVITVSDDGAGIDVNLVKLKAIEKGLISDREAQNLSTQEVYEILFHPGFSTKDQADDFAGRGVGLDVVRTSLIDVRGTITIDSVLGQGTTFTLRLPLTLSICKALCCVSNHARIGFSMDGVEDVRDFRARDIQMDRGGRRCVFWQNTLLPFQPLSDLLSYNRQLSRGSFYTGKQGEDSFAIVILRGGNNLLAVQVDRVIGEQEIVIKQIEGPIPKTAGIAGATVLGDGTVMPVGDVLELIDIASGRLRIDNGGLWRQSVPPIDVEISQKSEAMVLIVDDSITVRELLSLSFSKTGYRVEQARDGQEAWEKLRGGLPCDIVFCDIEMPRMNGLELLSNLQKYPRLAAIPVALLTSRGSERHRQVAAKLGASGYFTKPYTEIDLLSAAERMIAGEVLLANSIKATSNQLSSSDTTIIDSDSANLLAQSSPLVLIVDDSLIVREMLAISLVKAGYRIEQAQDGLEAWEKLQAGLACDLILCDIEMPRLNGLELLSRLQEDEQLQGIPVAIIAYQGTQKMQHLAAAKGAKGYFVKPYIEDVLLSAAPRLIAGEVLIQKENSLD

SEQ ID NO: 21204 - protein, 1340 aa, Oryza sativa Indica Group
MGLRSPNSMLWLVLLVWAALLCGSCHGRFVVEKNSLKVTSPSDMKGTYECAIGNFGVPQYGGTMVGVVAYPKANKKACKSFDDFDISYKAKPGSLPTFLLVDRGDCFFTKKAWNAQNAGAAAILVADDKTEPLITMDTPEENGNTDYLENITIPSALITKSFGDKLKKAIDNGDMVNVNLDWRESLPHPDERVEYEFWTNSNDECGPKCDSQIDFVKSFKGAAQVLEKKGYTQFTPHYITWYCPDSFILSKQCKSQCINHGRYCAPDPEQDFSKGYDGKDVVVQNLRQVCVYKVAKEHGKPWLWWDYVTDFAIRCPMKEKKYTKECADGVIKSLGLDHKAIDKCIGDPDADKENPVLKAEQDAQIGKGSRGDVTILPTLVINNRQYRGKLDKGAVLKAICAGFRETTEPAVCLSEDIQTNECLENNGGCWQDKAANISACKDTFRGRVCECPVVKGVKFVGDGYTHCEASGSGRCEINNGGCWKDSRHGRTYSACTLQFKSIFMLFLMYRMMVVNVRMGSKVMESTNAKAKMQQQRGTWIQRSAPSWPSTCPWTTKEMFPIILTISSYEKSEDSMQLPPMLPKWDEKSFSWFLRKKKNQAFHTCWWKRMPFTSINWLRDRLFTSIRRRRRRRALAPLAPTAIAMPSCFTLDSASDDGRSTAQGQGWCAGVGGFLSSFFSAGAARADGGKPSPDWDAHGLAASALPVPLSRLDGKKRYKVSELTFLDRRTRAATEDPLFDALRPGGVYTRAQLRDELDALAASGMFDHVTFQTKPKPDGTLGLTVSYAETQWPAVEHLKCINVGGLMARPDGDELEPDDDMTARERMEHLRRQEREYRQLVRRAKPCVLPEKLQRELQGMVKKQRKVSSGLLKRMAGRIERWYHDEGFQCAQVVGYNGNLDAGEVLRPGHIYNNGAGKQALKNIDSLGLFSTVEVEPRPDETNQGGVIVAIKLKEHDPKSAQVITDWSIVSGSQGTPTLASIQPGGTVSFEHHNICGLKRSPIGSVTTSNLLNPEDDLSFKLEYAHPYLDGVDNRSRNRTFKISCFNSRKLSPIFVAGPNMYEAPPIWVDRIGFKANITESFTKQSKFTYGLVVEEITTRDENNNICTHGSRQLPSSALSMIGPPTTLSGTGVDRMAFLQANITRDNTEFVNGATIGDRCIFQYSEQSFLVGYRWIKASVLEARTLFNRHQLTVTKFINLNKQEKGPRKPPPAVLALHGRYAGCVGDLPSYDAFALGGPHSVRGYGMGELGASRNLLEVATELSVPITVKNRHTQVYAFAEHGTDLGSSKDVKGNPTEFFRRVGHGSSYGVGVKLGAVRAEYAVDHNTGTGAFFLRFGERF

SEQ ID NO: 21205 - protein, 390 aa, Wolbachia endosymbiont of Drosophila ananassae
MSKIIEIRAPKTLGGESVTEGIVKIKKGIGEAVKVDDLIFEIETDKTALELTAEASGQITEFLVKEDDVISPDQLLAKLSVGEVKEEAKKEDKSESAAKKDAPSARKIMEENAISAESVKGTGMGGRITKADVIGHMNKAEQPAIKQYELPKSVVNGEQREERVKMSKIRQVIAARLKASQNTAAILTTFNEIDMKNVMDLRTKYKDAFEKKYGIKLGFMSFFIKAAVQALKEIPEINAEISGDEIIYKHYYDIGVAVGTDKGLVVPVIRSADQMSFAEIELTLVALGKKAREGKLQVSEMEGATFTISNGGVYGSLLSTPIINPPQSGILGMHSIQNRPVAVGNAVEIRPMMYIALSYDHRIVDGKGAVTFLVKIKNYIEDPNRLVLEV

SEQ ID NO: 21206 - protein, 189 aa, Glycine max
  misc_feature (34)..(34): Xaa can be any naturally occurring amino acid
  misc_feature (46)..(46): Xaa can be any naturally occurring amino acid
  misc_feature (55)..(55): Xaa can be any naturally occurring amino acid
  misc_feature (68)..(68): Xaa can be any naturally occurring amino acid
  misc_feature (71)..(71): Xaa can be any naturally occurring amino acid
  misc_feature (85)..(85): Xaa can be any naturally occurring amino acid
  misc_feature (125)..(125): Xaa can be any naturally occurring amino acid
TRPPRFPLNPSALLLAKKQATNMSVGALKEGDLXGKRAFVRVDLNXPLADNLNIXDDTRLRAAVPTIXFLXTGHGATVILSSPLXRPKRGTPNYSEKPLVPMLAQLLQIEGTTANDSIAEETEKXVAQLPKRRAWLLENVRLYKEEEKIDPVFAKKEAALAELYVNDAFSTDHTAHALTEGVAKHLKPS

SEQ ID NO: 21207 - protein, 398 aa, Pyrococcus furiosus DSM 3638
MIRASKRALSVEYAIRDVVLPARELEKKGIKVIRLNIGDPVKFDFQPPEHMKEAYCKAIKEGHNYYGDSEGLPELRKAIVEREKRKNGVDITPDDVRVTAAVTEALQLIFGALLDPGDEILVPGPSYPPYTGLVKFYGGKPVEYRTIEEEDWQPDIDDIRKKITDRTKAIAVINPNNPTGALYDKKTLEEILNIAGEYEIPVISDEIYDLMTYEGEHISPGSLTKDVPVIVMNGLSKVYFATGWRLGYMYFVDPENKLSEVREAIDRLARIRLCPNTPAQFAAIAGLTGPMDYLKEYMKKLKERRDYIYKRLNEIPGISTTKPQGAFYIFPKIEVGPWKNDKEFVLDVLHNAHVLFVHGSGFGEYGAGHFRAVFLPPIEILEEAMDRFEKFMKERLKE

SEQ ID NO: 21208 - protein, 270 aa, Vitis vinifera
MAKKPVKYSVVDAFTDSAFKGNPAAVCLEMRIGCRPWLWSSMSLKLALDSFRLRWFTPVAEVKLCGHATLAAAHLLFTSSLMKGNMIEFITLSGVLTARKYENGEAQEHFSVELDFPIVPMVEYNSAEVASISKALNGASVIDIKKTEKDDLFVVLPSGKTVVDIEPQFDDIQKLPGRGLIITGLAPPESEFDFFSRFFCPKLGIKEDPVCGSAHCSLAPYWSQKLGKCDLLAYPASPRSGIVDIHLDEQNQRVLLRGKAVTVMEGCVLV

SEQ ID NO: 21209 - protein, 328 aa, Salinibacter ruber DSM 13855
MRVLVTGGAGYIGSTVARQLVETGDDVIVLDNLSQGHRAAVPDDAAFVHGDLNDRGLIDRTLAEHRPEAIMHFASHTLVGESMEEPFLYLDENVRCGMNLMKSAVEHDVDRFILSSTANLFGTPERIPIDEDVTVDPGSPYGESKFILERTLHWLDETEDLSYAALRYFNAAGAAGPNQGEDHAPETHLIPIVLEVALGQRDKIVIFGDDYDTPDGTCVRDYVHVLDLAQAHVLALNALDDGSRVYNLGNGKGYSVREVIETARRVTGHEIPAEEGAPRPGDPPVLIASSDKIREELGWAPEHSALDDIIGSAWEWHRRHPNGYDGLQ

SEQ ID NO: 21210 - protein, 396 aa, Erythrobacter sp. SD-21
MSISPLMPVYPRCGVRPVKGEHCHLIDEDGTRYLDFASGIAVNLLGHSHPGLIGAIQRQAETLMHVSNLYGSPQGEDLAQRLVDKTFADTVFFTNSGAEAMECAIKTARAYHQHEDGDSNRTELITFTNAFHGRTMATISASNQEKMHKGFYPMLAGFQYAEFDNLESAKALVSDKTAGFLVEPIQGEGGIRPASDEFIHGLKALCDEHDLMLVFDEVQCGVARTGKLYAYEHYGIKPDIMASAKGLGGGFPVGACLATEKAARGMGFGTHGSTYGGNPLAMAAGVAVMEAVANDEFLAEVTEKGERLRSRLEQFIGNYPDLFDFVRGKGLMLGIRMKVESRPFFVHLRDNHQLLTVAAGDQTLRVLPPLVADNAEFDEFMDKLSAGAASFVPAAS

SEQ ID NO: 21211 - protein, 284 aa, Vitis vinifera
MAKKPVKFTVVDAFTDSAFKGNPAAVCLLEEERDEDWLQALAMEFNISETCYLNRITEPEALDSFRLRWFTPTTEVNLCGHATLAAAHFLFTSSLMKGNMIEFITLSGVLTARKYENGEAQEHFSVELDFPIVPMVEYNSAEVASISKALNGASVIDIKKTEGDDLFVVLPSGKTVVDIEPQFDDIQKLPGRGLIITGLAPPESEFDFFSRFFCPKLGIKEDPVCGSAHCSLAPYWSQKLGKCDLLAYAASPRSGRVDIHLDEQNQRVLLRGKAVTVMEGCVLV

SEQ ID NO: 21212 - protein, 321 aa, Erythrobacter sp. SD-21
MAGGGALDLAPAVRNLLDLSDAGGDAIAAMLADAQDRKAARRGWPKGQPDSDAPLAGHVLGMIFEKNSTRTRVSFDMGMRQLGGSALILDSGTSQLGRGESIADTARVLSRMVDAIMIRTDDHAKAEELAHHAHVPVINGLTDRSHPCQIAADLLTIVEHGKALPGLEVAWLGDGNNVLHSILEAAGIFKFNVRVGVPHGYEPESEFVDMARKGGATITLTRDAAEAARGADIIVTDTWISMGQDHAEAKLAAMQPFRVDSALMAFAKPDAKFLHCLPAHVGDEVTGGVFESAQSAVFDEAENRIHAQKSILLWCFGKIGA

SEQ ID NO: 21213 - protein, 295 aa, Vitis vinifera
MAKKPVKFTVVDAFTDSAFKGNPAAVCLLEEERDEDWLQALAMEFNFSESCYLNRITEPEALDSFRLRWFTPTTEVTLCGHATLAAAHFLFTSRLVNGNLIEFITLSGVLTARKVMQGNKSDALKYENGEAQEHFSIELDFPIVPMVEYNSAEVASISKALNGASVIDIKKTEGDDLFVVLSSGKTVVDIEPQFDDIQKLPAMGLIITGLAPPESEFDFFSRSFYPKLGIKEDPVGGGVHCSLAPYWSQKLGKCDLLAYVASPRGGIVDIHLDEQNQRVLLRGKAITVMEGCVLV

SEQ ID NO: 21214 - protein, 267 aa, Arabidopsis thaliana
NWGPLDACSSGRQCDGYLQNSPLSGPVRRDTTLLDSSNSDFEFHISSNFDPGDSSPADEIFADGMILPVLPFQVTATSTMPKRLYKYELPPIVSAPTLSSYLPPLPLPLPEHSRKYSVKETRGSLNGRGSGANSDSEAEKSSKSFWSFKRSSSLNCDIKKSLICSFPRLTRSNSTGSVAISKREMLRDINKHSSQRHGVPRPGVNPSSHMRPPSSFCCSSYQFRPQKHAGKNGGGRGGSFWIAPVIGGPSPFGLGSILRLTKEKKKK

SEQ ID NO: 21215 - protein, 364 aa, Pseudomonas putida GB-1
MSAVTRAAVEGVLRQYTDPYLNQDPVSAGCVRAIDIQGGQVSVQLQLGYAAGLFKNGWAQVLQTAIGNLEGVSGAQVSIDCVVAAHKAQAQVPAMANVKNIIAVASGKGGVGKSTTAANLALALAREGARVGILDADIYGPSQGVMFGIAEGTRPQIREQKWFVPIKAHGVEVMSMAFLTDDNTPMVWRGPMVSGALLQLVTQTAWDDLDYLVIDMPPGTGDIQLTLAQKVPVAGSVIVTTPQDLALLDAKKGVEMFRKVNIPVLGVVENMAVHICSNCGHAEHLFGEGGGEKLASQYGVDLLASLPLSMLIREQADSGKPTAIAEPESQIAMVYQELARQVGARIVLQEAAAPAMPSITISED

SEQ ID NO: 21216 - protein, 355 aa, Salinibacter ruber DSM 13855
MNALVYDDFDAPLTLRTVSRPTPTPRGVVLQVLACGVCRSDWHGWKGHDPMITPPNVPGHEVVGIVTAVGDRVEEWSGGERVTVPFVGGCGTCAQCRAGQHQVCPHQFQPGFSAPGAFAEYVGIDYADENLVRLPGSIDAVTGASLGCRFATAFRAVVDQGAVRSGEWVAVHGCGGVGLSAVMIAQAAGARVVAVDVADPALALADEVGASRTINADDTENVAAAVREATRGGAHLSLDALGSPDTCRNSVANLRTHGRHVQVGLLMGEHARTAIPFDRVVADELEVRGAHGLQAHRYPALFNMIETGRLHPRQLVRQTISLPEAADRLRQMGDFAGTGIAVIDDFGGGRTQAEV

SEQ ID NO: 21217 - protein, 231 aa, Triticum aestivum
  misc_feature (100)..(100): Xaa can be any naturally occurring amino acid
  misc_feature (113)..(113): Xaa can be any naturally occurring amino acid
  misc_feature (180)..(180): Xaa can be any naturally occurring amino acid
  misc_feature (182)..(182): Xaa can be any naturally occurring amino acid
  misc_feature (186)..(187): Xaa can be any naturally occurring amino acid
  misc_feature (190)..(190): Xaa can be any naturally occurring amino acid
  misc_feature (210)..(210): Xaa can be any naturally occurring amino acid
MAGRAATFPPASPPPGEQFAEVVVVRHGETSWNASRTIQGQMDPELNETGRRQALVVARRLSREAKPAAVYSSDLKRAAETAQTIATACGVSSLVLDPAXLRERHMGDLHGRXFDDAVRRSPEIFSSYSRTHEIPGGGESLDQLSKRCVSYLNTVAEKHKGERVIVVTHGASTEELCIHXDXTSPXXGKXYNTSICVFRIGGGEWILEKXGDVGHLDQGEFEDFGGDGVSA

SEQ ID NO: 21218 - protein, 639 aa, Cryptococcus bacillisporus
MPTLSFLFLASATAASVATAAVHDLYWNITYATANPDQLHNKTQAIGVNGTWPPPPIVVNQGDTLTVHAFNGLGSVGTTLHSHGNYFNGSNYYDGAAAVTQCPIPPGETLVYEIPVNDQWGTYWIHGHYNGQYVDGLRAPLIIMPNKTTERTDITWDEDFTIIMGDWYHDTSPYLVSSYFLNWVNPTGAEPIPDSVAFYVMNTTSGEYMSRNIAQGVDVSADVNNNAAIPFEPGKKYRIRFINMSALSMLHIYMGGHTFDIIEVDAVDIEPYQSTNLTVSVAQRYSILVEALNTTDANYAIMFYQDTDMYDTVPDALAVNNSVTLQYDASLGPADMFNITDDTWPMLDDTRFVPLQAKRSAEADVSYELGAYFDTFDDGTNRAAFNNITYVMPTTPSLFTQISMGTDAWDTRIYGQQTHALMMPHLEMIELVIVNWDTGYHPFHLHGHEFQIMAKSFDVTSNDTSINPPVLEKQSNPARRDTIMVPPGGSVHIRFRADNPGAWIFHCHIDWHMDSGLAVIMITDPSYSQLSLKIPQTMKDHCEYWGYSATGNVVGLNSTTDFKGEAIGPLPLVMDWTPKAKGALAGCIIAALAGFASVVWYGAEHLDEKEIEAEIRRKAEIKAASGGKFGMIKKMAKRE

SEQ ID NO: 21219 - protein, 277 aa, Pseudomonas fluorescens PfO-1
MQHIVNRQGLNLPKLGLGTWPMLGDECTRAVEQALELGYRHIDTAAAYNNEDAVGQALANTPTPREQIHVTTKVWWDQLQPDAMRHSLDRSLKALRSEYVDLFMIHWPTTDWDLPHTLETLASFKEQGLARNIGVANFPLPLLRKVVEEYGIPLSAIQIEYHVLLGQNALLDYARQHDLALTAYTPLARNKVSEIPQIQQIAEKHGVLPTQVALKWLLDQDNVAAIPKASSKTNQLANLASLQVELDDDDRALIAALSKRERQVSPDFAPVWDAFDR

SEQ ID NO: 21220 - protein, 206 aa, Coprinopsis cinerea okayama7#130
MVIEQTGRGERSYDIFSRLLRERVIMLHGPIRDTDSTLVVAQLLFLEAEDSTKPIHLYINSPGGSVTAGLAIYDTMQYVSAPIHTYGLGLAASMGSLLLAAGAKGRRHCLPNASIMIHQPSGGASGQATDIAIHAKEILRIRQLLTGIYQRHCAKEGETEAAGLKRFETALERDYYMTAQEALEFGIVDGILEKRPPLEEGASSEP

SEQ ID NO: 21221 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFNLMAKGEGIRCIIRMEN

SEQ ID NO: 21222 - protein, 381 aa, Mycobacterium avium subsp. paratuberculosis K-10
MARDYYGLLGVSRGASDAEIKRAYRKLARELHPDVNPDEAAQAKFKEISVAYEVLSDPEKRRIVDLGGDPLEGAAAAGGGFGGFGGLGDVFEAFFGGGFGGGTTSRGPIGRVRPGSDSLLRMRLDLEECATGVTKQVTVDTAVLCDRCHGKGTNGDSAPVPCDTCGGRGEVQTVQRSLLGQVMTSRPCPTCRGVGVVIPDPCHQCMGDGRVRARREISVKIPAGVGDGMRVRLAAQGEVGPGGGPAGDLYVEVHEQPHDVFVREGDDLHCTVSVPMVDAALGATVTVDAILDGVSEITIPPGTQPGSVITLRGHGMPHLRSGTRGDLHVHVEVVVPSRLDARDTELLREFKGRRGRDVPEVRSTHAGGGLFSRLRETFTGR

SEQ ID NO: 21223 - protein, 671 aa, Coprinopsis cinerea okayama7#130
MTVVAPTINGETISKEERKRLKKLAKQQAKEAAAANENVEPQANGVESKKKEKKDKKKKEKKEKSEVKDESGDGDAMAVDTPMNGESKEDKKEKKKEKKDKKKKEKEKSSETEGEPMLVDSTESSSKEDRKEKKKRKREAEADEPVSKESKKEKKKRRKEGETSSASAEASSSSTPAAEPSSSSSPTKFALSAPTTPKAAEEFLAKHSITITLPEGSSPADKVLPVVSFDQLSNLPQRLREEAFKGFKEPSPIQACTWPPALEGKDVVGIAETGSGKTLAFGIPALNRLISSPSGSGISTLIVAPTRELAIQTHDNLSALAASFGIASVAIFGGVSKDSQIKMLKKSISSSKSKKGKGGEGGDGLVTRIVVGTPGRILDLMQDGVLDLSGVDYLVLDEADRMLDKGFENDIRRIIAATKKKEERQTMMFSATWPEAVRRLASTFQRDPVRVTVGSDDLTANSRVEQVVEVFDDVRSKDQRLNNHLRALLPKNKKSSASANSPLEISRILVFALYKKEASRVEEMLKRQGYTVGALHGDMSQSARMEALDNFKTGKTQLLVATDVAARGLDIPNVGAVINYTFPLTIEDYIHRIGRTGRGGKTGKSITFFTGENHERSLAGEFARVLSDGGFDNEQLKAKFPMTIKKKEHSVYGAFYRDDIPAPKGPTKITF

SEQ ID NO: 21224 - protein, 465 aa, Chlamydomonas reinhardtii
MGSCLAKPAESAEQKKASSVPSPPPAPAPQPVQQAAAPAPKDSGDVKPGQQATPVPPPSPPPQPKPAPPAQPAPAPAAKVVEAIPAVADEKSPQGKQPRRSQEHDNGVKAEEIELVKQKSTEPQPSASATAAVATPKAIEPAMEPKVAAPSAPAAAPAPAQAPAAAPTPARPGSKLRTDVKLRDLYKLGKTLGTGGFSVVKLATDRGTGVEYACKIMALPPVGQEVGENENTREDIFKEIDLLCGMNHENVIFLKEYFEEGNKVYLITELLTGGELLEAVLKRGSYTEAEARLCFVQVLRGIEYLHSKNVVHRDLKLENLLLAKQDDISLVKIADFGLAKHAVNGMQTICGTPQYVAPEVIVGAKGHVYGPGVDMWSAGVVLYILLGGYPPFWSDSEPQLFDMIRKGKYSFGDPVWNKVSEGAKDLIRKLLVVDPTKRLSATEALQHQFILEGNFNPPSTPKGPR

SEQ ID NO: 21225 - protein, 489 aa, Ralstonia metallidurans CH34
MRRLSWIGAWIIACFLASIGSAWAQENSAGPASFKPEELEALVAPIALYPDSVLAQALMASTYPLEVVQAARWVKANPNVKGDAAIKAVESQPWDVSVKSLVAFPQVLEPMSDKLDWTQKLGDAFLAQEKDVMAAVQRLRAKAQQSGNLKSNEQQKVIVEPPAQASGGTTGGGGTTQTIVRIEPANPEVIYVPSYNPTVVYGGWSYPSYPPYYWPPSPYYYPGGALMTGFAWGVGLAAAGAIFSNCNWGGGDVNINVNKAANIDRNFDRTKVQNGNRWQHDSSHRKGVAYRDNATREKFGNNVGGADRRNDFRGREGGRDGAGDRAGDRAGNRQGDRAGDRAGDRGGDRGGDRGGDRGGNRASTGDRMGGSDRAGVADRSAGGGDRGGAGVGDRSAGVADRSAGGGNRNSYGGGGRDNAFQGVGGGSTAQRDLDRGRASSSQAGFSGGQRGGGGGGGGFSGGGGRGGGGFSGGGGRGGGGGGRGGGGRR

SEQ ID NO: 21226 - protein, 537 aa, Ostreococcus tauri
MPPLVGARGRVRARLGVNETFVDLGVVADGVEEEREANVRATAGEGEMLSFVVFGASGDLAKKKIYPALFALYYEGRLPKNFMIYGYARSKMTTEAFKDKIAESLTCRLDWSKQGGSDCAQKSEEFFDRCVYVAGQYDVAADFKALDAQMCEDEKHVSAVKRVFYLSIPPSIFVPVAQNAARECQCKKGDTRVIVEKPFGRDLTSSRELTAALASELSEEQTYRIDHYLGKELIENLTVMRFSNIMFQPLWNRNYIRNVQINFSEDFGTEGRGGYFDHYGIIRDIMQNHLLQILALFAMEEPASLNAEDIRDEKVKVIRCMRPIEMDNVALGQYKGRLTDGRKYPAYLDDETVPKGSLCPTFAAMALFIDNARWDGVPFLLKAGKALHKRQAEIRVQFRHAPGNLYGERQGRVEHVTNELVIRIQPDEAIYLRINNKVPGLGQRLDQTVLDLQYKSAYGQVQLPDAYERLILDVINGDKRLFIRNDELEAAWKLFTPLLDKIEQQKIAPELYPYGSRGPIGAHYLASRFNVRWGDTD

SEQ ID NO: 21227 - protein, 338 aa, Ostreococcus tauri
MTAAVIRETGPASAMKIEKDYPTPKLAKGGVIVKNRYSGINFIDTYHRSGLYKRELPFIGGQEGGGYIAAASEEAIAQGVKVGDRVSYSSVFQTYAQYTAVPASKVITVPENIPLDVAVSCGVQGMTAHYLTHSAHAGLVQPGEWMLIHGTGSGTCQWAAQMAKLRGYKVIGTCSKSKEDIARATGVDELIVYDEAPGTSYEDYTSVDLVPRVMEITKGEGVKAVIDGIGLATYETSIDVLARRGIFVSFGNASGAVPAFPPLRFINKSGYLTRPKLNDYTVTRAELMERANDIFGWIASNKLQVAVDRCFPLEQAVEGHEYLEAGKSRGKVLYEIPE

SEQ ID NO: 21228 - protein, 273 aa, Saccharophagus degradans 2-40
MSQVFDFSGRTVVVVGGTSGINRGVAECFARAGAKVAVASRSQEKVDETVAALQQAGAEQAMGFAADVRDVDAIAAGLQGIATVMGSIDVLVSGAAGNFPALAEDLSANGFKSVIDIDLLGTFHVMKAAFPHLTKPGASIVNISAPQAFLPMQAQTHVCAAKAGVDMVTRCLALEWGEHGIRVNSLVPGPIEGTEGMKRLAPTPELMELAKQSVPLQRLGKPEDIGNMCMYLASEQAAYVSGAIIPVDGGWSLAGASGLSQTLVQMLKQLKNM

SEQ ID NO: 21229 - protein, 507 aa, Brassica napus
  misc_feature (443)..(443): Xaa can be any naturally occurring amino acid
MTMINSLRRMARSSQVTLQSRYAASSSSSQYTSGSRIFTTEASPQKQTIVGSKGHDMLAPFTAGWQSADLHPLIIAKSEGSYVYDDHGKKYLDSLAGLWCTALGGNEARLVSAAVEQLKTSPFYHSFWNRTTKPSLDLAKDLLAMFTANKMAKAFFTNRGSEANDTQVKLVWYYNNALGRPEKKKFIARKKSYHGSTLISASLSGLPALHQNFDLPAPFVLHTDCPHYWRFHLPGETEEEFSTRLAKNLEDLIIKEGPETIGAFIAEPVMGAGGVIPPPATYFEKIQAVVKKYDILFIADEVICAFGRLGTMFGCDKYNIKPDLVSLAKALSSAYMPIGAILMSQEVADVIYSQSNKLGAFSHGFTYSGHPVSCAVAIEALKIYKERNIPEHVAKVAPRFQDGLKAFAKTSPIIGEIRGTGLILGTEFTDNKSPNEPFPPEWXVGAYFGAECQKRGMSVRVAGDGIMMSPPLIISPEEIDELIAIYGGSIGKLRKRRVKELKAQQKK

SEQ ID NO: 21230 - protein, 387 aa, Datura inoxia
ARHAEKQIPPEPHWGFCYLMLHKVSRSFALVIQQLPVELRDAVCIFYLVLRALDTVEDDTSIPTDVKVPILISFHQHVYDREWHFSCGTKEYKVLMDQFHHVSTAFLELGKHYQQAIEDITMRMGAGMAKFICKEVETTNDYDEYCHYVAGLVGLGLSKLFHASGKEDLASDSLSNSMGLFLQKTNIIRDYLEDINEVPKCRMFWPREIWSKYVNKLEELKYEENSVKAVQCLNDMVTNALSHVEDCLTYMSNLRDPAIFRFCAIPQVMAIGTLAMCYDNIEVFRGVVKMRRGLTAKVIDRTRTMEDVYGAFFDFSCMLKSKVNNNGPNATKTLKGLEAVLKTCRDSGTLNKRKSYIIRSERNYSPVLIVIIFIILAIILAHLSGNR

SEQ ID NO: 21231 - protein, 244 aa, Zea mays
  misc_feature (92)..(92): Xaa can be any naturally occurring amino acid
SRTRTTPAKSCWNGALGELAKRVNKNTTAYENYKRIFVPEGQPLESEPNEPLRVNVLFKHVQKMLTGDSAVIAETGDSWFNCQKLKLPEGCXYGSIGWSVGALLGYAQGANHKRVIAFIGDGSFQVTAQDVSTMLRCEQNSIIFLINNGGYTIEVEIHDGPYNVIKNWNYTGFVDAIHNGLGKCWTSKVKSEEELTAAIETALGEKKDCLCFIEVIAHKGDPSKELLEWGSRVSAPNSRPPNPQ

SEQ ID NO: 21232 - protein, 396 aa, Haemophilus influenzae R2866
MFEHIKAAPADPILGLGEAFKSETRENKINLGIGVYKDAQGTTPIMRAVKEAEKRLFDKEKTKNYLTIDGIADYNEQTKALLFGKDSEVIKSNRARTVQSLGGTGALRIAAEFIKRQTKAQNVWISTPTWPNHNAIFNAVGMTIREYRYYDAERKALDWDHLLEDLSQASEGDVVLLHGCCHNPTGIDPTPEQWQELAALSAKNGWLPLFDFAYQGLANGLDEDAYGLRAFAANHKELLVASSFSKNFGLYNERVGAFTLVAENAEIASTTLTQVKSIIRTLYSNPASHGGATVATVLNDTQLRQEWENELTEMRERIKKMRHLFVQLLKEYGAEQDFSFIIEQNGMFSFSGLTGEQVDRLKEEFAIYAVRSGRINVAGITEDNIRYLCESIVKVL

SEQ ID NO: 21233 - protein, 320 aa, Lactococcus lactis subsp. lactis Il1403
MSKKIVTLAGDGIGPEIMSAGLSVLKAVSKKIDFEYELEAKDFGGIAIDKHGHPLPEETLQAVKNADAILLAAIGHPKYNNAKVRPEQGLLALRKELGLYANVRPLKIYPALKKLSPIRNVENVDFLMIRELTGGIYFGQHELADDKARDVNDYSADEIRRILHFAFKSAQSRPRKLLTSVDKQNVLATSKLWRKMADEIADEYPDVRLEHQLVDSCAMLLITNPQQFDVIVTENLFGDILSDEASSLAGSLGVMPSSSHGFNGLALYEPIHGSAPDIAGKGIANPVSMILSIAMMLRESFGQEDGATMIEKAVTQTFTD

SEQ ID NO: 21234 - protein, 474 aa, Pseudomonas aeruginosa
MQTKLLINGALVAGEGESHAVYNPSQGNVLVRITEASGAQVHAAVQSADAAFDAWSQTPPKDRAALLLKLAERIDAQAHVFARLEADNCGKPFNAVLLDELPAVSDVFRFFAGAVRCLQGSAAGEYVAGHTSMIRRDAVGVVASIAPWNYPLLMAAWKLGPALAGGNTVVLKPSEHTPLSTLKLGELLAEIFPAGVVNIVHGRGASVGEPLTSHAQVRMVSLTGSVRTGSRIIEGTAESVKRMHMELGGKAPVLIFDDADIDAAVEGIRAFGFYNAGQDCTAACRLYVQKGVYQEFVRKLGEAVSSIRCGLPDDPATEMGPLITKEHLERVEGFVNRARELPHIEVVTGGKRAEGAGFFFEPTVLAGATQEDEVMRREIFGPVVTVSSFEDEAQALAWANDSDYGLASSVWTADVGRAHRLAARLQYGCTWVNTHFMLVSEMPHGGVKLSGYGKDLSMYGLEDYTVVRHVMFKH

SEQ ID NO: 21235 - protein, 279 aa, Pseudomonas putida GB-1
MLVDCSFANGQYMPLSPCRNFRLPAKAALLASVHTRQLDIKPMHTMDMQSAVIARLPVPDELASFKVVKNLVTSALLECCSIDEFEALKETLVIESVSEQAHADLQAFAQKDPAAGRDLVFIAKTYTSYSAVLHYRLAHWIYRNTASTYGAGGQCLAAMISRRGKMLSGAEIHFRSRIGARFIIDHGMGTVIGETSTIGDDCYVLGGVTLGARGISDNPSSARHPTLGNRVQIGAFASVLGAIHVGDGAFIGPGCIITKDVPAAARVQIKTSLQVVLEP

SEQ ID NO: 21236 - protein, 300 aa, Salinibacter ruber DSM 13855
MRVHQSLLPLDLYPGRFVSPRSATFQSPPPMPTPLYQVDAFATVPFAGNPAAVCLLRDDRDADWMQQVAAEMNVSETAFLRPWDEEATYQLRWFTPTDEVALCGHATLASAHVLWATDHEAARPALHFETASGRLTARRDDGWIWMDFPADPVAPADPPTPLLNALDGATPEEVGWSGRDYLVRLPDAGAVRALQPTLSPLHTLDEARGVIATAPAEADDVDFVSRFFAPRVGVPEDPVTGSAHCALGPYWAARMGRTELTGRQVSARGGTVRVHLDTPDAERVALGGRAVTVVDGRLDA

SEQ ID NO: 21237 - protein, 158 aa, Lactococcus lactis subsp. lactis Il1403
MRRMIIAKLHNVTGIMNRFTAVLNRRQVNILSITAGVTESQDLTHTTFVIEVDHLDEVEQIIKQLNRLIDVIEVADITDLPHVEREVVLIKVSAPPTIRAEIFTMIEPFRVNVVDVNLENVTIQLTGDSAKIEALIDVVSPYGILNMARTGSAGFERG

SEQ ID NO: 21238 - protein, 287 aa, Aspergillus nidulans FGSC A4
MASPSQAAPSTQPLTPPAEPSSTNNATTTNTTAAPSQQPTQPTSAPTTTPAPASQPAQIPSTSLKDSGKSRRPRDVRLIHMLLAAQGVTAYQERVPLQLLDFAYRYTSGVLQDAVHLTTEGYAGTGADTTTSSGNKGPPEVNSVTLPALRLSIASRLHYQFQTGLPKEFLMDVAAERNRVALPGATRGFDAGAGKPAASNSVLMAGMRLPPERFCLTGTGWKMSDEWESEGEEDIAAPEEKNDVMAGAEREEGEGEGDEDEDGKMEDIFGEDAVMGDDDGDKDMTDV

SEQ ID NO: 21239 - protein, 416 aa, Lactococcus lactis subsp. lactis Il1403
MISAKEVEDAYDLLKAVVTKTPLQLDPYLSNKYQANIYLKEENLQKVRSFKLRGAYYSISKLSDEQRSKGVVCASAGNHAQGVAFAANQLNISATIFMPVTTPNQKISQVKFFGESHVTIRLIGDTFDESARAAKAFSQDNDKPFIDPFDDENVIAGQGTVALEIFAQAKKQGISLDKIFVQIGGGGLIAGITAYSKERYPQTEIIGVEAKGATSMKAAYSAGQPVTLEHIDKFADGIAVATVGQKTYQLINDKVKQLLAVDEGLISQTILELYSKLGIVAEPAGATSVAALELIKDEIKGKNIVCIISGGNNDISRMQEIEERALVYEGLKHYFVINFPQRPGALRTFVSDILGPNDDITRFEYIKRADKGKGPCLVGILLSDASDYDSLIDRIERFDNRYVNLHGNDSLYELLV

SEQ ID NO: 21240 - protein, 446 aa, Pseudomonas fluorescens PfO-1
MTFATLGLIEPLLRSLEKLGYQTPTPVQAQAIPVVLAGRDLMAAAQTGTGKTAGFALPLLQLLAMEGPKVTANSVRALILVPTRELAEQVHEAVRQYAENLPLRTYAVYGGVSINPQMMKLRGGVDLLVATPGRLLDLFRQNALKFNQLQTLVLDEADRMLDLGFSEELANIYRALPKKRQTLLFSATFSDDIRLLAGQMLNDPQSIEVSPRNVAANTVKQWVVTVDKKRKPELFVHLMRKNKWKQVLVFAKTRNGVDALVEKLQGLGVNADGIHGDKPQATRQRALDRFKLSEVQILVATDVAARGLDIEDLPLVVNFDLPIVAEDYIHRIGRTGRAGSTGEAISLVCADEVNMLSAIEMLTRSTLKREIEPDFVPEHRVPDTDASGQVIKKPKKPKKPKASGGGGGKRNLGKWVDSGETQAPEPSIKPVRKVPVFNTGPRKRKP

SEQ ID NO: 21241 - protein, 215 aa, Isatis tinctoria
MASNQQSYKAGETRGKTQEKTGQAMGTMRDKAEEGKDKTSQTAQATQQKAHETAQSTKDKASQAAQATQQKAHETAQSTKDKASQAAQTTQQKAHETAQSAKDKTSQAAQTAQDEACESKDKAGSYMSETGEAIKHKAQDAAQYTKETAEAGRDKTGGFLSQTGEHVKQMAMGAADAVKHTFGMATEEEDREHFPGTTATTTGTTRTTGQTYQRK

SEQ ID NO: 21242 - protein, 216 aa, Chlamydophila abortus S26/3
MSEKQSLSIMHPWHGPILTQDNYESLCCYIEITPQDSVKFELDKTTGLLKVDRPQKFSNFCPCLYGLLPRTYCGELSGQYSGEQSLKADIRGDDDPLDVCVLTEKNITHGNILLQARPIGGLRIIDSGEADDKIIAVLEDDLVFSEIKDISDCPCTVLDMIQHYFLTYKATPEHLINAKPAKIEIVGIYGKKEAQKVIQLAHEDYLNKFVREKTTI

SEQ ID NO: 21243 - protein, 151 aa, Oryza sativa Indica Group
DEALDDPALEKLRQQRLVEEADFKSTTELFGKKDGSEKSLDTFIPKSESDFAEYAELIANKLRPYEKSFHYMGLLKNVMRLSMASLKGADAKDISSSIAAIANEKIKAEKEAAAGKKKQGAKKKQLHIENKDDDFIPGKGNFDDPDEYDFM

SEQ ID NO: 21244 - protein, 145 aa, Listeria monocytogenes str. 1/2a F6854
MDESKKNERLQQLTDIQYNVTQKAGTERPFQNEFYDNEAKGIYVDIVSGKPLFSSNDQYDAGCGWPSFTKPIDEAEVIENRDLNHGMIRTEVKSADADSHLGHVFPDGPQDKGGLRYCINSAALRFIPVDKLEEEGYQAYKKIFE

SEQ ID NO: 21245 - protein, 197 aa, Zea mays
  misc_feature (60)..(60): Xaa can be any naturally occurring amino acid
  misc_feature (107)..(107): Xaa can be any naturally occurring amino acid
  misc_feature (123)..(123): Xaa can be any naturally occurring amino acid
  misc_feature (133)..(133): Xaa can be any naturally occurring amino acid
  misc_feature (145)..(145): Xaa can be any naturally occurring amino acid
  misc_feature (172)..(172): Xaa can be any naturally occurring amino acid
  misc_feature (183)..(183): Xaa can be any naturally occurring amino acid
  misc_feature (185)..(185): Xaa can be any naturally occurring amino acid
MAATIQSVNARQIFDRRLYLTVQVIVFCSDGTFGWAAAPIGASIVVYQALEFRDGRSDYXRRVSTQMRNNVNSVIGPTLIGKDPTVQTEIDNFMDQHHYGTKNEWGXSKLKLGANAILTESLXTCKAGPNIKXIPLYHIIANLPXNKQLEMPVPALNVINGGYHAGNKIAMXEFMILATGAAXIXEAMNIGVETYHH

SEQ ID NO: 21246 - protein, 196 aa, Escherichia coli O157:H7 EDL933
MQLKRVAEAKLPTPWGDFLMVGFEELATGHDHVALVYGDISGHTPVLARVHSECLTGDALFSLRCDCGFQLEAALTQIAEEGRGILLYHRQEGRNIGLLNKIRAYALQDQGYDTVEANHQLGFAADERDFTLCADMFKLLGVNEVRLLTNNPKKVEILTEAGINIVERVPLIVGRNPNNEHYLDTKAEKMGHLLNK

SEQ ID NO: 21247 - protein, 879 aa, Listeria monocytogenes str. 1/2a F6854
MRKFVYQFSEGSKEMKNLLGGKGANLAEMTNIGLPVPPGFIISTDACNDYTANNKHLSEAIFDEVKIHLAELEKQTGKIFGFAENPLLVSVRSGAPFSMPGMMDTVLNLGLNDQAAEGLANLTGDARSAYDSYRRFIQMFGDVVFEIPSYHFEQALSRIKKANDYRLDTELTATDLSELIDAYKLIFSQATGTDFPQDPLEQLRLAIIAVFDSWMNPRAVIYRRLHDIDASFGTAVNIQAMVFGNTGETSGTGITFTRNPSTGEKKVFGEFLLNAQGEDVVAGIRTPEPISALEERMPTVYKELLHTCELLENHYLDMQDIEFTIEKGKLYVLQTRSGKRTAKAAIQTAVDFVQEGKITREEAIMRVETKQLNQLLHPTFLESALKNGQVIATGLPASPGAATGQIFFEAKEAVQAAERGIPVILVRNETSPEDIEGMARSNAILTAHGGMTSHAAVVARGMGKCCIAGCAELTINEQEKTLLLSNGEALHEGDYLSLDGSTGKVYLGEIALTEAQIGGHFNDLMAWADAEKKLMIRVNADTPADFKKALLFGAEGIGLCRTEHMFFDEKRIPYVRQMILAESLSERESVLAILKEMQKADFSELFRIADGRAVNIRLLDPPLHEFLPKMKQEIEQLAGAMNRTVPQITNRINELREANPMLGHRGCRLAITFPEIYRMQAEAIIESAIIVHNEGIDVHPEIMIPLITTKNELSYIKKELQQAVQAIFDKEQVVIPYDIGTMIEIPRACVTADEIAEEAAFFSFGTNDLTQLTYGFSRDDATKFLADYYEKDILPKDPFVSIDKNGVGALVEMAVTRGRMTSEHLKMGVCGEHGGDPESIQFFHQLGLTYVSCSPYRVPIARLAAAQAALAEKHLIPTI

SEQ ID NO: 21248 - protein, 328 aa, Staphylococcus aureus subsp. aureus MW2
MKENFWSELPRPFFILAPMEDVTDIVFRHVVSEAARPDVFFTEFTNTESFCHPEGIHSVRGRLTFSEDEQPMVAHIWGDKPEQFRETSIQLAKMGFKGIDLNMGCPVANVAKKGKGSGLILRPDVAAEIIQATKAGGLPVSVKTRLGYYEIDEWKDWLKHVFEQDIANLSIHLRTRKEMSKVDAHWELIEAIKNLRDEIAPNTLLTINGDIPDRKTGLELAEKYGIDGVMIGRGIFHNPFAFEKEPREHTSKELLDLLRLHLSLFNKYEKDEIRQFKSLRRFFKIYVRGIRGASELRHQLMNTQSIAEARALLDEFEAQMDEDVKIEL

SEQ ID NO: 21249 - protein, 285 aa, Phaseolus vulgaris
MAKDVEVQEQGEYAAKDYQDPPPAPLFDPEELTQWSFYRALIAEFIATLLFLYVTVLTIIGYKRQTDANVGGTECDGVGILGIAWAFGGMIFILVYCTAGISGGHINPAVTFGLFLGRKVSLIRALLYIVAQCAGAICGTGLAKGFQKAYYNRCGGGANSVADGYNKGTALGAEIIGTFALVYTVFSATDPKRNARDSHVPVLAPLPIGFAVFMVHLATIPVTGAGINPARSFGAAVIYNNEKIWDDQWIFWVGPIIGAAVAAFYHQYILRAAAIKALGSFRSNA

SEQ ID NO: 21250 - protein, 599 aa, Caulobacter crescentus CB15
MAQEVSPESYKDLVLFLATAGIVAPIFKRLKINPILGYLLAGVILGPFGLGRFIPYAPWLDYFTVDNPDEIAQLAEFGVVFLLFMIGLELSWERLRLMRRWVFGLGAVQVIGCSLALGAGGMLLGLEPVVALTIGAALTLSSTAIAVPVLAERRRLHSEAGRATFSVLLFQDLAVAPILITLAILGRGNGSFQLQDLLALAPAALGLAVIVLVGRLALRPMLKSVAKAKSEEMFMAACLLVIIGAGMVAALSGLSMALGAFVAGVLLAETEYRHEVEVKIEPFKGLLLSLFFVSLGIRLDLSLLAAQPAAILGTALGLLVLKTAVVFGSGLLMGLNRRAAIEAALILAAGGEFAFVLLDNAMSAQVVPPAIGQAVLVSATLTMFLIPGLAALGGYLGRKNAPLPVSEAPPSTANEPDRLGPEPAGQVLVIGYGRVGRLVGDMLGRHDLPWIAVEREARLVEQGRRDGARIYYGDASRLELLERCGLATARAVVVTMDAFEVAEAVVVAARGARPDVPIVVRARDARHAARLYELGATDAVPETIEASLQLSEAVLVDIGVPMGLVIASIHERRDEYRKKLNRPDALGGRRRRLRDATLR

SEQ ID NO: 21251 - protein, 287 aa, Phaseolus vulgaris
MENKEEDVKVGANKFTERQPLGTAAQGDKDYKEPPPAPLFEPGELKSWSFYRAGIAEFVATFLFLYITILTVMGVNRSSSKCSSVGIQGIAWSFGGMIFALVYCTAGISGGHINPAVTFGLFLARKLSLTRAVFYIIMQCLGAICGAGVVKGFEGNGRYELFKGGANFVNSGYTKGDGLGAEIVGTFVLVYTVFSATDAKRNARDSHVPILAPLPIGFAVFLAHLATIPITGTGINPARSLGAAIIYNRDHAWDDQWIFWVGPFIGAALAALYHQIVIRAIPFKARA

SEQ ID NO: 21252 - protein, 606 aa, Oryza sativa
MGNFVWMVAAAAAAVVSWAFIAVVVKLVWRPRAISRRLRAQAVGGPGYRFFSGNLGEIRRLRAEGAGVVLDVSSHDFVPIVQPHFRKWVSLYGKTFLFWFGAQPNICLADINIVRQVLSDRTGMYPKDLTNPYFAHLLGKGLVLIDGDEWKRHYKVVHPAFDMDKLKMMTVTISDCTGSMMSEWESELGMKGGSAEIELSQRFQELTADVISRTAFGSSYSEGKQVFLAQRKLQFLAFSMFLTIQIPGFRYLPTKKNLKIWSLDKKVRSMLRNIIKIRLANKDTMGYGNDLLGLMLETCAPEHDESQQLSMDEIIAECKTFFFGGHDTTSHLLTWTMFLLSTHPEWMRKIRKEVTTMCGDEVPTGDMLNKMNLLNMFLLETLRLYSPVSLISRRTGTNAKFGGIKVPEGTILRIPIATIHRDKEVWGEDADEFKPARFENGVSKAAKHPNALLSFSNGPRSCIGQNFAMIEAKAVITMILQRFSFTLSPKYVHTPISVITLRPKYGLPMILRSLKNFAMLEAKAVITMILQRFFFTLSPKYVHAPTSLITLWPKYGLPKILRSLKMCRMESQELSQPEGGEWLSDRLSSVGLTAACRRSDRRYITG

SEQ ID NO: 21253 - protein, 181 aa, Salinibacter ruber DSM 13855
MSHPWHDIAVGGEAPDMFSCIIEIPQGCKVKYELDKESGLLRVDRMLHSSVVYPANYGFIPRTYADDGDPLDMLVLAQESVDPLSILRARPIGLMNMLDDDEEDAKIICIHLDDPAFNDYWHIKELPDHRLRELRRFFQDYKALEDKTVQVKDFFGPDRAKGIVDGALQRYEEEIAPMRDG

SEQ ID NO: 21254 - protein, 100 aa, Arabidopsis thaliana
MASLFTPSPTTTSSSGDTIYVAAVPLKAAAGPPQLIMSMAYSLNISNLQHFMVLIKPSSPIRQEVLVFDFQPRNPESIEAAISLLSGNLIPGSDSQTSNV

SEQ ID NO: 21255 - protein, 411 aa, Arabidopsis thaliana
MNALAATNRNFKLASRLLGLDSKLEKSLLIPFREIKVECTIPKDDGTLASFVGFRVQHDNARGPMKGGIRYHPEVEPDEVNALAQLMTWKTAVAKIPYGGAKGGIGCDPSELSLSELERLTRVFTQKIHDLIGIHTDVPAPDMGTGPQTMAWILDEYSKFHGHSPAVVTGKPIDLGGSLGRDAATGRGVLFATEALLNEHGKTISGQRFAIQGFGNVGSWAAKLISDKGGKIVAVSDVTGAIKNNNGIDILSLLEHAEENRGIKGFDGADSIDPDSILVEDCDILVPAALGGVINRENANEIKAKFIIEGANHPTDPEADEILKKKGVMILPDIYANSGGVTVSYFEWVQNIQGFMWDEEKVNRELKTYMTRGFKDLKEMCQTHSCDLRMGAFTLGINRVAQATTIRGWGS

SEQ ID NO: 21256 - protein, 315 aa, Haemophilus influenzae R2866
MPDIKLFAGNATPELAKRISERLYISLGDATVARFSDGEIQVQINENVRGADVFIIQSTCAPTNDNLMELVVMVDALRRASAGRITAVIPYFGYARQDRRVRSARVPITAKVVADLLSIVGIDRVLTCDLHAEQIQGFFDVPVDNVFGSPVLIHDILKKSDLENPIVVSPDIGGVVRARAVAKLLNDTDMAIIDKRRPRANVAQVMHIIGDVADRDCILVDDMIDTGGTLCKAAEALKERGAKRVFAYATHAVFSGAAAKNLASDAIDEVVVTDTIPLSEEMKAIGKVRVLTLSSMLAEAIRRISNEESISAMFN

SEQ ID NO: 21257 - protein, 188 aa, Pyrococcus furiosus DSM 3638
MIIIMDNGGQYVHRIWRTLRYLGVEAKIIPNTTPLDEIKAMKPKGIIFSGGPSLENTGNCEKILEHYEEFNVPILGICLGHQLIAKFFGGEVGRGEKAEYSLVEIEIIDENDIFKGLPRKVRVWESHMDEVKKLPPKFKLLARSDTCPVEAMKHEELPIYGVQFHPEVAHTEHGADILRNFAKICGEL

SEQ ID NO: 21258 - protein, 431 aa, Synechococcus sp. CC9311
MKRVLAIILGGGAGTRLQPLTKMRAKPAVPLAGKYRLIDIPISNCINSSINKMYVLTQFNSASLNRHLSQTYNLNAGFGQGFVEVLAAQQTLDSPSWFEGTADAVRQYQTLFREWDVDEYLILSGDQLYRMDYSRFVEHHRSTGADLTVAALPVDAAQAEAFGLMRTDEVGNIKEFREKPKGDSLKAMAVDTSRFGLSVESSKERPYLASMGIYVFSRKTLFDLLDANPGHKDFGKEVIPEALSRGDNLKSYVFDDYWEDIGTIGAFYEANLALTQQPTPPFSFYDEAFPIYTRPRYLPPSKFVDSQITDSIISEGSIIKACSIHHSVLGVRSRVENNVVLQDSLLMGADFFESQGERETLRARGGIPVGVGEGTTVKGAILDKNARIGKNVTIVNKDRVEEADRPDQGFYIRNGIIVVVKNASIADDTVI

SEQ ID NO: 21259 - protein, 313 aa, Pyrococcus furiosus DSM 3638
MKRWVKVWEKFIEEKIREIRETVGDSKAIIALSGGVDSSTAAVLAHRAIGDRLHAVFVNTGFLRKGEPEFVIKTFRDEFGMNLHYVDAQDRFFAALKGVTDPEEKRKIIGRVFIEVFEEVAKDIGAEYLIQGTIAPDWIESQGKIKSHHNVGGLPEKLNLKIIEPLRDLYKDEVRQLAKELGLPEKIYNRMPFPGPGLAVRVIGEVTPEKIRIVREANAIVEEEIEKAGLRPWQAFAVLLGVKTVGVQGDIRAYKETIAVRIVESVDGMTANAMNVPWEVLQRIAFRITSEIPEVGRVLYDITNKPPATIEFE

SEQ ID NO: 21260 - protein, 501 aa, Triticum aestivum
  misc_feature (215)..(215): Xaa can be any naturally occurring amino acid
MVLSRAASDTDVSVHSTFASRYVRSSLPRYRMPENSIPKEAAYQIINDELMLDGNPRLNLASFVTTWMEPECDKLIMASINKNYVDMDEYPVTTEFQNRCVNMIAHLFHAPLGESETAVGVGTVGSSEAIMLAGLAFKRRWQNKRKAEGKPFDKPNIITGANVQVCWEKFARYFEVELKEVKLREGYYVMDPDQAVEMVDENTICVAAILGSTLXNGEFEDVKRINDLLEEKNKQTGWETPIHVDAASGGFIAPFLYPELEWDFRLPWVKSINVSGHKYGLVYPGIGWCVWRTKEDLPDELIFHINYLGSDQPTFTLNFSKGSSQVIGQYYQLIRHGIEGYTNIMENCQENAMVVKEGLEKTGRFNIVSKDEGVPLVAFSLKDHSRHDEFEISDMLRRFGWIVPAYTMPADAQHVTVLRVVIREEFSRTLAERLVLDIDTVMAQLDALPSKLTPPALLPATLPKTVVVANGHVKKTELETQKSVTEAWKKFVLAKKTNGVC

SEQ ID NO: 21261 - protein, 487 aa, Oryza sativa
  misc_feature (383)..(383): Xaa can be any naturally occurring amino acid
MASPPPPPPSAAAPGSPPSAQVVGNAFVHQYYNILHQSPDLVHRFYQDGSRIGRPASPAAAEMDTVTTMEAINAKIVSMDIVRAEIKAVDAQESLGGGVTVLVTGHLTGSDDVRREFSQSFFLAPQEKGYFVLNDILRYVGGEGDQEVEPEPELELSFPPSQQPDSVPAPSANGTSVPREQEAFSQPEQHVADPAPNAQEADLNGEEVYNPPNNTEGPVVEETPIPEVIDEVPNNVAVAMPTPPAPAPAPVPQEEAPKKSYASIVKVMKEIPPQISAIPSRPAPPKQEKQVAPAPVAPVADAPTFSPNPESSNIQEAEVDAHAIYVRNLPLSATPEQLEEAFKKFGAIKPDGIQVRSHKIQGFCYGFVEFEDPSSVQSANCGXLPVTISDRQCYVEEKRTAGSRGGGRGRFAPGRGGNFRGEGMRGRGNYTGGRGYGRGEFNYRSDYGGRGAGRGGSSRGGDVGYQRVDHSAGRAARAPSGTSAVAK

SEQ ID NO: 21262 - protein, 398 aa, Bacillus subtilis subsp. subtilis str. 168
MKFEQSHVLKELPKQFFASLVQKVNRKLAEGHDVINLGQGNPDQPTPEHIVEEMKRAVADPENHKYSSFRGSYRLKSAAAAFYKREYGIDLDPETEVAVLFGGKAGLVELPQCLLNPGDTILVPDPGYPDYWSGVTLAKAKMEMMPLVKDRAFLPDYSSITAEIREQAKLMYLNYPNNPTGAVATSEFFEDTVRFAAENGICVVHDFAYGAVGFDGCKPLSFLQTEGAKDIGIEIYTLSKTYNMAGWRVGFAVGNASVIEAINLYQDHMFVSLFRATQEAAAEALLADQTCVAEQNARYESRRNAWITACREIGWDVTAPAGSFFAWLPVPEGYTSEQFSDLLLEKANVAVAAGNGFGEYGEGYVRVGLLTSEERLKEAAYRIGKLNLFTQKSIDKTL

SEQ ID NO: 21263 - protein, 273 aa, Pseudomonas fluorescens PfO-1
MRTLELAGVQVPVIGQGTWRMGEDRSAHKREVAALRSGIELGMTLIDTAEMYGEGGAETVVGEAIAGLRDQVFLVSKVYPHNASRQGIPQACERSLRRLDTDYIDLYLLHWRGQYPLEETVEAFERLREDGKIGRWGVSNFDVDDLEELSHSACATNQVLYNLEERGIEFDLLPWCQQQRMPLMAYCPIGQGGAMLAEPVLKQIAARHGVTPAQVSLAWILRQDGLIAIPKAVRPEHVQLNAQAAQLPLDGGDLAALDQVFHAPQRKQRLAMV

SEQ ID NO: 21264 - protein, 263 aa, Brucella melitensis 16M
MARSALLNVMVQAAMKAGRSLARDFGEVQNLQVSLKGPGDYVSQADRRAEQIVYTELSRARPDFGFLMEESGEVEAKDGQHRWLVDPLDGTTNFLHGIPVFAVSIALERQGQIVAGVIYNPAMDELYTAERGGGAFLNDRRLRVASRNKLVDSVIGTGIPHLGRGHHGHYLVELRNVMAETAGIRRMGAVALDLAYVAGGRLDGFWEEGMHPWDLGAGILMVREAGGFVSDKKGGQDIFSTQSIVAGNEAIHGALLKTLKKPI

SEQ ID NO: 21265 - protein, 146 aa, Pseudomonas fluorescens PfO-1
MKTVAQLLKLKDPKNQEVHQIKPDHMVLEALMKMAEKNVGALLVVEDDNVVGIISERDYARKLVLHGRSSVGTPVRDIMVANVITVDTHQTVDTCLGIMSDKRLRHLPVVENGKLIGLLSIGDLVKEAIAEQAELIKQLEQYIRGE

SEQ ID NO: 21266 - protein, 412 aa, Shigella flexneri 2a str. 2457T
MADTRPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKCYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENHDRIRQAIRGIKAMFRADGLLPVSSKHIHENAE

SEQ ID NO: 21267 - protein, 441 aa, Salmonella enterica subsp. enterica serovar Typhi str. CT18
MTQYQALIIGFGKAGKTLAATLAKTGWRVAIIEQSASMFGGTCINIGCIPTKTLVYDAEREGDFSVAMQRKAAVVNFLRDKNFHNLADLDNVDVIEGRAEFIDNHTLRVFQADGERVLRGEKIFINTGAESVIPAITGLTTTAGVFDSTGLLSLSQRPARLGILGGGYIGLEFASMFANFGTKVTIFEAAPQFLPREDRDIAQAITHILQEKGVELILNANVQAVSSTEGAVQVETPEGAHLVDALLVASGRKPATAGLQLQNAGVAVNERGGIIVDDYLRTTADNIWAMGDVTGGLQFTYISLDDFRIVRDGLLGDGKRSTRDRQNVPYSVFMTPPLSRVGLTEEQARASGATVQVVTLPVAAIPRARVMNDTRGVLKAVVDVNTQRIVGVSLLCVDSHEMINIVKTVMDADLPYTVLRDQIFTHPTMSESLNDLFSLIK

SEQ ID NO: 21268 - protein, 195 aa, Brassica napus
  misc_feature (142)..(142): Xaa can be any naturally occurring amino acid
  misc_feature (163)..(163): Xaa can be any naturally occurring amino acid
  misc_feature (178)..(178): Xaa can be any naturally occurring amino acid
MVTFGATANSNPNKSFEVTPSPSDSISSLSFSPRADVLVATSWDNQVRCWEISRSGTSLSSAPKASISHDQPVLCSAWKDDGTTVFSGGCDKQAKMWPLLSGGQPVTVAVHDAPIVDMAWIPGMNLLVTGSWDKTLKYWDTXRRQPPVHTQQLPDKCYSLSVXKHPLWVVGTADRNLXVYNLQNPQTEFKRIVSP

SEQ ID NO: 21269 - protein, 831 aa, Shigella flexneri 2a str. 2457T
MLTIQFLCPLPNGLHARPAWELKEQCSQWQSEITFINHRQNAKADAKSSLALIGTGTLFNDSCSLNISGSDEEQARRVLEEYILVRFIDSDSVQPTQAELTAHPLPRSLSRLNPDLLYGNVLASGVGVGTLTLLQSDSLDSYRAIPASAQDSTRLEHSLATLAEQLNQQLRERDGESKTILSAHLSLIQDDEFAGNIRRLMTEQHQGLGAAIISNMEQVCAKLSASASDYLRERVSDIRDISEQLLHITWPELKPRNNLVLEKPTILVAEDLTPSQFLSLDLKNLAGMILEKTGRTSHTLILARASAIPVLSGLPLDAIARYAGQPAVLDAQCGVLAINPNDAVSGYYQVAQTLADKRQKQQAQAAAQLAYSRDNKRIDIAANIGTALEAPGAFANGAEGVGLFRTEMLYMDRDSAPDEQEQFEAYQQVLLAAGDKPIIFRTMDIGGDKSIPYLNIPQEENPFLGYRAVRIYPEFAGLFRTQLRAILRAASFGNAQLMIPMVHSLDQILWVKGEIQKAIVELKRDGLRHAETITLGIMVEVPSVCYIIDHFCDEVDFFSIGSNDMTQYLYAVDRNNPRVSPLYNPITPSFLRMLQQIVTTAHQRGKWVGICGELGGESRYLPLLLGLGLDELSMSSPRIPAVKSQLRQLDSEACRELARQACECRSAQEIEALLTAFTPEEDVRPLLALENIFVDQDFSNKEQAIQFLCGNLGVNGRTEHPFELEEDVWQREEIVTTGVGFGVAIPHTKSQWIRHSSISIARLAKPVDWQSEMGEVELVIMLTLGANEGMNHVKVFSQLARKLVNKNFRQSLFAAQDAQSILTLLETELTF

SEQ ID NO: 21270 - protein, 275 aa, Oenococcus oeni PSU-1
MKFKDFSNRYLPEINNDLSNYFADRDDDIFRMITYALNSTGKRLRPLLTLATFAAAGNVINDSTIEAATAVEFVHAYSLVHDDLPEMDDDTKRRNQSSTWKKFGVGNAVLVGDGLLTEAFKKISNLSLPESIRLRLIYNLALAAGPDNMVRGQQYDLFSQDKVESIDDLEFIHLMKTGALMTYAATAGGILAGLSDDKLRALNIYGANLGIAFQIKDDLRDIKQDEEENKKSFPRLIGVQKSQTELEEHLKISANAIKEIPDFQNTVLLDLLDRI

SEQ ID NO: 21271 - protein, 299 aa, Arabidopsis thaliana
  misc_feature (228)..(228): Xaa can be any naturally occurring amino acid
MEGGVEELSIEQLASSISTYKEQLEQVRQLLSEDPRNSEYADMEKELKEVIALTEEVLATAKQNEISLSDAGVSAEATPGSPDLEGAWEKTGLRNDPIHEGKFPVGTKVQAVFSDDGEYDATIEAHTANGYFVAYDEWGNKEEVDPDNVRPIEQNAIVEAERLAQATKNALKRKIEKAASSDYQTKTLPAKLKIDPNDPEDVKIAKRKKIHAFKSKARFEQLEVVQNXKQNDWQQFQTTKAKTKKVGFFTGRKKESIFKSPEDPFGKVGVTGSGKGLTDFQKREKHLHLKSGNAEGTDE

SEQ ID NO: 21272 - protein, 123 aa, Crocosphaera watsonii WH 8501
MSKQKDSHPSEFTRTPPWGKVTMLEEGHRYRINRIELNPGQHISTQMHYHRSEHWIVVSGTAKVVFNGEEHLLKQKESTYVPMNTRHRVENPGVIPLVLIEVQNGEYLGDDDIIRFAEEEGKK

SEQ ID NO: 21273 - protein, 462 aa, Sulfitobacter sp. EE-36
MPEKRMPNLRREDFKEIYAEYADEKAQEQSSRCSQCGVPYCQTHCPLHNNIPDWLRLTAEGRLQEAYEVSQATNTFPEICGRICPQDRLCEGNCVIEQSGHGTVTIGSVEKYITDTAWENGWVQPIKPKTERAESVGIIGAGPGGLAAADVLRRAGVQVTIYDRYDRAGGLLTYGIPGFKLEKDVVMRRNDQLAEGGVNFELNCDVGVDISFADIRAKHDAVIIATGVYKTRDIQAPGVGGVGLERAIDFLTVSNRKSFGDKVEEFDSGRFNAEGKRVVVIGGGDTAMDCVRTSIRQGATSVKCLYRRDRANMPGSQREVQNAEEEGVVFEWLSAPKGFVGDPVTGVVVQKMRLGAPDVSGRQAPEVIEGADYVEEADLVIMALGFEPEDLPTLWNTPELPVNRWGTVKADYITGATELDGVYAVGDIVRGASLVVWAIKDGRDCAQAILEKMGASVAIAAE

SEQ ID NO: 21274 - protein, 588 aa, Arabidopsis thaliana
MGTNQTQISDEYVTGNSSGVGGGISDVYGEDSATLDQLVTPWVTSVASGYTLMRDPRYNKGLAFTDKERDAHYITGLLPPVVLSQDVQERKVMHNLRQYTVPLQRYMALMDLQERNERLFYKLLIDNVEELLPVVYTPTVGEACQKYGSIYRRPQGLYISLKEKGKILEVLKNWPQRGIQVIVVTDGERILGLGDLGCQGMGIPVGKLSLYTALGGIRPSACLPITIDVGTNNEKLLNNEFYIGLKQKRANGEEYAEFLQEFMCAVKQNYGEKVLVQFEDFANHHAFELLSKYCSSHLVFNDDIQGTASVVLAGLIAAQKVLGKSLADHTFLFLGAGEAGTGIAELIALKISKETGKPIDETRKKIWLVDSKGLIVSERKESLQHFKQPWAHDHKPVKELLAAVNAIKPTVLIGTSGVGKTFTKEVVEAMATLNEKPLILALSNPTSQAECTAEEAYTWTKGRAIFASGSPFDPVQYDGKKFTPGQANNCYIFPGLGLGLIMSGAIRVRDDMLLAASEALASQVTEENFANGLIYPPFANIRKISANIAASVGAKTYELGLASNLPRPKDLVKMAESCMYSPVYRNFR

SEQ ID NO: 21275 - protein, 456 aa, Pseudomonas fluorescens PfO-1
MTTSRETRDYQAADAAHHIHAFVDQKALNDEGPRVMVRGDRLHLWDNDGRRYLDGMSGLWCTNLGYGRKDLNAAASRQLEQLPYYNMFFHTTHPQVIELSELLFSLLPGHYSHAIYTNSGSEANEVLIRTVRRYWQVLGKPEKKIMIGRWNGYHGSTLAATALGGMKFMHEMGGMIPDIAHIDEPYFFAHEGNLTPAEFGLRAAQQLEAKILELGADKVAGFIAEPFQGAGGMIFPPESYWPEIQRICRQYDVLLCADEVIGGFGRTGEWFAHEYFGFEPDTLSIAKGLTSGYIPMGGLILSKKMADVLVEQGGVFAHGLTYSGHPVAAAVAIANLKALRDEGVVTRVKDDIGPYLQQCLREVFGNHPLVGDIQGTGMVAALQLAEDKATRKRFANENDIAWRCRTIGFEEGVIIRSTLGRMIMAPALIASREEIDELVGKTLKALDRTAQEYGRL

SEQ ID NO: 21276 - protein, 464 aa, Salmonella enterica subsp. enterica serovar Typhi str. CT18
MKNASTASGASVSDAASKNEPTLQRGLQNRHIQLIALGGAIGTGLFLGIGPAIQMAGPAVLLGYGVAGIIAFLIMRQLGEMVVEEPVSGSFAHFAWKYWGPFAGFLSGWNYWVMFVLVGMAELTAAGIYMQYWLPDVPTWVWAAVFFIIINAVNLVNVRLYGETEFWFALIKVLAIIGMIGFGLWLLFSGHGGEHASIDNLWRYNGFFATGWHGLLLSLAVIMFSFGGLELIGITAAEARDPQKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSHRGVPVNSLMLSGAITSLVVLINYLLPQKAFSLLMALVVATLLLNWIMICLAHLRFRAAMRRKGRETQFKALFYPAGNYLCIAFLALILVLMCTMDDMRLSAILLPVWIVFLFIAFTVLRRKAH

SEQ ID NO: 21277 - protein, 497 aa, Pseudomonas fluorescens PfO-1
MFELADWQRKAAELSYPYQAVIDGKLRAAQSGQTFAAINPATGQLLANVAACGEEDVDAAVQNARQVFEAGTWAGRSPTERKQVLLRLADLILAHREELALLDSLNMGKPVMDAYNIDVPGAAGVFRWYAESLDKLYDQVAPSASNVLATITREALGVVAAVVPWNFPLDMAAWKLAPALAAGNSVILKPAEQSPFSALRLAELALEAGLPAGVLNVLPGLGEQTGKALGLHPDVDCLVFTGSTQVGKYFMQYSAQSNLKQVWLECGGKSANLVFADCQDLDLAAQKAAFGIFFNQGEVCSANSRLLVERSIHDEFVERLKAQAERWQPGDPLDPASAAGAIVDTRQTESILRFIHQAEREGATRVCGGRQLSFNGSDNFVQPTIFTDVQPHMTLFREEVFGPVLAVIPFDDEAHALHLANDSVYGLAASLWTDDLHRAHRVARQLRAGTVSVNSVDALDVTVPFGGGKQSGFGRDLSLHSFDKYTQLKTTWFQLRS

SEQ ID NO: 21278 - protein, 192 aa, Sinorhizobium meliloti 1021
MKTLDVFLTSTGLALMVGFSTSTTIPAHAQNLTGPMLVAEQCSPLTDANYEACCMAQNRADILTAGQIEQCPPLSTAAIGNSFSTTSTDSGPRNLNGDDGGGGNPGGGGGGGGGGGGGGGGGGGGGGGGGGGGDPGGGGGQDTGKGNQDHGKGNQDNGKGSQDNGKGSQDNGKGSQDNGKGSQDNGNQDPQR

SEQ ID NO: 21279 - protein, 360 aa, Trichodesmium erythraeum IMS101
MINCRITLLPGDGIGPEIMAVAVDVLKVVGKQFNLEFEFQEAPIGGVAIDATGEPLPKETLEMCRNSNAVLLAAIGGYKWDNLPRHQRPETGLLGLRAGLGLFANLRPAKIFPQLIDASTLKREIVEGVDIMVVRELTGGVYFGTPKGVFETETKEKRGVNTMAYSESEIDRIAKVGFETAQKRGGKLCSVDKANVLEVSQFWRDRINLVAQEYQDVELSHLYVDNAAMQLVRFPKQFDTIVTGNLFGDILSDAAAMLTGSIGMLPSASLGASGPGVFEPVHGSAPDIAGQDKANPLAQVLSVAMMLRYALEQPVVADKIEQAVLQVLEQGYRTGDIMSEGMKLVGCKEMGEVLLKILSL

SEQ ID NO: 21280 - protein, 450 aa, Escherichia coli CFT073
MNAFRQEIIMNKYQAVIIGFGKAGKTLAVTLAKAGWRVALIEQSNAMYGGTCINIGCIPTKTLVHDAQQHTDFVRAIQRKNEVVNFLRNKNFHNLADMPNIDVIDGQAEFINNHSLRVHRPGRNLEIHGEKIFINTGAQAVVPPIPGITTTPGVYDSTGLLNLKELPGHLGILGGGYIGVEFASMFANFGSKVTILEAASLFLPREDRDIADNIATILRDQGVDIILNAHVERISHHENQVQVHSEHAQLAVDALLIASGRQPATASLHPENAGIAVNERGAIVVDKQLHTTANNIWAMGDVTGGLQFTYISLDDYRIVRDELLGEGRRSTDDRKNVPYSVFMTPPLSRVGMTEEQARESGADIQVVTLPVAAIPRARVMNDTRGVLKAIVDNKTQRILGASLLCVDSHEMINIVKMVMDAGLPYSILRDQIFTHPSMSESLNDLFSLVK

SEQ ID NO: 21281 - protein, 359 aa, Sinorhizobium meliloti 1021
MIDWTDRHYRFFARQLSSHALLYTEMIVADAILRGDREKLLGHDTSEHPVALQLGGSDPAKMAEAARIAEGFGYDEINMNVGCPSDRVQSGTFGACLMQEPALVADCIAAMKAAVKIPVTVKCRIGVDDQDPEVALRDLVQRVKDAGTDAVWVHARKAWLKGLSPRENREIPPLDYGLVHRLKAENANLFIGLNGGLQRLDQALSHLDPLSLPTGGTTGTAAEPACGAPLDGVMLGRAAYHDSGLLTAADGYFVHPLTGAEPMPVDRDGFSDHDHKLSLDFWSGIRDAMADYAAAHIENGGRLIHVTRHMVGLFQGWPGARRYRQILSTEATRKDAGPQVIHAAFDAVFEAVTARQAAE

SEQ ID NO: 21282 - protein, 496 aa, Arabidopsis thaliana
MVRTRGDSRRPTRAPANTRAVARTRSEARRAAPSAPATTPIVGRTRRDARRTAPTIISDDSDSSSDDAVPDPKAARSPVAVPSKQAAEAPPPPSHAPDDSPAPVSDLPPKTSTAPPINDPAPDLLRNAFSSRGRLPYDPSDRCSIHRHHQAERDAADPSIWTPPYEPLTIQFLTSQGVERYKDFKLRDPYEQRYVPRGPPEMRDMMKVIEDNHLLDTVAEIDPFVKEVIWEFYANFHIFNEETKKSKVFVRGKMYEFSPQMINKTFRSPAIKWHAKAEFERVTMSKHALAKYLSDGKVVTWKDLRTPVMPTHLAGLYLICCINWIPSKNNSNVTVDRAKMLYLLNERIPFNFGKLVYDQVEKAARSPGQIQNILPFPNLIYRVLMFQRVITLENYEKPGPHPKLFNPDVRGGIEHPKRRGEYLFGTSLPGDLRHVSTLLTTIATRIEDVEAQGLEPEADDDYVPPVDEGWSPENSDSFVNSLDVDNEEGYEDTQSS

SEQ ID NO: 21283 - protein, 230 aa, Zea mays
  misc_feature (79)..(79): Xaa can be any naturally occurring amino acid
  misc_feature (207)..(207): Xaa can be any naturally occurring amino acid
MSTAGKTITCKAAVAWEAGKPLSIEDIEVAPPKANEVRIQIYYTGVCHTDAYTLSGKDPEGAFPIVLGHEGAGIVESIXGEGVTNVKVGDHVVALYTPECKECKFCKSGKTNLCGKIRATQGKGLMPDGTSRFKCKGKDLLHFMGTSTFSQYTVVADISVVAIEHDAPMDRTCLLGCGITTGYGAATITANVQAGDNVAIFGAGCVXGLSVVQGAAARKAGKIIVVTSPF

SEQ ID NO: 21284 - protein, 250 aa, Sinorhizobium meliloti 1021
MRRTGKTIIGSLLGLAYVVATPFASLASFDDGLRQSTALAGPHGDVLVVADAGSAPGGSQETGSGGGQDTGSSGGQDSGSGGGEGSGGGQDTGSGGGQDTGSGGGQDTGSGGGQDSGSGGGEGSGGGQDSGSGGGQDTGSGGGQDTGSGGGQDSGSGGGEGSGGGQDSGSGGGQDTGSGGGQDSGSGGGQDSGSGGGEGSGGGQDTGSGGGQDSGSGGGEGSGGGQDSGSGGGQDTGSGGGETPASTSSD

SEQ ID NO: 21285 - protein, 168 aa, Methanosarcina mazei
MKFFLKVLQRVCSLYERRKQIEAYIESSMEILAPNLALLAGPMLGARLISIAGSLEKLAAFPSSTIQVIGASKALFKHLRSRAPSPKHGIIYSHPLINTSPWWVRGKVARALAAKLSLAARIDFYSAKRNPSLENELEEKIRKIRAENPRPPQKRQEIRAKPKKKRRK

SEQ ID NO: 21286 - protein, 452 aa, Thermotoga maritima MSB8
MMKMERKNVWHHRKKEEIEAFSKEYMEFMSKAKTERMTVKEIKRILDESGFVPLEDFAGDPMNMTVYAVNRGKAIAAFRVVDDLKRGLNLVVAHIDSPRLDFKPNPLIEDEQIALFKTHYYGGIKKYHWLSIPLEIHGVLFKNDGTEIEIHIGDKPEDPVFTIPDLLPHLDKEDAKISEKFKGENLMLIAGTIPLSGEEKEAVKTNVLKILNEMYGITEEDFVSGEIEVVPAFSPREVGMDRSLIGAYGQDDRICAYTALRALLSANPEKSIGVIFFDKEEIGSDGNTGAKARFYLKALRQILKMQGAKDSEFVLDEVLENTSVISGDVCAAVNPPYKDVHDLHNAPKLGYGVALVKYTGARGKYSTNDAHAEFVARVRKVLNEQGVIWQVATLGKVDQGGGGTIAKFFAERGSDVIDMGPALLGMHSPFEISSKADLFETYVAYRSLMEKL

SEQ ID NO: 21287 - protein, 302 aa, Triticum aestivum
  misc_feature (51)..(51): Xaa can be any naturally occurring amino acid
  misc_feature (60)..(60): Xaa can be any naturally occurring amino acid
  misc_feature (235)..(235): Xaa can be any naturally occurring amino acid
MHSNFGENPLSNYVNREPIGKGAYGHVFKCIDNKTRAVVAMKKITLDMENXGFPSTSIRXISLLREIDHKNVVTLKDVVIDQKQLYLIFEYLDKDLRAYMEGLGNNKMMEPIKIKKFLYQMLAGIADCHMKRIIHRDLKPANILLDANDNLQIADFGLARTYSIPVRPYSEEVVTLWYRAPEILLGSMDYCTPLDIWAIGCIFAEMVTKRPLFAGDSELDQLYRIFRILGTPCEXIWPGVTQLRDYKSTFPHWPHHPIPNVVSGLTLDNLGLDLLGRMLRYDPHARISAKAALQHPYFRELF

SEQ ID NO: 21288 - protein, 258 aa, Triticum aestivum
SFLDVAMRQQLDIYASISLCKSVPGYPTRHKDVDFAIIRENTEGEYSGLEHSSVPGVVESLKIITRTKCERIARFAFDFALKNHRKHVTCVHKANIMKLADGLFLETCRKVAKEYERSGITFSDMIVDNASMQLVAKPQQFDVMVMPNLYGAIVANIGAALVGGPGIVPGANIGREFALFEPGCRHVAKDIMGQDVANPIAMVLSSTMMLRHLGLDFQADSIARAVYTIIEQGKIRTPDMGGKNHTSEVTRAIIEQLK

SEQ ID NO: 21289 - protein, 432 aa, Ustilago maydis 521
MAIPETLQIASPSGKTLTVPTGLFINNKFVPSVDGETLETINPATGKSLGFVSAATASDVDIAVSSARTAFNTTWGRNSSPTQRASILFKLADLLEQHAVELSELESLDNGKPRWIAETMDIADTAGCFRYYAGLADKIEGKTIEQKEGEKLAFTKLEPLGVCGQIIPWNYPIGMLGWKVAPALAAGNCIVLKPAEQTPLSALRIAQLSVEAGLPEGVFNVVNGLGPIVGDAITGHMDVDKVAFTGSTAIGKRVMERAARSNLKKVTLELGGKSPVVVFDDADLDQAVNWAALGILFNQGQDCTAGSRLFVQEGIYDKFLPKLVAAFRAHTIGDPFSNSTFQGPQITQRHQQRILDYIESGKQQGATVEVGGGAWTDGQGEFANGFYVQPTIFSGCKKGMKIVDEEIFGPVLAVAKFKTEQEAQREYVHARR

SEQ ID NO: 21290 - protein, 279 aa, Ostreococcus tauri
MTLERELECARACALAAGREISNAWTSKRDVEYKGSVDLVTATDKKCEEIIFKMIRETFPEDDVVGEETHGSETLRPSTRRTWYVDPLDGTTNFVHGFPFACVSVGLCVDGKPAVGVVHNPTLNETFEASLGGGARLNGNAIAVSACTELGRGLIGTEIGVHRDEATVDAVMGRLRALTKHARSVRCSGSCAMNMCGVAMGRLDGFFEIGFGGPWDCVAGAVIVREAGGVVLDPSGEDFDVCARRVLCANAHVGSSLVDALSTVPDGPDEPQKPSVATC

SEQ ID NO: 21291 - protein, 326 aa, Ralstonia metallidurans CH34
MAKVVRMYETGGPEVLRYEDMEVGDPGPGQVRIRHVAVGLNYADTYFRNGTYPVPLPAGMGVEASGVVQAIGPDVTNVAVGDRVTYTGFLNTLGAYSTERLVPAAPLIRLPENIGFETAAAMTMRGLTSAYLMRRIYAFKRGDTILLHAAAGGVGLIVSQWAKLQGLNVIGTVSSEAKAEVARAHGCDHIINYSHEDVAKRVRELTDGVGATVVFDSVGKNTFMASLDSLKRRGLLVCVGTASGPIPPFDPVLLAMKGSVYVTRPALADYIADPGEKAELAGELFDHVGAGRIRIEINQRYALEDAVQAHRDLESRKTTGSSIFVV

SEQ ID NO: 21292 - protein, 213 aa, Brassica napus
EMGPVTKNEWIMVGTMLLAVTLWICGESLGIPSVVAAMIGLSILLLLGVLNWDDCLSEKSAWDTLAWFAVLVGMAGQLTNLGVVTWMSDCVAKVLQSLSLSWPAAFGLLQAAYFFIHYLFASQTRHVGALFSAFLAMNIAAGVPGVLAALALAYNTNLFGALTHYSSGQAAVYYGAGYVDLPDVFKIGFVMATINAIIRGVVGTFWWKFLGLY

SEQ ID NO: 21293 - protein, 162 aa, Malassezia dermatis
MSNVFFDITKNGAPLGTIKFKLFDDVVPKTAANFRALCTGEKGFGYAGSHFHRVIPDFMLQGGDFTAGNGTGGKSIYGAKFADENFQLKHNKPGLLSMANAGPNTNGSQFFITTVVTSWLDGKHVVFGEVVEGMDVVKAIEAEGSGSGKTRSRIEIAKCGVC

SEQ ID NO: 21294 - protein, 160 aa, Salinibacter ruber DSM 13855
MNPRDGLLDTRVKDIIQSKSALADDGNVLTTSPTATVFECIGRMVDRDVGSIVVMEGDAIAGLFTERNYMQSIALEGRSSDETEVQEVMTEDVATVRPDKPLEECLRLMTRLRCRHLPVVDEGGDLIGIVSIGDGVKQIIQTAQRETSRLRQYVTGTYAE

SEQ ID NO: 21295 - protein, 162 aa, Malassezia globosa
MSNVFFDITKNGAPLGTIKFKLFDDVVPKTAANFRALCTGEKGFGYAGSHFHRVIPDFMLQGGDFTAGNGTGGKSIYGQKFADENFQLKHSKPGLLSMANAGPNTNGSQFFITTVVTSWLDGKHVVFGEVVDGMNVVKAIEAEGTSSGKPRSRIEIAKCGVC

SEQ ID NO: 21296 - protein, 554 aa, Haemophilus influenzae R2866
MKGNTMKNINPTHTQAWKFLEAHKAELSNTTIQDLFKQEKNRFDDYSLTFNNQILVDFSKNNINQTTLSLLRQLAQECSLDSAKEAMFTGEKINRTENRAVLHTALRNRANTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTNNMFEFWDWVGGRYSLWSAIGLSIALSIGFENFEALLNGAHEMDKHFRSTPIEKNIPTTLALVGLWNTNFLGAQTEAILPYDQYLHRFAAYFQQGNMESNGKYVDRDGNVINNYQTGPIIWGEPGTNGQHAFYQLIHQGTTLIPCDFIAPAQSHNPLADHHNKLLSNFFAQTEALAFGKTKEEVEAEFVKAGKSLDDVKNIVPFKVFTGNKPTNSILVQKITPFTLGALIAMYEHKIFVQGVIFNIFSFDQWGVELGKQLANRILPELTDSEKVASHDSSTNGLINQFKAWR

SEQ ID NO: 21297 - protein, 162 aa, Malassezia japonica
MSNVFFDITKNGAPFGTIKFKLFDDVVPKTAANFRALATGEKGFGYEGSSFHRVIPDFMLQGGDFTAGNGTGGKSIYGAKFADENFNLKHNKPGLLSMANAGPNTNGSQFFITTVVTNWLDGKHVVFGEVVDGMDIVKAIEAEGTGSGKPRSQITIAKCGVC

SEQ ID NO: 21298 - protein, 162 aa, Malassezia nana
MSNVFFDITKNGAPLGTIKFKLFDDVVPKTAANFRALCTGEKGFGYAGSHFHRVIPDFMLQGGDFTAGNGTGGKSIYGAKFADENFQLKHNKPGLLSMANAGPNTNGSQFFITTVVTSWLDGKHVVFGEVIEGMDVVKAIEAEGSGSGKTRSRIEIAKCGVC

SEQ ID NO: 21299 - protein, 339 aa, Zea mays
  misc_feature (225)..(225): Xaa can be any naturally occurring amino acid
MALRRLLQGSVLPRIIGRDLAPAVAPFSTESGETIRATLFPGDGIGPEIAESVKQVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRGVVESLKIITRQASLRVAEYAFHYAKANGRERVSAIHKANIMRKTDGLFLKCCREVSEKXLVMPNLYGDIISDLCAGLIGGLGLTPSCNIGEGGICLAEAVHGSAPDIAGKNLANPTALMLSAVMMLRHLQFNDKADRIHNAILQTIAGGKYRTADLGGKASTSEFTNAVCDHI

SEQ ID NO: 21300 - protein, 465 aa, Haemophilus influenzae R2866
MGPSTDRDNNLEKIIAAGANVVRMNFSHGTPDDHIGRAERVRSIAKKLGKTVAILGDLQGPKIRVSTFKDGKIFLNIGDKFILDAELPKGEGTQESVGLDYKTLPQDVVPGDILLLDDGRVQLKVLSIDGAKVFTEVTVGGPLSNNKGINKLGGGLSADALTEKDKADIITAARIGVDFLAVSFPRSSADLNYARELAQQAGLNAKIVAKVERAETVANDEAMDDIILASDVIMVARGDLGVEIGDPELVGVQKKLIRRSRQLNRAVITATQMMESMISNPMPTRAEVMDVANAVLDGTDAVMLSAETAAGQYPSETVAAMASVCLGAEKMPSINVSRHRMDKEFETIEESVAMSAMYAANHMKGVAAIVTLSSTGRTPLLMSRISSGLPIFALSRNQETLNLCALYRGVTPIYHGEESRTEAGAKAALQSLKEKGYLSTGDLVLVTQGGQGATQTNVCRTLIVE

SEQ ID NO: 21301 - protein, 195 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEGVRQRAKQPPHDRPYIKCQRRLVHL

SEQ ID NO: 21302 - protein, 162 aa, Malassezia obtusa
MSNVFFDITKNGSPLGTIKFKLFDDVVPKTAANFRALATGEKGFGYEGSGFHRVIPDFMLQGGDFTAGNGTGGKSIYGQKFADENFNLKHNKPGLLSMANAGPNTNGSQFFITTVVTPWLDGKHVVFGEVVDGYDVVKAVEAEGTGSGKPKSQIKIAKCGVC

SEQ ID NO: 21303 - protein, 280 aa, Lactococcus lactis subsp. lactis Il1403
MIEQEKYTLNDGHLIPKIGLGTFQIRGYEGVEQILTAIQSGYRLLDTSTNYDSEGAVGEAIRRSGIPRSNFFVTTKLPGKYHHFEDALKMIEESLLRTGLSYFDLYLIHWPLPKRDNYVEAWKALIAAKKRGLVRSIGVSNFEEDHLDKIIQETGVIPAINQNEIHPYWPQEKLLKINKKYGILTEAWSPLGRGSKELEESLIQNIAQKYGKDTGQIILRWQVERGIIPIVKATSPEHQRRNIDIFDFSLSSEEINKITALKQENGRVDNQDPNEYEEFV

SEQ ID NO: 21304 - protein, 259 aa, Vitis vinifera
MSQQQRPRPTQPTTEPIKYSDVFPVSGSLASKPIAPQDAATMQSAENTVLGNTQKGGPAAVMNSAATKNERAGLVSHEQVTDVVATDGVTISQANVAGSRIITEAVGDQVVGEYARPPPVAMTSPASALDRDAITIGEALQATALSAGNKPVDQSDAAAIQVAEMRATGSSEVVPGGIAAQAQSAATTNARLILDENKTKLSDILTDATAKLPDDKPATREDAERVIGAELRNDPNMVTYPGGVAESVAAAARLNQSTK

SEQ ID NO: 21305 - protein, 412 aa, Shigella flexneri 2a str. 2457T
MTNYRVESSSGRAARKMRLALMGPAFIAAIGYIDPGNFATNIQAGASFGYQLLWVVVWANLMAMLIQILSAKLGIATGKNLAEQIRDHYPRPVVWFYWVQAEIIAMATDLAEFIGAAIGFKLILGVSLLQGAVLTGIATFLILMLQRRGQKPLEKVIGGLLLFVAAAYIVELIFSQPNLAQLGKGMVIPSLPTSEAVFLAAGVLGATIMPHVIYLHSSLTQHLHGGSRQQRYSATKWDVAIAMTIAGFVNLVMMATAAAAFHFSGHTGVADLDEAYLTLQPLLSHAAATVFGLSLVAAGLSSTVVGTLAGQVVMQGFIRFHIPLWVRRTVTMLPSFIVILMGLDPTRILVMSQVLLSFGIALALVPLLIFTSDSKLMGDLVNSKRVKQTGWVIVVLVVALNIWLLVGTALGL

SEQ ID NO: 21306 - protein, 105 aa, Prochlorococcus marinus str. MIT 9215
MSSIKLEQRVSNSSAVIEKKPAELKNKSPKYKVLLHNDPVNSMEYVTISLREVVPQLSEQDAIAIMLEAHNTGIGLVIICDLEPAEFYSESLKSKGISSSIEKED

SEQ ID NO: 21307 - protein, 609 aa, Lactococcus lactis subsp. lactis Il1403
MAFSKKTRQEAITKIQNEEMDLLVIGGGITGAGLTLQAAAAGMKVAVLEMQDFSEGTSSRSTKLVHGGIRYLKNFDVEVVSDTVSERAVVQGIAPHIPKPDPMLLPIYDDEGKTTFDMFSVKIAMDLYDRLAGVDEDSPYANYTISPEEVLRREPLIKKKGLQGAGVYLDYRNNDARLVIDNIKKAVEDGAQAISKMKVIDFIYTDGQISGIRARDLLTDQVIEVKAKLVINTSGPWVDKIRYLNFTRPIVPKMRPTKGVHLVVDAAKLPVPQPTYFDTGKHDKRMVFAIPRENKTYFGTTDTDYHGDFTDPKVTQEDVDYLLDVINFRYPEANITINDIEASWAGLRPLLGGNSGSDYNGGDNGAVSETSFNAVVEAVLRYKNKTATKAEVEHLLNNMESSLSEKGDAPSSVSRGSSLERESDGLITLAGGKITDYRKMAAGAMELICQLLEEDFGLKYEPIDSKKYQISGGEFDPTKVEEVVAENMKVGVAAGLTEEEAKYIADFYGMNALQVFAYASEMEAYEGLSLAESARLCYALEDEMILTPVDYLLRRTNHILFMREGVDAIKVHVVNAMADDLGWSAEEKAEQEKALEEALRESDLSDLKK

SEQ ID NO: 21308 - protein, 414 aa, Prochlorococcus marinus str. MIT 9215
MKFLSKVVQVNENYLKLKAGYLFPEIAKRVKIYSQSNKGTEIIKLGIGDVTEPLPRSCIEAMGKALDDMGTLDGFRGYGPEQGYSWLREKISEHDFISRGCNISPEEIFVSDGSKCDSSNILDILGKDNSIAVTDPVYPVYVDSNVMTGRTGDALENGTYQGLTYLAINEGNNFLPRIPEKKVDILYLCFPNNPTGATINKEDLKKWVDYALQNKSLILFDAAYEAFIQDNDIPHSIYEIEGAKDCAIEFRSFSKNAGFTGVRCAFTVIPKNLKGLSSTNEEIDLWPLWNRRQSTKFNGVSYVVQRGAEAVYSLEGKKQVRGLIDFYMENAKIMKNKLQNAGYKVYGGDNAPYIWIKVPDQMTSWDFFDFLLQKVSVVGTPGSGFGLSGEGYFRLSAFNSRSNVINAMERIINI

SEQ ID NO: 21309 - protein, 115 aa, Alteromonadales bacterium TW-7
MALERTFSIVKPDAVAKNHIGAIYNRFETAGLKIVAAKMVHLSQEKAEGFYAEHSERPFFGALVSFMTSGPVMVTVLEGENAVLKNREIMGATNPAEALAGTLRADYADSIDENA

SEQ ID NO: 21310 - protein, 696 aa, Schizosaccharomyces pombe
MTEIFGKLHRSSNSENTNQASPSTIQSHSTQPVLSNDHSTKVNDYEGKEGASSNGYDPVFMSDRMKMRYNEITAQLHKEQSLKEDKESGSNSSESNGITPMGTYSEKPKLLQSRTPPSSCYIRHDTVVPKDKNGQHAFGRLYVRLHQGRDLNVKSVNAQPYAVITFEKTQVMVPPPLKDIDGGIPISIPSKNRPLAGSRSGSSSGLHSELMLADVRCPHWDFETVFDVTKMKSQMVVSVYDKYEDDKFLGSVKITPIFLHEYVQEAWYKLEPLDLTKSLEGEIKVETIYEHIEHVRYGPEDFTALRLIGKGTFGQVYLVRKNDTNRIYAMKKISKKLIVRKKEVTHTLGERNILVRTSLDESPFIVGLKFSFQTASDLYLITDYMSGGELFWHLQHEGRFPEQRAKFYIAELVLALEHLHKHDIIYRDLKPENILLDADGHIALCDFGLSKANLSANATTNTFCGTTEYLAPEVLLEDKGYTKQVDFWSLGVLVFEMCCGWSPFYAPDVQQMYRNIAFGKVRFPKGVLSSEGRSFVRGLLNRNPNHRLGAVADTTELKEHPFFADINWDLLSKKKVQPPFKPNVQNDLDVSNFDKEFTNTNVKNINIVSNVDPANASTPLSNTIQDRFRGFTFVNKSIDEQFQNLGLQENEETDNLHACRTTTHSSVNSINSHGNPRTVDANDPVADTVFGETFEA

SEQ ID NO: 21311 - protein, 149 aa, Sulfitobacter sp. EE-36
MPTYEKTDAAINALSPEEFRVTQQNGTERPGTGKLLDNKEPGIYVDIVSGEPLFASSDKYESGCGWPSFTKPIEPAHVAELRDASLGMIRTEVRSAHGDSHLGHVFPDGPADRGGLRYCINSASLRFIHRDDMQDAGYGDYINQVEDVA

SEQ ID NO: 21312 - protein, 281 aa, Prochlorococcus marinus str. MIT 9215
MRKQVAYLGPKGTYAEKAAQILSKLANFQTPIFVPCNGLHSVIKLLAYNNCDAAVVPIENSVEGGVTATLDALWKYPEIFINKAIVLPIKHALISDGDLSNISEVLSHPQALAQCAEWLSENLPNAIPLPTNSTSEAVNMVKGSKFRAAIGSKSLIQIGGLKELAFPINDVPGNCTRFVLLSKESNSNLANIASFAFSLISNKPGALLKAINNIADFGFNMSKIESRPSKRELGEYIIYIDLEINNKNNIKSFIELRNKLKPLCKNFVDFGNYFSENVEID

SEQ ID NO: 21313 - protein, 176 aa, Sinorhizobium meliloti 1021
MPLYALGPLRPQTPTEGSYWVAPDANIIGQVELGEDVGIWFGATLRGDNEPIRIGARTNIQEAVIIHVDPGHPVSIGEGCTIGHRAIVHGCTIGDNSLIGMGATILNGAKIGRNCLVGANALVTEGKEFPDNSLIVGAPAKMVRTLDDAAVEGLKRSAEHYVKNWQRYAAQFTLLD

SEQ ID NO: 21314 - protein, 207 aa, Oryza sativa Indica Group
VVNNRNKALMLIEAWGESGDELRYLPVYEETYKSLKSRGVRFPGRDNESLAPIFTPARSVAEAEVDANFSQQTFEDVQVHTYTAEETKEAFDVARNSIELLSTVLSSSPQQDALQDDLTSTLVQQCYQSQHTIQRMIETAGDNEAMLFEALSVNDEIQKVLSKYEQMKKPAASENAEQRPVVIPIATEHEDSATVGNEDALVRKPAG

SEQ ID NO: 21315 - protein, 539 aa, Ralstonia metallidurans CH34
MITIDTRIDSTSDTFATQRAGMQALTDRLRALEQRAVDASSRARSSFQKRGALLPRERVACLLDPGAPFLPLATLAGYGLDDPNPDTSIPGGSLVAGIGFVCGVRCMVLATDSGIDAGAMTEAGNLKLMRCQDIALENRLPLIHLVESAGANLRKYRVEKFVRGGTIFYNLARLSAAGLPVITVVHGSSTAGGAYMPGLSDYVVMVRKRARAFLAGPPLLKAATGEIATDEELGGADLHATVSGLAEYLAEDDEHAIATARDIVASLDWPRVDQTPPRPARAPKLPAAELEGVMTLDHKRPVDMREVIARLVDDSAWLPFKPDYGPGTVCGHARIEGHAVGFIANNGPIDPAGATKAAQFIQACNQSGTPIVFLQNTTGFIVGKASEEAGMIKHGSKMIQALSNSTVPHVTLYCGASFGAGNFGMCGRGFHPRFCFSWPNARTAVMGGEQAAMTLEIVARQQAARKGVPVDEAALAAQTAEIVANFERQGSAFVTSGLLLDDGVIDPRDTRAVLAFVLATAREAAARTPRAMQFGVARF

SEQ ID NO: 21316 - protein, 116 aa, Oryza sativa Japonica Group
MAGVACVLVVGVLWLSAGQSAACDGHPCPTPAGKCPINTVKLGVCADVLDGLIHASTPPKEPCCPLIAGLADLDAAVCVCLAINANLLGLNLDVPVDLSLLLNYCGCKLPAGFKCA

SEQ ID NO: 21317 - protein, 194 aa, Oryza sativa
WATTRPTPTTSRSGCSIAPLSLLLLLPLISLDLVGGGADWWCWRLCCCGGSQLRCENCGEVSAKATCVSLGEVVDLPNGRSTANLVQKCKLCGRDASIVMIPGQGTPLTMEQSQKGDRTCLMVFDCRGCEPIDFAFGNGWKAESLEGTSFDIDCSEGEFADYDEKGECPVGVGKLRSEFRVVKKQESRGKTKYV

SEQ ID NO: 21318 - protein, 208 aa, Burkholderia xenovorans LB400
MHLTRQTLRLPMPFNFPIFLTWLRIVLIPLVVGVFYLPDMMMSPAHRNLAAATIFILAALTDWFDGFLARKWNQTSAFGAFLDPVADKLMVTAALLVLVQLARIDSAIALVIVGREIAISALREWMAQIGASKSVAVNSLGKFKTVCQMVAIPMLLFYGPLRFGGGVVVDTRVWGLWLIYLAAFLTIWSMLYYMKLAWPQIRERSGVA

SEQ ID NO: 21319 - protein, 633 aa, Physcomitrella patens subsp. patens
MASKPAFGCCLSSPSAPHQNGCGLVEEEFEKAIRGRKVKAMNAADLATFLINTQCEKSMTEDRATTLMTDFNRVVMKSDSSRHFRIPGFSGSSRLSRSSRHATPAPEQPPTFDFPTFLRFLWHPDFNGPQAAKSSTPTDDMNRPLSDYYISASHNTYLSGNQLWGRCSTTPIIKALEEGCRVIELDCWNGTGLNIDVLHGGTLTKPVSFQECVTAIKNHAFQYSDYPVIVTIENHLDHEHQKEAAKAMQVLHEILGQRMMFVPPPTERPPKLFRHPEQLKNKIIISDKPPGLPLLTQIVEDREFAEEIIKKEIIGSDSEDGEDGEDENEHSRKCMKKVLTRQDQISRSRTLQPTSSQDTDDSSSEFDPEFDKLLYIHCQKPNEMENDHVKGGPLKIGKVAIMANLSEPQLNAQVKDHPDSLIEFSKRNLGRVYPFGLRIDSSNGDPMYAWEHGVQIAAINWQGCDWPVWISKALFSKNGGCGYVKKPAVLLPESKHDHRSLKDIKPKLELKVKFLLGYVWQKKYASRRRGYFVRVTIHGMHGDKQKKRTRVIKQSPNPSWEDQELEFQIRVPELAVLRVELKRRDRMIRNGWVGQCCVPVTELLQGIRTMRLAARNGDHRRSKLLCYFEKKLL

SEQ ID NO: 21320 - protein, 413 aa, Oryza sativa Japonica Group
MTEGNIARWVKKEGDKVSPGEVLCEVETDKATVEMECMEEGYLAKIIHGDGAKEIKVGEIIAVTVEEEEDIGKFKDYKAPSSAESAAPAESKPQSEPTEPKKEKEQPKAPEPKATKTEESFLSEDRTFSSPIARKLAEDNNVPLSSIKGTGPDGRILKADIEDYLASVAKGAKKETAAAPGLGYVDLPNTQIRKVTANRLLHSKQTIPHYYLTVDTRVDKLIKLRSELNPLQDTSGGKKISINDLVIKAAALALRNVPECNSSWMNDFIRQYHNVNINVAVQTEDGLFVPVIRDADKKGLATIADEVKQLAQRARDNSLKPEDYEGGTFTVSNLGGPFGIKQFCAIVNPPQSAILAIGSAEKRVIPGAEGQFEVGSFMSATLSCDHRVIDGAIGAEWMKAFKGYIENPTTMLL

SEQ ID NO: 21321 - protein, 195 aa, Brassica napus
MGDDRLDLELSDEVLSVIPMDPFEQLDLARKITSMAIASRVSNLDSEVVELRQKLQGKETVVRELVDKASRLEKDRREADSRLKTVLEENMILTKEKDSLAMTVTKLTRDLAKLETFKRQLIKSLSDESAPPQTEPVDIKACDQSSIGSTGSYTGKDERTTVHSTHRSYSGSSDMNNPIVEASKYAGNKFSMTPY

SEQ ID NO: 21322 - protein, 58 aa, Triticum aestivum
  misc_feature (2)..(2): Xaa can be any naturally occurring amino acid
  misc_feature (20)..(20): Xaa can be any naturally occurring amino acid
  misc_feature (30)..(30): Xaa can be any naturally occurring amino acid
MXKICCIGAGYVGGPTMAVXAVKCPAIEVXVVDISKPRIDAWNSDKLPIYEPGLDEVV

SEQ ID NO: 21323 - protein, 449 aa, Thermotoga maritima MSB8
MYDAVIIGGGPGGYVCAIKLAQLGKKVALVEKDALGGTCTNRGCIPTKAMLTVSHLMDEMKEKASKYGLKVSGVEYDVAAIMKHVQKSVMMSRKGIEYLLKKNGVEVFKGTAVVENKNTVVVQETGEKLEAKNLVLAHGSVPSVFSPFDIDGVWTSDDVFNLKEFPKSLVIVGGGVIGVEFATFFGSFGVDVTIVEIAEHILPYEDSDVAEEVKKALKRKGVKILEKTKISSLSKVDDGFEVALENGETLKAEKVLLAAGRKPNIPEDVKALGVKIEKGVVTDSRMRTNVENVYAIGDIRSGIMLAHVAMYEGIVAAKNIAGEEEEMDYSAVPSIIFSSPEVASVGVREKDVNPEEVVISKFPVSANGRARTMLENIGFAKVIADKKDGTVLGMSIVSPSATDMIMEGVIAVKFRMKAEDLEKAIHPHPTLTETILGALEGVSGKPIHL

SEQ ID NO: 21324 - protein, 162 aa, Malassezia restricta
MSNVFFDITKNGAPLGTIKFKLFDDVVPKTAANFRALCTGEKGFGYAGSHFHRVIPDFMLQGGDFTAGNGTGGKSIYGAKFADENFQLKHSKPGLLSMANAGPNTNGSQFFITTVVTSWLDGKHVVFGEVVDGMDVVKAIEAEGTGSGKPRSRIEIAKCGVC

SEQ ID NO: 21325 - protein, 162 aa, Malassezia slooffiae
MSNVFFDITKNGAPLGTIKFKLFDDVVPKTAENFRALCTGEKGFGYAGSSFHRVIPDFMLQGGDFTAGNGTGGKSIYGAKFPDENLALKHNKPGLLSMANAGPNTNGSQFFITTVPTSWLDGKHVVFGEVTDGMDVVKAIEREGSGSGKPKSVITIAKCGVC

SEQ ID NO: 21326 - protein, 141 aa, Malassezia yamatoensis
MSNVFFDITKNGSPLGTIKFKLFDDVVPKTAANFRALATGEKGFGYEGSNFHRVIPDFMLQGGDFTAGNGTGGKSIYGQKFADENFNLKHNKPGLLSMANAGPNTNGSQFFITTVVTPWLDGKHVVFGEVVDGMDVVKAIE

SEQ ID NO: 21327 - protein, 238 aa, Brassica napus
  misc_feature (6)..(6): Xaa can be any naturally occurring amino acid
  misc_feature (14)..(14): Xaa can be any naturally occurring amino acid
  misc_feature (17)..(17): Xaa can be any naturally occurring amino acid
  misc_feature (29)..(29): Xaa can be any naturally occurring amino acid
  misc_feature (32)..(32): Xaa can be any naturally occurring amino acid
  misc_feature (39)..(39): Xaa can be any naturally occurring amino acid
  misc_feature (46)..(47): Xaa can be any naturally occurring amino acid
  misc_feature (51)..(51): Xaa can be any naturally occurring amino acid
  misc_feature (54)..(54): Xaa can be any naturally occurring amino acid
  misc_feature (65)..(66): Xaa can be any naturally occurring amino acid
  misc_feature (75)..(75): Xaa can be any naturally occurring amino acid
  misc_feature (97)..(97): Xaa can be any naturally occurring amino acid
  misc_feature (116)..(116): Xaa can be any naturally occurring amino acid
  misc_feature (128)..(128): Xaa can be any naturally occurring amino acid
  misc_feature (149)..(149): Xaa can be any naturally occurring amino acid
  misc_feature (194)..(194): Xaa can be any naturally occurring amino acid
EHEDLXKVAEPLTXDLXNVPRQAEPKSQXTGXDFRQHSXGEATHFXXAFEXPGXKDEKEALIASXXQMLMGGGGXFSAGGPGKGMHSWLYLRILNEXQQVQSCTAFTSIFDNTGLXGIYGYTSPEFAXKAIELAAKELKDVAGGKVNTXHLDRAKAATKSAVLMNLESRMIAAEDIGRQILTYGERKPVEQFLXAVDELTLKDITDFTSKIISKPLTMGSFGDVLSVPSYDTVSSKFC

SEQ ID NO: 21328 - protein, 480 aa, Zea mays
MALTRIGLAGLAVMGQNLALNIAEKGFPISVYNRTTSKVDETVQRAKVEGNLPVFGFHDPASFVSSIQKPRVVIMLVKAGAPVDQTIATLAAHLDQGDCIVDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLIAEAYDVLKSVGKLTNSELHQVFSEWNKGELLSFLIEITADIFGIKDDKGEGYLVDKVLDKTGMKGTGKWTVQQAAELSVAAPTIEASLDSRFLSGLKDERVEASKIFQGDYSTGLPVDKAQLIEDVRQALYASKICSYAQGMNIIKAKSSEKGWGLNLGELARIWKGGCIIRAIFLDRIKKAYDRNPNLANLLVDPEFAQEIIDRQAAWRRVVCLAINNGVSTPGMSASLAYFDSYRRDRLPANLVQAQRDYFGAHTYERVDMPGSFHTEWFKIARNSKI

SEQ ID NO: 21329 - protein, 318 aa, Brucella melitensis 16M
MKAIAAFSDFVGRSFAIWVIVFAALGFVMPATFSIFAPWIVVLLGIIMFGMGLTISGKDFAEVAKRPFDVAIGVLAQFIIMPLLAVLLTRIIPMSPEVAAGVILVGCCPGGTASNVMTYPSKGDVALSVACTSVTTLLAPLVTPFLVWFFASQYLPVDAMSMFISIVKVILVPLALGFVLQKLVPGVVKAAVPMLPLVSVVGIVLIVAAVVAVNKAAIAQSGLLIFAVVVLHNCCGLLLGYFAARFAGLSLAKRKAISIEVGMQNSGLGAALANAHFSPLAAVPSAVFSVWHNISGALVASYYARMEDDASETQTSAQ

SEQ ID NO: 21330 - protein, 284 aa, Sulfitobacter sp. EE-36
MEKTLLSIGHGFSARALAARLVPQGWRIIGTTRSPDKADAIADTGVEPVVWPGADLGALIAQFPNVLVSAGPDSAGDPVLNAVEDAVIRAAPDLRWVGYLSTTGVYGDHDGNWVDEDTPLTPSTKRGRARVTAEARWQAIPDLPLHIFRLAGIYGPGRGPFAKVRAGTARRIIKQGQVFSRIHVEDIAQALELSLQRPDPGAVYNLCDDDPAPPQDVIAHAAALLGLPVPPAIPFDQADMTPMARSFYAESKKVRNDRIKQALGWAPQFPTYRAGLAALLAQDS

SEQ ID NO: 21331 - protein, 300 aa, Pseudomonas aeruginosa
TLSRDDAAQVAKVLSEALPYIRRFVGKTLVIKYGGNAMESEELKAGFARDVVLMKAVGINPVVVHGGGPQIGDLLKRLSIESHFIDGMRVTDAATMDVVEMVLGGQVNKDIVNLINRHGGSAIGLTGKDAELIRAKKLTVTRQTPEMTKPEIIDIGHVGEVTGVNVGLLNMLVKGDFIPVIAPIGVGSNGESYNINADLVAGKVAEALKAEKLMLLTNIAGLMDKQGQVLTGLSTEQVNELIADGTIYGGMLPKIRCALEAVQGGVTSAHIIDGRVPNAVLLEIFTDSGVGTLISNRKRH

SEQ ID NO: 21332 - protein, 194 aa, Staphylococcus epidermidis ATCC 12228
MNLIPTVIETTNRGERAYDIYSRLLKDRIIMLGSQIDDNVANSIVSQLLFLQAQDSEKDIYLYINSPGGSVTAGFAIYDTIQHIKPDVQTICIGMAASMGSFLLAAGAKGKRFALPNAEVMIHQPLGGAQGQATEIEIAANHILKTREKLNRILSERTGQSIEKIQQDTDRDNFLTAAEAKEYGLIDEVMEPEK

SEQ ID NO: 21333 - protein, 248 aa, Oryza sativa Indica Group
TLRPPDFSVPLEELKAAVSKNTRAIMINTPHNPTGKMFTREELEFIATLCKENDVLLFADEVYDKLAFEADHISMASIPGMYERTVTMNSLGKTFSLTGWKIGWAIAPPHLTWGVRQAHSFLTFATCTPMQAAAAAALRAPDSYYEELRRDYGAKKALLVNGLKDAGFIVYPSSGTYFVMVDHTPFGFDNDIEFCEYLIREVGVVAIPPSVFYLNPEDGKNLVRFTFCKDDETLRAAVERMKTKLRKK

SEQ ID NO: 21334 - protein, 249 aa, Populus trichocarpa
MKFNIANPTTGCQKKLEIDDDQKLRAFFDKRISQEVSGDSLGEEFNGYVFKIMGGCDKQGFPMKQGVLTPGRVRLLLHRGTPCFRGYGRRNGERRRKSVRGCIVSQDLSVLNLVIVKKGDNDLPGLTDTEKPRMRGPKRASKIRKLFNLSKEDDVRKYVNTYRRTFTTKSGKKVSKAPKIQRLVTPLTLQRKRARISDKKKRIAKAKSEAAEYQKLLATRLKEQRERRSESLAKKRSRLSIASKPSVAA

SEQ ID NO: 21335 - protein, 238 aa, Crocosphaera watsonii WH 8501
MLKHNQQRLCLQVEQILVEQELVIKSLGDTLTLPSYIQGYSVLGNGALTLVIDPMALPSQPQKTSQTVHPLLKTLSGEPQKSERSPMTTVAQQKDLSINPEKPSLLGHSVSVLVVDDSVVQRQALLQTIEKGGYKVLQAGNGQEALAKLNKHPEIKLIICDIEMPYMNGFEFLSHWKQNANISEIPVIMVTTRSGKKHRQLALALGAKSYLTKPCSHPELLETIGELITQNQTLVTLK

SEQ ID NO: 21336 - protein, 194 aa, Coprinopsis cinerea okayama7#130
MVAPRDAAQPAPGTGFNPEKTNTPLQGHVAFFDRDGDGIIWPWDTYNGFRDIKFGVALSLLAMCIVHFGFSYMTMGSWIPDPILPSEDQAKHGSDSEVYTGIGEYDDNRFNYMFDMYTQPPHAYMTFPEAMYMVRANMNPWDFFGWFAAIFEWTATYIMLWPADGKMGREDIKGVYNGSIFYMISGRKPMGKVV

SEQ ID NO: 21337 - protein, 285 aa, Glycine max
MAKHDVEGGSFAAKDYHDPPPAPLIDAEELTQWSFYRALIAEFIATMLFLYITVLTVIGYKSQSDVKAGGDVCGGVGILGIAWAFGGMIFILVYCTAGISGGHINPAVTFGLFLARKVSLIRAIMYMVAQCLGAICGVGLVKAFQKAYYNRYGGGANELSEGYSTGVGLGAEIIGTFVLVYTVFSATDPKRNARDSHVPVLAPLPIGFAVFMVHLATIPVTGTGINPARSLGAAVMYNQQKAWDDHWIFWVGPFIGAAIAAFYHQFILRASAAKALGSFRSNPTI

SEQ ID NO: 21338 - protein, 404 aa, Emericella nidulans
MASQVQPGQKPKVQPCRYKTGKTLGAGLYSVVKECVHIDTGQYYAAKVINKRLMVGREHMVRNEIAILKQVSTGHQNILTLVDYFETMNNLYLVTDLALGGELFDRICRKGSYYESDAADLVRAILSAVAYLHDHGIVHRDLKPENLLFRTPEDNADLLIADFGLSRIMDEEQLHVLTTTCGTPGYMAPEIFDKSGHGKPVDIWAIGLITYFMLCGYTPFDRETNLEEVQAIATANFSFTPVEYWRGVSQEARDFIKRCLTVNPKKRMTAHQALQHPWINPPYDTTDDLGSGEDLLPNIKKNFNARRTLHKAIDTVRAINKLRENGGLMMDGIMSVDPKPEHVNGSEVVEDRTTPRERENEDAMEIDSRSNARGQTEQQIREQERKVKETVAGLWSRTAPRSER

SEQ ID NO: 21339 - protein, 506 aa, Triticum aestivum
MAAVLPICLLLVLLLAIPLILFKSRRPAPHRGPGGRAVRLPPGPWALPVIGHLHHLAGALPHRALRDLARRHGPLMMLRLGELDAVVASSPDAAREIMKTHDASFASRPLTSMQQMAYGDAEGLIFAPYGDAWRQLRKICTVEIFSSRRVQSFRPAREEELGHLLRSVAAASASSSPVNLSERISAYVADSTVRAIVGSRFKQRDTYLEMLQEGLKIVPGMTLPDIFPSSRLVRLLSSVPGRIQRHSQDMKLFMDTIIQEHQVNSGPDCDGDKEEDLLDVLLRLQKEGDSQYPLTTDNIKTVMLDMFGAGSETSATTLQWAMAELIRNPRVMRKAQDEVRQQLAGHDKVREADLADLRYLGFVIKETLRMHPPAPLLLPRRCGSPCQVLGLDVPEGVMVIVNAWAIGMDPAHWEAPEEFAPERFEQNGRDFKGADFEFVPFGGGRRICPGMAFGLAHVELALAALLFHFDWELPGGAAAEDLDMTEEFGVTARLRSDLVVVAVATE

SEQ ID NO: 21340 - protein, 506 aa, Physcomitrella patens subsp. patens
MASDGLSRIGLAGLAVMGQNLALNIAQKGFPISVYNRSANKVDETVERAKEEGNLPVKGFKDPAEFVNSIQKPRCVIILVKAGSPVDQTIELLSKYLEEGDCIIDGGNEWYENTERRAETVKAKGLLYLGMGVSGGEEGARHGPSLMPGGTLEAYKYIEDIVQKVAAQVDSGPCVTYVGPGGAGNFVKMVHNGIEYGDMELIAEAYDVLKSVGGLSNKELHETFFEWNKGELESFLVEITADIFSVPDDKAEGELVDKVLDKTGMKGTGKWTVQQAAELSVACPTVATSLDLRFLSGLKEERVEASKVFKSLGVSDLLTEVKVDKQELIDNVRKALYASKICSYAQGMNLIRAKSAEKGWNLDLGELARIWKGGCIIRAKFLDRIKQAYDRNPKLASLLIDPEFAKEMVERQSAWRKVVSLAIEVGVSTPGMSASLAYFDTYRRARLPANLVQSQRDYFGSHTYERVDMNDAYHTEWYKIAKKLLNDRAAITGEQLTIGSHEQKHS

SEQ ID NO: 21341 - protein, 284 aa, Oryza sativa
MAGGPAAVSFLTNIAKAAAGLGAAASLLSASLYTVDGGERAVIFDRFRGVLPETVGEGTHFLVPWLQKPFVFDIRTRPHNFSSNSGTKDLQMVNLTLRLLSRPDVVHLPTIFTSLGLEYDDKVLPSIGNEVLKAVVAQFNADQLLTERPHVSALVRDALIRRAREFNIILDDVAITHLSYGIEFSQAVEKKQVAQQEAERSKFLVAKAEQERRAAIVRAEGESESARLISEATAAAGTGLIELRRIEAAREIAAELARSPNVAYVPAGDNGRMLLGLNAAGFGR

SEQ ID NO: 21342 - protein, 515 aa, Physcomitrella patens subsp. patens
MAERGFEVDTRVENELKTVGGFRNARRTKLVATIGPACCSYEQLDELASSGINIARLNMCHGTHEWHRQVIENCRRLNAAKGYGIAVMIDTEGSEIHMGDLGGASSARAEDGEEWCFTVRKFNGPLPAYTLQVNYEGFAEDVQVGDELVVDGGMVRFEVLEKVGPDVQCKCTDPGILLPCANLNLWRDGFLVRKKNVTLPTISSKDWVDIDFSISEGVDFIAVSFVKSPEDIKHLKSYVSARSPDRSIGVIAKVEDGDSLRNLDGIIRVSDGVMVARGNLGAHIPLEQVPSVQEAIVDACRKLNKPVIVASQLLESMVEYPTPTRAEVADISNAVRQQADALMLSGESAMGLHPKKAVEVLRIVSLRMEQWGREETHHDKVSLPEISQSDTARTSEQICNVAAQIANKLGADAIFVYTRRGYMASLLSRNRPDCPIFAFTESTNVTRRMDLLWGIVPFKFDFRKDLESNLLQSSALLKARGMASSGNLVVAVSDVSSSSQSEIGILQSIQVHVLS

SEQ ID NO: 21343 - protein, 411 aa, Oryza sativa
  misc_feature (299)..(299): Xaa can be any naturally occurring amino acid
  misc_feature (320)..(320): Xaa can be any naturally occurring amino acid
  misc_feature (333)..(333): Xaa can be any naturally occurring amino acid
  misc_feature (343)..(343): Xaa can be any naturally occurring amino acid
MAASDSDSDADAAASLLPAPIHLLPPDALHNVLLRLPLRDAVVCRPVSRLFHETLSHNFLALLPSLRLLLLRHPRPDGGGCLHAFDPDRRHWLRLPFSAFLPNQSFSPVASSPSLLYLWLESPSPSPPSLPSSSSSTASTAHPPKSLAVCNPFAGTYSFLPPLGSAWAPHASAHASAHASAHASELAALSYTPSGSGKWMKHPLSLPSKPRSPILASGAAAVFALCDVGTPWRSQWKLFSCPLSMLTGGWAPVERSAWGDVFEILKRPRLLAGAGGRRVLMIGGLRSSVAIDAPCSTVXLILRLNLAPMEWDKPGRSLPXMYRCFTGPWEVVXQGNALPTALXGGKNKAKGFGGDGKVWFAGKRVRGKLAMWEEDELGNSGGKWDWVDGVPGYSDGVYRGFVFDGGFTAMP

SEQ ID NO: 21344 - protein, 294 aa, Solanum lycopersicum
MTYMFKYDSVHEQWKHHELKVKDEKTLLFGEKAVTVFGIRNPEDIPWGEAGADFVVESTGVFTDKDKAAAHLKGGAKKVVISAPSKDAPMFVVGVNENEYKPELDIVSNASCTTNCLAPLAKVINDRFGIVEGLMTTVHAMTATQKTVDGPSMKDWRGGRAASFNIIPSSTGAAKAVGKVLPQLNGKLTGMAFRVPTADVSVVDLTVRLEKEASYEDIKAAIKEESEGKLKGILGYTEDDVVSTDFVGDSRSSIFDAKAGIALSKNFVKVVSWYDNEWGYSSRVIDLVCHMAKA

SEQ ID NO: 21345 - protein, 266 aa, Glycine max
MERKRSHASFTMFAMLVGVISQSLVIPVVSTTVEDQKNYYTPDPHAGSPPSGSHSSTPPSHGHGSSPPSHHHSSPSTPSTPSGGNCGSSPPQHHDPTTPSTPSTPSNPPSGGYYGGSPPTPVTVSPPTTPVDPGTPSIPSPPLIPSPSPFTGTCNYWRNHPAIIWGILGWWGTLGSAFGVTGTTVPGFSPGLSLPQALSNTRTDGLGALYREGTASFLNSMVNNKFPYTTNQVRDRFVASLNSNKAAEAQAQLFKMANEGRMKPRP

SEQ ID NO: 21346 - protein, 520 aa, Magnetospirillum magnetotacticum MS-1
MSNASPRRPRPVVLCILDGWGWREDSADNAITQADTPNWDRFLASYPHSLLQSSGLQVGLPDGQMGNSEVGHMNLGAGRVVMQDLPRIDTAVADGSLAANPELTKAIAAVKARGGAMHLMGLLSPGGVHSHQDHLAALARTIADAGVTVQVHAFLDGRDTPPSSAKGFMERFLAAVKGHDVHLATVSGRYYAMDRDKRWDRVSLAWNAMVEAKGVAGADPLAAIAASYADSKTDEFMLPAVIGSYAGMKDGDGLLMGNFRADRAREILDCLVNPAFDGFARARQVSFAARLGLTEYSKDLNAFLGTLFGPETLDNILGEVLSRAGLKQLRIAETEKYAHVTFFFNGGREMVFPGEERILVPSPKVATYDLQPEMSAAEVTDKLIAAIEGGTFDVIVVNYANGDMVGHTGFMKAAIAAAQTVDACLGRLETAVKTAGGTMLVTADHGNAEQMKDPVTGEPHTAHTTGPVPAVLVAPPAGIDGIGDGRLADVAPTLLALLGLPQPAEMGGQSLLRQSLRAAG

SEQ ID NO: 21347 - protein, 479 aa, Escherichia coli
  misc_feature (249)..(249): Xaa can be any naturally occurring amino acid
MSVPVQHPMYIDGQFVTWRGDAWIDVVNPATEAVISRIPDGQAEDARKAIDAAERAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVXLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVAFGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 21348 - protein, 265 aa, Glycine max
MAIPYPHFIATEKAAMDAGLLHPSSPSSVILTQDDLKKIAAYKAVEYVESGMVLGLGTGSTAKHAVDRIGELLRQGKLKDIVGIPTSTKTHDQALSLGIPLSDLDSHPTVDLAIDGADEVDPFLNLVKGRGGSLLREKMVEGACKKFIVIVDESKLVNYLGGSGLAMPVEVIQFCWRFTAARLQKLFQEAGCVAKLRTFAEKDEPYVTDNGNFIVDLYFERSIGDLKAASDAILQLAGVVEHGMFLDMATTVIVAGELGLTVKNK

SEQ ID NO: 21349 - protein, 520 aa, Polyporus brumalis
MARFQSLLSYVTLLFVASAYAAIGPVTDLTVTDANISPDGFTRAGIVVNNVFPAPLITGQKGDRFQLNLVNQMSNHTMLKTTSIHWHGFFQKGTNWADGPAFVNQCPIASGNSFLYDFQVPDQAGTFWYHSHLSTQYCDGLRGPFVVYDPTDPHLSLYDVDDDSTVITLADWYHVAARLGPRFPLGADSTLINGLGRSTATPTADLAVISVTKGKRYRFRLVSISCDPNHTFSIDGHKLTVIEADGISTQPVTGIDSIQIFAAQRYSFVLTADQDVDNYWVRANPNFGTTGFAGGINSAILRYDGAPAVEPTTSQTGTNLLVETDLHPLSTMPVPGLPTQGGADFNLNLAFNFNGSDFFINGASFVPPTVPVLLQIISGANSAQDLLPSGSVYALPSNSSIELTFPATAAAPGAPHPFHLHGHAFAVVRSAGSTVYNYDNPVFRDVVSTGTPAAGDNVTIRFQTDNPGPWFLHCHIDFHLDAGFAVVFAEDLPDVVSANPVPQAWSDLCPIYNALDPSDQ

SEQ ID NO: 21350 - protein, 336 aa, Staphylococcus epidermidis ATCC 12228
MAIKVAINGFGRIGRLAFRRIQDVEGLEVVAVNDLTDDDMLAHLLKYDTMQGRFTGEVEVIEGGFRVNGKEIKSFDEPDAGKLPWGDLDIDVVLECTGFYTDKEKAQAHIDAGAKKVLISAPAKGDVKTIVFNTNHDTLDGSETVVSGASCTTNSLAPVAKVLSDEFGLVEGFMTTIHAYTGDQNTQDAPHRKGDKRRARAAAENIIPNSTGAAKAIGKVIPEIDGKLDGGAQRVPVATGSLTELTVVLDKQDVTVDQVNSAMKQASDESFGYTEDEIVSSDIVGMTYGSLFDATQTRVMTVGDRQLVKVAAWYDNEMSYTAQLVRTLAHLAELSK

SEQ ID NO: 21351 - protein, 396 aa, Staphylococcus epidermidis ATCC 12228
MAKKIVSDLDLKGKVVLERADFNVPIKDGEITNDNRIVQALPTIEYIIEQGGKLVLFSHLGKVKEESDKEGLSLKPVAENLSKKLGKEVIFVPETRGEKLETAIENLNEGDVLLVENTRFEDLDGKKESKNDPELGKYWASLGDVFVNDAFGTAHREHASNVGISTHLETAAGYLMEKEIKFIGGVVNDPQKPVVAILGGAKVSDKINVIKNLVNIADKILIGGGMAYTFIKAQGKEIGLSLLEEDKIDFAKDLLENNGDQIVLPVDCKIAKEFSNDAKITEVSINEIPSDQEAMDIGPKTVELFNKELQGAHTVVWNGPMGVFEFSNFAKGTIGVCESIAKLEDATTIIGGGDSAAAAISLGFEDDFTHISTGGGASLEYLEGKELPGIKAINDK

SEQ ID NO: 21352 - protein, 524 aa, Polyporus brumalis
MSRFQSLVAFVALTLASSRLVAAAIGPVADLTISNADISPDGFTRAAVVVNNVFPGPLITGNKGDNFQLNVIDNLSNDTMLTATTIHWHGFFQKGTNWADGPAFVNQCPISTGNSFLYNFNAPDQAGTFWYHSHLSTQYCDGLRGPMVVYDDADPHASLYDVDDDSTVITLADWYHTAARLGPRFPVGSDSTLINGLGRFFGGVVDAPLSVFTVTSGKRYRSRLINISCDPNFTFTIQGHTLTVIEADAVSVQPYEVDSIQIYAGQRYSFVLTADQAVDNYWIQAIPNIGTVTTDGGVNSAILRYDGADIVEPAAATVTGSNPLVETSLVPLENLAAPGEPTVGGVDYPLNLDFSFDGTDFAINGATFTSPTVPVLLQIMSGAQDVADLLPSGSIYSLPSNATIELSFPITATNAPGAPHPFHLHGHTFYVVRSAGSTEYNYVNPPQRDTVSTGAAGDNVTIRFTTNNPGPWFLHCHIDFHLEAGFAVIFGEDIPAIADANPPSSAWEDLCPTYNSVYPNGDGN

SEQ ID NO: 21353 - protein, 253 aa, Staphylococcus epidermidis ATCC 12228
MRTPIIAGNWKMNKTVQEAKDFVNELPTLPDPKEVESVICAPTIQLDALVTAVKDGKAKGLKIGAQNAYFEESGAYTGETSPVALSELGVKYVVIGHSERRDYFHETDEEVNKKAHAIFNHGMTPIICVGESDEEREAGKANKIVGNQVKKAVEGLSDDQLKEVVIAYEPIWAIGTGKSSTSEDANEMCAHVRQTLADLSSQEVADATRIQYGGSVKPNNIKEYMAQSDIDGALVGGASLKVEDFVQLLEGAK

SEQ ID NO: 21354 - protein, 312 aa, Sulfitobacter sp. EE-36
MATATLSEWLLLAGFDISLETELTRKPFHAAMPHAADLAIGQILHGLDGLDGTVAEAMRYAVTGGKGLRAFLVIESARLHGVMDAQAAPAAGAIEALHAYSLVHDDMPCMDDDALRRGQPTVHVKWDEATAVLAGDALQTLAFELVAATGCGDAERVALVTGLARAAGVRGMVGGQAMDIAAETARQPLTLDQITTLQAGKTGALIEWAATAGPVMAGDDAAALRSYARNLGLAFQIADDILDVEGDAATVGKAVGKDADAGKATFVSLLGLDPARARARDLVDAACDALSPYGSDAETLRDAARFVISRKS

SEQ ID NO: 21355 - protein, 505 aa, Staphylococcus epidermidis ATCC 12228
MAKQPTALIILDGFANRESEHGNAVKQAHKPNFDRYYEKYPTTQIEASGLDVGLPEGQMGNSEVGHMNIGAGRIVYQSLTRINKSIEDGEFFDNTVLNNAVKHVKDNGSALHVFGLLSDGGVHSHYKHLFAILELAKKQGIDKVYVHAFLDGRDVDQKSALKYIEETEDKFKELGVGQFASVSGRYYAMDRDKRWDREERAYNAIRNFEGPTFTSAKAGVEANYKNDVTDEFVEPFIVEGQNDGVNDGDAVIFYNFRPDRAAQLSEIFTNKAFDGFKVEQVDNLFYATFTKYNDNVDAEIVFEKVDLNNTIGEVAQDNGLKQLRIAETEKYPHVTYFMSGGRNEEFEGERRRLIDSPKVATYDLKPEMSAYEVKDALLEELDKGDLDLILLNFANPDMVGHSGMLEPTIKAIEAVDECLGEVVDKIIDMGGHAIITADHGNSDQVLTDDDQPMTTHTTNPVPVIVTKEGVTLRETGRLGDLAPTLLDLLNVKQPSEMTGESLIKH

SEQ ID NO: 21356 - protein, 646 aa, Sulfitobacter sp. EE-36
MESQMTDRPDTPLLDRVNRPADLKNFSDAELVKLSHELRAETISAVSETGGHLGAGLGVVELTVAIHSVFDTPKDKLIWDVSHQCYPHKILTERRDRIRTLRMKDGLSGFTKRSESPYDPFGAAHSSTSISAALGFSVARDLGGNVPEGLGDAIAVIGDGSMSAGMAYEAMNNAGHLKKRMFVILNDNEMSIAPPVGAMSTYLSRLYAEEPFQDFKAAAKGAVSMLPGPFREGAKRAKDMLKGMAVGGTLFEQLGFSYLGPIDGHDLNQLLPVLRTVKARATGPVLIHVITKKGKGYGPAEAARDKGHATAKFNVLTGEQKKAPSNAPSYTRVFADSLIAEAAKDDKICAVTAAMPDGTGLNLFAERYPSRCFDVGIAEQHGVTFSAGLAAGGMKPFCTMYSTFLQRGYDQVVHDVAIQRLPVRFAIDRAGLVGADGATHAGAFDVAFLANLPDFVVMAAADEAELVHMVATAAAYDDGPIAFRFPRGEGAGVTMPERGEPLEIGKGRIIAEGKRVALLSFGTRLSEVEKAAEALRAKGITPTIADARFAKPLDREMILSLAADHEALITIEEGAVGGFGSHVAQLLADEGVFDAGLKYRSMVLPDIFIDQASPADMYAVAGMNAEHIEAKVLDVLGIASIGAQRA

SEQ ID NO: 21357 - protein, 144 aa, Sulfitobacter sp. EE-36
MTHTRYAFVKARWHADIVDRAYDGFSETIPASQIDVVDVPGAFEMPLMAQTLAKSGKYDAVICAAFVVDGGIYRHDFVATAVVDGLMRVGLDTGVPVLSVSLTPHHYQETDHHNAIYRAHFVEKGREAASAALGIVAARQLLDA

SEQ ID NO: 21358 - protein, 434 aa, Staphylococcus epidermidis ATCC 12228
MPIITDVYAREVLDSRGNPTVEVEVLTESGAFGRALVPSGASTGEHEAVELRDGDKSRYLGKGVTKAVENVNEMIAPEIVEGEFSVLDQVSIDKMMIQLDGTHNKGKLGANAILGVSIAVARAAADLLGQPLYKYLGGFNGKQLPVPMMNIVNGGSHSDAPIAFQEFMILPVGAESFKESLRWGAEIFHNLKSILSERGLETAVGDEGGFAPRFEGTEDAVETIIKAIEKAGYKPGEDVFLGFDCASSEFYENGVYDYTKFEGEHGAKRSAAEQVDYLEELIGKYPIITIEDGMDENDWEGWKQLTDRIGDKVQLVGDDLFVTNTEILSKGIEQGIGNSILIKVNQIGTLTETFDAIEMAQKAGYTAVVSHRSGETEDTTIADIAVATNAGQIKTGSLSRTDRIAKYNQLLRIEDELYETAKFEGIKSFYNLDK

SEQ ID NO: 21359 - protein, 386 aa, Salmonella enterica subsp. enterica serovar Typhi str. CT18
MRNNPLIPKSKLPNLGTTIFTQMSALAQKHQAINLSQGFPDFDGPSYLHERLAYHVAQGANQYAPMTGAQALREAIADKTAEIYGYRPDDVSDITVTAGATEALYAAITALVRAGDEVICFDPSYDSYAPAVALSGGVLKRIALTPPHFRVDWQAFSALLSERTRLVILNTPHNPTATVWRQADIEALWQAIGEREIYVLSDEVYEHICFAAEGHASVLAHPQLRERAVAVSSFGKTFHMTGWKIGYCVAPAAISAEIRKVHQYLTFCVNTPAQLALADMLRAAPEHYRALPDFYRKKRDVLVNALAQSRLKVLPCEGTYFLLIDYSAVSTLNDVEFCQWLTEEVGVAAIPLSVFCAAPFPHQLIRLCFAKQESTLLAAAERLCKL

SEQ ID NO: 21360 - protein, 476 aa, Sinorhizobium meliloti 1021
MSQAEIGLIGLGVMGSNLALNIAEKGNRIAVFNRTVDATRKFYAEAGALKDQIVPCETIEEFVAAIRPPRPIIIMIKAGDPVDQQMEALKPHLAKGDIMIDAGNANFRDTMRRFDALKDSGLTFIGMGVSGGEEGARHGPSIMVGGTEESYRRVEKVLTSIAAKYDSDPCVAWLGENGAGHFVKTIHNGIEYADMQMIAEIYGILRDGLKMTAQEIGEVFGAWNKGRLNSYLIEITEKVLKAADPLTGKPIVDMILDKAGQKGTGKWSVIEAQNMGVPATAIEAAVAARSISSAKEEREAAEKVLGLPPVGEIKVADRDGFIKDLENALLAAKIGAYAQGFAVMAAASKEFGWNLPMPTIAKIWRAGCIIRSQFLDEITTAFTKAPDAANLIVTPAFAAMVKESDGALRRVVSTAVLGGLPVPALASALGYFDSYRRGRGTANVIQAQRDFFGAHGFDRVDGADSHHGPWGSGLNA

SEQ ID NO: 21361 - protein, 161 aa, Glycine max
  misc_feature (30)..(30): Xaa can be any naturally occurring amino acid
NHSHPSSPNPPPPSPPLSHHPQQPPPPPPXHPRRREFLSIITATTWLVPLSPALASSDEEYMKETEEVINKVRTTIVMDKNDPNVATAVAELRETSNSWVAKYRREKALLGRVSFRDMYSALNAVSGHYISFGPTAPIPAKRRARILEEVDTAEKALLRGR

SEQ ID NO: 21362 - protein, 187 aa, Salmonella enterica subsp. enterica serovar Typhi str. CT18
MSLINTKIKPFKNQAFKNGEFIEVTEKDTEGRWSVFFFYPADFTFVCPTELGDVADHYEELQKLGVDVYSVSTDTHFTHKAWHSSSETIAKIKYAMIGDPTGALTRNFDNMREDEGLADRATFVVDPQGIIQAIEVTAEGIGRDASDLLRKIKAAQYVAAHPGEVCPAKWKEGEATLAPSLDLVGKI

SEQ ID NO: 21363 - protein, 154 aa, Chlamydophila abortus S26/3
MKTFKGIASAKDMRVAIVGSCFNGPIADALVSGAAQTFLELGGAEDRLTIVRVPGAFEIPCTLKKLLTSGIEYHAIVACGVLIKGETTHYDHIADQVSARISELSVEYNLPITFSIITAPCVDSAWQRAGIKGSHLGVSGMRTALEMADLFKKL

SEQ ID NO: 21364 - protein, 421 aa, Chlamydophila abortus S26/3
MVIKFDDDARASCFVPVEKAIADIAEGKFVIVVDETSRENEGDLIIAGEKMTVEKMTFLLKYTTGIICASLDSERIKQLDLPPMVKDNRCRYRTAFTVSVDAAKGITTGVSAADRTRVVELLSDPNSVPGDFVRPGHFFPLMATPGGVLKRAGHTEAALDLMRLANMQPCGVLSELVNEDHTMMRLPQIIEFAMQHKLSIISTSDLVAYRMLSERLVVPISSARLPTEYGDFTIHVYESVLDGIQHIALVKGDVRGKENVLVRVHSECLTGDILGSIRCDCGCQLHSAMEYIGLEGEGVLVYLRGQEGRGIGLGHKVRAYALQDRGYDTVDANLEIGFPIDSREYGIGAQILVDLGLTKIKLITHNPHKYFGLQGYGLEIVDRIALPINLSEENECYLRTKKERMGHWIDFPSYKEEVNIR

SEQ ID NO: 21365 - protein, 127 aa, Vibrio vulnificus CMCP6
MAYSEKVIDHYENPRNVGSFDKEDPSVGSGMVGAPACGDVMKLQIKVTPEGIIEDAKFKTYGCGSAIASSSLVTEWVKGKSIEEAASIKNSEIAEELELPPVKVHCSILAEDAIKAAVADYKKKHQL

SEQ ID NO: 21366 - protein, 267 aa, Vibrio vulnificus CMCP6
MHPMLNIAIRAARKAGNHIAKSLENVEKIESTLKGTNDFVTNVDKEAETIIIDTIKSSYPEHCIVAEENGLINGKDKDVQWIIDPLDGTTNFVKGLPHFAVSIAVRIKGKTEVACVYDPMLNELFTAQRGAGAQLNNARIRVKQPKDLQGAIIATGFPFKQKQHSESYFKIMSAMFVEVADFRRAGSAALDLCYVAAGRVDGYFELGLKPWDIAAGELIAREAGAIITDFAGGTEYIKSGNVVASSARGVKSLLKHIRENGNEAILK

SEQ ID NO: 21367 - protein, 632 aa, Debaryomyces hansenii CBS767
MLAEKNSHNTGDIITPTVTKYSQTATASGVDKTTSAVEKLHHESVSESKELHLIDSNISTEFEKSRGVRRIENVKAMMQSDEGKKVTIAFWTCLVVIAWVYSLDSSTTYNYAIPAASNFSRHSMISTVNIASGIIGSVVLPFQAKFSDITSRPICFALSLLFYTVGTVIAASSSSIGGYVVGTVFTAVGSNGISFLRDIIVADLTDLKWRGLVNGIMTSPYLITVWFAGLIVDAVLKTNWRWGYGMFAIIMPVIVSPLIFVLSYYEHKAQKLVPKVVKPKKSVWKIVKDAAIEIDAFGLILLGFGWSLFLLPFSIYSYADKGWKNPSIIAMLVVGPVLLIIFVVYEVFYAPFPSMPKRVIKNKTFVTAIIINIIYLLADGIRAQYLSTIMWIGKDWSNQNWVYFNNTLTMSLCFFGVVAGATCRITHRYKYMQSFGILVRVISYCLPLRSQGTLANTASFVMSQVLMGFGSAYSTIGTQISSQASVPHQDLSLVMSLVLLWSTVGSSIGYAISSVIWTSKLPQYFREFIPNSYTDEEVYNFYTDMDLLRAMPFDSDARQGATKAFTYVAIFMFAPPIAMEFINFLLSFFQTNFYLGDTHNAIEDQNGKDPTNPDEEIRVPQTTKEKFLYLFR

SEQ ID NO: 21368 - protein, 119 aa, Brassica napus
MQPSGLKETQLNNNNNNQKVHPQPMEQQQSINQNPEAMEALISNLFGNISSLKSAYIQLQSAHTPYDPDKIQEADKVVISELKNLSELKHLYRENNPKPVCVSPQDSRLAAEIQEQQSL

SEQ ID NO: 21369 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIGDGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFNLMAKGEGIRCIIRMEN

SEQ ID NO: 21370 - protein, 308 aa, Photobacterium sp. SKA34
MRQLTTLLDQWLNSFNKVMDETIASGIPFTVPTVREGLAAITRELVTDIPNIALIENLTIKDKVPIRIYHPQPETALPVLVFFHGGGHMSGNVEVYDPICRKLAQYSQFIVVSVEYPLAPEHPYPAAIEDGYLVLQSLFQTLIRAEISFIPQLSIAGDSAGGAICATLARIAQFDDDVEIAKQVLIYPSLDYTLSFPSVNQNGIGYLLQQPRIEWYFSNYFQHNEDRRKASPVWGPYSMALPESLVITAEFCPLKDEGIAYVEALKKQGVESEHIHFEQMIHAFLNMENIVKKECEQTYTTIGVFLNK

SEQ ID NO: 21371 - protein, 190 aa, Silicibacter sp. TM1040
MAAFSNFADMPLFRYGLIMADPPWSYENWSAKGDHKNASAKYDCIGLDDIKGMQVGHLAAESCVLWLWATNPLLDKAFEVMEAWGFQSKTAGHWSKKTSGGKQAFGTGYILRCAGEPFLIGTVGNPKTARNVRSVIEGPLREHSRKPEEAFAAAEALCGDVPRLELFSRQERTGWDVFGNEVDKFQGAAA

SEQ ID NO: 21372 - protein, 264 aa, Oryza sativa Japonica Group
MAMATTSSKNERWSLAGATALVTGGSKGIGRAIVEELASLGATVHTCARTEAPLNRCREELTAKGLAVTVSVCDVSLRADREALAGTVRELFGGKLSILVNCAGMSFLKPAVELTPDDCSQVMGMNFESCFHLSQLAYPLLKASQRGCIINISSIASVVAFCSLPNAVYSAAKGAMNQVTRNLAAEWANDGIRVNCVAPGFIRTPLLSEFVEGNELGRAEFSRVPMGRLGEPEDIASLVAFLSMPASSYITGQVICADGGRCLS

SEQ ID NO: 21373 - protein, 554 aa, Arabidopsis thaliana
MESSPASSSSPTPVTDSSADSLAKDLQNQSLGAVDEGVKIKKKLEDFNWDHSFVKELPGDPRTDVISREVLHACYSKVSPSVEVDDPQLVAWSVSVAELLDLDPKEFERPDFPLMLSGAKPLPGAMSYAQCYGGHQFGMWAGQLGDGRAITLGEVLNSKGERWELQLKGAGRTPYSRFADGLAVLRSSIREFLCSETMHCLGIPTTRALCLLTTVAIRRKNPAQSFAGFLSHFYALDYAIKHHFPHIESMDRSDSLSFKTGDEDDSVVDLTSNKYAAWIVEIAERTATLVARWQGVGFTHGVLNTDNMSILGQTIDYGPFGFLDAFDPSYTPNTTDLPGRRYCFANQPDIGLWNIAQFSKTLAVAQLINQKEANYAMERYGDKFMDEYQAIMSKKLGLTKYNKEVISKLLNNMSVDKVDYTNFFRLLANVKANPNTPENELLKPLKAVLLDIGKERKEAWIKWMRSYIQEVGGSEVSDEERKARMDSVNPKYILRNYLCQSAIDAAEQGDFSEVNNLIRLMKRPYEEQPGMEKYARLPPAWAYRPGVCMLSCSS

SEQ ID NO: 21374 - protein, 246 aa, Brassica napus
MSTQTSAAVISSSVAAARVEPYPDSKKPIGSIRFQPLPLSLSYCSKSGKVSSKICAMSKPNDAETLSSVDTSLSPRVKSLKPSKTMVITDLAATLVQSGVPVVRLAAGEPDFDTPKIVAEAGINAIRDGFTRYSLNAGIAELREAICRKLKEENGLSYAPDQILVSNGAKQSILQAVLAVCSPGDEVIIPAPYWVSYTEQARLADATPVIIPTKISDNFWLDPKVLESKLTEKSRLLILCSPSNPT

SEQ ID NO: 21375 - protein, 231 aa, Streptomyces avermitilis MA-4680
MTRASLDKQPHEVASMFDDVAERYDLTNDLLSLGQDRVWRREVAKAVDARPAQKILDLAAGTATSSLPFARAGAYVVPCDFSLGMLRVGKKNHPWLPLTAGDATKLPFKDDTFDAVTISFGLRNVQDTDTALSELYRVTKPGGRVVICEFSHPTWAPFRTVYTEYLMRALPPVARAVSSNPDAYVYLAESIRAWPTQPELAERLRKAGWSKVAWRNLTGGVVALHRGFKAV

SEQ ID NO: 21376 - protein, 200 aa, Saccharophagus degradans 2-40
MGVLVGKQAPDFTAPAVLGSGEIVDSYNFAEATKGKKAVVFFYPLDFTFVCPSELLAFDHRIAEFEKRGVEVIGVSIDSHFSHNAWRNTPVNEGGIGPVKYTLVADMTHAICKAYDVESEGGVAFRGSFLIDEDGLVRHQVVNDLPLGRNVDEMLRMVDALAFHQEHGEVCPAGWKDGDKGMTASPEGVAAYLSENASNL

SEQ ID NO: 21377 - protein, 121 aa, Lactococcus lactis subsp. lactis Il1403
MALNIENIVAELENATILELSELVKAIEEKFDVTAAAPVAAAAGAGDAAAAKDSFDVELTSAGDKKVAVIKEVRGITGLGLKEAKELVDGAPTMIKEGLSESEANEVKEKLEAAGASITLK

SEQ ID NO: 21378 - protein, 374 aa, Oryza sativa Japonica Group
MALHVLASMGDLWRRYAPHNLMILSQLCYTLMYFITEAAFNKGLNPFIYVTYRHLVVAVFLAPFAYYQEKKLRPRMTLMLFLEIFVLSLLGVSLTLNMYFASLMYTSPTFVTSVVNTVASITFVIAIVVRMEIVDVRSIRGLAKVAGTVVSFAGVTTMTLYKGTAISSPWKAPISIHGGGGGGGVHESWLKGSFLAVASCICWSIWYILQASSLKRYPAQLSLTAWMCTVGGIQSAVFTAFMQHKPEDWRIGFGLKFWCIVYSGFACNGFTVFAQLWCTEKKGPVFVTMFNPLSTIMVAILAYFMFGENLYVGSIIGGVVVILGLYMLLWGKDKDQEYNANKQQESDLDCEKQARITEFSAAQNDQEEPRRTKK

SEQ ID NO: 21379 - protein, 614 aa, Vitis vinifera
MDQYEILEQIGKGSFGSALLVRHKHEKKKYVLKKIRLARQTDRTRRSAHLEMELISKVRNPFIVEYKDSWVEKGCYVCIVIGYCEGGDMAEAIKRANGVHFPEEKLCKWLVQLLTALEYLHANHILHRDVKCSNIFLTKDQDIRLGDFGLAKMLTSDDLASSVVGTPSYMCPELLADIPYGSKSDIWSLGCCIYEMTAHRPAFKAFDMQALINKINKSIVAPLPTMYSGAFRGLVKSMLRKNPELRPSAAELLTHSHLQPYILKIHLKSNSPRRNTFPFQWSDSNYIKKTRFLEPEAVPMFSDREKRRSFSNDRTLNPSISGTEQDSPCSSQKMQEFSSHLNRKFAELSVGSTHEDIGIDKSVVTKFSSATKTPRSTPSKTSSTPRRQTATSKISRIGSNHDSFPVSHTPVSKSSWSTRRASLPFPTRAATLETPYRPNVRLLRSVESPDISVNAPRIDRIAEFPLASCDEPLFPIRKTSSTSAQCSSNSPDSGDCSITKDKCTVQILDKAFVRQNFTDADHGVPRNGSECSEHNPTTGVSSRSSSDSRQRRFDTSSYQQRAEALEGLLEFSARLLQQERFDELGVLLKPFGPEKVSPRETAIWLTKSFKETAA

SEQ ID NO: 21380 - protein, 392 aa, Bacillus subtilis subsp. subtilis str. 168
MEHLLNPKAREIEISGIRKFSNLVAQHEDVISLTIGQPDFFTPHHVKAAAKKAIDENVTSYTPNAGYLELRQAVQLYMKKKADFNYDAESEIIITTGAQAIDAAFRTILSPGDEVIMPGPIYPGYEPIINLCGAKPVIVDTTSHGFKLTARLIEDALTPNTKCVVLPYPSNPTGVTLSEEELKSIAALLKGRNVFVLSDEIYSELTYDRPHYSIATYLRDQTIVINGLSKSHSMTGWRIGFLFAPKDIAKHILKVHQYNVSCASSISQKAALEAVTNGFDDALIMREQYKKRLDYVYDRLVSMGLDVVKPSGAFYIFPSIKSFGMTSFDFSMALLEDAGVALVPGSSFSTYGEGYVRLSFACSMDTLREGLDRLELFVLKKREAMQTINNGV

SEQ ID NO: 21381 - protein, 438 aa, Physcomitrella patens subsp. patens
MVLPEVERKVLKPHPCERFKVPQPPADPKRTGPRPCPVCYLDEELAISQLPAEGTYQSPVLKRLTFVSDPDAAKRPSPGAPGSAFGGYPSLEDRAASFNVREEMKVNCGFVKGPTPGLGTGYDFDEEDRQAMLACRGVVVASAIFGNYDQLQQPKNVSDEAKKSVCFFMFVDEETEASLDDYENFRTTKQVGLWRVVVVRNLPYRDARRTGKIPKLLLHRLFPNVRFSIWADGKLEIVQDPYKILERFLWRTNETFAISQHYKRFDVFEEAEANKAAAKYNNKSIDDQINFYKKEGLTPYSTAKLPITSDVPEGCVIIREHTPIANLMSCLWFNEVDRFTSRDQLSFGIVRDKLMAAVPWRVTMFKDCERRNFVVQVYHRDLLVQRGLLPVANSSSVAVVKEVKGDSSPVVGKPVVKNHASSGKRSSIRRKRSEERRP

SEQ ID NO: 21382 - protein, 564 aa, Candida albicans SC5314
MSFSSGKFLFVFLFFFFFKNTSCSNQRKYITKQQTMSKDKKEHKDKKRKHDNEDVEIADSKKQRKLEKQEKKDKKDKKDKKEKKEKKEKKHKKEKKHKDSESSPVEPAANDSSSSTNYTQSSKLSSVSQSDIDKFLSDNEITVEDPSSSSLRPILSFDQVQLTSAITSKLSKFDKPTPIQSVSWPFLLSGKDVIGVAETGSGKTFAFGVPAINNIITTGNTKTLSVLCISPTRELALQIYDNLIELTADSGVNCVAVYGGVSKDDQIRKIKTANVVVATPGRLVDLINDGAINLGKVNYLVLDEADRMLEKGFEEDIKTIISNTSNSERQTLMFTATWPKEVRELANNFMNSPVKVTVGDRDELSANKRITQVVEVINKFDKEKKLIQLLRKYNANESSDNKILIFALYKKEASRIENFLKRNRFSVAAIHGDLSQQQRTAALSAFKSGQSNLLLATDVAARGLDIPNVKVVINLTFPLTIEDYVHRIGRTGRAGAKGTAHTLFTEDEKHLSGALCNILRGANQPVPEELLKFGGHTKKKAHSVYGAFYKDVDMTKTAKKIKFD

SEQ ID NO: 21383 - protein, 263 aa, Oryza sativa Indica Group
MAKIKIGINGFGRIGRLVARVALQSDDVELVAVNDPFITTDYMTYMFKYDTVHGQWKHHEVKVKDSKTLLFGEKEVTVFGCRNPEEIPWGETGAEFVVESTGVFTDKDKAAAHLKGGAKKVVISAPSKDAPMFVVGVNEKEYKPDIDIVSNASCTTNCLAPLAKVINDRFGIVEGLMTTVHAITATQKTVDGPSSKDWRGGRAASFNIIPSSTGAAKAVGKVLPALNGKLTGMAFRVPTVDVSVVDLTVRLEKPASYDQIKAA

SEQ ID NO: 21384 - protein, 432 aa, Triticum aestivum
MGNCWGTRIKDGSTHPGVSGMFSRSSGKDGSRLSACSSRASSASMPPSAKTECEILQSANVKVFTYNDLRLATRNFRPDSVLGEGGFGSVYKGWIDEHTLSACKPGTGIPVAVKRLNLEGLQGHREWLAEVNYLGQFCHTNLVKLIGYCLEDEHRLLVYECMPRGSLENHLFRRGSHFQPLSWNLRMKVALGAAKGLAYLHSAEAKVIYRDFKTSNILLDTDYTAKLSDFGLAKDGPVGEKSHVSTRVMGTHGYAAPEYLSTGHLTAKSDIYSFGVVLLEMLSGRRAIDKNRPQGEHNLVEWARPYLTHKRKIFRVLDTRLEGQYSLNGAQTIAALAVECLSFEAKMRPSMDAVVSILEGIQDSSDPARRPADPARRPADPTRRPAAERPQDPKSGSKTAPGASNSGKGRRKSSGDLLKEPGRDPKPSAYSS

SEQ ID NO: 21385 - protein, 139 aa, Coprinopsis cinerea okayama7#130
MLDCACLAGIVALRHFRRPEVEVIGEDEVIVHSPLERAPMPLAIHHTPLCFTFAFFSYPDTQPILDPSQLEQRLSAGLMSIALNAQKEICVLQKLGGVPQETEEILRLIKVAVEKAKEVSEVVERRLREDWETRKVEVR

SEQ ID NO: 21386 - protein, 94 aa, Coprinopsis cinerea okayama7#130
MRPPSPSIPEKEFLAASLKENLRLDGRLPLQMRDPVITFGPELGYVECALGKTRVIANVEAKMVKPTPERPFEGIITIHSEISPMASSEYEPGR

SEQ ID NO: 21387 - protein, 412 aa, Salmonella enterica subsp. enterica serovar Typhi str. CT18
MKALTYHGPHHVKVENVPDPGIEQPDDIILRVTATAICGSDLHLYRGKIPQVKHGDIFGHEFMGEVVETGHDVKNIRKGDRVVIPFVIACGDCFFCRLQQYSACENTNDGHGAAMNKKQIPPPAALFGYSHLYGGVPGGQAEYVRVPKGNVGPFKVPPLLSDDKALFLSDILPTAWQAAKNAQIQQRSSVAVFGAGPVGLLTIACARLLGAEQIFVVDHHAWRLRFAEERYGAIPINFDDENDPAEKIIEQTAGHRGVDAVIDAVGFEAKGSMTETVLTNLKLEGSSGKALRQCIAAVGRGGVVSVPGVYAGFIHGFLFGDAFDKGLTFKMGQTHVHAWLGELLPLIEKGLLKPEEIVTHYMPFEEAARGYEIFEKREEECRKVILVPGAMSAQAAQKQATGVINPMPGGVV

SEQ ID NO: 21388 - protein, 249 aa, Escherichia coli
AVTKLVLVRHGESQWNKENRFTGWYDVDLSEKGVSEAKAAGKLLKEEGYSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNETILPRMKSGERVIIAAHGNSLRALVKYLDNMSEEEILELNIPTGVPLVYEFDENFKPLKRYYLGNADEIAAKAAAVANQGKAK

SEQ ID NO: 21389 - protein, 227 aa, Chlamydophila abortus S26/3
MAFLILLRHGKSVWNEKNLFTGWVDIPLSQKGIDEAMLAGEAIKDLPIDCIFTSSLVRSLMTALLAMTHHNSKKIPYIVHDDPEQKHMSKIYSDEVNHMIPLYRSSALNERMYGELQGKNKKKTAEQFGEEQVKLWRRSYKTAPPNGESLYDTGQRTIPYFQETIFPLLQNSKNVFVSAHGNSLRSLIMDIEKLSEEEVHSLELPTGKPIVYLWTGHTFERHPELFG

SEQ ID NO: 21390 - protein, 202 aa, Geobacillus stearothermophilus
ATTLYLTRHGETKWNVERRMQGWQDSPLTEKGRQDAMRLGKRLEAVELAAIYTSTSGRALETAEIVRGGRLIPIYQDERLREIHLGDWEGKTHDEIRQMDPIAFDHFWQAPHLYAPQRGERFCDVQQRALEAVQSIVDRHEGETVLIVTHGVVLKTLMAAFKDTPLDHLWSPPYMYGTSVTIIEVDGGTFHVAVEGDVSHIE

SEQ ID NO: 21391 - protein, 501 aa, Salmonella enterica subsp. enterica serovar Typhi str. CT18
MSLSKDNIWKLLAPLVVMGVMLLIPVPDGMPPQAWHYFAVFVAMIVGMILEPIPATAISFIAVTICVIGSNYLLFDASELADPAFKASKQALKWGLAGFSSTTVWLVFGAFIFALGYEVTGLGRRIALFLVKFMGKRTLTLGYAIVIIDILLAPFTPSNTARTGGTVFPVIKNLPPLFKSFPNDPSARRIGGYLMWMMVISTSLSSSMFVTGAAPNVLGLEFVSKIAGVQISWLQWFLSFLPVGIILLIVAPWLSYVLYKPEVTHSAEVAAWAGGELKNMGRLSRKEWTLIGLVLLSLGLWVFGGKIINATAVGLLAVSLMLALHVVPWKDITRYNSAWNTLVNLATLVVMANGLTRSGFIDWFANTMSTHLEGFSPDATVIVLVLVLVLVLVLVLVLVLVFYFAHYLFASLSAHTATMLPVILAVGKGIPGVPMEQLCILLVLSIGIMGCLTPYATGPGVIIYGCGYVKSRDYWRLGAIFGVIYIAMLLLVGWPILAMWN

SEQ ID NO: 21392 - protein, 149 aa, Oryza sativa Indica Group
SNSRLLEKAIQRSFLVSADMAHALHPNYMDKHEENHQPKLHGGLVIKHNANQRYATNAVTAFIFREIAERHHLPIQDFVVRNDMGCGSTIGPILASGVGIRTVDIGAPQLSMHSIREMCAVDDIKHSYEHFKAYFEEFTELDSKVKVDC

SEQ ID NO: 21393 - protein, 116 aa, Glycine max
MSLGKFNIVRLRQMLRRWRSKAHRIPSDVPAVHVAVCVGTNSRRFVVRATYLNHPVFKKLLVEAEEEYGFSNHGLLAIPCDEALFEQLLRFISRSDCHLALRNNLHFYLQSLPLLH

SEQ ID NO: 21394 - protein, 736 aa, Oryza sativa Japonica Group
MEEWHRFGRTGVYRTFMFSSPTILAVTPEACKQVLMDDEGFVTGWPKATVTLIGPKSFVNMSYDDHRRIRKLTAAPINGFDALTTYLSFIDQTVVASLRRWSSPESGQVEFLTELRRMTFKIIVQIFMSGADDATMEALERSYTDLNYGMRAMAINLPGFAYYRALRARRKLVSVLQGVLDGRRAAAAKGFKRSGAMDMMDRLIEAEDERGRRLADDEIVDVLIMYLNAGHESSGHITMWATVFLQENPDIFARAKVQAEQEEIMRSIPATQNGLTLRDFKKMHFLSQVVDETLRCVNISFVSFRQATRDIFVNGYLIPKGWKVQLWYRSVHMDDQVYPDPKMFNPSRWEGPPPKAGTFLPFGLGARLCPGNDLAKLEISVFLHHFLLGYKLKRANPKCRSRSEMDGVVAASADATRDEIKIMNVYIWDMDETLILLKSLLDGSYAGAFDGLKDHDKSVDIGKRWENLILELCDEHFFYEEIENYNEPFLSAVKEYDDGKDLTTYDFEADCFSSPYDDLNKRKLAYRHRAIGEKYTKGLEKILDHHMIKVWNDLYSATDKYTDGWLSSALMWHNQMLMWYNRVLMRLKLYKVGASVPCMRPSHKLLEEAMGKSTAESTAKHSSINCIVTSGSLIPSLAKCLLYRLDDVVAFENVYSSWEVGKLQCFKWIKERYDGPNVRFCAIGDGHEECTAAQIMKWPFVKIEFHPDAPHRFPGLNLPTIHRIMDTVYDSSSNDG

SEQ ID NO: 21395 - protein, 195 aa, Brassica napus
HASGFFEFGNQSKKRDIFALCLCRVNSFDQGTKEKEKFEETLNSNGSSSNSSEVPRLAYLISGAKGDSHMMMRTLQAVYHPRNQYVLHLDLEAPPKERLELAMSVKSDPTFREVANVRVMSQSNLVAYKGPTMIACTLQAVAVLLKESLDWDWFINLSASDYPLVTQDDLLCVFSKLSRNPNFIEHTKFTGILNS

SEQ ID NO: 21396 - protein, 434 aa, Chlamydophila abortus S26/3
MTHLNYEKSQLHYWQPYRTCGLLSRVSGNLLEVQGLSACLGELCRICTPKYPDILAEVIGFHNQTTLLMSLSPMHHVALGSEVLPLRRPPSLHLSDHLLGRVIDGFGNPLDNKESLPKTQIKPLISPPPSPMSRQPIQEIFPTGIKAIDAFLTLGKGQRIGVFSEPGSGKSSLLSAIASGSKSTINVIALIGERGREVREYIEQHASGLKHHRTIIVASPAHETAPTKVISGRAAMTIAEYFRDQGHDVLFIMDSLSRWIAALQEVALATGETLAAHHYAASVFHHVSEFTERAGNNERGSITALYAILYYPNHPDIFTDYLKSLLDGHFFLTHQGKALASPSIDILLSLSRSAKKLALPHHYAAAEKLRSLLKTYQEALDIIHLGAYSPGHDKDLDDAVKILPSIKNFLSQPLSSYCQLENTLKELEALVNLE

SEQ ID NO: 21397 - protein, 141 aa, Zea mays
MQDPRDDDFLAPKLHKKKGVYRPQPSGHLKGEPELLRRKFPQSSGMVQKPPKRSLKGEPRTPPSDRGTPDSLPESGPTDEYRALRRKYLMLEEENFALDKELSMEDEEMKALEDEKLALLDQLVVLEGLVEPSQLQSQPRP

SEQ ID NO: 21398 - protein, 155 aa, Rhodopirellula baltica SH 1
MPSIDGTTGNLPSGRVAIIASRYNANICDSMVQAALQSLSDAGIPEDKQWLIRVPGAWELCWAVEQAFQHADVIGAITLGCVIKGETTHDEHINRAVSDTLMEQAVRSGRPVGFGLLTCNTVEQAIQRSGGAVGNKGHEAADAMLEMLRLQTKMR

SEQ ID NO: 21399 - protein, 554 aa, Ralstonia metallidurans CH34
MISVRNVTLRRGVNVVLDRASVTFNPGEKIGLVGRNGAGKSSFFGLLNGTLHEDSGEFSIPAAWKMGQVAQEMPETEQSATDFVVEGDTALLAAQTEVAAAEACDDGMRMAHAYMALHDAGAHDAPARAQALILGLGFSAAQLSQPVNSFSGGWRMRLQLARALMCPSDLLLLDEPTNHLDLDALVWLEAWLKRYQGTLVVISHDREFLDAVTQVTVHVDNAQLVRYGGNYSKFEDMRAEQLVLQQAAMAKQADKIAHLQKFIDRFKAKASKEKQAQSRVKALERMEKIAPVLADAEFNFEFKEPLNVPNPLLSMLDTSFGYPAPAGALPGTPPTVIVRGINRSVLAGQRIGILGANGQGKSTLVKTVAHALAPIAGEISEGKGLNIGYFAQQELDVLRPLDTPMEHMIRLAKGTPAHMRAPGQSGTEQSLRTFLGTFNFSGDMVHQAVSTMSGGEKARLVLCMIVWQRPNLLLLDEPTNHLDLATREALGMALNEFEGTVMLVSHDRALLRAVCDEFWLVTKGGVEPFDGDLDDYQQFLRDEARRIREQAAAA

SEQ ID NO: 21400 - protein, 395 aa, Thermotoga maritima MSB8
MRAVRLHAKWDPRPEFKLGPKDIEGKLTWLGSKVWRYPEVRVEEVPEPRIEKPTEIIIKVKACGICGSDVHMAQTDEEGYILYPGLTGFPVTLGHEFSGVVVEAGPEAINRRTNKRFEIGEPVCAEEMLWCGHCRPCAEGFPNHCENLNELGFNVDGAFAEYVKVDAKYAWSLRELEGVYEGDRLFLAGSLVEPTSVAYNAVIVRGGGIRPGDNVVILGGGPIGLAAVAILKHAGASKVILSEPSEVRRNLAKELGADHVIDPTKENFVEAVLDYTNGLGAKLFLEATGVPQLVWPQIEEVIWRARGINATVAIVARADAKIPLTGEVFQVRRAQIVGSQGHSGHGTFPRVISLMASGMDMTKIISKTVSMEEIPEYIKRLQTDKSLVKVTMLNE

SEQ ID NO: 21401 - protein, 766 aa, Caulobacter crescentus CB15
MGNADMSDAERKTFTDAEALAFHRYPTPGKIAIVPTKPMATQRDLSLAYSPGVAVPVHAIAADPDMAYEYTSKGNLVAVISNGTAILGLGDLGALASKPVMEGKSVLFKRFGDVDSIDIEVTTKDPDEIITVVKNIGVTFGGINLEDIKSPECFRIETELQELLDIPVFHDDQHGTAIICAAGLINACHITGKKIEDVKVVLNGPGAAGIASLELIKAMGVRAENCIAVDSKGVLYRGRTEGMNQWKSAHAVETDKRTLAEAVVGADVLLGLSAKGAFTPEMIASMAPNPVIFAMANPDPEITPEEVKRVRKDAIMGTGRSDYPNQVNNVLGFPYIFRGALDVRARRVNHEMKIACAQALAMLAREDVPDEVAAAYHGRQLKFGPDYIIPSAFDPRLIWYVPPFVAQAAMDTGVARKPIADMDAYRAGLAQRLDPTAGFLQKISGSVLANPKRIVFAEGEDPSVIRAAYAYQSGGFGKAILCGRENLVHENMKLVGLDPDTAGLEIINARLSDRNPDYVDALYARLQRQGYLKRDVQRLINQDRNSFAASMVTLGEADGMVTGVTRSFDQALEEVLRVVDPAPGGRIMGMSVVLAKGRTIFVADTNVTELPEAEELVEIACEAARAVRRLGFKPRVAFMSYSTFGNPMGLRSEKVREAVAMLDEMEVDFEYEGEMPPELALDPEKRANYPFMRLTDSANILIMPAIHAASISTKLVQSLGGATVIGPVLLGLSKSVQIAPLSASVSKILNMAMMAAYDQPVDDGEG

SEQ ID NO: 21402 - protein, 452 aa, Medicago sativa subsp. falcata
MKEVAPGTQDQKQPLRANSKRALSDVTYLPHKKRAILQDVTNNCGENTKRSCLNPTEIQAKKRKVAKPAQPNVSNEVPSAAELPPFIADSKPVSSMEMRLRSSEDFRCLDDLEDNAPFRMSSNQCGTNNNLLQSQTSRISARPSSSQKKASQIVAAKKANISELLDVSKHPDVADIDADFEDPQLCSHYAADIYDHLRVAELSRRPYPNFMETVQQDITPSMRAILVDWLVEVSEGYKLQANTLYLAVYLIDWFLSKNCIEKERLQLLGITCMLIASKYEEINAPRIEDFCFITDNTYTKEEVVKLESLVLKSSSYQLFAPTTKTFLRRFLRAAQASYKRPSIELEYLTNYLAELTLLNYGFLNFLPSMIAASAVFLARWTLDQSSHPWNPTLEHYASYKASDLKATVLALQDLQLNSNDDCPLTAIRKKYTQDKLNCVAALSSPKLLETLF

SEQ ID NO: 21403 - protein, 353 aa, Thermoplasma acidophilum
MEKVEMKRYLITSDGTVIAGYGYGSPVTGYGELVFTTSMTGYLESMTDPSYVGQILVFASPTIANYELRKGVMESDRVKVSGIVTRDAHINMPAGTLGLDFDRFLRDEGIPAIDGVDTRLLVRKIRQGGVLRAYIADDPQGHSDFPDPMSENLVARAVDARGVKNIRGKGERRILFIDLGSKKTLRDMMLEHFSLIMASADSDLDAIDKYDAIFVSNGPGDPDHPSLRPVVNFLKRNIGVKPIFGICFGLQIIALAYGSKTYKMKFGHRGSNHAVTDGNRIYVTTHNHGYAVDPDTVRDFHVRERDINDGTIEMIEDGMMMAVQYHPEASPGPHDTRWFFSEMRRRTEDAAKG

SEQ ID NO: 21404 - protein, 79 aa, Physcomitrella patens subsp. patens
MSDDHTAKWMQNTQSKKSPMELINEVPPIKVDARVAACEGGTDPALGHPIEYICLDGKGPHVCKYCGLRYYQGNVHGHH

SEQ ID NO: 21405 - protein, 388 aa, Saccharophagus degradans 2-40
MSVSALMNTYGERKTTLTKGDGPYLWDSEGRRYLDALSGIAVCGLGYNYPSVTQAISEQAKTLIHCSNLFLIEPQQELGKLLVQASGMDKVFFSNSGAEANEAAIKLARKYAQDKGITAPHIITCDKSFHGRTMATLSATGNPKVKAGFFPMVEGFSHVPYNDIEAIKQAATENTIAIMVEPIQGEGGVNVPADDYLTNLRALCDENGWLLILDEIQTGNGRTGAYFAYQHTNIHPDVVTTAKGLGNGVPIGACLAKGKAAEVFQPGNHGSTFGGNPLACSAAVATFKALVNDGIMKSGAATGNSMIAKFKERFANNPKVVEVKGQGMMMGIQLSQDCPTLVERAKEKNLLLNVTAGNTIRLLPPLILTEEQAQTVVDTVVQLVEEIE

SEQ ID NO: 21406 - protein, 303 aa, Saccharophagus degradans 2-40
MTKPRHFLTLEDLSAKELEEVIQRAIDLKAQHKAGTTDEPFKNQVLGMIFEKSSTRTRVSFEAGMAQLGGSAIFLSSRDTQLGRGEPIEDSARVLSRMVDIVMIRTFEHSIVERFAEYSRVPVMNALTDDYHPCQLLADIQTFVEHRGSPKGKTVAWVGDGNNMCHSYINAAKLCDFKLQIACPEGFDPAPQLIAENSDRVTVTRIPEEAVKNADWVATDVWASMGQEDEKKKRLAAFAGYEVNHKLMSHAKKDAIFMHCLPAHRGEEVSAELLEDENISVVWDEAENRLHAQKALMLFLMGK

SEQ ID NO: 21407 - protein, 128 aa, Silicibacter sp. TM1040
METHTASCHCGAVEISARFPNGLASASRCDCSFCLRRGAAAVTATTESLQILRGAENLSLYTWGTHTAQHHFCKTCGIYVYHQRRSNPAECGVNLGCIDTGNPRTHAEIYGEIPWRDGVNHPSDTDGD

SEQ ID NO: 21408 - protein, 208 aa, Dehalococcoides sp. CBDB1
MKSTKALILATLFPVTLFAGSCGGDAVPEVTPMSWTTAPAMQIDPAKQYYATIETTLGSFKIELFASESPKTVNNFVFLAKQNYYNGVIFHRIIKEFMIQTGDQTGTGRGGPGYRFADELPVKHSYDPGIVAMANAGPNTNGSQFFVCTGAQAKNLNYQPNYTQFGRVIEGMDVITKLASVSVVGNSYGEVSTPSNPPKIIKITITES

SEQ ID NO: 21409 - protein, 454 aa, Photorhabdus luminescens subsp. laumondii TTO1
MTARLGRWLATLDTFEQKLAKTSPVRRYGRLTRATGLVMEATGLHLPLGATCLIERQNGSNIEEVESEVVGFNGEKLLLMPLEDLEGIVPGARVYARPYSEDCGGGRQLPLGPELLGRVLDGAGRPLDGFPSPDTSYRAPLTTPPINPLQRTPISDVLDVGVRAINALLTVGRGQRMGLFAGSGVGKSVLLGMMARYTQADVIVVGLIGERGREVKDFIENILGAAGLARSVVVAAPADISPLLRMQGASYATRIAEDFRDRGKHVLLIMDSLTRYSMAQREIALAIGEPPATKGYPPSVFAKLPALVERAGNGVNGGGSITAFYTVLTEGDDQQDPIADAARAILDGHIVLSRSLAESGHYPAIDIEASISRAMTALIDKQHYRRVQQFKQRLASYQRNRDLINVGAYAAGSDPLLDKAIELYPYMAQFLQQDIEERSEYDAACIQLQQLLPT

SEQ ID NO: 21410 - protein, 320 aa, Arabidopsis thaliana
SRIAKDVTELIGNTPLVYLNNVAEGCVGRVAAKLEMMEPCSSVKDRIGFSMISDAEKKGLIKPGESVLIEPTSGNTGVGLAFTAAAKGYKLIITMPASMSTERRIILLAFGVELVLTDPAKGMKGAIAKAEEILAKTPNGYMLQQFENPANPKIHYETTGPEIWKGTGGKIDGFVSGIGTGGTITGAGKYLKEQNANVKLYGVEPVESAILSGGKPGPHKIQGIGAGFIPSVLNVDLIDEVVQVSSDESIDMARQLALKEGLLVGISSGAAAAAAIKLAQRPENAGKLFVAIFPSFGERYLSTVLFDATRKEAEAMTFEA

SEQ ID NO: 21411 - protein, 261 aa, Silicibacter sp. TM1040
MIGSANLNVMIKAARKAGRSLVKDFREVENLQVSTKGAGDFVSRADIAAEKILKDELLGARPTYGWLAEEGGEIPGEDPTRRWIVDPLDGTTNFLHGLPHWAVSIALEHKGKIVAGVVYDAAKDEMFFAEKGAGAWMNETRIRVSARHRMIESIFATGLPFAGRADLPETLQDLARLMPACAGVRRWGAAALDMAYVAAGRYEGFWERRLNAWDLAAGIIIVKEAGGLCEALDPSESIIESGEVICANEPIFENFTKVIRG

SEQ ID NO: 21412 - protein, 124 aa, Dehalococcoides sp. CBDB1
MKYNELSPQEEAVIVRKGTEPAFSGEYVNLFKDGTYVCRRCDAPLYRAKDKFHSGCGWPSFDEELSGAVKRQTDPDGRRTEILCAACGGHLGHVFEGESFTPKDTRHCVNSLSIKLVPDNGGNK

SEQ ID NO: 21413 - protein, 1091 aa, Aspergillus nidulans FGSC A4
MTMIIAGVYTILVSADSSAMSDPITQALPHTHATPAMTSAALSSAPSNSRNPVYPDLLSGPPIPPPRTSSNHRSRGSNNTASASSGERGSGSRYKGKGEERSRREKKGEESRSRHQGSKSSEDQSRGPSTYGQSSPQPEDLMATIPSQGTLVKESSTVINQLLVSDPAVDIEREQARQQAVPAPNENASTSGLGLMSGENLDDGAGGNLPSRQEFPEHTVKRKETTFGQYILGQTVGEGEFGKVKLGWKRDGSIEVAIKLIRRESLGSNPTRLPKIYREISILRDLSHPNIVRLHEMVETDRHIGIIMEYASGGELFDHILRNKYLKDNSARRLFAQLVSGVGYLHKKGIVHRDLKLENLLLDRNRNIIITDFGFANTFDPNDELTEEIEYNLTNKEFVKKMRLDKPNAKGFRRGDLMQTSCGSPCYAAPELVVSDSLYTGRRVDVWSCGVILYAMLAGYLPFDDDPANPDGDNINLLYKYIVSTPLTFPEYVTPHARDLLRRILVPDPRKRADLFEVARHSWLSEYADLVSHITSSTTKVADIASATVPRGMEFRTNGPTQSPADLISPEQPREGPSLARSASVREPPKTHHGSSPSIGGLVHHPGDISQDQSDRSKTPRDTKRRTVQVEYVAPQSQTSRGETSGSSATVQNVSPTEPISTRPKPTGQEHSVKTQTSPEQSISSGSAAAPAQPISHLPRSTSDTAALTGTTTQTARPTTGASMASFKTGRLPSRGSYGQPVAPTVAATNAEGRLAQPKSKQYVISAPIQQDAGQASAMGSPSVQNFPSKFNTTPRQEPPKGHKRSNTVSAIGEKLFGRSGSIFGGRGGQQSASKQKAGRRYPPTSMRDPYPGDDSRTSVDSRRSAQYGYGTRKASEAGGENRTRRFSLLPASFSLKGISSSSRSQTPDEESKADRFSDNRVSQRPSTGAIRTRVRATSYGAHDTIASAATDGPSDDVIVHDEPVNYQARIDQQFAALHSNNSGTYQPSPYGTVSAEQVHQNDNEHYYRNNYANHSTPNYYDEYNGVHDNASGASLQTGRSSNRPGVLQKNHRRFADAYENESHHSGSSGAARKVMDFFRRRAKSRVGDDR

SEQ ID NO: 21414 - protein, 479 aa, Lactococcus lactis subsp. lactis Il1403
MADPNGFLNYPRNDNPYRELAERIKDFAELQVPLSTEERQKQAARCMHCDVPFCHQGIFYGGKRAVSGCPNDNHIPEWNDLIYRGLQRKAYERLILTNPFPEFTGRVCPAPCEKSCAEALNGAGVTIKDNERFLGDLGNDEGWVAEIGKAAEPTGYKIAIIGSGPAGLSAAWRLNQLGHSVTVFEKSDRLGGLLMYGIPNMKLDKKVVQKRIDLMTELGVTFVTNTEIGKTISYEDLSVNFDRIILAIGAGIPRDLNISGREAVGIRFAIDFLTETTKTVLEEGEDNISQSLKGKKVVVIGGGDTGNDCIGTAVRLGAASVSQLEITPSLPTDRLDNNPWPEWPMTLRAGYGQKEAEFVGNTDLITYQMTATAFQTNAEGQLTGLKVAKVGPDFKALEGTEQVIEADLVLLAMGFVGTDTGLLDKFGIQEIYDDYRTNNDKVLVAGDARRGPSLVIWAIREGRKTAEIVDEQLIKVATA

SEQ ID NO: 21415 - protein, 160 aa, Oryza sativa
QELGHQVDVIRQIANKVFTDMGKTIGYKVGTMIEIPRAALVADEIAAQAEFFSFGTNDLTQMTFGYSRDDVGKFLPIYLSQGILQHDPFEVLDQRGVGELVKLATERGRKARPNLKVGICGEHGGEPLSVAFFAKAGLDYVSCSPFRVPIARLAAAQVLL

SEQ ID NO: 21416 - protein, 624 aa, Arabidopsis thaliana
MDDMNLIQQAQRHQLVVSNLGEEIDLEIGPGEDDAAFANNSLIGGPPREPSTGEHDETKHMVLVSDLPSEDQDISKGTPAKRKKKVVKRWREEWADTYKWAYVDMKDGTARIFCSICREYGRKHRRNPYGNEGSRNMQMSALEEHNNSLLHKEALRLQTASKDKIVVDKPIYVKTVMSKSAGSIVEGALKRDPNEIEFVQSVQESVHALERVIAKNSHYVNIMERLLEPERMIVFRVPWIDDRGETHVNRGFRVQFNQALGPCRGGIRFHPSMNLSIAKFLGFQQTLKNALSPYKLGGASGGSDFDPKGKSDNEIMRFCQSFMNEMYRYMGPDKDLPSEEVGVGTREMGYLFGQYRRLAGQFQGSFTGPRIYWAASSLRTEASGYGVVYFARLILADMNKEIKGLRCVVSGCGKIAMHVVEKLIACGAHPVTVSDSKGYLVDDDGFDYMKLAFLRDIKSQQRSLRDYSKTYARAKYFDELKPWNERCDVAFPCASQNEVDQADAINLVNAGCRLLVEGSNMPCTAEAVDVFRKANVLIAPAIAAGAGGVAAGEIEVLRESNSMQWSAEDFESRLQEALKQTYEKALKAANDFGYQKESPEALLHGATIAAFLNIAQAMTDQGCV

SEQ ID NO: 21417 - protein, 89 aa, Zea mays
  misc_feature (9)..(9): Xaa can be any naturally occurring amino acid
  misc_feature (74)..(74): Xaa can be any naturally occurring amino acid
AWTMIEISXAALETHGMAGHAELGSFKTNDLSQIILGYSRDDVRNLMLIYLAHGILQHDLFEVVDHRGLGELVXLATNMGRTARPNLKA

SEQ ID NO: 21418 - protein, 446 aa, Streptomyces antibioticus
MHPVPAPEQPGELIARLRAASRTGRPRSLEWRTEQLTRLRSLLQEHTDALAEALFADLHKSRSEAHAAEIGFTVREIDHLLENLEEWLRPQPAAVPGCPAGSTAYVQYDPLGVVLVIAPWNYPVQLLLVPVAGALAAGNTVVAKPSEVAPACSALLARLIPQYLSRDAVAVVEGGVAETTALLAQRFDHIFYTGNGTVGRIVMRAAAEHLTPVTLELGGKSPVFVDRGTNLADTATRLARAKFANAGQTCVAPDYVLTDPDTARGLVAEIARSVRRMFGSEPELARGYGRIVNLHHFDRVVRLLGSGRIVLGGRHDRENRYIAPTVLADVAAESPVMREEIFGPVLPIVEVPGVDQAISFINDRDKPLAVYGFTAREEVRRRLAEETTSGGLVLGMPMAQVLDPGLPFGGVGESGTGSYRGAHSLAAFSHLKPVLDVPMRPTGPVG

SEQ ID NO: 21419 - protein, 202 aa, Vibrio vulnificus CMCP6
MVLVGRQAPDFTAAAVLGNGEIVDNFNFAEFTKGKKAVVFFYPLDFTFVCPSELIAFDNRYEDFKAKGVEVIGVSIDSQFSHNAWRNTPVENGGIGQVKYPLIADVKHEICQAYDVEHPEAGVAFRGSFLIDEDGLVRHQVVNDLPLGRNIDEMLRMVDALNFHQKHGEVCPAQWEEGKAGMDASPQGVAAFLSEHAADLKK

SEQ ID NO: 21420 - protein, 206 aa, Prochlorococcus marinus str. MIT 9215
MTDTPTKQETQSNKDNVPGAIPVEQKKNNRNDRKRNRRGDSKNLERDSDWQERVVQIRRVSKTVKGGKKMSFRAIVVVGNEKGQVGVGVGKAGDVIGAVRKGVSDGKKNLVRVPLTPNNSIPTLSKGRDGAANVLIRPAAPGTGVIAGGSIRTVLELAGIKNVLAKRLGSKTPLNNARAAMVALSQLRTHKSASRERGISLEQLYS

SEQ ID NO: 21421 - protein, 863 aa, Arabidopsis thaliana
MESHRVFVATFMLILHLVQAQDQPGFINVDCGLLPRDSPYNALGTGLVYTSDVGLVSSGKTGKIAKEFEENNSTPNLTLRYFPDGARNCYNLNVSRDTNYMIKATFVYGNYDGHKDEPNFDLYLGPNLWATVSRSETVEEIIHVTKSDSLQVCLAKTGDFIPFINILELRPLKKNVYVTESGSLKLLFRKYFSDSGQTIRYPDDIYDRVWHASFLENNWAQVSTTLGVNVTDNYDLSQDVMATGATPLNDSETLNITWNVEPPTTKVYSYMHFAELETLRANDTREFNVMLNGNDLFGPYSPIPLKTETETNLKPEECEDGACILQLVKTSKSTLPPLLNAIEAFTVIDFLQVETDEDDAAAIKNVQNAYGLINRSSWQGDPCVPKQYSWDGLKCSYSDSTPPIINFLDLSASGLTGIIAPAIQNLTHLEILALSNNNLTGEVPEFLADLKSIMVIDLRGNNLSGPVPASLLQKKGLMLHLDDNPHILCTTGSCMHKGEGEKKSIIVPVVASIVSLAVIIGALILFLVFRKKKASKVEAIVTKNKRFTYSQVVIMTNNFQRILGKGGFGIVYHGFVNGVEQVAVKILSHSSSQGYKQFKAEVELLLRVHHKNLVGLVGYCDEGENMALIYEYMANGDLKEHMSGKNRFILNWETRLKIVIDSAQGLEYLHNGCKPLMVHRDVKTTNILLNEHFEAKLADFGLSRSFPIGGETHVSTVVAGTPGYLDPEYYKTNRLTEKSDVYSFGIVLLEMITNRPVIDQSREKPYISEWVGIMLTKGDIISIMDPSLNGDYDSGSVWKAVELAMSCLNPSSTRRPTMSQVLIALNECLVSENSRGGASRDMDSKSSLEVSLTFDTDVSPMAR

SEQ ID NO: 21422 - protein, 334 aa, Chlamydophila abortus S26/3
MKEKIAYLGMGIWGFCLASLLAHKGYRVVGWARNPELVAQLQTEHRHPQAPDMPIHPNLSFTTDMVEAVDGASMIVEAVSSAGIRPVSKQLKTITDLKVPFVITSKGIEQHTGLLLSEIVVEIFGSQASRYLGYLSGPSIAREVLKGCPCSVVISAYDPDTLKKIHHAFLTPKFRVYPNSDLKGVALGGALKNIIAIACGISDGFQFGDNAKSGLVTRGLHEIRKFATIMDCRPDTLYGLAGLGDLCTTCFSSLSRNTRFGKLIAQGFTLEQAKAEIGMVVEGAYTALSAYQIAKHHKIDMPITTGIYRVLYENLDIKEGIAALLQRNTKEEYL

SEQ ID NO: 21423 - protein, 91 aa, Cyanidioschyzon merolae strain 10D
MTEQQILDKVQSIVSEQLGVERSQISPNASFTHDLGADSLDNVELVMAMEEEFDLEIPDSAAEQITTIQQAVDYILQHKKSLSQNNLSQNN

SEQ ID NO: 21424 - protein, 221 aa, Oenococcus oeni PSU-1
MKVTFYLVRHGQTYFNRYNKLQGWSNSPLTENGLSDARKVGEKLSGVRFEAAYSSDTSRAMQTAKIILDKNTTDFQPELSCLANFREEFYGSYEGSNMDIAWLNAGAPYGLKSYAEIVDDYGVASTKDFLKAADPWHDAENNDEYWARLDEGFTKLLEDPNVKDGAKVLLISHGNTLLSLADRYGNNKISLHARPKNGSVSKLVYEDRQYHFISFDDKEIN

SEQ ID NO: 21425 - protein, 386 aa, Oryza sativa Japonica Group
MELDSLREAFDRVIEKRASSSAKAQEVIDQIVSEVEQAITKMQMMNTDSMGTADHSSILAELKAKLNELAPLNQLEGCQKELNVALSKYLKLLEKSFSPDISKAYRNVDFEASTINSIIANHFYRQGLFDLGDSFVRECGESDGAHLKLQFQEMYSILEAMQVRNLQPALSWAAKNHDQLLQNGSMLELKLHQLQFVEILTKGSRDEALKYARTHLVPFASLHKAEIQKLMACLLWADRLDQSPYAEFMSSTHWEKLAEELTHQFCSLLGQSSESPLGVAVSAGFQGLPTLLKLTTVMAAKKQEWQAMKQLPVPIDIGPEFQYHSVFVCPVLREQSSDENPPMLMPCGHVVSKQSIMKLSKSSSRPFKCPYCPSEAVASQCKQLHF

SEQ ID NO: 21426 - protein, 401 aa, Oryza sativa Japonica Group
MDEEQLRALLRDLDALKQRPDPAAIDRDMSSEVVDSNPYSRLMALQRMGIVDNYERIRDYSIAIVGIGGVGSVAAEMLTRCGIGRLLLYDYDTVELANMNRLFFRPDQVGMTKTDAAVQTLSGINPDVTLESYSLNITTVKGFETFLGSLKARSSDGRNTGVDLVLSCVDNYEARMVVNQACNELGQTWMESGVSEDAVSGHIQLLVPGETACFACAPPLVVASGVDERTLKREGVCAASLPTTMGVVAGLLVQNALKYLLKFGQVSPYLGYNSLKDYFPTMEMKPNPQCSNPACVQRQKEYMQSKPARDAAAKAKMEAEASAADECPVHLDNDWNISVVDDSDTVTPSILSTGADSLPEGLVRELPTADSYQEPVAPVTSGAIDDDLEELQRQLDALNSS

SEQ ID NO: 21427 - protein, 150 aa, Pseudomonas aeruginosa
MALQRTFSIIKPDAVSKNVIGEILTRFEKAGLRVVASKMVQLSEREAGGFYAEHKERPFFKDLVSFMTSGPVVVQVMEGEDAILRNRELMGATDPKKADAGTIRADFAVSIDENAVHGSDSEASAAREIAYFFSSTEVCEALPDSANERG

SEQ ID NO: 21428 - protein, 351 aa, Listeria monocytogenes str. 1/2a F6854
MYKGLLEKYKEYLPVTDKTPMISLAEGNTPLIPLPNLSKELGVTLYGKYEGLNPTGSFKDRGMVMAVAKAKEEGAEAVICASTGNTSAAAAAYATRAGLKAYIVIPEGKVALGKLAQAVMYGADIISIQGNFDEALKSVRELAETEAVTLVNSVNPYRLEGQKTAAFEICEQLGSAPDVLAIPVGNAGNISAYWKGFKEWNEAKASGLPRMHGFEAEGAAAIVQGKPIDNPETIATAIRIGNPASWRLAEAARDESGGYIHSVTDDEIVNAYKKIAAQDGVFIEPGSAASLAGVIQHVANGTIKKGETVVCVFTGNGLKDPDTAMSVHEIPISHVDDIEAMRTHLRSGVKA

SEQ ID NO: 21429 - protein, 429 aa, Debaryomyces hansenii CBS767
MIRVIQPPLIASKQLFRRYLATGGTFTNKTSQLDRATLTIKDGPVFSGYSFGANKNISGEAVFTTSLVGYPESMTDPSYKGQILCFTQPLIGNYGVPSSTLKDEFNLLKHMESPSVQCIGIVVADVALEYSHWTAVESLQQWCQRSGVAAISGVDTRQLVSYLREKGSSLAKITIGEEYDADEDAAFEDPGSVNLVHKVSTKAPFHISCPEKYAKGLHIAVLDCGAKENILRCLVERGASLTVFPYNYPIDKIANKFDGIFISNGPGDPTHCSSTTENLAKTMEKYHDLPIFGICLGHQLLALASGARTIKMKYGNRAHNIPALDLTTGKCHITSQNHGYSVDAETLDSDWEPYFTNLNDLSNEGMKHKSRPIFSTQFHPEAKGGPLDTAFLFDKFFENIEQYRATNGLNLGNVDDSLLVDILPKGRVL

SEQ ID NO: 21430 - protein, 331 aa, Debaryomyces hansenii CBS767
MDLFKRTSALLPILANSHLASNISTESYTDVFHSLQNLSQGDTSVSQLNILEKLWASWYIYMNNDILATGILFFATHELMYFGRCLPWLIIDRISFFNKWKIQDEKIPSDKEQWECFKSVLKLHLLVEALPIWLFHPLCATLNISIDVPFPSYLVMFLQICLFFVCEDFWHYWAHRLFHYGWLYKYIHKQHHRYAAPFGLTAEYAHPVEVMSLGFGTVGFPIIYAYITKCKPSLDLPSLHLFTLSFWITLRLFQAVDSHSGYDFPWSLHNVLPFWAGADHHDDHHHYFIGNYASSFRWIDYFMSTESGEIAKANREKRMRRRAEIQAKKSQ

SEQ ID NO: 21431 - protein, 398 aa, Lactobacillus plantarum
MGEHMDFLGILCLLILATTLAGHFAHRAGIPAVIGEILVGVILGPALLNWVHLTTLVQTFSDIGVVVLMFIGGLESNLALLRKYLRPAIIVAIIGVIFPVVIMGLASRFFQFSWFESLFIGVIFSATSVSISVEVLKEFKVLDTKEGATILGAAVADDIIGVILLSIMIAMMGGQSGVAQTNLGIVLLEQVGFFIGVFIVIKWVAPYLMRLSDHLLMAASPTIMAIIICLALAWLAELVGLSGAIGAFFAGVAIAQTDYQHVVDVSIEPVGYTTFIPLFFVSVGLNMTFKGVWQLLPFIVVMTVLGVLTKLWGCGLGAKLNGFSRHSNYLVGAGMISRGEMALITAQIGFSAHLLSNDYYSDIILVIIVVTMIAPFVLKNAIHRAGQVTATHSIIKEH

SEQ ID NO: 21432 - protein, 175 aa, Triticum aestivum
MAPTVMASSATSVAPFQGLKSTAGLPVSRRSNGASLGSVSNGGRIRCMHVWPIEGIKKFETLSYLPPFSTEALLKQVDYLIRSKWVPCLEFSKVGFIYREHNASPGYYDGRYWTMWKLPMSGCTDATQVINEVHEVNKEYPDAYVRIIGFDNMRHVQRVSFIAFKPPGCDESGKA

SEQ ID NO: 21433 - protein, 270 aa, Debaryomyces hansenii CBS767
MSYGSKAAERVANKIVLITGASSGIGEATAKEIASAANGNLKLVLCARRKEKLDNLSKELTDKYSSIKVHVAQLDVSKLETIKPFINDLPKEFSDVDVLVNNAGLALGRDEVGTIDTDDMLSMFQTNVLGLITITQAVLPIMKKKNSGDVVNIGSIAGRDSYPGGGIYCPTKASVKSFSQVLRKELISTKIRVLEVDPGNVETEFSNVRFKGDMEKAKLVYAGTEPLLSEDVAEVVVFGLTRKQNTVIAETLVFSTNQASSSHLYRESDK

SEQ ID NO: 21434 - protein, 405 aa, Methanosarcina barkeri str. Fusaro
MYHLKCIECGAEYSKDEVIYTCSKCDGLLDVIYDYSSVKIDMEKLKTECPSVWKYAKLLPIEREPVTIQEGGTPLYKCNRLAEKIGIKELYVKHEGMNPTGSFKDRGMTVGVTKALELGMNTVACASTGNTSAALAIYGAKAGIPVIVLLPAGKVALGKVAQALMHGAKVLSIRGNFDDALALVRTLCSQEKIYLLNSINPYRLEGQKTIGFEIADQLGFKVPDRVVLPVGNAGNITAIWKGFREFKKLGITDSLPKMTGIQAAGSCPIVTAIKSEAPEITPEEKPETVATAIRIGNPVNAKKALAAIRESGGTAESVTDEEILTAQKDLARLEGIGVEPASAASVAGLKKLVDMGVISRDETVVCITTGHLLKDPQTVIDICEKPIVVDASIEAIREAIFGKAE

SEQ ID NO: 21435 - protein, 466 aa, Lactococcus lactis subsp. lactis Il1403
MLYGKENRDEAEFLEPIFGSESEQVDLPKYKLAQQSIEPRVAYQLVQDEMLDEGNARLNLATFCQTYMEPEAVKLMSQTLEKNAIDKSEYPRTTEIENRCVNMIADLWNASEKEKFMGTSTIGSSEACMLGGMAMKFSWRKRAEKLGLDINAKKPNLVISSGYQVCWEKFCIYWDIEMREVPMDKEHMSINLDKVMDYVDEYTIGVVGIMGITYTGRYDDIKALDNLIEEYNKQTDYKVYIHVDAASGGLYAPFVEPELEWDFRLKNVISINTSGHKYGLVYPGVGWVLWRDKKYLPEELIFKVSYLGGELPTMAINFSHSASQLIGQYYNFVRYGFDGYKAIHERTHKVAMFLAKEIEKTGMFEIMNDGSQLPIVCYKLKEDSNRGWNLYDLADRLLMKGWQVPAYPLPKNLENEIIQRLVIRADFGMNMAFNYVQDMQEAIEALNKAHILYHEEPENKTYGFTH

SEQ ID NO: 21436 - protein, 291 aa, Blumeria graminis
MPTDGIPPMLGQSSPLKLRKYEGRLSDDNFRNHVIAAIGEFLGTTLFLFYGFLAAQIINSKPDNLSDAPSLLQLIFVASAFGVSGAVNVWLFYRVSGGHLNPAITIGLTLIGAVPVTRALLLVSVQLLGGILAASLVLAVTPGSLNVQTALGNATSVKQGFFLEMILTATLVLTVFMLAVEKHRTTPLAPLGIGLILFLDVLLAAQFSGGSLNPARSFGPAVVELNFATYHWIYWFGPIAGAVLAAAIFKVLKFLAYETAVAGQDHDGLDVYRLIDDAGGHEVDREIQLEV

SEQ ID NO: 21437 - protein, 487 aa, Brucella melitensis 16M
MLALKDPSLLKSQCLVNGRWIDAADGTTIKVTNPADGSVIGTVPSLSVATIKEAIDASAKALSGWAAKTAKERAGILRKWFDLIIANADDIALIMTSEQGKPLAEARGEVLYAASFIEWFAEEAKRVYGDTIPAPQNGQRLTVIRQPVGVTAAITPWNFPAAMITRKAAPALAAGCTMIVRPADLTPLTALALGILAEKAGIPAGVLQIVTGKAREIGAELTSNDTVRKLSFTGSTEVGRLLMAQCAPTIKRISLELGGNAPFIVFDDADLDAAVDGAMVSKYRNAGQTCVCANRIYVQRGVYDKFAEKLAAKVKELKVGNGTEPGVVIGPMIEEKAITKVKAHIEDAVSKGAKLITGGKELGGLFFEPGILTGVTSDMLVAKEETFGPLAPLFAFDTEEEVIAQANDTIFGLAAYFYTENFSRAIRVSEALEYGMVGHNTGLISNEVAPFGGVKQSGLGREGSKYGIEEYLETKYICSAYKRGAKK

SEQ ID NO: 21438 - protein, 180 aa, Bacillus subtilis subsp. subtilis str. 168
MAERMVGKQAPRFEMEAVLASKEFGKVSLEENMKNDKWTVLFFYPMDFTFVCPTEITAMSDRYDEFEDLDAEVIGVSTDTIHTHLAWINTDRKENGLGQLKYPLAADTNHEVSREYGVLIEEEGVALRGLFIINPEGELQYQTVFHNNIGRDVDETLRVLQALQTGGLCPANWKPGQKTL

SEQ ID NO: 21439 - protein, 205 aa, Chlamydophila abortus S26/3
MQMTLVPYVVEDTGRGERAMDIYSRLLKDRIVMIGQEITEPLANTVIAQLLFLMSEDPKKDIKVFINSPGGYITAGLAIYDTIRFLGCDVNTYCIGQAASMGALLLSAGTKGKRYALPHSRMMIHQPSGGIIGTSADIQLQAAEILTLKKHLANILSECTGQPVEKIIEDSERDFFMGAEDAISYGLIDKVVSSAKDTKDKDTIS

SEQ ID NO: 21440 - protein, 458 aa, Xanthomonas oryzae pv. oryzae KACC10331
MSALFGATPADWLDARNLRLATRLGTLGLEPTAGRTLIREGILRRAVGLTLEATGCEAPMGATCKVEVDGGWLDAEVVGFAGERTYLMPSAELHGLLPNARVVPSRHRGGVEVGEGLLGRVIDSDGTPLDGKGPIRAEGSVGMAGVSINPLAREPITTSLDVGVRAINAMLPIGRGQRVGLFAGSGVGKSTLLGMMTRFTAADVIVVGLIGERGREVRDFVETTLGEEGLRRAVVVAAPADRPPLARLHGAYRATAIAEWFRDQGLNVLLLMDSLTRFAQAQREIGLSVGEPPTTRGYPPSVFAKLPALVERAGNGAKGRGSITAFYTVLTEGDDPQDPIADAARAILDGHILLSRRVADSGLYPAIDLESSVSRVVQDIADDTWRLRIRKLKRLLSAYTANRDLIAIGAYQRGSDPATDEALARWPEIVEFLGQDVHKASVLSDSLSALQQLVEPEN

SEQ ID NO: 21441 - protein, 570 aa, Trichodesmium erythraeum IMS101
MNKQQNQKFKFDPIDTALADIKAGKCVVVVDDEHRENEGDVICAAQFATPNMINFMAVKARGLICLALTGDRLDQLEVPLMVTNNTDSNQTAFTVSIDASPELGVSTGISAEDRARTIQAVINSNTKPEDLRRPGHVFPIRAKEGGVLKRAGHTEASIDLARLSGLYPAGVICEIQNPDGSMARLPQLVEYAQTHNLKLISIADIISYRIKHDRFVFREAVAKLPSQFGNFQIYAYRDTQNNLEHIAIVKGNPAEFSQRDIMVRVHSECLTGDAFGSLRCDCRMQLQAAMKMIEHAGAGVVVYLRQEGRGIGLVNKLKAYSLQDIGLDTVEANERLGFPADLRNYGVGAQILHDLGVNKMRLITNNPRKIAGLHGYGIEIVDRVPLLIETTDYNSAYLATKAQKLGHILLRSYLVTIAINWNNQKIEEETFDNSDHINMKSLAQQRYQYLEKLRSLIKEYDFLLQEETRPVATAVFAQAPLIVNFGLEQATLTTSKWYQESNNPYLVAIAKVLTEIAQWQNMLKLEFIIASGLDPMIALQIKLERQTLEITELSTAMEHLETQKIYSLKI

SEQ ID NO: 21442 - protein, 171 aa, Glycine max
  misc_feature (77)..(77): Xaa can be any naturally occurring amino acid
  misc_feature (83)..(83): Xaa can be any naturally occurring amino acid
  misc_feature (85)..(85): Xaa can be any naturally occurring amino acid
  misc_feature (109)..(109): Xaa can be any naturally occurring amino acid
  misc_feature (119)..(119): Xaa can be any naturally occurring amino acid
  misc_feature (146)..(146): Xaa can be any naturally occurring amino acid
  misc_feature (152)..(152): Xaa can be any naturally occurring amino acid
RHQADLVFTSAASENPLFLKEHVKDFPPASQEVGGRRFFIDISVPRNVGSCVSDLESVRVYEVDDLREVVAANEEDXRVEAVXGXAISGEEGEQFQGWRDSLETVPTGXRWRADAEGIXLGELEKCLCGMGDDIREKTRGAVDDAXRGMVRXVRHGPMQQVVCDVNNNPSS

SEQ ID NO: 21443 - protein, 118 aa, Microcystis aeruginosa PCC 7806
MDTIHVTGIRAYGYTGYLAEEQVLGQWFEVNLSLEVDISIAGKSDAIEDTLDYRQAIEIVKHQIETGKFALVEKLATVIAEDILQLDRVRQVRVQLSKPAAPIPHFTGKITIDITRSR

SEQ ID NO: 21444 - protein, 441 aa, Frankia sp. CcI3
MAVRGSRGPVPGDGGPPLVGYTLRYLHDPAQHWRQRYDRYGPVSWERTFGLRVVSLLGPDATGLALRNHEQAFANGPGQQRIAGPFFRRGLSMLDFDEHRHHRRILAGAFAPDRLRGYLAGMNPSIERGVAGWRPGARFQVYPAVKQLTLELATRIFMGERLGPEADRFNAALFACIRAPGAVVRVPAPGLRWSRGLAGRRYLEEFLRLRVPAKRAGSGTDMFSRLCHAEAEDGSRLSDDDVVNHMILMMVAAHDTSTITMTSMSYYLARHPEWQQRCREESLALGTPAVDHADLDRLPSLALVMKEALRLVTPVPILLRATVKDIDVLGVTVPAGTVAALALAFTHQMPEYWPSPERFDPERFADHRREDKVHPYAWQPFGGGPHTCIGLHFAGQQVKAILHQMLLRYRWSLAPGYRISLDRFPLPVPRDGLPVQLEKIT

SEQ ID NO: 21445 - protein, 720 aa, Zea mays
  misc_feature (472)..(472): Xaa can be any naturally occurring amino acid
MRARTLSLLLHLLAAAASSFTPSASTDTIYRNTTLTGNQTLVSAGGIYALGFFSPAGADGRTYLGIWYASIPGPTTVVWVANRRDPVANAPAALQLSAGGRLVILDGNNDTVWSTAAPTVGNVTAAQLLDSGNLVLSADGGGQSVAWQSFDYPTDTLLPGMKLGVDIRAGITRNITAWRSPSDPSPGDVTFKLVIGGLPQFFLLRGATRVYTSGPWNGEILTGVPYLKAQAFTFEVVYSPDETYYSYFIREPSLLSRLVVDGAATQLKRFSLNNGAWNSFWYYPTDQCDYYAKCGPFGFCDTDRSPPCSCLPGFVPRSPDQWGRREWSGGCVRSTSLSCDGGDGFWVVNRMKLPQATDATVYAGMTLDQCRQACLGNCSCGAYAAANNSGGIGVGCVIWTVDLLDMRQYPIVVQDVYIRLAQSEIDALKAAATGDHQHLHKSKLIVVIVATISAVLFLLRLLGAAFSGRRRXGSRKAEGEDMTSLPPSTADFALPYRVRSQPSSSPVRDHKQLLDASEETRYPTDKDVDLPLFELEVILAATDNFAGHKRIGAGGFGPVYMEFSRRINAWQGVLEDGQQVAVKRLSQGSTQGVSEFMNEVRLIAKLQHRNLVRLLGCCIENDERMLVYEYMHNQSLDTFIFDEGKRRLLRWQKRFEIILGIARGLQYLHEDSRFRIIHRDLKASNVLLDRNMVPKISDFGIARMFGGDQTTAYTRKVVGT

SEQ ID NO: 21446 - protein, 202 aa, Ustilago maydis 521
MWRRRWSVTELVLFTLLLISTIYHLHSRTLRSHPSPPLNSTCPSSTALFKMATEQTYIMIKPDGVQRGIVGEIIKRFENRGYKIAALKMVHASEEHLEKHYKDLKGKKFFPGLIKYMASGPVVCIVFEGKDAVKTGRVLLGATNPLDSAPGTIRGDFAIDVGRNVCHGSDSVESAKAEIALWFGEQNPTIQYTRAVDSWIYE

SEQ ID NO: 21447 - protein, 357 aa, Chrysanthemum x morifolium
MDDNSLHENRFVRDEDERPKVPYNKFSSEIPVISLKGIDDVEESSGGIKSRRAEICEKIIKACEDWGIFQVVDHGVDTKMLSEMTRLAREFFEMPAEEKLRFDMTGGKKGGFIVSSHLQGEAVQDWREIVTYFSYPIKARDYSRWPDKPKEWRAVTEKYSEDLMGLGCKLLEVLSEAMGLEKEALKDACVDMDQKVVLNYYPKCPQPDLTLGLKRHTDPGTITLLLQDQVGGLQATRDGGKTWITVEPIEGAFVVNLGDHGHYLSNGRFKNADHQAVVNSNTSRLSIATFQNPAPNAIVYPLIVNEGEKSIMEEAITFMDMYKKKMSTDLELARLKKLAKAKQQDLEKAKPIESILA

SEQ ID NO: 21448 - protein, 229 aa, Rhodopseudomonas palustris CGA009
MHDLVRRVTQHSTNVQETVPMSLHIGDIAPDFTADTTKGKISFHDFIGNSWVFFFSHPADFTPVCTTEMGKTAKLAQPFASRNVKPIGLSTDTVDEHLKWIADVNDTQQTDLQFPIIADPELKVAKLYDMIHPNQSDTAAVRSVFIIDPNKKIRLTMTYPMNVGRNFDEILRVIDALQFADKHTVAAPADWRPGDKVIIPLSVKGEAATKAFPQGWEEPRPYLRLTTIK

SEQ ID NO: 21449 - protein, 305 aa, Corynebacterium glutamicum ATCC 13032
MSVVGTGLFFGSPEEERDKLMQSLMDQKNKLSKSEGIPLVTLNDGKTIPQLGFGVFKVDPDEAERVVTEALEVGYRHIDTAAIYGNEEGVGRAIAKSGIPREELFITTKLWNDRHLDVEAAFEESLQKLGLDYVDLYLVHWPAPKNDNYVAAWKGLEKLGDRARSIGVCNFLPEHLEKLLAEATTVPAINQIELHPALQQRDAVEASLAAGITVESWGPLGQGRFDLGAEEPIAAAAKNHGKTPAQVVIRWHLQNGFVVFPKTVTKSRMVENIDVFDFELSDEEMAAITALERNDRGGSHPNDLN

SEQ ID NO: 21450 - protein, 390 aa, Oryza sativa
MTDLLSDTEIEPILTGNLPPGFDTSTCRSVYVGNVHVQVTEALLREVFQSTGLVEGCKLIRKEKSSYGFVDYYDRRSAALSILTLNGKQIFGQLIRVNWAYASGQREDTTDHFNIFVGDLSPEVTDSALFAFFSGYSSCSDARVMWDQKTGRSRGYGFVSFRNQQDAQSAINDLNGQWLGSRQIRCNWATKGASNGEQQTSDSKNVADLTNNLTEDGKEKANEDAPENNPQYRTVYVGNLAHEVTQDVLHRLFHALGAGAIEEVRIQLGKGFGFVRYSNHAEAALAIQMGNGRILGGKPIKCSWGNKPTPPGTTSAPLPPPAAPSVTAADLLEYQRSLALSKMVSSQALMQAQAQQHLKQAMGMGAGVSQAMYDASFPNVGPSQQQLMYY

SEQ ID NO: 21451 - protein, 620 aa, Physcomitrella patens subsp. patens
MLAVELVSGNFVVEENSLAVMSPESLKGTYRSAIGNFGVPKYGGTLSGVVIYPTVNMKGCGKFPHDHFRSNSGERPKFALIDRGDCYFATKVWNAQQAGAAAVLVVDNRDEDLITMNSPEEDPVASKYLPNISIPSALIIKKFGDKLKTALSNKELVAIKLDWREAMPHPDERVEYEFWTNSNDECGPKCDDQVEFVRNFKGKLTFTLFCSFKNKIVEIQDNHSKSINSAFIESKQCKAQCINNGRYCAPDPELDFTRGYDGKQVVTENLRQLCVFKVANESLPRQPWKWWDYVTDFQIRCRMKDNRYGPECAEEVMKSLSIDVDAVRKCIGDPNADADNEILKHQQDVQVGEGVRGDVTILPTLVINQRQYRGKLDKTAVLKAICAGYLETTDPPICLSDTIETNECADNNGGCWERGSITACKDTFRGRVCECPLVHGVQFEGDGYTHCEAHGLGRCKVQNGGCWEETRLGVYHSACSDYHHHGCHCPLGFEGNASKVEGGCVDIDECARKLKCQCPDCKCTNTWGSYECECANDLLYFHEHDTCINRKSGQSKAAGWVVSLIVLAGLSVLGLGSYVVYKYRLRTYMDSEIRAIMAQYMPLDSQGEVQNHSHNGVREP

SEQ ID NO: 21452 - protein, 272 aa, Dehalococcoides sp. CBDB1
MEMTQSSNHIVVIKLGGSVLDSKDTSLKDIATLKQLGLKPVLIHGGASTVSAWSAKLGLETRLVNGERVTDDATLDVVAAILAGLVNKEIVAALLDMGIKAAGISGVDSATITGQIRATETGYLGDVVQVNTELITALLDANITPVISPVSFHQINRPSGSRRLLNINGDPVAGEIASALQAERLVFLTDVPAVKGKNGEALGEISADHAAELLASGTASGGMIPKLRSCLKATLAGSSACIIDGRKPHMLIRELTEGNCGTTVTGQHLRRS

SEQ ID NO: 21453 - protein, 398 aa, Dehalococcoides sp. CBDB1
MDNWQELEHKYYMQTFYRAPITIVKGQGAKVWDDKGKEYLDFVAGWAVNSLGHCHPAVVKAVTEQAGTLIQTSNNFYTIPQLNLAKLLIDNSCLDRIFFCNSGTEASEGAVKLARRYGKLKLKGAYEVITATGSFHGRTLAMVSASGQSKYQEPYTPLPTGFVNVEYNNPKAIKVAITDKTCAVMLEPIQGESGVNVPDAGYLKEVRKICDEAGILLILDEIQTGIGRTGKLFAYEHFGIEPDIITLAKGLASGVPIGAFMAKESASVFAKGEHGSTFGGNPLACAAGYATMKFILDNHISEHAAAMGKYLIKGLEKLKAKHSIIQGYRGCGLLMALDFKADIAKELVSNCLSEGLLLNAVKPNALRFMPSLNITEADIDEALSKLDNVLTHSESAGV

SEQ ID NO: 21454 - protein, 332 aa, Zea mays
MSAPSDAAVAAAAPASTTTAAASSGGLTFKLHPLVIVNVSDHHTRVKAQAACSGDSSSPSSSAPGAGQPPRVFGCVIGVQRGRTVEIFNSFELVLDPVSGTLDRAFLDKKQELYKKVFPDFYVLGWYSTGSDVHDTDMLIHKSLMDINESPVYLLLNPTINLSQKDLPVTIYESELHVIDGIPQLIFVRSNYTIETVEAERISVDHVAHLKPSDGGSAATQLAAHLTGIHSAIKMLNSRVRVIHQYLVAMQKGDIPLDNSLLRQVSSLVRRLPAMESQKFQDDFLMEYNDTLLMTYLAMVTKCSSTMNELVEKINTSYERTTSRRGGRGAFM

SEQ ID NO: 21455 - protein, 468 aa, Photorhabdus luminescens subsp. laumondii TTO1
MAENIHTSLSTKTGETQLQRNLSNRHIQLIAIGGAIGTGLFMGSGKTISLAGPSIIFVYMIIGFMLFFVMRAMGELLLSNLNYKSFSDFSADLLGPWAGFFVGWTYWFCWVITGIADVVAITSYISYWQPDFPQWITSLLCVSLLLSLNLATVKLFGEMEFWFAMIKIVAIIALIATGAVLIGMHFQSPAGHTASLANIWNDGGFFPKGLSGFFAGFQIAIFAFVGIELVGTAAAETKDPMKSLPRAINAIPIRIITFYVLALIIIMSVTPWRSIIADKSPFVELFVLIGLPAAASIVNFVVLTSAASSANSGVFSTSRMLFGLAKEGDAPQQFSRLSRRSVPASGLIFTCLCLSCGVVLIYLIPDVMHVFTLVTTVSAILFMFIWSMILCSYLVYRKRRPALHKASTYKMPLGIIMSWVCLTFFAFVLILLTLRDDTRQALIITPVWFLILIIGFQIVKKRRTRLYS

SEQ ID NO: 21456 - protein, 320 aa, Xanthomonas arboricola pv. pruni
VQQHITFPANIIEPALFEEGKMFDGSSIAGWKGINESDMVLLPDAGTAYLDPFFADPTIVLTCDILDPATMQSYERDPRGIAKRAEAYLKSSGTADQAFFGPEPEFFIFDSVRFANDMGHTFFQVGSEEAAWNTGAKYDGGNSGYRPGVKGGYFPVPPTDTLHDLRAEMIKTLEQVGIETEVHHHEVATAGQCEIGTKFSSLVQKADELLTMKYIIKNVAYRNGKTATFMPKPIVGDNGSGMHVHQSLTKGGVNLFSGDGYGGLSQMALWYIGGIFKHARAINAFSNSGTNSYKRLVPGFEAPVMLAYSARNRSASCRIP

SEQ ID NO: 21457 - protein, 516 aa, Arabidopsis thaliana
MALVSLLEISIAFFCFLIFRIFLISKKPHRSFLTNWPLLGMLPGLLTVLPRVYDFITEVLEDGNLNYLFIGPFLGGIDMLFTVDPANIHHIMSSNFANYPKGTEFKKLFDVLGDGIFNADSDLWKDLRKSSQSMMNHPDFQRFSLATSLSKLEKGLVPLLDHVAKEKLVVDLQDVFQRFTFDTTFVLATGYDPGCLSVEMPEIEFARALDDAEEAIFYRHFKPEVVWKMQRLIGVGAELKLKRAHAIFDRVCSKCIASKRDEISQGIDSSSSKDLLMSSINVDTTKYKLLNPSDDRFLRDTILSFMLAGRDTTGSALTWFFWLLCNNQEAMTKIRQEINTNLFPRNKTDDGSVSYDSDSFNPQEVKKLVYLHGAVCEALRLYPPVPFNHKSPAKPDVLPSGHKVKANSRILFCLYSLGRMKSVWGEDAMEFKPERWISESGRSVHEPSYKFLSFNAGPRTCLGKEVAMTQMKTVAVKIIQNYDINVVEGHKIKPAPSVILHMKHGLKVTVSKRCLS

SEQ ID NO: 21458 - protein, 155 aa, Glycine max
  misc_feature (37)..(37): Xaa can be any naturally occurring amino acid
MKSAICGRILSPNHVFKPGDTHSICKGPYSNLCVPMXVLATGPGKGGGVLEKPVIEKVTPGRESEFDLKKSRKSAPPYRVILHNDNFNKREYVVQVLMKVIPGMTLDNAVNIMQEAHYNGLSVVIICDQADAEDHCMQLRGNGLLSSIEPANGGC

SEQ ID NO: 21459 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHAPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGLVNVAGMTPDNMAPLCEAIVAVL

SEQ ID NO: 21460 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHAPTGIDPTLEQWQTLAQLSVEKGWLPLFDFAYQGFARGLEEDAEGLRAFAAMHKELIVASSYSKNFGLYNERVGACTLVAADSETVDRAFSQMKAAILANYSNPPAHGASVVATILSNDALRAIWEQELTDMRQRIQRMRQLFVNTLQEKGANRDFSFIIKQNGMFSFSGLTKEQVLRLREEFGVYAVASGLVNVAGMTPDNMAPLCEAIVAVL

SEQ ID NO: 21461 - protein, 457 aa, Lactococcus lactis subsp. lactis Il1403
MYTVGDYLLDRLHELGIEEIFGVPGDYNLQFLDQIISRKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENPTSNTSDQEILNKIQESLKNAKKPIVITGHEIISFGLEKTVTQFISKTKLPITTLNFGKSSVDETLPSFLGIYNGKLSEPNLKEFVESADFILMLGVKLTDSSTGAFTHHLNENKMISLNINEGKIFNERIQNFDFESLISSLLDLSGIEYKGKYIDKKQEDFVPSNALLSQDRLWQAVENLTQSNETIVAEQGTSFFGASSIFLKPKSHFIGQPLWGSIGYTFPAALGSQIADKESRHLLFIGDGSLQLTVQERKLQVQVSQPSSSHMNSYS

SEQ ID NO: 21462 - protein, 97 aa, Oryza sativa Indica Group
KKDKDKKPSITVIQGPKPGKPTDLSRMRQILVKLKHAPPPHMMQPPPASAAKDGAKDGAKDGTPAPANGTKKPAESKEKPANGSPAEAEKEQPAASE

SEQ ID NO: 21463 - protein, 368 aa, Sulfitobacter sp. EE-36
MANPTLLILAGDGIGPEVMGQVVRIIDWFGDKRDLAFDVDHDLVGGAAYDKHGTPLHDDTMAKALAADAVLLGAVGGPKYDALDFSVKPERGLLRLRKEMDLFSNLRPAQCFDALADFSSLKKDLVAGLDIMIVRELTSGVYFGEPRGIFEEGNERVGINTQRYTESEIDRVARSAFELARRRGNKVCSMEKANVMESGILWREVVQKVHDEDYPDVELSHMYADNGAMQLVRAPKQFDVIVTDNLFGDILSDCAAMLTGSLGMLPSASLGAPNADGRPKALYEPVHGSAPDIAGQGKANPIACILSFAMALRYSFDQGDEAARLEKAVEKVLADGARTADLMGPEGGSPISTSEMGDAILAALDASL

SEQ ID NO: 21464 - protein, 1617 aa, Cryptococcus neoformans var. neoformans JEC21
MSRTPISPRPNSNPRVPPSSAAFLQHLHSDPSSHHITLSGHRVSGLSLSPQSLTGEGDLLDINGTSEPSISPSLHSHLSPVSSGTSSGPSPLGSVGRAPSKRARPKTAPSRNDEWPLGRSYETSPDLPPLIPPQADEHLRSSPVGDLCTNAMTMDEGLVDAMEALSTSGEPKSYLIGRSESLAGTAESHTGPSKPSPASMNWSTFAQAVPNPPTPNETPTEFQSARSSPGQKYSSLPLNHKYSMPTVPHNRSGSSSENYSSKSSKDSVSTNASSAPSTSSASASGKQMSMAASLAARKKAYELENIRSKPSGLALNTDKLSLPSYSLAAATVRMASTSILNDLAPLSMPSPERELTDPLASVVSFDSSSTKKDSARSDPGSSRFPLHHSVSSAANPYTSSLRLPTIQASPVTTPLEGPHRPKGKDRSPPRARHGIVNSRIPSASAPLEKTAEAESSTDYFGAVAVAAVSPQETDSSSTATDPTPTGPSLELRKTTPLRSNSVVPEPSPRQQKDPLPPLVTPSDLNRIYDQYGWLPAPLPPDEAARRRALYRFSILHSAPDINFNRIAHMTKLVFNPKAVLITLIDSDTQWFKSQSGFTVEQGGRISSFCAHTILPRTDEPFVVLDTSSDWRFENNPNVVGPNSIRFYAGAPLRTADGFNVGALCILDDKPRTEFPPRSRLILKEFAAVTMREMELWRDKLQLRVRDKIQTSMEKFTRECLEMDSASPTSDAETVNKMEHVYSRAAQLVCSTIGLDGCFILDISQIEMVQTNTPTGKKSTYRANPYGAAENTSPVLERSESFGPVNPFPVLAAVPTAKSTRALTPYEHEKLSDFMQNHHDGRIFEGAAPQWIRYMFPQSFRYGMAVPIYGVDQQPFAMICAYTANPEKQFLEGYELQFLRAIGVIILSAVLRRRMALADKTKSILISSVSHELRTPLHGILAAAELLSDTQLDSNQLSFLKTVQTCGNSLIETVNHVLDFTKLSGTQSCKGSPSDLGKVNLAALVEQTVEGCWIGQRARFFMGDSDIGSFYAPPAPTSIVPKSKRALVGEELSHVETVVDIDMREKGWMVRCEKGGLRRVLMNLVGNSFKFTKNGYIQVSLREMPHEPGSKTIPVEMTVVDTGKGIGKDFLKDQLFHPFSQENPLQTGTGLGLAIVNTIVRSDSVNGKVDVWSAEGVGTEIKVTFDVEVVDDDDGQPSISSSSSVVSATSTFGHGLSVSFVGFNPKHQGHMLSCEVFTRYVNYWYFSIEDQQRADILIVNELEELVNHPMAAQKPILLLSVQRGFESTALAEKINRGGGFCQVVYKPVGPSALQKALNAAVHWIEERDSSDKSDILGGNVTGINLEGNSYRPSISRGSSGESHESHSTISELSNARFNQQSSINSRLPLQRRRSEENEQAPRRPSMAPRGMTYHSSRKMQRSSNDSAGSTPSQVPPSPTSSIPTIPLADGGVMLKAATVSAEAPRKEKMGRVMVVEDNVINRRVLGAFLKKRGFEYAEAVDGQAGVELFENAPPNYWDVILMDISMPIMNGHQATRAIRRIEATRRNSLSDIPIVPPPGKPVTISSQKAVQARVKIFALTGLATPDDKREAFWSGVDGYLVKPVSLSSLDIIFKKIGF

SEQ ID NO: 21465 - protein, 247 aa, Populus trichocarpa
MAGIAFGRFDDSFSLGSFKAYLAEFISTLLFVFAGVGSAMAYNKLTGDAALDPAGLVAIAVCHGFALFVAVSVGANISGGHVNPAVTFGLALGGQITILTGIFYWIAQLLGSIVACYLLKVATGGLAVPIHSVAAGVGAIEGVVMEIIITFALVYTVYATAADPKKGSLGTIAPIAIGFIVGANILAAGPFSGGSMNPARSFGPAVASGDFHDNWIYWAGPLVGGGIAGLIYGNVFITDHTPLSGDF

SEQ ID NO: 21466 - protein, 491 aa, Pseudomonas sp.
MKQYRNFVDGKWVESSKTFQDVTPIDGSVVAVVHEADRDLVDAAVKAGHRALEGEWGRTTAAQRVDWLRRIANEMERRQQDFLDAEMADTGKPLSMAATIDIPRGIANFRNFADILATAPVDSHRLDLPDGAYALNYAARKPLGVVGVISPWNLPLLLLTWKVAPALACGNAVVVKPSEDTPGTATLLAEVMEAVGIPPGVFNLVHGFGPNSAGEFISQHPDISAITFTGESKTGSTIMRAAAEGVKPVSFELGGKNAAVIFADCDFEKMLDGMMRALFLNSGQVCLCSERVYVERPIFDRFCVALAERIKALKVDWPHETDTQMGPLISSKHRDKVLSYFELARQEGATFLAGGGVPRFGDERDNGAWVEPTVIAGLSDDARVVREEIFGPICHVTPFDSESEVIRRANDTRYGLAATIWTTNLSRAHRVSELMRVGISWVNTWFLRDLRTPFGGAGLSGIGREGGMHSLNFYSELTNVCVRIDKESPDV

SEQ ID NO: 21467 - protein, 305 aa, Escherichia coli CFT073
MLGNPLLCRAFAFRHSSVYASASDYQNNEFHGRSEAMEKKIGFIGCGNMGKAILGGLIASGQVLPGQIWVYTPSPDKVAALHDQFGINAAESAQEVAQIADIIFAAVKPGIMIKVLSEITSSLNKDSLVVSIAAGITLDQLARALGHDRKIIRAMPNTPALVNAGMTSVTPNALVTPEDTADVLNIFRCFGEAEVIAEPMIHPVVGVSGSSPAYVFMFIEAMADAAVLGGMPRAQAYKFAAQAVMGSAKMVLETGEHPGALKDMVCSPGGTTIEAVRVLEEKGFRAAVIEAMTKCMEKSEKLSKS

SEQ ID NO: 21468 - protein, 396 aa, Rhodopseudomonas palustris CGA009
MLDATKTQRARGLLTASARSDVPPFMVMDVMAAADRIEAAGGHVIHMEVGQPWAPAPRAALAAAHAALDSSRIDYTSALGIPSLRARIAKHYRETYRCDVDPDRIVVTTGSSGAFILSFLALFEPGDRVAVTVPGYPPYRHILNALGCVPVPIETHSETRHALTGEALLAAHRKAPLKGVLVGSPANPTGTMMTREALTELIAVAESEGIRFISDEIYHGLDYAFPAVTAAELSPNAVVINSFSKYFCMTGWRVGWMVLPESLVRPVERLQQNLAISVPTLSQIAAEAAFDGRAEMEAVKRGYEENRAILIEGLPKAGLTEFLPADGAFYLYADVSAFTSDSYDFTKRMLEEARVAATPGIDFDPVRGKSFVRFSYARSADDMREAVRRITAWLGR

SEQ ID NO: 21469 - protein, 1005 aa, Oryza sativa
MFRRLLLPLRRCFSTSTSSSATPTLYSSGTTPVSILSWGRGASGQLGGGKEERRLYPSPVAHLSLPDPAPVLSPTPGRLPDAAAAGTAAGGVEVGISCGLFHSAVVVDGGAWVWGKGDGGRLGLGDESSAFVPRHNPNLSELRVLALGGIHSAALTASGEVFTWGYGGFGALGHYVYHRELLPRKVNGPWEGKISHIATSGAHTAAITDSGELYTWGRDEGDGRLGLGSGGGPGEAGSLSVPSKVNALPVSVAAVACGGFFTMALTSDGQLWSWGANSNFELGRGSNSSDWRPQLIPSLKNLHVIQVACGGYHSLALTDEGVVLSWGHGGHGQLGHPTLQNHRVPLAIKALSEERIVYIACGGSTSAAISEKGDLYMWGNARDCQLGVPGLPEIQPLPVMLSFARTSFGGQTAHLPKSKSSGYKHFVSISSGLPCFLAIRRQSPGYSSVHTASFSSQHNQLSTDRSGTVMAERELIDKDKLILRGLQFHGFHGVKQEEKTLGQKFVVDVDAWMDLSAAGETDSISDTVSYTDIYRIAKDVVEGPSRNLLEAVAHRIASATLLKFPQISAVRVKVGKPHVALPILFAFLKSSCRRGVFFFTEASSWPETRMPPVNSDGAGPSSGEDGSAAAVKKRNRPKYHRFTQQELQACKPILIPQTVILVLVFVGLIFIPIGLACIAASNKVVELVDRYDTKCVPRNMLRNKVAFIQNSSIDKTCTRVFKVPKDMKKPIYIYYQLDKFYQNHRRYVKSLNDMQLRNPKKVADTQYCSPEATANGRPIVPCGLIAWSLFNDTYSFTRGHGNETLRVNKDGISWKSERNRRFGKNVYPKNFQNGTLIGGGQLNPSKPLSEQEDLIVWMRIAALPTFRKLYGRIDMDLQAGDRVEVTMQNNYNSYSFNGKKSLVLSTAGWLGGKNAFLGRAYAIVGLACFLLALLLALLYFVFPMSVSATAELNPQFFIPFMKCSWILILEYMIQTWLLKEFFNTVSAVQSANLGVPGAPFVKDTT

SEQ ID NO: 21470 - protein, 482 aa, Prochlorococcus marinus str. MIT 9215
MLEILSHQYLKNFLRDQNISWEHIYSFGRIISKCIANDSTYLINSEIFSSYDWLPPILISLFLKEEDSTFILSQEKIQFISQFQIDSLKNLGFNFILKNDQLIFSNHNVRLITIQNFLDDPNSRNLRNHRIVYSGIEDIKQDLRTHFRISLLKKDWTKNFKEFELINQKFIEIYDSLKKKFFMRKVLGNSYINLDEKEISFFSNFFQENSYFSEKFLSLNKAFSQGWACWVKLNDTNLDWNLYLQPIDELSQIKEFFSNNKFVFLSALRKDNFFQMYFKKHSLDIDLVINFKSNFEEKKISLYIPPKQLLPNNPLFTNSILDKCKKLILFRKGLTLVLSDDIELKTNLATELASNYGKRVLLETIPSGKNEILCSSFDWWIMNSYLIQIPEQIIIPLLPIPNMSEPINAITVSHKKKLSQDWFRDFFLPQARIKLERSISPLRRNSGKLIILDGRANKRNWGRLLLQNIQPSKQIYYMLPFD

SEQ ID NO: 21471 - protein, 512 aa, Lupinus albus
MSNKLLALSLFLPFLLLFFCGCFASTFRQQPQENECQFQRLNALEPDNTVQSEAGTIETWNPKNDELRCAGVALSRCTIQRNGLRRPFYTNAPQEIYIQQGRGIFGMIFPGCGETYEEPQESEKGQGPRPQDRHQKVEHFKEGDIIAVPTGIPFWMYNDGQTPVVAITLIDTTNLDNQLDQIPRRFYLSGNQEQEFLQYQEKEGGQGQQQEGGNVLSGFDDEFLEEALSVNKEIVRNIKGKNDDREGGIVEVKGGLKVIIPPTMRPRHGREEEEEEEEEDERRGDRRRRHPHHHHHEEEEEEEEEWSHQVRRVRRPHRHHHHRKDRNGLEETLCTMKLRHNIGESTSPDAYNPQAGRFKTLTSIDFPILGWLGLAAEHGSIYKNALFVPYYNVNANSILYVLNGSAWFQVVDCSGNAVFNGELNEGQVLTIPQNYAAAIKSLSDNFRYVAFKTNDIPQIATLAGANSEISALPLEVVAHAFNLNRDQARQLKNNNPYKFLVPPPQSQLRAVA

SEQ ID NO: 21472 - protein, 363 aa, Oryza sativa Japonica Group
MASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGLDGLASREAAYYQQGARFAKWRTVVSIPNGPSELAPEILLDGEHGIDRTFEVAQKVWAETFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 21473 - protein, 290 aa, Cyanidioschyzon merolae strain 10D
MQQQINPEIIQEISDDLRVQVLTEALPYIQKWRNEIMVIKYGGAVVKQDADIIKDILFLTCCGFQIVVVHGGGPLINEWLKQLNKSPQYWEGIRVTDKVTMEIVEMVLAGKVNKQLVGSINANGGKAIGLCGKDANLIVAKASSKKELGLVGEIEQIHPQVIDMLLEKHYIPVIASVAASHDGTTYNLNADVVAGELAIKLKAKKLIFLTDTKGILADINNENSVISTLNLKEAKNLANTISGGMIPKVNACICAVENGVEAAHIIGGKEKHQLLLELLTEKGRGSMIVV

SEQ ID NO: 21474 - protein, 131 aa, Oryza sativa Japonica Group
MGMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 21475 - protein, 145 aa, Oryza sativa Japonica Group
MAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 21476 - protein, 352 aa, Brassica napus
MQAATSCDLKFRSTNLTASTARPTNGMSKRVNVLCGYRSMPSSFRNGVSVSRADWQSSCAILSSKVASVEDPGGLADKIAVVNGHKNGSVDLSLVPVETTNGKLSQVQPLTITDLSPAPLHGSNLRVAYQGVPGAYSEAAAGKAYPNCEAIPCDQFDVAFQAVELWIADRAVLPVENSLGGSIHRNYDLLLRHRLHIVGEVQIPVHHCLLALPGVRTDCVSRVISHPQALAQTERSLDNLTPRAAREAFHDTAAAAEYIAANNLHDTAAVASARAAELYNLQILADGIQDDTGNVTRFLMLAREPIIPRTDRPFKTSIVFAAQEHKGTSVLFKVLSAFAFRNISLTKIESRP

SEQ ID NO: 21477 - protein, 794 aa, Streptomyces coelicolor
MAELPTSHLAAAVLTDGNRALVAVIAVVALAALVLAGVLVRQVLAAGEGTDSMKKIAAAVQEGANAYLARQLRTLGVFAVVVFFLLMLLPADDWNQRAGRSIFFLIGAAFSAATGYIGMWLAVRSNVRVAAAAREATPAPGEPEKDLALVSHKATKIAFRTGGVVGMFTVGLGLLGACCVVLVYAADAPKVLEGFGLGAALIAMFMRVGGGIFTKAADVGADLVGKVEQGIPEDDPRNAATIADNVGDNVGDCAGMAADLFESYAVTLVAALILGKVAFGDSGLAFPLLVPAIGVLTAMIGIFAVAPRRSDRSGMSAINRGFFISAVISLVLVAVAVFVYLPGKYADLDGVTDAAIAGKSGDPRILALVAVAIGIVLAALIQQLTGYFTETTRRPVKDIGKSSLTGPATVVLAGISLGLESAVYTALLIGLGVYGAFLLGGTSIMLALFAVALAGTGLLTTVGVIVAMDTFGPVSDNAQGIAEMSGDVEGAGAQVLTDLDAVGNTTKAITKGIAIATAVLAAAALFGSYRDAITTGAADVGEKLSGEGAPMTLMMDISQPNNLVGLIAGAAVVFLFSGLAINAVSRSAGAVVYEVRRQFRERPGIMDYSEKPEYGKVVDICTRDALRELATPGLLAVMAPIFIGFTLGVGALGAFLAGAIGAGTLMAVFLANSGGSWDNAKKLVEDGHHGGKGSEAHAATVIGDTVGDPFKDTAGPAINPLLKVMNLVALLIAPAVIKFSYGADKSVVVRVLIAVVAFAVIAAAVYVSKRRGIAMGDEDDADPEPKSADPAVVS

SEQ ID NO: 21478 - protein, 335 aa, Mycoplasma mobile
MNKTNKISIIGSGAMATAMAKVLYDSGNTNIFIYGIDEKELEDLKIGKNAKYFSTDIKLPSFNTTKDLKIALDKTDYIVLAIPSIFIQATFLEILKLLNSKVLVISVSKGFYPNSFLSIHEGLSKDSKSNEFVRGVVTVTGPSFAEEIIKEQLTTICAVDSNIKNAQEVQKLFSNKYFKLYVQSDVIGAEVGASFKNVLAIFSGIANQQGYGINTLASILSRGLKEMKLYNDKVGGKLSTLLGLTGVGDLILTATSPLSRNFSFGKEFVINKSKALETVKTVEGLKALENIYRSNKKYGLDLPIISSLYELIFENISLEEFKEKIWNRTLKSEFE

SEQ ID NO: 21479 - protein, 609 aa, Debaryomyces hansenii CBS767
MSVSSSKAKREQKRLEREAQKSAAGKTMKKTKKQAAKDSEEKEIDDTEAQISKMQLQTDEYGISDRVTTGVLESLNTSRDIKLSSVSLLFHGKVLIQDSTIELNYGRRYGLLGENGCGKSTLLNSIAAREFPIPEHIDIYLLNEPAAATDFSALEYVVREAEAEMKRLEDLVEEIIIKDGPENPALEGLYEKIDEMDPSTFESRAAIILTGLGFNGVTIKKRTRDMSGGWRMRVALAKALFVKPTLLLLDDPTAHLDLAACVWLEEYLKRFDRILILVSHSQDFLNGVCTNMIDMRLKELQLYGGNYDSYVKTRAELETNQMKQYAKQQEEIAHIKKFIASAGTYANLVRQAKSRQKTLDKMEAAGLIQAVVPDKVFTFRFPDVDKLPPPVLAFDGMSFSYSGKKEDNLYENLDIGIDMDSRVALVGPNGIGKSTLLNLFQGKLQPQQGRVIQHTHIKLGVYSQHSAEQLDLTKNPLEFVRDKFSHISQDFQYWRQQLGRYGLTGEGQTSQMATLSEGQRSRVVFALLALEAPNLILLDEPTNGLDLSTIDSLAEAIKAFNGGVVVVSHDFRLLDKVAKDIYVIENKGATRWDGTILDYKKSLAKDVVI

SEQ ID NO: 21480 - protein, 859 aa, Oryza sativa
MFRRPLTVAPRAGARLASTSSSSSASAQRRALPNRSVLVAVALAGGAAAAYSLSKPSLYADAPDTVPGDTRPHPLWSPPSRAQMLGALRQSSAKSLRPNASRGNNDNASLLPLAKDSRSSSPSPAAHEQSGGAAASRSGDEDDEGFDILVVGGGATGTGVAVDAATRGLSVAMVERDDLGAGTSSKSTKLVHGGVRYLQKAVFELDYEQYKMVREALHERKTFLKIAPYLSDHLPIMLPVYKWWQIPYFWAGTKMYDILAGSENMESSYVLGKGKALEAFPMLKSSGLAGAVVYCDGQHNDTRMNVALAMTAVHHGAVVANHTEVVAIHKKPVEGKADQICGARVRDMLTGDEWDVKCKCLINATGPFSDTLRKLDAPTAQEIVAASSGVHITLPGYFSPRDMGLIDPQTSDGRVIFFLPWQGNTIAGTTDTAAPVEAHPRPKEEEIQWILDEVRNYLSPDIKVRRGDVLSAWSGLRPLVKDPAATDTQSLVRNHMINASESGLLTIAGGKWTTYREMAEQTVDRAIEEFKLKPQRGCVTKNTRLLGSHGWTKTMYVKLLQRFGLETDVARHLSNTYGDRAWSVCSIAEPTGQRWPVHGKRIDQLYPYIEAEIRYACRSEYAATAQDFIARRTRLSFLNAEATVDALPRVIDVMGEELGWDEKRKKQEWAESVDFMASMGLQPARVDQLKATSLDQMRQQREKQQRALKVSSLGAASLDEKDALAISARASFSSEEMEELRAKFKLLDVNKDGKLDSKDLKEVLQQIGYADVDDSTLRGIVSEVDFTKTGALHFEDFLDVFAALKDARLENAFTHILSEMDSRGLQPPSHDPVGPAAKEKSERRDASRTIPVEKSGGGW

SEQ ID NO: 21481 - protein, 452 aa, Fusobacterium nucleatum subsp. nucleatum ATCC 25586
MRGVCIMINNLSELQKKDLKYVFHPCAQMKDFEENPPLVIKKGDGLYLIDENGNKYMDCISSWWVNLFGHCNKRINRIITEQVNNLEHVIFANFTHEPAAELCEELTKVLPKGINKFLFSDNGSSCIEMALKLSFQYHLQTGNPQKTKFISLENAYHGETIGALGVGDVDIFTETYRPLIKEGRKVKVPYIDSKLSNDEFVKLEDECIKELEDLIIKNHNEIACMIVEPMVQGAAGIKIYSAKFLKAARDLTKKYNIHLIDDEIAMGFGRTGKMFACEHAGIEPDMMCIAKGLSSGYYPIAMLCITTDIFNAFYADYKEGKSFLHSHTYSGNPLGCRIALEVLRIFKEENILKTINEKGTYLRNKMKEIFEDKSYIKDIRNIGLIGAIELKDNLLPNVRIGKEIYNFALKKGAFLRPIGNSVYFMPPYVITYEEIDKMLHVCKESIEELLKI

SEQ ID NO: 21482 - protein, 129 aa, Triticum aestivum
MGMAEKGSAARKAGLITKTLDRCRSTTARNKPAEGCFSVYVGADRQRYVVRTECLNHPLFQALLEEAEEAFGYADAGPLELPCNTEAFAKVLEKIEGEKQMAAPRRHVLPRGNSYRSLGTGWPMIVGRS

SEQ ID NO: 21483 - protein, 713 aa, Oryza sativa Japonica Group
MSSFVNGKGDFTLSRRWRQRPTGPHHNTLVRGTRIRCPRKYPRRVASRHHPPRPASRGTANLHRQPRPHPPTNSPLTPQPHHQLPTDSTTPPYPGGRDHPRVSTPPPPPSQIRTPHAIPRRRRRRTPSAPDPHCHNSQVATRASSRDNRSGGSRSPLGRLRGARLLLVRFCFLFKPNAPPHRLRSPPRLTQPPVAMGNRTSRHHRAAPEQPPPQPKPKPQPQQQQQQWPRPQQPTPPPAAAPDAAMGRVLGRPMEDVRATYTFGRELGRGQFGVTYLVTHKATGKRFACKSIATRKLAHRDDIEDVRREVQIMHHLTGHRNIVELRGAYEDRHSVNLIMELCEGGELFDRIIARGHYSERAAAALCREIVAVVHSCHSMGVFHRDLKPENFLFLSKSEDSPLKATDFGLSVFFKPGEHFKDLVGSAYYVAPEVLKRNYGAEADIWSAGVILYILLSGVPPFWAESEDGIFDAVLRGHIDFSSEPWPSISNGAKDLVKKMLRQDPKERLTSAEILNHPWIREDGEAPDKPLDITVISRMKQFRAMNKLKKVALKVVAENLSDEEITGLKEMFRSLDTDNSGTITLEELRSGLPKLGTKISESEIRQLMEAADVDGNGTIDYAEFISATMHMNRLEKEDHILKAFEYFDKDHSGYITVDELEEALKKYDMGDDKTIKEIIAEVDTDHDGRINYQEFVAMMRNNNPEIAPNRRRMF

SEQ ID NO: 21484 - protein, 193 aa, Lactococcus lactis subsp. lactis Il1403
MKLLLIDNYDSFTYLLAQYFEELDCSVTVVNDQDKMSQKIRISPDFICENYDAIIISPGPKTPKEAVFSRDVVQLYAGKIPMLGICLGQQVIAECFGGNVVLGERPMHGKISVIRHNCQGIFKGLPQNLKVARYHSLIVDKLPNDFEIDAQSEDGVIQAIHQPKLKLWALQFHPESLVTEYGHEMLNNFLKVV

SEQ ID NO: 21485 - protein, 172 aa, Methanopyrus kandleri
MRTVSVGEVARRDVITGSPTETAVEIAYKMREHGIGSVVIVNEKDEPIGIITERDLVIKVVSQGKNPDEVIARDIMSQPVITVEEDMEVNEAVKLMVDKGIRRLPIVDDNGKLIGIVTMQDILQVEPYLVATIEEEMKKFQEELEELEEVSEIIEGVCDLCETYSEELRFVD

SEQ ID NO: 21486 - protein, 244 aa, Escherichia coli O157:H7
MKCFTLSSQRRRIIGIPIFCTSTFLIFFSVCCFFTLFAAFAHKTVLFCILKDLHKANNAPKVISKSFIAEVSMSDVLRPYRDLFPQIGQRVMIDDSSVVIGDVRLADDVGIWPLVVIRGDVHYVQIGARTNIQDGSMLHVTHKSSYNPDGNPLTIGEDVTVGHKVMLHGCTIGNRVLVGMGSILLDGAIVEDDVMIGAGSLVPQNKRLESGYLYLGSPVKQIRPLSDEEKAGLRYSANNYVKWK

SEQ ID NO: 21487 - protein, 156 aa, Sulfitobacter sp. EE-36
MRVHICAVGRLRAGPEKDLIDDYLNRFDRTGRALGLGPARVIEVEDKKNGGMPAEAALLRRAIPAGSLICVMDERGRVETSPDFATRLGDWRDQGRGDLCFVIGGADGIDKELRREADHALSFGKMVWPHMLVRVMLAEQLYRAASILSGGPYHRV

SEQ ID NO: 21488 - protein, 292 aa, Prochlorococcus marinus str. MIT 9215
MQKLSLIEVNEICAELGETYPKSIEQVHGGDIHSAWRIKFSNKKLFLKRNIRNKKFLEFEKYCLQNLRKYINQENLVIPEVITYKNIENIEILIIEWIDMHNFDQKKLGKGLGEMHLKSSESNPKVFGFPVEGYIGTTEQKKGWEDNWMDCFLNLRIIPQLLSLKSNTLDKETISKVKEKIKSELINHNPINALVHGDLWSGNAGIDKSGKGVLYDPASWWADNEVDIAMTKLFGGFRKEFYEEYHRIFPRKKGFEKRIIIYNFYHILNHANMFGGAYLKQVKDYVKEILNM

SEQ ID NO: 21489 - protein, 438 aa, Cryptococcus neoformans var. neoformans JEC21
MSSTSPTASFRPNQRSSQSYHPQISTSTASSTASQAFSDRAPVSIARRPSRATHPPMAPPRPLTHDEALEALRAFLKERSSYDVFPVSFRLIVLDTQLKVKKALDVMLLYGVVSAPLWNTSSAQFAGMFTVQDVIHLIQYYYHTSSWEGATADVEQFRLQSIRDIEKVLHVPPPPLLYVHPLRPLYDACRYLIRTHARRLPLIDKDPQTNGEVVISVLTQYRVLKFIAMNCRDITQYLTASVQELGIGTYVSPNPDPSNTNKFWPIAAATMKTTVFDVVHMFSEQGISAVPIVDDQGKVLNLYETVDVITLVRNGAYTSLDLTIAQALKQRAVDFAGVVTCSPKDSLSAIFSLIKIRRVHRLVVVAGQDDEQPGRLVGVISLSDIMRALIGNDIPLGGAGVGAMGVDRALREEGEEGVFARSEGSKSAGTSTEGQSTE

SEQ ID NO: 21490 - protein, 392 aa, Vibrio vulnificus CMCP6
MTEQPLSLDEIRLRLNDLDDQLLSLLSERRKLSIEVAKSKVETSKPVRDASREQQLLVKLITNGREKYQLDAQYITKLFHTIIEDSVLLQQSYLQNLLNPEQSRKPLARVAFLGSKGSYSHLASREYFSRKNTELIELNCDHFKEVTQTVESGHADFGVLPIENTSSGSINEVYDLLQHTTLYIVGELTQPIEHCLVATKDVRLEEIKVLYSHPQPHQQCSEFLGRLKGVTLKSCASTADAMKKVQELNRDDVAAIGNASSGKLYGLQPIQGNIANQTENHTRFIVVARKPVEVSAQIPAKTTLIMSTSQKAGSLVETLLVLQRYGINMTKLESRPIMGNPWEEMFYVDLEAHLDSEEMQLALGELTKITKHLKVLGCYPSENVKPTQVKLS

SEQ ID NO: 21491 - protein, 306 aa, Hordeum vulgare subsp. spontaneum
MATAGEVIKCKAAVAWEAGKPLSMEEVEVAPPQAMEVRDKILYTALCHTDVYFWEANGQTPVFPRILGHEAGGIVESVGKGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTSNADAMISAFECVHDGWGVAHKEAVFKTHPMNFL

SEQ ID NO: 21492 - protein, 174 aa, Trichodesmium erythraeum IMS101
MSNQPFFWPSPDLSKAAFVADNATVIGKVEVGKGASIWYGTVVRGDVEKIIIGNHANVQDGAVLHGDPGLVTVLEDYVTVGHRAVIHSAHIEKGCLIGIGAVILNGLRVGAGSIIGAGSIVTKDVPPSCLVVGVPAKKVRDLSEQEVTNLLKHAEHYEKLALVHSGKGTDIGFS

SEQ ID NO: 21493 - protein, 182 aa, Brassica napus
MKFVSIRDSLLQQRQINTTFHTSFEILSMEEADQLCLAAKSNDFKKVRTLITSGADVSHFDGDSLTPLMHAAKTGNAEIISALLEAGAPWNALSPSNLSAGDFAMEAGHQEAFDLLLKTGIQSELILGTIARKETKNEYSNQEYLQDRVTFSEDKIMDNESKGVMMSWEKPLMEAHAKAICT

SEQ ID NO: 21494 - protein, 578 aa, Triticum aestivum
MGGGNGIVDGFRRLFHRRTPSGSVLGSSNQSSAGEDSSDVEAVEDLDLVGLRPIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRKEFQDIYVVFELMESDLHHVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDGNNEQHISDQEMSAEPDAHGTVSPQKSQDAPSVGPNGLSPTSLSSRTYLKSASISASKCVVVNPNKQPEYDDAISEETEGAVDGLSEKVSKMHA

SEQ ID NO: 21495 - protein, 306 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLYDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 21496 - protein, 281 aa, Trichodesmium erythraeum IMS101
MKIFRNKLTNAFIPKPRPVNKKQQRRGIEIKSEKEIEIMRQSCKIVATVLKEISQIVKPGMTTADLDAYAEKRILEMGAIPSFKGYLGFPSSICASINNEVVHGIPNKKKVIRTGDVLKVDTGAYYQEFHGDSCITIAVVEVAPEAAKLIRVAEEAMYKGIEQVKAGAYLLDIAGAIQDHVETNGFCVVEEFTGHGVGRNLHEEPAVFNFRTLNLPNVRLRAGMTLAIEPIVNAGSRFTKILSDRWTAVTLDNSLSAQFEHTVLVTNTGYEILTARSTPDR

SEQ ID NO: 21497 - protein, 306 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVTKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 21498 - protein, 385 aa, Streptococcus pyogenes MGAS315
MKITVVGIGYVGLSIGLLLAKEHDVTFFDIDNKKIDLINKRQSPLKEAAINKLLCKAKNINATYSEELAYKDATFIILSLPTNLKVNKLDTSIIEISVSNILKINKKATIVIKSTVPIGFTEYLRNRFHYNDIIFSPEFLREGSTIYDQLYPSRTIVGNESRNSQLFLDILTDISVEKDSSSLLVGSSEAEAIKLFSNAYLAQKIAFFNELDTFAEMQNLDSKKIIEAMGYDQRIGNSHNNPSFGFGGYCLPKDIKQLEYHFKEIPAPIITSISESNLLRKIHIAKMILNSSAKTIGIYRINSKKDSDNCRESSTIDVAKLLKSSGKDVIIFEPLINQKKFLGCPLINDFNEFIKYSDIIVANRIDDALRKCNSKVFTRDIFQYD

SEQ ID NO: 21499 - protein, 889 aa, Arabidopsis thaliana
MKSLHFCLLFMIVSFTVSRPVEAQDQAGFISLDCGLVPKETTYVETSTNITYKSDANYTDSGLVGKINDAHKTLVQQPLWALRSFPEGERNCYNFNLTVNSTYLIRGTFLYGNYDGLNQSPSFDLHIGASKWTSVNIVGVTDTVMPEIIHVLTQKRLQVCLVKTGKTTPFISSLELRPLINNIYIAESGSMVLQNRVYFPSDSTSIVRYDEDIHDRVWNPVSDDDSSSISTDLQVQTNNLYDVPQFVMKTAAIPKDASAPWSLVWTIDNTTALSYVYMHFAEIQDLKANDLREFDITYNGGKLWFSQFRPNKLSILTMFSQVPLTSSNGEYNFTFEMTSNSTLPPLINALEIYTGLEILQLQTDKDEVSAMMNIKTTYDLSKKISWQGDPCAPQLYRWEGLDCSYPDTEASRIISLNLNASGLNGTITSDITKLTQLSELDLSNNDLSGEIPEFFTDMKLLKLINLSGNPKLNLTVPDSLQQRVNNKSLTLILGEKVKMNPTAKKESKKVPIVPIAASVAGVFALIVILAIFFIVKGKKGKSAEGPPLSVTSGTAKSETRSSNPSIMRKDRKITYPQVLKMTNNFERVLGKGGFGTVYHGNMEDAQVAVKMLSHSSAQGYKEFKAEVELLLRVHHRHLVGLVGYCDDGDNLALIYEYMANGDLRENMLGKRGGNVLTWENRMQIAVEAAQGLEYLHNGCTPPMVHRDVKTTNILLNAQCGAKLADFGLSRSFPIDGECHVSTVVAGTPGYLDPEYYRTNWLSEKSDVYSFGVVLLEIVTNQPVINQTRERPHINEWVGFMLSKGDIKSIVDPKLMGDYDTNGAWKIVELGLACVNPSSNLRPTMAHVVIELNECVAFENARRQGSEEMYTRSSTNFSHTSASEFSPGAR

SEQ ID NO: 21500 - protein, 247 aa, Dehalococcoides sp. CBDB1
MLGLNGKVALITGSGRGIGKAIALRFAEAGAKVVVNSLSPNGEETASQIRSQDGQAIFVQADVSQSSGVEALFKASQEAFGGVDILVNNAGITRDQLTMRLSEEDWDSVIQTNLKSVFLCSKAALRQMLKNRWGRIINLSSIVGLKGNPGQANYAAAKAGILGFSYSLAKEVASRNITVNSIAPGFIETNMTAALSDEQRQAITARIPMQKLGTVEDIAACALYLAQEDAKYITGQVICLDGGMSII

SEQ ID NO: 21501 - protein, 763 aa, Methanosarcina barkeri str. Fusaro
MTDSKTTIKLKVAEADQRDVGKGIVRIGESFREKLGLEPFDVIEIKGGKSTSALIGRPYPSDSGLEIIRMDGFIRTNAKTSIGEYVAICKADWKEAKSVIFAPVARGMQIYAPSETLKAVFMNRTVSKGDFISTTSLRKSRESETFGKGVMFEDFFQDFFGQGFEPSFGLGEIKLQVVSTSPSGIVKITDLTQVELLSEATEVIPEQNIPTVMYEDLGGLKEAIGKVREMIELPLNHPELFDRLGIDAPKGVLLHGPPGTGKTLLAKAVANESDAYFISINGPEIMSKYYGESERAIREIFEDAEKNAPAIIFLDEIDSIAPKRAEVTGEVERRVVAQLLSLMDGLKARKNVIVIGSTNRPEALDVALRRPGRFDREIELRVPDTDGRLEIFQIHTRGMPLAENVNLMDFAQITYGFVGADIAALCREAAMSALRRVLPKINLNEPEIPAEILDSLQVIREDFENALKDVQPSAIREILIEVPTVGWDDVGGLEEVKRLLKEVVEWPLKNPESYRDIGVEAPKGVLLYGPPGTGKTLLAKAIAHESDANFITAKGSDLLSKWYGESEKRIAEVFTRARQVAPSIIFLDELDSLAPIRGASISEPQVTARILNQLLSEMDGLEELRAVVVIGATNRPDVIDPALIRPGRFDELILVPIPDEGARREIFKVHTEKMELAEDIDIEKLVSITDQYTGADIAAVCKKAGRLALREDIHAKNVKQRHFLKAITETGPSVTPDTMKYYEAIKGELRTRKSKEIENPSYI

SEQ ID NO: 21502 - protein, 442 aa, Nicotiana tabacum
MKITWESLVPSCFKGENPKPKAKEIKVVTKQSSFHRISISDFSASTISEDLSISLAGSNLYIFTLQELKVITQNFSSSNFLGEGGFGPVHKGFIDDKLRPGLKAQPVAVKLLDLDGTQGHREWLTEVIFLGQLRHPHLVKLIGYCCEEEHRLLAYEYMPRGSLENQLFRRYSVSLPWSTRMKIAVGAAKGLAFLHEAEKPVIYRDFKASNILLDSDYSAKLSDFGLAKDGPEGDDTHVSTRVMGTQGYAAPEYLMTGHLTAASDVYSFGVVLLELLTGRRSVDKTRPNREQNLVDWARPQLKDPRKLRRIMDPRLEGLYSEEGAQKAALVAYQCLSHRPKARPEMSSVVKTLEPLKDYKDISNMIFVYIAPAEVKEMCKESEKEDQKKTIKKENSPYHQKHHHHHLDRKHRRSPQNSTIYSEKALHKKLGPNSPLRNDFHRA

SEQ ID NO: 21503 - protein, 400 aa, Silicibacter sp. TM1040
MSVLSATLSRVKPSPTIAVTNKARELKAAGRDVIGLGAGEPDFDTPQSIKDAAVRAIAEGKTKYTAVDGIPELKQTICEKFKRDNGLDYRPEQVTVNSGGKQTLYNALMATLNPGDEVIIPAPYWVSYPDMVLLAGGTPVPVEASLESSFKLTPDQLEAAITDKTKWFIFNSPSNPTGAGYSRAELKALTDVLMRHPHVWVMTDDMYEHLAYDDFEFCTPAQVEPGLYDRTLTCNGVSKAYAMTGWRIGYAAGPETLIAAMRKVQSQSTSNPCSVSQYAALEALTGPQDFLASNNEIFVRRRNLVVSMLSEIDGLTCPVPEGAFYVYPSIAGLIGKTTPKGVTINSDEDFATALLEEADVAVVFGAAFGLSPNFRVSYATSDDALKEACTRIQRFCASLS

SEQ ID NO: 21504 - protein, 418 aa, Escherichia coli
MTLLALGINHKTAPVSLRERVSFSPDKLDQALDSLLAQPMVQGGVVLSTCNRTELYLSVEEQDNLQEALIRWLCDYHNLNEEDLRKSLYWHQDNDAVSHLMRVASGLDSLVLGEPQILGQVKKAFADSQKGHMKASELERMFQKSFSVAKRVRTETDIGASAVSVAFAACTLARQIFESLSTVTVLLVGAGETIELVARHLREHKVQKMIIANRTRERAQILADEVGAEVIALSDIDERLRERDIIISSTASPLPIIGKGMVERALKSRRNQPMLLVDIAVPRDVEPEVGKLANAYLYSVDDLQSIISHNLAQRKAAAVEAETIVAQETSEFMAWLRAQSASETIREYRSQAEQVRDELTAKALAALEQGGDAQAIMQDLAWKLTNRLIHAPTKSLQQAARDGDNERLNILRDSLGLE

SEQ ID NO: 21505 - protein, 383 aa, Methanosarcina barkeri str. Fusaro
MDLEDTLLMMPGPVTVTPRVLRAMSKPMINHRSAEFAGIYTDCREILSSVFQTKNDIFVLSGSGTAGMEAAIGSSVGSGDKVIAIENGKFGERFKDIAAIYGDVVPVVFEWGHPVDLEVVKEKLEEGAKAVTLVHNETSAGILNPAAEIGKLAKKHDALFIMDGVTSLGGDDVKVDEWGVDIAVVGSQKCLAAPPGLSVVSVSEKAFEVMKDVTKRPYYNDLLAYKKSGDKPKAETPYTPAIPLFYALQEALHIVKEEGMEARIKRHRVLSEAIRAAVAELNIEMFPQLNEYSHYSNTVSAMKAPADVNGENIKSDMKARGVIIAGGQERLKNKIFRIGCMGNVTGRDVLSTIQQLEIVLNKRGYIDRLGAGVEAATRVLDRA

SEQ ID NO: 21506 - protein, 502 aa, Agastache rugosa
MDLFLLEKTLLGLFAAIVVAAVVSKLRGKKFKLPPGPIPVPIFGNWLQVGDDLNHRNLTDYAKKFGDIFLLRMGQRNLVVVSSPELAKDVLHTQGVEFGSRTRNVVFDIFTGKGQDMVFTVYGEHWRKMRRIMTVPFFTNKVVQQYRHGWEAEVAAVVEDVKKNPDSATTGIVLRRRLQLMMYNNMYRIMFDRRFESENDPLFVKLRALNGERSRLAQSFEYNYGDFIPILRPLLKGYLRICKEVKDRRLQLFKDYFVDERKKLASTKPMDNDGLKCAIDHILDAQQKGEISEDNVLYIVENINVAAIETTLWSIEWGIAELVNNPEVQRKVREEMDRVLGVGVPVTEPDTHKLPYLQAVIKETLRLRMAIPLLVPHMNLHDAKLGGFDIPAESKVLVNAWWLANNPEQWKKPEEFRPERFLEEESKVEANGNDFRYLPFGVGRRSCPGIILALPILGITLGRLVQNFELLPPPGKSKIDTTEKGGQFSLHILNHSTIVMKP

SEQ ID NO: 21507 - protein, 585 aa, Xanthomonas campestris pv. campestris str. ATCC 33913
MAEIKEALVPDIGDYSDVPVIEVLVSVGDTVSKDQSLVTLESDKATMEVPSSVAGVVKEIKVKVGDSLSQGALVALIEVADADAGAETAAAPAPAAAPAKAAPAAAPAPAAKAAPAAASDGGQVEARVPDIGDYSGVPVIEVLVAVGDTVAKDQSLVTLESDKATMEVPSSVAGVIKELKVKVGDSLSQGDLVAIIAASDGGAGAAQSPAKPTTDTAETAGKVEPVAVPAEPDKLAQREIAQVQSARSTAASQPAQAAPGTPSSPPVTFDADSVLPSKVPYASPVVRVFARELGVDLNQIKGSEKGGRITREDVQRFVKAALSGGAPAAAGAAPAGGGNGLNLLAWPKVDFSKFGETETQPLSRIKKISGANLARNWAMIPHVTQFESADITDLEALRVALNKENEKAGIKLTMLAFLIKASAAALKKFPEFNASLDAAGENLTLKKYINIGFAADTPNGLVVPVIRDVDKKGVLQIAQESGELAKKARDGKLGPADMSGGCFSISSLGGIGGTAFTPIINAPEVAILGVSKSAMQPVWNGKDFAPKLMLPLSLSYDHRVIDGALAARFTTYLSQVLADMRRVLL

SEQ ID NO: 21508 - protein, 380 aa, Methanosarcina barkeri str. Fusaro
MSSARLKRVEESATIKISNIATRMIKEGTDVINFSLGEPDFNTPKNICDAAAKAMYEGKTHYAPSGGIPELRAAIAEKLRTENNLDVTESGVLVTPGAKQGIFEVMMSVLDDGDQALLFNPAWVTYDACIRFAGAETVWVPTVPEKGFIPDNFEEYITDKTKLIVVNSPGNPTGGVFGKKTLQCIADLAIDHDLIVVSDEIYEKIIYDREHISIGSLDGMQERTITVNGFSKAYAMTGWRLGYLTAPPEILKLLLKIQSHSVSSATTFVQYGGLEALQGPQDSVKAMVDRFKVRRDVLIDGLNKMGFECKKPDGAFYAFANVSEYGNGTQVAERLLKEAQVAVTPGIAFGSSGEDFVRISYATSIDRIREALERLEKVFS

SEQ ID NO: 21509 - protein, 305 aa, Glycine max
MVMKSKLDKYEKLEKLGEGTYGVVYKAQDKTTKDLFALKKIRLESEDEGIPSTAIREIALLKELQHPNVVRIHDVIHTNKKLILVFEYVDTDLKKFMNQFDKGLDAKVIKSLLYQLVRGVAHCHQMKVLHRDLKPQNLLVSQEGVLKLGDFGLARAFGIPVKNYTNEVVTLWYRAPDILLGSKNYSTSVDIWSIGCIFVEMLNQKPLFPGSSEQDQLKKIFKIMGTPDATKWPGITDLPDWKAENFEKYPGESLSKICPKLDADGLDLLDKMLRCNPTERISAKTALSHPFFKDIPENLKKLYNN

SEQ ID NO: 21510 - protein, 328 aa, Escherichia coli
MDKKQVTDLRSELLDSRFGAKSISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSAGGSGNCTVL

SEQ ID NO: 21511 - protein, 615 aa, Xanthomonas campestris pv. campestris str. ATCC 33913
MAVIEIKVPDIGDYSDVPVIEVLVAVGDSVVKDQGLVTLESDKATLEVPSSAAGVVKELKVKIGDNLSEGAVVLLLETEGEAAAAPAAPKAETKAETKAAAPAAAPAAAAPGSKPPVTPSHRAPAEPAASKPALASGKAADIECKMVVLGAGPGGYTAAFRAADLGLDTVLIERYASLGGVCLNVGCIPSKALLHAAAVIDEVAHAGDFGVDFGQPKITLDKLREYKEKVVGKLTGGLASMAKQRKVRTVTGVASFVSPNELEIVGDDGKTQLLRFEHCIIAAGSQAVKLPNFPWDDKRVMDSTDALELHDIPKTLLVVGGGIIGLEMATVYSALGSKVTVVEFMDQLMPGADKDLVKPLADRLKKQGVEVHLKTKATDVSADAKGITVSFEAATEGEKPGLQATAFDRVLVAVGRSPNGKKIGADKAGVTVTERGFIPVDRQMRTNVPHIFAIGDIVGNPMLAHKATHEGKLAAEVAAGEKKEWVARVIPSVAYTNPEIAWVGVTETEAKAKGLKVGVAKFPWAASGRAIGIGRTEGFTKLIFDEETHRIIGGAIVGVHAGDLLAEIGLAIEMGAEAEDIGHTIHAHPTLSESVGMAAEVYDGTITDLYIPKKK

SEQ ID NO: 21512 - protein, 192 aa, Oryza sativa
RERGRDKGMIELTNGSSEGGKDNANEDGPENNPQYTTVYVGNLPHDVNSNDVHRFFHSLGVGSIEGVRVTRDKGFGFVRYSTHEEAALAIQTGNGQLIGGRQIKCSWGSKPTPPGTASAPLPPPAPTPFNPGMSATDLLAYERTLALSKMAANPALMSQHAALKQAAAMGMGAGASQAIYDGGYQSANAVFY

SEQ ID NO: 21513 - protein, 525 aa, Physcomitrella patens subsp. patens
MANQSPEIEALIPKRASDGGGDLEELGSSNPELGLRRSLSLVDGISVLVGIIIGSGIFTSPGVVLQDAGSVGLGLMAWVAAAFMALCSALVYAELGAAIPQAGGNAEYFRIAFGDAWGFAFVWTMFFVLTNGSLAILTITLSRYLVAGFVGLHIFEGDMSSDLTVKAVAIGCVVILTVWNCFGIHVGAKLQNIISVLKLLLISVLIVAAVVFVWDNPLVLEENFRKPFEGSNFSGFGVSCVAALWAFTGWGDLVFLTEEMKDPERDIPRGTVLPHHNSLFMTIELHPCAASFHYSLSQSLTTLGTVVVKITSAIHVIVSMWQLLLNAIYLCILPAAVVKTSAVVAIDAADAALGPWAGSFMSILVAISLLGSANGIIICGARYLYAAARHGQIFKSIGAVGTQSRAPYVAHLLQGLLCILLLLQSSDFVELVSFFGVSSYIFYGLTGAVHIKLRRDLPTLHRPYRVAFYPYAPLVVICFSLYLVISALMAQPKATSLSLSFIIVSFPVYYLSKKSPLSSSLTNNS

SEQ ID NO: 21514 - protein, 206 aa, Escherichia coli O157:H7
MAIPAFGLGTFRLKDDVVISSVKTALELGYRAIDTAQIYDNEAAVGLAIAESGVPRHELYITTKIWIENLSKDKLIPSLKESLQKLRTDYVDLTLIHWPSPNDEVSVEEFMQALLEAKKEGLTREIGISNFTIPLMEKAIAAVGAENIATNQIELSPYLQNRKVVAWAKQHGIHITSYMTLAYGKALKDEVIARIAAKHNATPAQV

SEQ ID NO: 21515 - protein, 491 aa, Sulfitobacter sp. EE-36
MTDAKTDLKSMLKDPSLLETRAYIGGEWVDGDDGTFDVVNPARGDVIAKVANLSRAQVAGAIAQAEKAQKEWASWTGKERAGVMRKWFDLMMENQDDLGAILTAEQGKPLGEAKGEIAYGASFIEFFGEEAKRVYGETIPGHQRDKRITVIKQPIGVAASITPWNFPNAMITRKAAPALAAGCAFVARPAAETPLSAIVMGVLAERAGIPAGVFNVLPSSSSSAVGKEFCENPAVRKLTFTGSTEVGRILLKQAADQVMKCSMELGGNAPFIVFDDADLDAAVEGAILCKFRNNGQTCVCANRIYVQAGVYDAFAEKLKARVEKMKVGDGFEDGVELGPLINGDASDKVKEHVEDAVSKGAEILLGSKEEKMEGNFLAPTIITGVTQDMKVSKEETFGPLAPLFKFDNEDDVIEMANDTIFGLASYFYAKDLSRVYKVAEALEYGIVGVNTGIISTEVAPFGGVKQSGLGREGSHHGIEDYLEMKYICMSV

SEQ ID NO: 21516 - protein, 598 aa, Vibrio vulnificus CMCP6
MQTETTALWLAGIGVIGLACQWFAWRLKLPAILFLLVAGLLVGPVSGWLQPELLLGDLLFPMVSLAVAVILFEGSLTLNFREIRGVSNTVWSIVTLGAVVSWGLTSTATHYLLGFDWPLALLFGSLTVVTGPTVIVPLLRTVRPSTRLSNILRWEGILIDPLGALFVVMVYEFIVSSSETHSLVVLAWILAIGLGLGVLFGQFLAVVLRRGWLPEYLQPFAVLSLVLGVFALSNHLEHESGLLTVTVMGMWLANSKGVDIKHILHFKEHLTILFITGLFILLAARIQPEDFYTLGISALVLFAFIQFVSRPVSIYLATLRSSLNGKEKAFLAWVAPRGIVAASISSLFAIKLESLGMSEAALLVPLTFMVIIGTVVLQSATARPVAVALGVSEPAPKGFLIIGANDVARTLAQAINKYDCRVVLTDSNWDYIRQARMAGLDHYFGNPVSSHADEYLNLIGIGHVVALSPDRYFNIMACMHFLNDFSDKRIFCLYDKSNGNGSGDKHSVSDGYKGLPFLDEAISYKKLASLINQGAEVRHTKISENYTYADYRETHANNYVLPLFVVDTNGRVQICHNSANFSPKEGETIVSLIKVQEA

SEQ ID NO: 21517 - protein, 304 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLCDLLGINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAWRTRSRCSRPTP

SEQ ID NO: 21518 - protein, 415 aa, Rhodopseudomonas palustris CGA009
MSTHPAVRNGSYDVDLVREDFPALALEVYGKKLVYLDNAASAQKPRQVLTRMTQAYESEYANVHRGLHYLANAATEAYEGGRTRVQHLLNAKRPEEIIFTRNATEAINLVASSWGATNIGEGDEIVLSIMEHHSNIVPWHFLRERQGAVLKWAPVDDEGNFLIDEFEKLLTAKTKLVAITQMSNALGTVVPVKEVVKIAHARGIPVLVDGSQAAVHLAIDVQDIDCDFYVMTGHKIYGPTGIGALYGKYDVLAKMRPYNGGGEMIREVAQDWVTYGDPPHRFEAGTPAIVEAVGLGAAIDYVNSIGKERIAAHEHDLLTYAEERLREINALRIIGSAKGKGPVISFEMKGAHPHDVATVIDRQGIAVRAGTHCVMPLLERFQVTATCRASFGMYNTREEVDQLVSALIKARDLFA

SEQ ID NO: 21519 - protein, 753 aa, Physcomitrella patens subsp. patens
MVLGTTFVLVFVPASAAVGILFALTQWYLVSYVTVGKSRVSNNGYMQVDEDGIDDASVNAKCAEIQAAISEGSEAFLTTMYTYLAIFMGLFSVIIFVFLASVGGFSFDRQPCDYDQTKSCPSSIASAFFSTVAFILGALTSTLSGYLGMKIATYANARTTLEARKGVGKAFAIAFRSGAVMGFLLAANGLLVLFLTILVFKLYFGDDWVGLYEAITGYGLGGSSVALFGRVGGGIYTKAADVGADLVGKVEQNIPEDDPRNPAVIADNVGDNVGDIAGMGADLFGSFAESTCAALVVSSISSFGNDKNFVAMCFPLLISSAGILVCLLTTLVATDIMSVKGVKEIEPTLKRQLVISTVLMTVAIFLISWFGLPETFTINVVGHEAKVVKNWHIFFCVGSGLWAGLIIGFVTEYFTSNAYTPVQDVADSCRTGAATNIIFGLALGYKSVIVPVFAIAVAIYLSFSLAAMYGIAVAALGMLSTLATGLAIDAYGPISDNAGGIAEMAGMSHEVRERTDALTRPDTTAAIGKGFAIGSAALVSLALFGAYVSRAGIASVDVIQPKEFVGLIVGAMLPYWFSAMTMKSVGKAALAMVEEVRRQFRTIPGLMEGTTKPDYKRCVKISTDASLKEMIPPGALVMLTPLIVGTLFGVETLAGLLAGALVSGVQIAISASNTGGAWDNAKKYIEAGASEHAKSLGPKGSDAHKAAVIGDTVGDPLKDTSGPSLNILIKLMAVESLVFAPFFAANGGWLFRG

SEQ ID NO: 21520 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEPVFKTHPMNFL

SEQ ID NO: 21521 - protein, 87 aa, Triticum aestivum
KEGTPAAPVPGAGGSLLPPAGAVTASPGPALALVNKRMFTEGPGLNLGVNNNPLGWILLGVFGLIWSLYTVYTSGLDKDKESGGLSL

SEQ ID NO: 21522 - protein, 153 aa, Cyanidioschyzon merolae strain 10D
MQNMNEQQEQWQERVIQIRRVAKVVKGGKKLSFRVLVVVGNLNGCVGVGMGKAADVMSAVTKAVVDAKKQLINITLTPTNSIVHASQGRFSAAVVFLKPAASGSGVIAGGAVRSVMELAGIQNVLSKQLGGSNPLNNAKAALLALKSSSANAR

SEQ ID NO: 21523 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMVVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEPVFKTHPMNFL

SEQ ID NO: 21524 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMVVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFL

SEQ ID NO: 21525 - protein, 805 aa, Methanosarcina mazei Go1
MPEDKNKYIRWFEETTIEDIPTVGGKNASIGEMYRELTSKGVRIPNGFSVTASAYWHMLETGGILEKLKKTMEGLDTFDVSDLAKRGKVARDLILDAGIPDDIWQEIKGAYDRLCEQYGEYTDVAVRSSATAEDLPTASFAGQQETYLNIRGYPGLKDACIRCFASLFTDRAISYRVTHGFDHFKVALSIGIMKMVRSDLASSGVIFTLDTETGFRDVVFITGAYGLGENIVQGQVNPDEFYVFKPTFREGYKPIIQKKLGSKEIKMIYGRGDSKVLTRNVEVPEADRQRFCINDEEVLKLAEYAIDIEDHYSNKYDESRPMDIEWAKDGITGELFIVQARPETVQSQREKDVLETYVIEEKSEVLVKGRSVGDRIASGKARVITDVSDLPSFRPGEILIADTTTPDWEPVMKTAAAIVTNKGGRTCHAAIVSRELGIPAVVGAENATEVLNTGREITVSCAEGEDGLVYAGLLPFRKNTVSLKDLERPQTEIMMNLGNPESAFSFSMIPNDGIGLARLEFIITSYIKVHPMALVHPEQVKDPRELREIERLTRGYEKKEDYFIKQLARGVGMITAAFYPKPVVVRMSDFKTNEYASLLGGRYFEMEENNPMIGFRGASRYFDERYREGFALECRAMKKVRDEMGLKNLILMVPFCRTVEEAKKVIAEMEKNGLRRGENGLQIYVMCEIPNNVLLVDEFSEYFDGFSIGSNDLTQLTLGVDRDSEMLAAEFDERDPGVLKIMSMAVQGAKRNERHSGICGQAPSDFPEIAEFLVKEGIDSISLNPDSVMKITLKVLETEKELGKR

SEQ ID NO: 21526 - protein, 490 aa, Bradyrhizobium japonicum USDA 110
MAASSQAPEAKGFRWKLIAPLVVWLAIYLWPVPSGLNVNQWHYFAVFAAVITGLILESMPVGAVGLIGLTVAGVGGYIDPDPTKSLRWMLAGFAESTVWLIVGAFVFSIGYRKSQLGRRIALVLVQKLGSNTLGLGYAVAMSDFLLAPATPSNTARSGGIVYPIISNIPRIYGSEPGPTAGRIGTYVMWTAFAATAVTSSLFFTALAPNAAALAIAKKTVGVEVSWGQWFIGFAPLGILLMILVPLLSYPVCRPEVKRSPEIAEWAAKELSEMGPMSRNEWIMLALIVLAMFLWIAGSSPDINVPLLGSNFVNATTVVFIVISLMLVTGVIEFADIVSEKSAWEVFFYFTSLLTLASGLNEIGFIKWFATEYAKPLAGLSPSTAMILLVALFFWIHYFFSSITSHAAAVLPVVLAVGSGIPGLPVTTLAMLCMYSLGLMGVISPYATGPAPMYFGSGYIGKGQFWGFGLIFGLLYFAGLLLIVLPWLQVR

SEQ ID NO: 21527 - protein, 505 aa, Pseudomonas syringae pv. tomato str. DC3000
MHDLLTADEYAAIAQSISFPSNAFINGAYKPAISGATFSTINPATGEFLSDLAACRAEDVDDAVSKAKKAFDDGRWRLLAPGERKSVLLKFARLLEDNRHELAVLESLDSGKPVRECQLVDVPDTIHTLRWHAELIDKLYDHTAPVGNDALTLVVREPIGVVGCVLPWNFPLLMLAWKIGPALAAGCSVIVKPAEQTSLTTLRVAELAFEAGVPAGVLNIITGTGKDVGEPIGLHKDIDMVSFTGSTVTGRRFLHYSADSNLKRVVLECGGKNPAVVMEDAEDLDLVAEQVVNGAFWNMGENCSATSRLLVHASVKDELLERMGAYIREWKMGDPLDPQTRVGALVSSDHFAKVKSYLDYANADKLDIVYGGDTQEGAFVQLTVVDGVERDSRLFQEEIFGPILSVTTFNSISEAIALANDTVYGLAASVYTGSLRKAIKLSREIRAGIVTVNCFGEGDASTPFGGFKESGFGGRDKSVFAHDQYTEIKTIWIDVSDRSVDETVK

SEQ ID NO: 21528 - protein, 359 aa, Zea mays
  misc_feature (280)..(280): Xaa can be any naturally occurring amino acid
MGVYLSTPKTDKLSADGENSRVRFGLSSMQGWRTTMEDAHAALPDLDECTSFFGVYDGHGGKAVSKFCARHLHKQVLINDANSSGDLPTSLHKAFLRMDEMMKGQRGWRELTELGDKGNKISGMIDDIIWPPKGGDSDKIREDWDTEEGPNSNFPGPTSGSTACVAVIRNDKLIVANAGDSRCVISRKGQAYNLSTDHKPDLEEERERILGAGGFVVAGRVNASLNLSRAIGDMELKQNDLLPVERQIVTAEPELKTVQLSEDDEFIVLACDGIWNNFDXWDCMSSQEVVDFVHKQLKTEDKISSVCEKLLNRCVAPTSGGEGCDNMTVIVVQFKKPALAVATSSAEQSATTAEGMRPK

SEQ ID NO: 21529 - protein, 110 aa, Zea mays
  misc_feature (37)..(37): Xaa can be any naturally occurring amino acid
  misc_feature (53)..(53): Xaa can be any naturally occurring amino acid
  misc_feature (62)..(62): Xaa can be any naturally occurring amino acid
TPTLILNANALHHLLTYQKDHFLSLFHAIDGLSATIXLLDPLLHKFLSKRNIXEILPQLCSXHVANHDDALSRIEKLLEVNPMLCFHSCRRVNQLSTLNRAAYLQQHLLP

SEQ ID NO: 21530 - protein, 483 aa, Physcomitrella patens subsp. patens
MSTEEEIGVGDVEIEVHMDPGNAGGVAGYRYNRDEMLAIYWGMGDSYYIGVAEVCAVLEPVSQELYDMDVDHSAQKPRHKTIDRRQRGKKARAPNPESEVHFPDEEIMLELGLDLPNQFLPTFSEPEVDEDSEDEIESFQPLAFAVEGEPDFESGEPQDGWEYLRRVKWEFARCPKVKVATIDPKKFAEQTPYMPSIPSVSACSPHLLPTKEWETEFLADFSNLRMKYAESVVEERKYSGSLPSIHNQVGWETFCFGKSASPVEEATTSVEDNLEASQGAIEEISEDKIKSVDEVLVEGIKIEMNKDADNILLPNLDSETEFPALGINATSSDEELHSSRVPDSNIQKDAIQDSTVIIELIKTGLKDAAKRKSSDLKGPNPPLLSILMRLDEVKRAALLRYHIAWLERVECVTKGRAQWLFALSAVVDKPLDAQTMAAYRALLRRCAALRSSKTSAEDEELHMLNILITIAGRYFGQAEDALS

SEQ ID NO: 21531 - protein, 325 aa, Medicago truncatula
MVRSSLDEISDSGAFTRSASTFRQFVSKDPNSQFPPESGRYHLYISYACPWACRCLAYLKIKGLDKAISFSSVKPIWGRTKESDEYMGWIFPESNTEVLGAEPDPLNGAKSVRELYEIASTNYSGKFTVPILWDKKLKTIVNNESSEIIRMFNTEFNDIAENPILDLYPSELQAQIDETNEWIYPNINNGVYRCGFAKKQEPYIDAARQLYEALDKCEDILSKQRYICGNKLTEADIRLFVTLIRFDEVYAVHFKCNKKLIREYPNIFNYTKDIFQIPGISSTVNMEHIKLHYYGSHPSINPFGIVPMGPNIDYFAPHDRERFST

SEQ ID NO: 21532 - protein, 401 aa, Burkholderia vietnamiensis G4
MKAVVFHGIGDIRIDTVPDPQLAQPTDAVVRLTASAICGTDLHMVRGTLGGMKPGTILGHEGVGIVEAVGRDVRNLKRGDRVLIPSTIACGSCAYCRAGYTAQCDVANPGGPRAGTAFFGGPADTGAFDGLQAEYARTPLANASLIRLPDSIDDDRAILMSDIFPTGYFGAQLAEIKPGDTVAVFGAGPVGQFAIASAKLMGAGRVFAIDRIASRLDMACAQGAETIDFAEEDPVDAVLRLTGGIGVDRAIDAVGVDAMRATHGPAAADADAARAFDTEVDAVAPRRKPDGRNWVPGDGPSQVLQWAVRAVAKAGTVSVIGVYPAQARVFPIGEAMNRNLTIKMGNCNHRTITPHLIELVRSGAFDPAAVLTCREPLTNAIDAYRAFDVREPGWMKVKLTP

SEQ ID NO: 21533 - protein, 61 aa, Vitis vinifera
MSRSLGIPVKLLHEAAGHVVTVELKSGELYRGSMIECEDNWNCQLENITFTAKVFFFFFFI

SEQ ID NO: 21534 - protein, 468 aa, Xanthomonas campestris pv. campestris str. ATCC 33913
MSQGKIVQIIGAVVDVEFQRNEVPKVYHALKVEGTAITLEVQQQLGDGVVRTIALGSTDGLKRNLLATNTERAISVPVGAGTLGRIMDVLGRPIDEAGDVQASDHWEIHRAAPSYEDQSSSTELLETGIKVIDLMCPFAKGGKVGLFGGAGVGKTVNMMELINNIAKAHSGLSVFAGVGERTREGNDFYHEMKDSNVLDKVAMVYGQMNEPPGNRLRVALTGLTMAEYFRDEKDENGKGKDVLLFVDNIYRYTLAGTEVSALLGRMPSAVGYQPTLAEEMGVLQERITSTKSGSITSIQAVYVPADDLTDPSPATTFAHLDSTVTLSRNIASLGIYPAVDPLDSTSRQMDPLVIGHEHYDTAQRVQQTLQKYKELKDIIAILGMDELSEEDKQSVSRARKIERFFSQPFHVAEVFTGSPGKYVSLKDTIRGFKAICDGEYDHLPEQAFYMVGSIEEAVEKANKMSAKA

SEQ ID NO: 21535 - protein, 330 aa, Physcomitrella patens subsp. patens
MTGFLGTEGSNVDTDLVVLMTHIQAACKHIASVLASPTELQTTISGADATHGAGRDAPKPLDIVSVGYGDSFFVSLGRKVAAIASEEDDQPIWFGEGPYIVVFDPLDGSRNIDASIPTGTIFGIYHRLPEADHLPTEEKAFVNVMQRGERQVAAGYALYSSATIMAISVGSGLHGFTLDYNLGEFVYSHHDIRIPERGQIYSVNDARYFDWPAGLRKYIDTVRQGKGQTRKQYSARYICSLVADLHRTIMYGGIAMNPRSHLRLLYEANPLSYLVEQGGGKGTDGKRRILEINPVETHQRLPLFLGSAADIAELVSYGDIQQEKNPGYTV

SEQ ID NO: 21536 - protein, 188 aa, Candidatus Phytoplasma vitis
MLSIKSLDEIVIMKEAGKILSFIRKELLKFLKVGISTFDLDMIAFDLIKKNGVISAFKGYQGFGGYICISVNEAVVHGLPSKTRILKLGDIVTLDIGIKHKGYCVDSAWTYSLGSVSNKIKQFIENTKKSLFLGIEQVKPGNKISDISRAIGKFGNKNNYGIIEIFSGHGIGKKLHEEPYIFNFDFVL

SEQ ID NO: 21537 - protein, 216 aa, Lactobacillus acidophilus NCFM
MKRIYIVRHGQTYINRYNKMQGWCDTPLTEPGIEGAEQAGEALKEVPFDIALSSDLKRASDTCEIIMKHNVNKDELQHIASPFFREQFYGYFEGLDSEMAWRMIGGSHGYATRQELFAHESIDTIKDWIKEADPYHDAENAEEYWNRMDQGLKMISELDGAENILLVTHGFTIRSLWYRYGDNIPLVPGPQNASITIMTMSDKGEIKIPTWNKMHL

SEQ ID NO: 21538 - protein, 353 aa, Zea mays
MAAPQIPEKQWAQVFEKTAGPIEYKQIPVQKPGPDEVLVNVKFSGVCHTDLHAWQGDWPLDTKLPLVGGHEGAGVVVARGELVKDVKIGEKVGIKWLNGSCLSCSYCQNADESLCAEALLSGYTVDGSFQQYAIAKAIHVARIPEECDLESISPILCAGITVYKGLKESGVKAGQSIAIVGAGGGLGSIAVQYCKAMGIHAIAIDGGEEKRKLTKELGATAYVDFTTTKNLIADVKATTSDGLGPHAALLVATNEKPFQQATQYIRSRGTVVCIGLPANAQFFAPVFDTVVRMISIKGSYVGNRADTAEAIDFFRRGFIKVPFKTVGLFELNEVYKLMKAGQIVGRYVVDTSR

SEQ ID NO: 21539 - protein, 188 aa, Candidatus Phytoplasma vitis
MLSIKSLDEIVIMKEAGKILSLIRKELLKFLKVGISTFDLDMIAFDLMKKNGVISAFKGYQGFGGYICISVNEAVVHGLPSKTRILKLGDIVTLDIGIKHKGYCVDSAWTYYLGSVSNKIKQFIENTKKSLFLGIEQVKPGNKISDISRAIGKFGNKHNYGIIEIFSGHGIGKKLHEEPYIFNFDFVL

SEQ ID NO: 21540 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAAMEGARLSGASRIIGVDLNPAKHEQAKKFGCTDFVNPKDHTKPVQEVIVEMTDGGVDRAVECTGNADAMISAFECVHDGWGVAVLVGVAQKEAVFKTHPMNFL

SEQ ID NO: 21541 - protein, 188 aa, Candidatus Phytoplasma vitis
MLSIKSLDEIVIMKEAGKILSLIRKELLKFLKVGISTFDLDMIAFDLMKKNGVISAFKGYQGFGGYICISVNEAVVHGLPSKTRILKLGDIVTLDIGIKHKGYCVDSAWTYSLDSVSNKIKQFIENTKKSLFLGIEQVKPGNKISDISRAIGKFGNKHNYGIIEIFSGHGIGKKLHEEPYIFNFDFVL

SEQ ID NO: 21542 - protein, 472 aa, Rhodopseudomonas palustris CGA009
MSFSNLGLSEKVQAAVAAAGYVSPTPIQQQAIPHVLARKDVLGIAQTGTGKTAAFVLPMLTMLEKGRARARMPRTLILEPTRELAAQVKEQFDKYGAGQKLNVALLIGGVSFGDQDLKLTRGVDVLIATPGRLLDHTERGGLLLTGVEMLIIDEADRMLDMGFIPDIERICKLVPFTRQTLFFTATMPTEIRRITETFLHNPEKIEVSKPASTAVTVTQSQVPCGREPHEKRETLRRLIRGATDLKNAIIFCNRKREVALLAKSLQRHGFSVGALHGDMDQTARTAALEAFRKGDLPILVASDVAARGLDIPEVSHVFNFDVPHHPDDYVHRIGRTGRAGRTGTAVTIVAPSDQKSMAAVEKLIGQAISRAEVGPSVESEAANTEAEAERPSRSRRAAPEARQREPRREPREQRERKPRREPRSPASTTGTTAPPTAHASFGSPPPARDTSSEAGDHSHLPAFLLRPVRARG

SEQ ID NO: 21543 - protein, 319 aa, Glycyrrhiza echinata
MAAAAAAAIEIPTKVLPNSTCELRVPVIGMGSAPDFTCKKDTKEAIIEAIKQGYRHFDTAAAYGSETALGEALKEARDLGLVTREELFVTSKLWVTENHPHLVIPALRKSLETLQLEYLDLYLIHWPLSSQPGKFSFPIQVEDLLPFDVKGVWESMEECLKLGLTKAIGVSNFSVKKLQNLLSVATIRPAVNQVEMNLAWQQKKLREFCTANGIVLTAFSPLRKGASRGPNEVMENDMLKGIAEAHGKSIAQVSLRWLYEQGVTFVAKSYDKERMNQNLQIFDWELTTEDHQKIDQIKQNRLIPGPTKPQLNDLWDDEL

SEQ ID NO: 21544 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAAMEGARLSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFL

SEQ ID NO: 21545 - protein, 188 aa, Candidatus Phytoplasma vitis
MLSIKSLDEIVIMKEAGKILSFIRKELLKFLKVGISTFDLDMIAFDLIKKNGVISAFKGYQGFGGYICISVNEAVVHGLPSKTRILKLGDIVTLDIGIKHKGYCVDSAWTYSLGSVSNKIKQFIENTKKSLFLGIEQVKPGNKISDISRAIGKFGNKHNYGIIEIFSGHGIGKKLHEEPYIFNFDFVL

SEQ ID NO: 21546 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAVMEGARLSGASRIIGVDLNPAKHEQAKKFGCTDFVNPKDHTKPVQEVIVEMTDGGVDRAVECTGNADAMISAFECVHDGWGVAVLVGVAHKEPVFKTHPMNFL

SEQ ID NO: 21547 - protein, 784 aa, Oceanobacter sp. RED65
MSKHVIWLDQLGLGDVDKVGGKNASLGEMISHLTKLGVTVPNGFATTADAFNEFLAYNGLPKLIDDQLEKLDSAHLSNLAEVGSAIRSAITGAKFPEKLEQGIRECYEKLGDGNDISVAVRSSATAEDLPDASFAGQQETHLNISGIDAVLASVKEIYASLYNDRAISYRIHQGYHGQQIALSVGIQKMVRSDIGSAGVMFTLDTESGFDDVVFITSAYGLGETVVQGAVNPDEFYVHKQSLKEDRPAILRRSLGAKAIKMIYGENEPVETVRVDREERFKFSITDSDIYDLANQALLIEKHYQRPMDIEWAKDGDDGKIYIVQARPETVKSRSDKNVMERYILKETGNVLCEGRSVGHKIGSGPVKVLKQIDQMETINEGDILVADMTDPDWEPVMKKASAIVTNRGGRTCHAAIIARELGIPAVVGCGDATDILQHGQEVTVSCAEGDTGFVYEGSLNFEHKTNSVGSMPELPFKLMMNVGNPDRAFAFQSLPGAGVGLARLEFIINRMIGVHPKALLNFDSLPEEIKLTVQRRMAGYDDPVDFYVEKLVEGISTLAAAFKDKKVIVRLSDFKSNEYANLIGGRLYEPEEENPMLGFRGASRYISKTFRDCFELECRALKKVRNEMGFTNVEVMVPFVRTVGEAKQVVDLLAENGLKRGENGLRIIMMCELPANALLADEFLEYFDGYSIGSNDLTQLTLGLDRDSGVIAHLFDERNEAIRKLLEMAITACKRQNKYIGICGQGPSDHPDLARWLMEQGIDSVSLNPDSVLDTWFYLAEKPQ

SEQ ID NO: 21548 - protein, 131 aa, Litchi chinensis
VNVASKCGSSVGDAGGAADRVLNQLLTEMDGTTVKKTVFIIGATNRPDIIDPALLRPGRLDQLIYIPLPDEASRLQIFKACLRKSPVSPDVDLAALARYAQGFSGADITEVCQRACKYAIRENIEKDIQKL

SEQ ID NO: 21549 - protein, 434 aa, Rickettsia prowazekii str. Madrid E
MNITFIGSGYVGLVSGIIMGYLGHNVTCLDNDDVKISKLNKKILPIYEAKLDEYLKHALESDRLKFTNIYSNEFRNFDAIFITVGTPSKELGEADLKYVYDAVDKVSKHINKDCLIVIKSTVPPGSCNNIIAYLKAKGFSFNVASNPEFLREGSAVEDFLYPDRIVVGVNNKESEALLRKIYAPLIEQGAKFLVTNLVTSELIKYVSNSFLATKIAFINEMADLCEKIGANIKDLSQGVGLDQRIGRNFLNAGPGFGGSCFPKDILALNNLVENHKIDCKILKSVIKSNKLRPSNMVAKIATLLDGDLKGRNIAILGLTYKAGTDDVRASPAIEIITILLNKDVYVKAFDPIGLENAKKNLEHKNLLYFASAVEACKSVDIIVIATEWSEFKELNWQEIYNLVKSPMIIDLRNILDNEVMKKIGFRYYAVGSQI

SEQ ID NO: 21550 - protein, 512 aa, Solanum lycopersicum
MAVAAFGQLNLDESPLWGSRSIECFEKLEQIGEGTYGQVYMARDKQTGEIVALKKIRMDNEKEGFPITAIREIKILKKLQHENVIKLLEIVTSQGPEEDEPEKLGIDSNKYKGNIYMVFEYMDHDLTGLADRPGLRFTIPQIKCYMKQLLTGLHYCHINQVLHRDIKGSNLLIDNEGNLKLADFGLARSFSGDHNANLTNRVITLWYRPPELLLGATKYGPAVDMWSVGCIFAELLFGKPILPGKNEPEQLNKIFELCGTPDEINWPGVSKIPWYSKFKPARPMKRRVREVFRHFDRHALDLLDKMLNLDPSQRICAKDALDGEYFWTDPLPCDPRSLPKYESSHEFQTKKKRQQQRQNEEMAKRHKLQHPQQHSRLPPIQQPGHSQHWGGSTHQMSNSQPAISAGAGHHQFGKPRGTGGSNRYPPGGNPGGGYYQDRGAQGGGYSSGAYPPQGRAPPFPGSGLAPSGPRGPSGGYGGPPNYSQSGQYGGSGAGRGSNQMSGNRNQQYGWQQ

SEQ ID NO: 21551 - protein, 441 aa, Leifsonia xyli subsp. xyli str. CTCB07
MTGYRPGADRYAAALRVAAPERVGAVTSAVGLSLTVAGLRGAVGDLVEIGEPGSVTHAQIVAVGPEMTCMPMTPAAGHSTGAGARFALRPPTVPTGRGLLGRVINGLGHPIDGKGPLDATSCLPLDNAVPNPLDRARIDTPLPLGVRALDTLIPVGRGQRLGLFAGSGVGKSSLLSMIARGTDADVFVLALIGERGREVREFLEDDLGADGLARSVVVVATSDEPALMRRRAAFAATRIAESFRDNGADAMLMMDSLTRVAMAQREIGLSAGEPPATRGYPSSTFSTLASLLERAGTAKTGSITGLYTVLVDGDDHNEPIADAARSILDGHVLLDRKLAINGHFPSIDVLGSISRLAGKICTPGQQAAATALRKVMAARRAAQDLLDVGAYKPGANPLVDAGVEHEDRIAAFLQQGMGEQTTAEAAWTDLGELVTGFGGFR

SEQ ID NO: 21552 - protein, 408 aa, Fusobacterium nucleatum subsp. nucleatum ATCC 25586
MENIKLKKLDNGITLITEKLPDMSTFSMGFFVKTGAMNETKKESGISHFIEHLMFKGTKNRTAKEISEFVDFEGGILNAFTSRDLTCYYIKLLSSKIDIAIDVLTDMLLNSNFDEESIEKERNVIIEEIKMYEDIPEEIVHEKNVEYALRGVHSNSISGTVASLKKINRKAILNYLEKYYVAENLVIVASGNIDEKYLYKELNKKMKNFRKTKKEEVLDLSYEIKKGKKVVKKPSNQIHLCFTTRGVSSKSELRYPAAIISNVLGEGMSSRLFQKIREERGLAYSVYTYLTRFENCGLLSVYVGTTKEDYKEVIKLIKEEFKNIKENGISERELRKAKNKYESAFTFSLESTSSRMNRLASTYIIYGKIISLDKVREDIEKVTLKDIKKAAEFLFDEQFYSQTIVGDI

SEQ ID NO: 21553 - protein, 369 aa, Avena sativa
MDGAPVAEFRPTMTHGGRFLLYNIFGNQFEITSKYQPPIMPIGRGAYGIVCSVMNFETREMVAIKKIANAFDNNMDAKRTLREIKLLRHLDHENIVGLRDVIPPSIPQSFNDVYIATELMDTDLHHIIRSNQELSEEHCQYFLYQLLRGLKYIHSANVIHRDLKPSNLLLNANCDLKICDFGLARPSSESDMMTEYVVTRWYRAPELLLNSTDYSAAIDVWSVGCIFMELINRAPLFPGRDHMHQMRLITEVIGTPTDDDLGFIRNEDARRYMRHLPQFPRRPFPGQFPKVQPAALDLIERMLTFNPLQRITVEEALEHPYLERLHDVADEPICTDPFSFDFEQHPLTEDQMKQLIFNEALELNPNFRY

SEQ ID NO: 21554 - protein, 555 aa, Silicibacter sp. TM1040
MYKYNDFDSAFLAERNRQFRAQVERRIAGALTEDEFKPLRLMNGLYLQLHAYMLRVAIPYGTLNPDQMRALALLAEKWDKGYGHFTTRQNIQYNWPKLKDVPDMLDALAEVNLHAIQTSGNTIRNVTADHFAGAAADEIEDPRPIAELIRQWSTDHPEFQFMGRKFKIAVSGAANDRAVLKAHDLAIKIVKNEDGEVGYQVLVGGGLGRTPMIGKVLNDFVAADDLLPYIESVISVWNQLGRRDNKYKARIKITVHELGLEKIRELTEERFAQVRPTFGGADQALFQDIKRHFAAPEFRSEGTEVFDAAYDSDPVFRAWADTNLAEHKAPGHAIATISIKKHGATPGDATAAQMYAMADIAEEFAYGELRISHEQNVILPHVHKNDLPAIHARLKAADLATANIGLISDIIACPGMDYCALATARSIPVAQEIATRFEDLKLEHDIGHLQIKISGCINACGHHHVGHIGILGLDRAGVENYQITLGGDATETAAIGTRTGPGFAYDEIVPAVERIVETYLEQRESAEEEFLQTYRRVGMEPFKAALYPASEKKVA

SEQ ID NO: 21555 - protein, 480 aa, Avena sativa
MVSSEIPSVTTTHTHGPKLFRGMILLPKGPPDVILPENVEFDFNDVFGPVAVHTPTEASIVTPDSPAPLAESGEEVYNDPVVITKRSHSLVGPTLLVSQSLPLSKLTLHESESSSDLLECLSKEKQSNQEALSDEELSNTKENEAVGLDNFEVLKLVGQGAFGKVYQVRMKGTSEIYAMKVMRKDKILEKNHAEYMKAERDILTKVDHPFVVQLRYSFQTKYRLYLVLDFVNGGHLFFQLYQQGLFREELARIYTAEIVSAVAHLHANGIMHRDLKPENILLDARGHAMLTDFGLAKEFDENTRSNSMCGTVEYMAPEIVQGRGHDKAADWWSVGILLFEMLTGKPPFFGGNRDKIQQKIVREKMKLPSYLSSEVHSLLKGLLHKEAGKRLGSGLGGSDEIKNHKWFKAVNWKRLEARQIQPSFCPNVAGQTCIANFDECWTSMPVLDSPVASPVAADSNFVGFSYVRPAPFFQKPSPLG

SEQ ID NO: 21556 - protein, 393 aa, Fusobacterium nucleatum subsp. nucleatum ATCC 25586
MSKIIIKKEKEQKILNFYPNVYKDEIKDTIGNVKTGDIVDVITNDMKFLARGYVTEGTSAFVRILTTKDEKIDRKFIFERIKNAYEKREHLLDETNSVRAFYSEADFIPGLIIDKFDKYVSIQFRNSGVEIFRQDIIEAVKKCLKPKGIYERSDVENRVIEGVETKTGIIFGEIPERTIMIDNGVKYSIDIVDGQKTGFFLDQRNSRKFIAKYINNQTRFLDVFSSSGGFSMSALKNGAKEVIAMDKDSHALELCHENYKLNEFTADFSTIEGDAFLMLNSLATRNKKFDIITLDPPSLIKKKTEIYKGRDFFLDLCDKSFKLLEDGGILGVITCAYHISLQDLIEVTRMSASKNNKLLSVMGINYQPEDHPWILHIPETLYLKALWVKVEGR

SEQ ID NO: 21557 - protein, 251 aa, Zea mays
TERARRRGGRVAGVEENMSAAKEAGPSSRAVLVTGGAGYIGSHAVLQLLTAGFRVVVVDSLANSSELVIRRLRSLAGEHAKNLAFHKVDIRDTDGLKKVFASTRFDAVIHFAGLKAVGESVQKPLLYYDHNVVGTINLLEVMAAHGCKKLVFSSSAAVYGLPNNPPCTEDFPLTPHNPYGRTKLMVEEICRDIYHSDPEWNIILLRYFNPVGAHPSGYLGEDPCGTPKHLMPFVQQIAVGRRPSLTIFGNN

SEQ ID NO: 21558 - protein, 75 aa, Glycine max
EAARYNTDKSVATGQVASTGMVLLSYVQKVSEKVSLASEFMCNYLSRDVTASFGYDYILRQKKTRFIWIYCPVFP

SEQ ID NO: 21559 - protein, 334 aa, Arabidopsis thaliana
  misc_feature (41)..(41): Xaa can be any naturally occurring amino acid
MPLCNNFSGNLVVPVALFFAGALYIFNYQNYVNPLGMVTKXTTQYPVGELEAALYTAAAGNNKTVIITMVNKAYVKEVGRGSTMLDLFLESFWEGEGTLPLLDHLMVVAVDQTAYDRCRFKRLHCYKMETEDGVDLEGEKVFMSKDFIEMMWRRTRLILDVLRRGYNVIFTDTDVMWLRSPLSRLNMSLDMQISVDRINVGGQLINTGFYHVRSNNKTISLFQKWYDMRLNSTGMKEQDVLKNLLDSGFFNQLGLNVGFLSTTEFSGFCQDSPHMGVVTTVHANCCLHIPAKVFDLTRVLRDWKRYKASHVNSKWSPHLKCSRSWNDTHYIPRL

SEQ ID NO: 21560 - protein, 330 aa, Lactobacillus acidophilus NCFM
MKKLLLLSTGGTIASVASDAGLVPKETGEELIKMLGKLPYDIQVRDILQLDSSNIQPEEWKFIAQNIYNYRNDYDGIVVSHGTDTMAYTASMLAFMLKNINIPVVLTGSQVPINVVLSDAHDNLRLAFAAAATCPPDIYLAFHNKVMLGCRSVKVRTTNFDAFESVNVPPVATVSSDGLVFNKESFQKKHDGAPELNTNIDSHVSLVKLFPGFDPNLLFAMVDSGCRGIVIEAYGLGGMNFIRRNMVAAIGKLIRQGIPVVASSQCLYERSDLTKYEVGREALLKGAISACDMTSESAITKLMWALGQGMDVHEITEFFNTNVAGEVTLK

SEQ ID NO: 21561 - protein, 207 aa, Triticum aestivum
  misc_feature (128)..(128): Xaa can be any naturally occurring amino acid
  misc_feature (150)..(150): Xaa can be any naturally occurring amino acid
TREDAHAFDVISVKIADLGNACWVNHHFTNDIQTRQYRSPEVILGSKWGASTDVWSMAAMVFELITGDYLFDPQSGTKYGKDDDHIAQIIELLGPFPKSLCLSGKWSQEIFNRKGELRNIHRLRHWAXLPDVLREKYHFKEDEAKRIADXLTPMLELVPEKRANAGGMAGHVWLEDTPGMKGLKIEGLEVGGRGEGIDGWATEVRKR

SEQ ID NO: 21562 - protein, 188 aa, Candidatus Phytoplasma vitis
MLSIKSLDEIVIMKEAGKILSFIRKELLKFLKVGISTFDLDMIAFDLIKKNGVISAFKGYQGFGGYICISVNEAVVHGLPSKTRILKLGDIVTLDIGIKHKGYFVDSAWTYSLGSVSNKIKQFIENTKKSLFLGIEQVKPGNKISDISRAIGKFGNKHNYGIIEIFSGHGIGKKLHEEPYIFNFDFVL

SEQ ID NO: 21563 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAAMEGARLSGASRIIGVDLNPAKHEQAKKFGCTDFVNPKDHTKPVQEVIVEMTDGGVDRAVECTGNADAMISAFECVHDGWGVAVLVGVAHKEPVFKTHPMNFL

SEQ ID NO: 21564 - protein, 696 aa, Vibrio vulnificus CMCP6
MATQGLTFHGDSIHIQFEEGLVGLVKRSAEPLNLAEASKHPAFKYFPQLGEETYHSFLGAPIIHRKKVLGVLVIQQKTPRLFSEMEESFLVTLSAQLAVIIAHAQSLGHWSLASKPAAVQGIAASSGVAIGEFWYDNSQPILSEVCPASTLDKEREQEWLAVAIEAALADFRRMRKKFDSEINKDALAIFDLFTHLLNDPMLRTDLKKHVERGDRADWALRQVVESYSSRFARMSDVYLRERAHDIRELGQRLLFFLHNSEQEQPRIERPVILVANELTASLLASVPKKYLLAVVALEGAANSHAAILSRALGVPAVMGANLNLEEVHGKQGIVDGYSGEIYIQPNRQILREYRSLVTEESELFAMVNKELALPAKTQDNVDVEVLLNAGLSADSNIAINAGVDGVGLYRTEIAFLLQHRFPSEDEQYQQYRAILSSYPQQRVVMRTLDIGGDKPLPYLPIEEDNPFLGWRGIRFTLDHPDIFLIQLRAMLRASAEHGNLSILLPMISGVGELDDAIRLIQQAYHEVVLLDERVVMPQIGVMIEVPSMVYLIPSIAQRVDFVSVGTNDLTQYLLAVDRNNARVSDVYESLHPAVLQALQQIYQQCGQYHLPVCICGELAGDPFGALLLLGLGYRSLSMNTSNVARIKYLIRHSQLSDLQALSQQALSLSYGKDIHQLMRDYFINHDFAGFIRAGKK

SEQ ID NO: 21565 - protein, 176 aa, Candidatus Phytoplasma vitis
MKEAGKILSFIRKELLKFLKVGISTFDLDMIAFDLIKKNGVISAFKGYQGFGGYICISVNEAVVHGLPSKTRILKLGDIVTLDIGIKHKGYFVDSAWTYSLGSVSNKIKQFIENTKKSLFLGIEQVKPGNKISDISRAIGKFGNKHNYGIIEIFSGHGIGKKLHEEPYIFNFDFVL

SEQ ID NO: 21566 - protein, 451 aa, Arabidopsis thaliana
MSSSSESHLATAKTALTAVASVAAAAILARSVVQDYMPNEVHEYISHGFRRFFSYFSYQMTAVIEEFGGFEHNQVFEAAEAYLSTKISNSTRRIKVNKLEKQSNYSVTVERDEEVVDIFDGVKLSWILVCRHVDKKDFRNPRDLNSTLKSEVRSYELSFRKKFKNMVLESYLPFVVEQAASIKQKFKTLKIFTVDSYSVEWTSVTLDHPSTFRTLALDPEVKKNLVEDLDRFVQRKGFYGRVGKAWKRGYLLYGPPGTGKSSLIAAIANHLNFDIYDLDLTSLNNNAELRRLLMSTANRSILVVEDIDCSIELKDRSTDQENNDPLHKTVTLSGLLNFVDGLWSSCGNERIIVFTTNYREKLDPALLRPGRMDMHIHMSYCTPAAFKVLASNYLEIQDHILFEQIEEFIREIEVTPAEVAEQLMRSDSVDKVLQGLVEFLKAKKQIDNSKA

SEQ ID NO: 21567 - protein, 188 aa, Candidatus Phytoplasma vitis
MLSIKSLDEIVIMKEAGKILSFIRKELLKFLKVGISTFDLDMIAFDLMKKNGVISAFKGYQGFGGYICISVNEAVVHGLPSKTRILKLGDIVTLDIGIKHKGYCVDSAWTYSLGSVSNKIKQFIENTKKSLFLGIEQVKPGNKISDISRAIGKFGNKHNYGIIEIFSGHGIGKKLHEEPYIFNFDFVS

SEQ ID NO: 21568 - protein, 431 aa, Oryza sativa Japonica Group
MVGKRVAVVVGGSVAGLACAHAVAEAGWEAVVVEKAAAPGAGSGTGAGLGLDAQSMETLARWIPGRLDAATLPLAVDLNRATDGETKAGRTLTRDEGFGFRAAHWGDLHRRLHEALPAGVTVLWGHQFVSFEMAPEGDGDGGVVVTARVLRTGETVEVAGDLLVAADGCTSAIRRRFLPELKLRYSGYCAWRGVFDFSGKEGCTTMVDIRRAYPELGNCLYFDLAYKTHAVLYELPKNRLNWLWYINGDEPELMGSSVTMKVNEATVSEMKEEAERVWCPELARLIGETAEPFVNVIYDAEPLPGLSWAGGRVALVGDAAHPTTPHGLRSTNMSILDARVLGCCLARWGGDGNAEPTSTPRRALAEYEAARRPVVAAQVLHARRLGRLKQGLGMGSAGDGEGFDARTATEEEISQLRQSSMPYFSGAPTIE

SEQ ID NO: 21569 - protein, 141 aa, Oryza sativa Japonica Group
METTGGGGSPKEAVVPSAASGDTTLGRHLAHRLVQVGVSDVFAVPGDLNLTILNHLIAEPGLHIVGCCNELNAGYAADGYARARGVGAYAVTFTVRGQLLHGCRRRSHRFLNQVTGDEARKQAPPLGIRSARARLRRCCRW

SEQ ID NO: 21570 - protein, 209 aa, Gibberella zeae PH-1
MANFLASIFGTELDKVNCSFYFKIGACRHGDRCSRKHVKPSYSQTILMPNLYQNPAYDPKNRMNPSQLQNHFDAFYEDIWCELCKYGELEELVVCDNNNDHLIGNVYARFKYEESAQKACDELNSRWYAARPIYCELSPVTDFREACCRLNSGEGCVRGGFCNFIHRKNPSEELDRDLTLSTKKWLKQRGRDERSASRSPTPEPTRRRY

SEQ ID NO: 21571 - protein, 89 aa, Glycine max
  misc_feature (83)..(83): Xaa can be any naturally occurring amino acid
TMIAAPAVTTVHHAGAGMAAPFTGQKSMVGFPTRKTNNGISCIGYNCLRLQCLQVWTPVVKSEVETLSYLPHLVDAQMAKEVXYLIRNG

SEQ ID NO: 21572 - protein, 323 aa, Pisum sativum var. macrocarpon
MENFPIVDMGKLNTEDRKSTMELIKDACENWGFFECVNHGISIEMMDTVEKLTKEHYKKCMEQRFKEMVATKGLECVQSEIDDLDWESTFFLRHLPVSSISEIPDLDDDYRKVMKEFALKLEELAEELLDLLCENLGLEKGYLKKAFYGSKGPNFGTKVSNYPPCPKPALIKALRAHTDAGGIILLFQDDKVSGLQLLKDEQWIDVPPMRHSIVINLGDPLEVITNGKYKSVMHRVIAQTDGARMSIPSFYNQGGDAVISPASTLLKEHEPSEVHPKFVFDAYMKISMGLKFQATEPRFELAEIMSIVKVGPVVRLWICVWLS

SEQ ID NO: 21573 - protein, 430 aa, Listeria innocua Clip11262 [sequence omitted]

SEQ ID NO: 21574 - protein, 510 aa, Listeria innocua Clip11262
MSKSPVAIIILDGFGKRAETVGNAVAQANKPNFDRYWANFPHGELKAAGLDVGLPEGQMGNSEVGHTNIGAGRIVYQSLTRIDKAIEEGEFQENKALNNAFTHTKENNSDLHLFGLLSDGGVHSHINHLVALLETAKDKGVKNVYIHAFLDGRDVAPQSSLEYLETLEKAISDLNYGAIATVSGRFYAMDRDKRWERVEKAYKAIVSAEGEKFEDPIELVKASYANDKNDEFVVPAIITKDGKPVATVKDNDAVIFFNFRPDRAIQLSNAFTDKEWDHFDRGANHPKNIKFVTMTLYNPSIDAEVAFEPIEMKNVIGEVLSNEGLSQLRIAETEKYPHVTFFMNGGRNEEFPGENRILINSPKVETYDLKPEMSAYEVTDALVEDIKNDKHDAIILNFANPDMVGHSGMLEPTIKAIEAVDENLGRVVDLILEKGGSAIIFADHGNSETMSTPEGKPHTAHTTVPVPVIVTKKGVTLREGGRLADVAPTMLDLLGVKKPAEMTGESLIQK

SEQ ID NO: 21575 - protein, 251 aa, Listeria innocua Clip11262
MRKPIIAGNWKMNKTAAKAGQFAEDVKNNVPSSDAVESVVAAPALFLQELVRLTEGTNLRVAAQNCYFEDEGAFTGEISPFALADLGVSYVIIGHSERREYFHETDEDINKKAHAIFKHGMTPIICCGETLDQREAGQTDTWVRGQIRAALAGLTEEQVIKSVIAYEPIWAIGTGKSSTSADANETCAVIRAEVADAVSQKAADAVRIQYGGSVKPENIADYLAESDIDGALVGGASLEPASFLALLEAVK

SEQ ID NO: 21576 - protein, 396 aa, Listeria innocua Clip11262
MAKKVVTDLDLKNKKVLVRVDFNVPMKDGKITNDNRIVAALPTIEYILEQNGKAILFSHLGKVKTEEDKEGKSLRPVAARLSELLGKEVKFVPTTRGPELEKAVDELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGDKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 21577 - protein, 336 aa, Listeria innocua Clip11262
MTVKVGINGFGRIGRLAFRRIQNVEGIEVVAINDLTDAKMLAHLLKYDTTQGRFDGEVEVHDGFFNVNGKEVKVLANRNPEELPWGDLGVDIVLECTGFFTAQDKAELHIKAGAKKVVISAPATGDMKTIVYNVNHETLDGTETVISGASCTTNCLAPMAKVLEDKFGVVEGLMTTIHAYTGDQNTLDAPHPKGDFRRARAAAENIIPNTTGAAKAIGEVLPTLKGKLDGAAQRVPVPTGSLTELVTVLDKKVTVDEVNAAMEAASDPETFGYTSDQVVSSDIKGMTFGSLFDETQTKVLTVGDQQLVKTVAWYDNEMSYTAQLVRTLEYFAKIAK

SEQ ID NO: 21578 - protein, 315 aa, Physcomitrella patens subsp. patens
MVSLHLPKPLSITDIGVLPPRETADLRVAYQGVPGAYSEAAAAKAYPRCEAVPCEQFEAAFSAVELWLVDRAVLPVENSLGGSIHRNYDLLLRHRLHIVGEVQLGIHHCLMGIPGVKKEELQRVVSHPQALAQCEQTLTKLGVTREAVDDTAGAAQFIAAHNLRDTGAVASARAAEIYGLEILMDGIQDDLDNVTRFLMLAREPVMPRTDRKFKTSIVFTLEEGPGVLFKALSVFALRDINLTKIESRPQRKRPLRVVDDSNNGSAKYFDYLFYIDFEASMADVRAQNALGHLQEFATFLRVLGSYPMDMSPMRA

SEQ ID NO: 21579 - protein, 342 aa, Burkholderia vietnamiensis G4
MKCTLKPVGEQTIVITGATSGIGLVTARKAARRGAKLVLFARNGDALNTLCDEIRQHGGLAVPVAGDVANLEDLQRAAAQAVDTYGGFDTWINNAGVSIFGTAAAVPLEDQRRLFDTNYWGVVHGSLVASDHFRRKGDFHGGAIINLGSEASDAPLPLQSAYVASKHAVKGFTDSLRLELESDRLPVSVTLIKPAAMDTMFVMHAKNYMNVEAKLPPPIYDPELVADAILFAAAHPRRTLFVGGAAKLASAGAYHAPRLFDRLAATLFSRGQRTVRAARPRDDNALYESRHALHEREGMEGPVLRGCAYNAVVQRPKVAGAVALGAAALMVVALARARRTTA

SEQ ID NO: 21580 - protein, 196 aa, Oryza sativa
  misc_feature (80)..(81): Xaa can be any naturally occurring amino acid
  misc_feature (87)..(87): Xaa can be any naturally occurring amino acid
  misc_feature (109)..(109): Xaa can be any naturally occurring amino acid
MATRIGLAGLAVMGQNLALNIAEKGFPIVYNRTTSKVDETVQRAKVEGNLPVYFHDPASFVNSKSMEKGWSLNLGELARXXKGGCIXRAIFLDRIKKAYDRNFDLVNLXVDPEFAQEIMDRQAAWRRVVCLAINNGVSTPGMSASLAYFDSYRRDRLPANLVQAQRDYFGAHTYERVDMPGSFHTEWFKIARAAKM

SEQ ID NO: 21581 - protein, 909 aa, Cryptococcus neoformans var. neoformans JEC21
MPSSRPATSSTVPFTPKPRKRASSSKFTFTDKELNQFAGTLASVRKVRPGAILEELEQSGEGSGILHRYESSLHRGNPEAQKRSASARAVENERDRSHFRTRPSSSASITQREYNPSFLRAMSGSRDLLPESDHKGREKVNEPAKIEPVLERPTPMTELSAERRLLDKVPLEVQEAWICEDLLFVLQGVEGVLIRYDEGYDPFDEEQRVKGAKWRVNPLLDASLLSLVKRLLPLASFFTAVEASMELRTAPEYGMVSHALCSGIRAMLKEFRVLTAQLESLFLTSPTFTLQTLYLHLHPTLHTMSLLASLCHALEADQAGQGTDDLSDDDDGLGGMAEELGLGGAGLKGLMKNLKAREGLIGDGGDVLGGEVLGIICEREATMSGDPTASTLHSSLLLHASQPYCKMLIQWIATGHLSDPFDEFMVKESGHITKGVLESDYTDEYWERRYTLRDGAIPGSSKVSARNNTPSISAGVPPPRQGTNRLPGGACIPQFLQPWKHKILLAGKYLNVIRECGIEVKKPGEVDEKEMVTMNDPNFYKRIEDAYIYANKTLLKLMVEEQELIPHLRSMKHFFFLNQSDFLTNFLDLAASELRKPAKSASIIKLQSLLDLAVRNPSSSSSNDPFKDDLKVVMQSQGLYDWLLKIVSKTGSLTEEGELDFALGDIHEEEGSKREKERPLIAIDALAFDYSVKFPLSLIISRKTIARYQLIFRFLLHLHHLESALSAMWLEHKSPSWRNNSGNEDIERWKARIFSLRTRMLAFVRQVLAFATGEVLEPNWKALEEKLAKVQTVDQLLRDHVDFLDTCLKQCMLTTSKLLNIYAKLMTTISVFVSYQSSLNSALNKFLVDPIAESDPAKSKLRWTALSKFEINFNHHAKLHLDAVTYNAGSENVALLALVTRLHQITLRI

SEQ ID NO: 21582 - protein, 188 aa, Candidatus Phytoplasma vitis
MLSIKSLDEIVIMKEAGKILSFIRKELLKFLKVGISTFDLDMIAFDLMKKNGVISAFKGYQGFGGYICISVNEAVVHGLPSKTRILKLGDIVTLDIGIKHKGYCVDSAWTYSLGSVSNKIKQFIENTKKSLFLGIEKVKPGNKISDISRAIGKFGNKHNYGIIEIFSGHGIGKKLHEEPYIFNFDFVS

SEQ ID NO: 21583 - protein, 137 aa, Rhodobacter sp. AP-10
HDDMPCMDDDDLRRGQPTVHVKWDEVTAVLAGDALQTLAFELCCDPAMGPADRRIELVAALARASGVEGMVHGQALDIAAESAGRPLTLEEITALQAGKTGALIVFAAEAGAILAGADRAPLRRYAQALGLAFQIAD

SEQ ID NO: 21584 - protein, 188 aa, Candidatus Phytoplasma vitis
MLSIKSLDEIVIMKEAGKILSFIRKELLKFLKVGISTFDLDMIAFDLMKKNDVISAFKGYQGFGGYICISVNEAVVHGLPSKTRILKLGDIVTLDIGIKHKGYCVDSAWTYSLGSVSNKIKQFIENTKKSLFLGIEQVKPGNKISDISRAIGKFGNKHNYGIIEIFSGHGIGKKLHEEPYIFNFDFVL

SEQ ID NO: 21585 - protein, 188 aa, Candidatus Phytoplasma vitis
MLSIKSLDEIVIMKEAGKILSLIRKELLKFLKVGISTFDLDMIAFDLMKKNGVISAFKGYQGFGGYICISVNEAVVHGLPSKTRILKLGDIVTLDIGIKHKGYCVDSAWTYSLGSVSNKIKQFIENTKKSLFLGIEQVKPGNKISDISRVIGKFGNKNNYGIIEIFSGHGIGKKLHEEPYIFNFDFVL

SEQ ID NO: 21586 - protein, 401 aa, Pseudoalteromonas tunicata D2
MQVTRALFDEVMVPNYAPSSVIPVKGQGSRVWDQNGKEFIDFAGGIAVNCLGHCHPVLVKALQDQSEKLWHLSNVMTNEPALRLAKKLTDATFAEKVYFANSGAESNEAALKLARRYALEVFGAEKTHIIAFNKGFHGRTFFTVTVGGQAAYSDGFGPKPADIQHCNYNDLAAFEALISDKTCAVMMEPLQGEGGIISPTAEFVQAVRALCDKHNALLIFDEVQTGVGRTGHLYAYQGLGVTPDILTTAKALGGGFPIGAMLTTTAIAAHLKVGTHGSTYGGNPLACAVAEAAFDVVNTPDVLNGVKEREQLFREGLTAINEKYNVFSEVRGEGLLLGAVLNADFAGRSRDFLLASADHGLMSLVAGTDVVRFAPSLIIPKEDIVEGLARFEKAVSQVVNG

SEQ ID NO: 21587 - protein, 147 aa, Rhodopseudomonas palustris
HDDMPAMDNSDLRRGRPTLHKAYDDATAILAGDALLTFAFDIVTRDEVHNDPTVRLLLTRVLARCAGLGGMVGGQMLDLAGEGRFGDREPVDVARLQQMKTGALLRYGCVAGAILGQASPDQYRALDDYGRALGEAFQIADDILDVE

SEQ ID NO: 21588 - protein, 267 aa, Pseudoalteromonas tunicata D2
MHNDVNALFANLWDNYLSVTPSAVEVHKLLGTTQQDDIINDHIALRTFNIEKVSLEKLAAHFLAVGYKECGEYHFEAKKLYAKHFEHSDPKQPKVFISELLIDQCSEQLQKIVTDLVDQIDPDAVTADNFLYSGTHWSVDSQTYKALLAESEYAAWMAAWGYRANHFTVNINELKNFETIESVNDALKKAGFALNTSGGEIKGSAEVLLEQSSTLADDYTVQFSDGEMTVPSCFYEFALRYPMANGELYTGFVAASADKIFESTNAR

SEQ ID NO: 21589 - protein, 421 aa, Corynebacterium glutamicum ATCC 13032
MALVVQKYGGSSLESAERIRNVAERIVATKKAGNDVVVVCSAMGDTTDELLELAAAVNPVPPAREMDMLLTAGERISNALVAMAIESLGAEAQSFTGSQAGVLTTERHGNARIVDVTPGRVREALDEGKICIVAGFQGVNKETRDVTTLGRGGSDTTAVALAAALNADVCEIYSDVDGVYTADPRIVPNAQKLEKLSFEEMLELAAVGSKILVLRSVEYARAFNVPLRVRSSYSNDPGTLIAGSMEDIPVEEAVLTGVATDKSEAKVTVLGISDKPGEAAKVFRALADAEINIDMVLQNVSSVEDGTTDITFTCPRSDGRRAMEILKKLQVQGNWTNVLYDDQVGKVSLVGAGMKSHPGVTAEFMEALRDVNVNIELISTSEIRISVLIREDDLDAAARALHEQFQLGGEDEAVVYAGTGR

SEQ ID NO: 21590 - protein, 144 aa, Rhodovulum sp. CP-10
HDDMPAMDDDDLRRGQPTVHVKWDDGTALLVGDALQTLAFDLLADPACHPDPGVRIDLVASLARASGIDGMVLGQAQDIAAETAGRPLTLAEITELQANKTGALIRWSAEAGARLGRADIAPLSSYATALGLAFQIADDILDAM

SEQ ID NO: 21591 - protein, 406 aa, Rhodopseudomonas palustris CGA009
MEEFYRIRRLPPYVFEQVNRAKAAARNAGADIIDLGMGNPDLPAPPHVLEKLKDTLGKPRTDRYSASRGITGLRRAQAAYYDRRFGVKLNPDTQVVATLGSKEGFANVAQAITAPGDVVLCPNPSYPIHAFGFLMAGGVIRSVPSEPTPDFFAAAERAIIHSIPKPIALIACYPSNPTAYVASLDFYKDLVAFAKKHEIMILSDLAYAEVYFDDNNPPPSVLQVPGAMDVTVEFTSMSKTFSMAGWRMGFAVGNERIIAALARVKSYLDYGAFTPVQVAATAALNGPDDCIKEMRETYKKRRDILVESFGRAGWEIPPPSASMFAWAPLPPAFREIGSMQFATLMVEKCGVVVSPGVGFGEHGEGFVRIAMVENEQRIRQAARGVRRFLESGVETLHNVVPLAAQR

SEQ ID NO: 21592 - protein, 533 aa, Oryza sativa Japonica Group
MDSSTVGAPGSSLHGVTGREPAFAFSTEVGGEDAAAASKFDLPVDSEHKAKTIRLLSFANPHMRTFHLSWISFFSCFVSTFAAAPLVPIIRDNLNLTKADIGNAGVASVSGSIFSRLAMGAICDMLGPRYGCAFLIMLAAPTVFCMSLIDSAAGYIAVRFLIGFSLATFVSCQYWMSTMFNSKIIGLVNGLAAGWGNMGGGATQLIMPLVYDVIRKCGATPFTAWRLAYFVPGTLHVVMGVLVLTLGQDLPDGNLRSLQKKGDVNRDSFSRVLWYAVTNYRTWIFVLLYGYSMGVELTTDNVIAEYFYDRFDLDLRVAGIIAASFGMANIVARPTGGLLSDLGARYFGMRARLWNIWILQTAGGAFCLLLGRASTLPTSVVCMVLFSFCAQAACGAIFGVIPFVSRRSLGIISGMTGAGGNFGAGLTQLLFFTSSRYSTGTGLEYMGIMIMACTLPVVLVHFPQWGSMFLPPNAGAEEEHYYGSEWSEQEKSKGLHGASLKFAENSRSERGRRNVINAAAAAATPPNNSPEHA

SEQ ID NO: 21593 - protein, 137 aa, Ehrlichia ruminantium str. Gardel
MSYSESLLEHYKNPKNVGTLPKEDYNVGTGLVGAPSCGDVMKLQIKVDDNGKIIDAKFKTFGCGAAIAASSLATELIKGKTVDEAHELKNTVLAKELSLPPVKIHCSLLAEDAVKAAINDYYMKQANKKNATKNPNE

SEQ ID NO: 21594 - protein, 461 aa, Campylobacter jejuni RM1221
MNLEKLRSKLGKENLSAIFGEITKISATSIEIRGLKTGVGDIVKLVSNENENLNTLAMVVEIKEQFSYLSPFSFIEGFKIGDRAFISDAGMQIGVSDELLGRVVDPFMRPKDGKGAIEVTKYMPIMRAPIDAMKRGLIEEVFPVGVKTIDALLTCGVGQKLGIFAGSGVGKSTLMGMIVKNSKAPIKVVALIGERGREIPEFIQKNLGGKLDDTVIIVATSDDSALMRKYGAFCAMSVAEYFKEQGKDVLFIMDSVTRFAMAQREIGLALGEPPTTKGYPPSVLSLLPQLMERTGKEEGKGTITAFFTVLVDGDDMSDPIADQSRSILDGHIVLSRELTDFGIYPPINIQNSASRVMSDIISPEHKLWARKFKRLNSLLKENEVLLRIGAYQKGSDKELDEAISKKEFMQKFLGQNPEESFEFNQTLELLSQIDTPNTPLPPTQNINVGSASATLPNPNLK

SEQ ID NO: 21595 - protein, 282 aa, Bacillus cereus
MFKKIGIVGAGTMGIGMAVDLVLHGLETVLIDVTEEQLEKAEEKILETVRFAPLINKAFPRMHKEEVLSLISSSTNLDEVAECDYIVENVPENWQIKEPIYRRLDEICKKDTIFGVNTSCISITKVGGVTKRPDKIIGMHFMNPVYMKPSIEVIRGHLTSDETVEKAQSFLKQLDKDAIVVNDQTGFVSNRISHLFMNESAWVVMDGVATPKQVDDIFKKCFGHTMGPLETADLIGLDTVLHSLNVLYEEYQDPKFRCCPLLKKMVDAGECGRKSGKGFYAY

SEQ ID NO: 21596 - protein, 286 aa, Oryza sativa
  misc_feature (16)..(16): Xaa can be any naturally occurring amino acid
  misc_feature (56)..(56): Xaa can be any naturally occurring amino acid
  misc_feature (131)..(131): Xaa can be any naturally occurring amino acid
  misc_feature (175)..(175): Xaa can be any naturally occurring amino acid
MSKEVSEEPEHVRCPXDYTDPPPAPLFDVGELRLWSFYRALIAEFIATLLFLYITXVATVIGYKVQSSADQCGGVGTLGIAWAFGGMIFILVYCTAGISGGHINPAVTFGLLLARKVSVIRAVMYIVAQCXLGGIVGVGIVKGIMKHQYNANGGGANMVASGYSTGTALGAEIIXGTFVLVYTVFSATDPKRNARDSHVPVLAPLPIGFAVFMVHLATIPITGTGINPARSIGAAVIYNQKKAWDDHWIFWAGPFIGALAAAAYHQYILRAAAIKALGSFRSNPSN

SEQ ID NO: 21597 - protein, 444 aa, Mesembryanthemum crystallinum
MVTIKCVKARQIYDSRGNPTVEADIHLDDGTYARAAVPSGASTGVYEALELRDGGKDYMGKGVYKAVKNVNEIIGPALVGKDPTQQTAIDNFMVQQLDGTVNEWGWCKQKLGANAILAVSLAVCKAGAQVKKIPLYQHIAEIAGNKNMVLPVPAFNVINGGSHAGNKLAMQEFMILPTGASSFKEAMKMGSEVYHNLKSVIKKKYGQDATNVGDEGGFAPNIQENKEGLELLKTAIEKAGYTGKVVIGMDVAASEFYKEDKSYDLNFKEENNDGSQRISGEALKDLYKSFVAEYPIVSIEDPFDQDDWEHYAKMTAECGEKVQIVGDDLLVTNPKRVKKAIDENPCNALLLKVNQIGSVTESIEAVKMSKKAGWGVMASHRSGETEDTFIADLSVGLSTGQIKTGAPCRSERLAKYNQLLRIEEELGDKAVYAGANFRRPVEPY

SEQ ID NO: 21598 - protein, 289 aa, Yersinia pestis CO92
MSTKHPVIAVTGSSGAGTTTTSLAFRKIFQQLDIRAAQIEGDSFHRYTRPEMDAAIRKARDQGRHISYFGPEANDFGQLEQSVAEYSKHGTGRSRKYLHTYDEAVPYNQIPGTFTPWEPLPEPTDVLFYEGLHGGVVTEHHDVAKHVDLLVGVVPIVNLEWIQKLVRDTGERGHSREAVMDSVVRSMDDYINYITPQFSRTHINFQRVPTVDTSNPFAAKAIPSLDESFVVIHFRGLDHIDFPYLLAMLQGSFISNINTLVVPGGKMGLAMELIMAPLVQQLLEGKQIA

SEQ ID NO: 21599 - protein, 421 aa, Streptomyces clavuligerus
MALVVQKYGGSSLESADRIKRVAERIVATKKAGNEVVVVCSAMGDTTDELLDLAQQVNPVPPEREMDMLLTAGERISNALVAMAISAQGAQAWSFTGSQAGVVTTAVHGNARIIDVTPSRVSEALEQGYVALVAGFQGVAQDTKDITTLGRGGSDTTAVALAAALNADVCEIYSDVDGVYSADPRIVPDARKLDSVPYEEMLELAASGSKILHLRSVEYARRYGVPIRVRSSYSDKPGTTVTGSIEEIPVEQALITGVAHDRSEAKITVTGVPDHAGAAARIFRVIADAEIDIDMVLQNVSNTSSGRTDITFTLSKANGPKAVASLEKIKEELGFSSVLYDDHVGKVSLVGAGMRSHPGVTATFCEALSKVGVNIEIINTSEIRISVLIRDAQLDDAVRAIHDAFELGGDEEAVVYAGSGR

SEQ ID NO: 21600 - protein, 459 aa, Rickettsia prowazekii str. Madrid E
MEKYDVAVIGGGPGGYVAAIRAAQLKKKVVLIEKAHLGGVCLNWGCIPTKSLLKSAEVFEYIKHAQDYGIDVGIAEINIKKIVERSRKIANTLACGVQLLLKKNKVTIIDGVASFGENKVINVNDKPTVKAENIIIATGTRPKILQGFEPDIKQIWTSKEAMIPQHVPKSMIIIGSGAIGIEFASFYNSIGVDVTVIEAKNRILPSEDTEIAGIAHKNFEQKGIKIITNAKLIKQTKSQNEIEVELELEGKTQKLQATILLMAVGISANIENLGLEKTKVEVENGYILTNGLMQTAESGIYAIGDVAGVPCLAHKASHEGIIAAESIAGLNPNGINKHNIPYCIYSSPQIASVGLTEEIAKDLGYEIKIGRFPFSANGKALVSGNSDGLIKTIFDVKTGELLGAHMVGLEVTELIQGYVVSKNLEGTELDLINTIFPHPTLSEMMHESVLAAYDMAIHI

SEQ ID NO: 21601 - protein, 228 aa, Glycine max
MADNKQPNHEEASPLLHQSQPKSEPPTPPETPEFLLGWTADGLPLGHGSVVGQPMGRAPWNSSICACLGQTDHFCSSDLEVCLLGSVAPCVLYGSNVERLESAPGTFANHCLPYSGMYIIGNSCFGWNCLAPWFSYPSRTAIRRRFNLEGSCEALNRSCGCCGSILEDEVQREHCESACDLATHVFCHVCALCQEGRELRRRLPHPGFNAQPVLVMIPPGEQTMGREA

SEQ ID NO: 21602 - protein, 380 aa, Prochlorococcus marinus str. MIT 9211
MNYSSKDDAILVLSDGTLLEGKPFGFKGTVLGEIVFNTGLTGYQEVLTDPSYHGQLVTFTYPELGNTGVNPEDQEADSPFVKGVIARQIINKPSSWRAKSNLADWLEKQKVIGIHGVDTRSLVRHLREYGTMNAAISTDGKFTPLQLLKKLQDVPSMEGLNLAEKVTTQKAYKWKENTAAGFDKREINQTSASFKVAAIDFGIKRSILNRLVAFGCEVNVLPASINFSEVIKLCPEGVFLSNGPGDPAAVTKGIALAKKLIEETEIPLFGICLGHQILGLALGAKTFKLPYGHRGLNHPCGANGQIEITSQNHGFAIDASSLNPNLVEITHLNLNDRTVAGFAMLNKPVFGIQYHPEASPGPHDADYHFERFVAQMSERR

SEQ ID NO: 21603 - protein, 398 aa, Streptococcus pyogenes MGAS315
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGSKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 21604 - protein, 367 aa, Vitis vinifera
MESSSELVAFPLLLTPIESNYRACTIPYRFPSDNPRKATPTELSWIDLFLNSIPSFRKRAESDGTVADANVKAEKFAQRYSEILEDLKKDPESHGGPPDCVLLCRLREQVLRELGFRDIFKKVKDEENAKAISLFENVVHLNDAIEDESKRLENLVRGIFAGNIFDLGSAQLAEVFSKDGMSFLASCQNLVPRPWVIDDLDSFKLKWSRKSWKKVIIFVDNSGADIILGILPFARELLRCGSQVVLAANDLPSINDVTYPELIEIIAKLKDENGQLVGVDTSNLLIANSGNDLPVIDLTRISQELAYLASDADLVILEGMGRGIETNLYAQFKCDSLKIGMVKHLEVAQFLGGRLYDCVFKYNEVLS

SEQ ID NO: 21605 - protein, 188 aa, Candidatus Phytoplasma vitis
MLSIKSLDEIVIMKEAGKILSFIRKELLKFLKVGISTFDLDMIAFDLMKKNGVISAFKGYQGFGGYICISVNEAVVHGLPSKKRILKLGDIVTLDIGIKHKGYCVDSAWTYSLGSVSNKIKQFIENTKKSLFLGIEQVKPGNKISDISRAIGKFGNKHNYGIIEIFSGHGIGKKLHEEPYIFNFDFVL

SEQ ID NO: 21606 - protein, 340 aa, Zymomonas mobilis subsp. mobilis ZM4
MPVLEEKKTADHFHHIGVLGAGSWGTALAAVASYKGAVTLWGRKREIIDAINQRHINPDYLPDIIIPRTIHATDELNDLSSASALLVAIPAQKMRSVLRQIPNDSRPLILCAKGIEAESGLLMSQLAADIFPHRPIAVLSGPTFASEVARHLPTAVTLAAKEKDIRAALMQRLAIPTFRPYASSDVIGADVGGAVKNVLAIACGVVAGAKLGNNARAAVISRGFAEMNRFGIALGAKEETLTGLSGLGDLVLTCSSELSRNFTFGKKLGEGYSYEEQQKKRAVTTEGVFTAPVLQRVANKLKVEMPLVSAICDLIEGKSVNSVLERLLSRPLKGEYSISV

SEQ ID NO: 21607 - protein, 447 aa, Xanthomonas oryzae pv. oryzae KACC10331
MSLPAQPHKQTRQTIVRLLSSMASAKEISQYLKRFSQVDAKRFAVVKVGGAVLRDDLDALTSSLSFLQEVGLTPIVLHGAGPQLDAELSAAGIEKHTVNGLRVTSPEALAIVRKVFQASNLKLVEALQQNGARATSITGGVFEAEYLDRDTYGLVGEVKAVNLAPIEASLQAGSIPVITSLGETPSGQILNVNADFAANELVQELQPYKIIFLTGTGGLLDADGKLIDSINLSTEFDHLMQQPWINGGMRVKIEQIKDLLDCLPLESSVSITRPSDLAKELFTHKGSGTLVRRGERVLRATSWDELDLPRLKSLIESSFGRTLVPEYFDTTTLLRAYVSENYRAAVILTDEGQFGAGRLTYLDKFAVLDDAQGEGLGRAVWNVMREETPQLFWRSRHKNQVNIFYYAESDGCIKQEKWKVFWYGLENFEQIQHCVAHCATRQPTLLG

SEQ ID NO: 21608 - protein, 188 aa, Candidatus Phytoplasma vitis
MLSIKSLDEIVIMKEAGKILSLIRKELLKFLKVGISTFDLDMIAFDLMKKNGVISAFKGYQGFGGYICISVNEAVVHGLPSKTRILKLGDIVTLDIGIKHKGYCVDSAWTYSLGSVSNKIKQFIENTKKSLFLGIEQVKPGNKISDISRAIGKFGNKHNYGIIEIFSGHGIGKKLHEEPYIFNFDFVL

SEQ ID NO: 21609 - protein, 588 aa, Aspergillus nidulans FGSC A4
MDAQNGVYGQGYFMPNNYPAQAAYAQPHYGQPNLQSPQPAYQSRMGYNVSPNDGTNGLIQQFSNQDLNSNRTGFFNRSASPAQRPRTAGNTAPGQQQQPGHLAPPVPRSPRLPPENEELQRYPERFSENVHKRGKAAKELVNVFFHENIERARDRNMRSAELDKMMRDPNISQDAKVKEAEMVGKKESTFLRFLRTPETPANFQTIKIIGKGAFGEVKLVQRKSDNKIYALKSLIKSEMFKKDQLAHVRAERDILADSKDNPWLVKLHASFQDPAYLYLLMEFLPGGDLMTMLIKYEIFSEDITRFYMAEIVMAIEAVHKLGFLHRDIKPDNILLDRGGHVKLTDFGLSTGGKKTHDNSYYQNLLKNSTSKDKNRNSGYFNDAINLTVSNRGQINTWRKSRRAMAYSTVGTPDYIAPEIFNGQGYTYLCDWWSVGAIMFECLVGWPPFCAEDTTDTYRKIVNWRECLYFPEELTLSRESEGLIRSFLCDAEHRIGNEGGQYGGATQIKNHPFFRGVVWDQLRKIRAPFEPRLTSNIDVSYFPIDEIPQEDTSAIHRAQARAMPDEQNAEMSLPFIGYTYKAFNAFQAS

SEQ ID NO: 21610 - protein, 341 aa, Xanthomonas oryzae pv. oryzae KACC10331
MSLKHFLNTQDWSRAELDALLTQAALFKRNKLGSELKGKSIALVFFNPSMRTRTSFELGAFQLGGHAVVLQPGKDAWPIEFNLGTVMDGDTEEHIAEVARVLGRYVDLIGVRAFPKFVDWSKDREDQVLKSFAKYSPVPVINMETITHPCQELAHALALQEHFGTPDLRGKKYVLTWTYHPKPLNTAVANSALTIATRMGMDVTLLCPTPDYILDQRYMDWAAQNVAESGGSLQVSHDIDSAYAGADVVYAKSWGALPFFGNWEPEKPIRDQYQHFIVDERKMALTNNGVFSHCLPLRRNVKATDAVMDSPNCIAIDEAENRLHVQKAIMAALVGQGRRDS

SEQ ID NO: 21611 - protein, 188 aa, Candidatus Phytoplasma vitis
MLSIKSLDEIVIMKEAGKILSFIRKELLKFLKVGISTFDLDMIAFDLMKKNGVISAFKGYQGFGGYICISVNEAVVHGLPSKTRILKLGDIVTLDIGIKHKGYCVDSAWTYSLGSVSNKIKQFIENTKKSLFLGIEQVKPGNKISDISRAIGKFGNKHNYGIIEIFSGHGIGKKLHEEPYIFNFDFVL

SEQ ID NO: 21612 - protein, 366 aa, Zymomonas mobilis subsp. mobilis ZM4
MGFRCGIVGLPNVGKSTLFNALTETAAAQAANYPFCTIEPNVGQVAVPDPRLNQIAEIANSQRVVETQLGFVDIAGLVRGASKGEGLGNQFLGHIREVDAIVHVLRCFEDDDITHVEGKVDPVADAEIIETELLLADLESLEKRVPNLQKKAQGGDKEAKVAASVLGQALDLLRDGKPARLTQPKDVDEERHFAQAQLITAKPILYVCNVDEAAAAEGNEFSTKIFERAKAEGSRAVIVSAAIESEIATMEPEDRSVFLSDLGLKETGLGRIIRAGYDLLDLITFFTVGPKEARAWTITKGAKAPQAAGVIHTDFERGFIRAETIGFDDYIACGGDAGAREAGKLRQEGKEYIVTDGDIMLFRFNV

SEQ ID NO: 21613 - protein, 188 aa, Candidatus Phytoplasma vitis
MLSIKSLDEIVIMKEAGKILSFIRKELLKFLKVGISTFDLDMIAFDLMKKNDVISAFKGYQGFGGYICISVNEAVVHGLPSKTRILKLGDIVTLDIGIKHKGYCVDSAWTYSLGSVSNKIKQFIENTQKSLFLGIEQVKPGNKISDISRAIGKFGNKHNYGIIEIFSGHGIGKKLHEEPYIFNFDFVL

SEQ ID NO: 21614 - protein, 166 aa, Oryza sativa Japonica Group
MKEGGGGGGERRNILAKTIDRCRSSLGHRTTRRPASAAGGGGYGGAAVPAGFFAVLVGPEKERFAVRARCANHPLFRALLDQAETEYGFAGCEGPLELPCDVDAFMDVMWEMEQADPAASPRCGARFGGPAAAGSGRGYGGHGHHHQHQGYQMMSTPARLLVAGRS

SEQ ID NO: 21615 - protein, 249 aa, Escherichia coli
MRLKQVTPWFCLRRIPELGGSGTLGVVALTVMPVCRTLVIHFIILAFPLAISMNFQEWNRVFRYLSAVAGEDALRESIRLNTEVVSLRKDAGHRVIRCASEGKDTEDIFDRVIIATGELWQPRRPPLPGEENFSGTLITSRDYQEPEAFKGKNILIIGGGVSGADIASDLVPFARSVSLSVKKMGLYLPRQFPTGPNDMMHSYLGRCLLSQMNYEDFIGYLDTMMPDYMQAYRASSLLPDMANNNAVHV

SEQ ID NO: 21616 - protein, 235 aa, Schizosaccharomyces pombe
YWASSQLTQLFLSTDLESLEPTCLSKDTIYQWKVVQTFGDRLRLRQRVLATAIVLLRRYMLKKNEEKGFSLEALVATCIYLSCKVEECPVHIRTICNEANDLWSLKVKLSRSNISEIEFEIISVLDAFLIVHHPYTSLEQAFHDGIINQKQLEFAWSIVNDSYASSLCLMAHPHQLAYAALLISCCNDENTIPKLLDLIKSTDAFKVILCVQRIISIYYFEDIEAAALEHHHHHH

SEQ ID NO: 21617 - protein, 473 aa, Methylococcus capsulatus str. Bath
MAEPKTIHADVLVLGGGPGGYTAAFRAADLGRQVVLVERYPTLGGVCLNVGCIPSKALLHVAQIIHEAREAGEFGLRFGAPEIDLDQIRGFKDKVVKTLTGGLETLARQRKVTVVQGTGRFTGEHGMQVETTDGPVTVGFDHAIIAAGSRAVKIPDFPHDDPRLMDSTDALALQEVPKRLLIVGGGIIGLEMATVYHALGAGITVVELMDQLIPGCDADLVRPLHQHIKKQYENIYLKTRVSRIEPEAAGLKVFFEGEGAPESDLFDRVLVAVGRAPNGALIGAENAGVHVDAKGFIPVDEHQRTNVPHIYAIGDIVGNPMLAHKATHEAKVAAEVIAGKPSAFQALTIPSVAYTDPEVAWMGVTEAQAKAQGIEYEKAVFPWAASGRALGIGRKEGATKLLCDKTTKRVIGAGIVGPHAGELIAEAVLAMEMGADAEDIGLTVHAHPTLSETFAFAAEMIEGTITDLYIRKR

SEQ ID NO: 21618 - protein, 436 aa, Methylococcus capsulatus str. Bath
MAQEQTVVVPDIGDFKDVEIIEVLVKPGDKVAANDSLITLESDKAAMEIPSPYSGTVTELHVRVGSKVSMGTPILQLREDEGTDASGAASAPVEPAPAEPVSPPPAAAAPAAGDTQAVPASAPTPPAPMPVAEEGSGPAHASPAVRRFARELGVDVAKVRGTGPKGRILKTDVQSFVKQAVATAERTGGGGFAVPAMPEIDFAQFGPIERQPLSRIQKLSSANLHRTWLTVPHVTQHDEADITELEAFRNALKAESAKRGVKLTLLPFIIKAAVAALKDFPRFNASVAPNGEELILKRYYHVGFAVDTPDGLVVPVIRDADTKGIWDIAAELAAIGDKARGKKLRTADLQGGTFTVSSLGGIGGIAFTPIINAPEVAILGVSKAQLRPVFQDGQFVPRLMLPLSLSYDHRVIDGADGVRFVTHVSSLLADMRRVLL

SEQ ID NO: 21619 - protein, 427 aa, Methanosarcina acetivorans C2A
MKVSVIGSGYVGSVTAACFAEVGHEVICVDIDSKKTEQINSGIPPIYEEGLEELLQKYAGKKLIATTDYEFAVNETDISFICVGTPSAEDGSIDLSIVRAAAASIGAVLAKKEGYHVVVVKSTVVPETTEKFVLPILEETSGKKAGKDFGVAMNPEFLREGKAVHDFMHPDKIVVGAIDRRSGDMVSELYRIFECEITHTGPATAEMIKYANNSLLATKISFANEIGNICKNLGIDTYEVMEAVGKDFRISPKFLNSGAGFGGSCFPKDVKALIGKAKAIGYSPVLLESVIAVNERQPLLMTEILQRKIGDLAGKKIAVLGLAFKNETDDIRESRSIPVIAELLRLEARVSAYDPMATENMKRIFPAVEYFGSASDALIDADACLVMTEWDEFRNLDSEFQGMKRKIVIDGRRIVKAKNVDYEGLCW

SEQ ID NO: 21620 - protein, 575 aa, Rickettsia prowazekii str. Madrid E
MNDHILINVIILLGTAVFIVAILKRFRLSPVLGYLIAGAAIGDHGLKIVTYDQTKLLGELGVVFLLFAIGLELSFERLKAMRRYVFGLGSLQVLTTAIVIAGAMVLIDGNSSAAIITGGGLALSSTALVMQVIDENRSQSTQIGRISLAILLLQDLAVVPLLVIVPLLASNNKASLAVALGIAFLKAVTALLTIFIVGRVLLRPVFSFISSESNNTSELPISMTLLIVLSAAWATETFGLSLALGAFVAGVLVAETEFRLQAEESIYPFKSLFLGLFFMTVGMNIDALEMYEKISHILTLSIALICIKTLIITAFCILFGFNKGVAFYSGLLLSQGGEFGFILFSLGKDSGVLEESTADILLLVVTFTMALTPLLAALGKKIAEKVDKGLGKTPTQMIELGARDLTNHIIIAGLGNTGKMVARVLEAEGISYVILDLDDDRVKEELSNGLPVFKGDVSQADTLKALGTERAFAIILTMNNQVTIKKSLKTISSNYQDIPVVVKLKNLKNAREFYDLGATTIIPESYETGLQIGGTVLKNIGISEQEINRIKVQFRLGNYIIAKKEDALSEVEDND

SEQ ID NO: 21621 - protein, 455 aa, Oceanobacter sp. RED65
MNDTPKSLAQEDSQYVLHPASSITALLDQGPQMIVSAKGSTITDADGNELLDAVGGLWCVNAGYGRPELAQVVKEATEQLAYYHTFSNASNPWQVQLAKKLLQLAPSNLGKVYFGSGGSDANDTLVKIAWHYHSLRGKSTKTKVIAREQAYHGTSISTASLTGLGGFHKEYPLPLDFVLHTDCPHFYTRGLEGETEQQFCDRLIDNVAKLIEKEGADNIAAFFAEPIHAAGGIIEPPAGYYPKLKTLLKQHDILLVADEVVCGYGRLGTWFGSDQLDIEPDMLSTAKGLTSGYFPMSAAFITDEIFDVLKEGSAKIGAFSHGYTYSGHPVGCAVALANLNIIENEGLVERAKENGAYLHARLLEELGDHKNVGEIRGRGLLAGVQLVKDKVNKELPDPADKWPAKVTAMMRKNGVIVRPLPSVGTLAISPPLVITRDEIDRLVSEIKAAIDAEIA

SEQ ID NO: 21622 - protein, 318 aa, Methanosarcina acetivorans C2A
MKSISTQCKNKFLRNFSFYGELTVTIKKALIPAAGLGTRFLPATKSMPKEMLPIIDTPVIQYVVEEAIASGIEDIIIITGRGKRAIEDYFDDSPELEMHLAKKNQTDMLKLVRDISSLVDIHYIRQKEPNGLGDAVLRAENHIGNEPFAVLLGDDIIVNDKPCTAQLIENFEKYGRSTIAVEEVPYEKLNSYGIIKGRPLDDSLYVLEDIVEKPSPEEAPSNIGAIGRYVFTPEIFDCIKKAGTGVGSEIQLTDGIRLLSRSQMIYACRFKGKRFDTGDRLGYIKSIIDFALQNESLRDNVLEYLREILAVEKVTAEK

SEQ ID NO: 21623 - protein, 336 aa, Fusobacterium nucleatum subsp. nucleatum ATCC 25586
MEQKKMKYLENLVGKTPMLELIFDYKGEERRIFVKNESYNLTGSIKDRMAFYTLKKAYEKNEIKKGAPIVEATSGNTGIAFSAMGAILGHPVIIYMPDWMSEERKSLIRSFGAKIILVSRKEGGFLGSIEKTKEFAKNNPDTYLPSQFSNLYNSEAHYYGIGLEIVNEMKSLNLNIDGFVAGVGTGGTVMGIGKRIKENFSNAKICPLEPLNSPTLSTGYKVAKHRIEGISDEFIPDLVKLDKLDNVVSVDDGDAIVMAQKLAKCGLGVGISSGANFIGALMLQNKLGKDSVIVTVFPDDNKKYLSTDLMREEKVKEDFLSKDITLKEIKNVLRVI

SEQ ID NO: 21624 - protein, 342 aa, Corynebacterium diphtheriae NCTC 13129
MISRRSFLGACALASVAGAVQTCSNKAGSAGVRNDASGHLIVLGTGGTIACTNVDGALVPTVSGEELVAGVYDTFDKDKLSIDVRQVSQLDSSAMTLKDTDMIITEVLKAVKEDGVTGVIVTHGTDSMEESAIAVDTFLDSDVPVVFTGSMLPFDDPKTDGPANLLLAVRTATAPENRGKGAFIAFGEKTLRARGAYKSNANSVDGFDSNADNELTRPAALAYKPLEHQRVDIIAAYPGAPRALVDASLASGAKALVIEGMGAGNVGGDIALAISDALDKKIPVVMSTRVDAGRVEGTYGGAGGGATLAAKGVIGADILRAGQSRILLACALATKTDPKTLF

SEQ ID NO: 21625 - protein, 148 aa, Dehalococcoides sp. BAV1
MSFKRSLTAVLALCMVFTGTLTGCDTDRTDPLDNTDSNLTKVQDISVAEAKDLIDRNTNSTEFVILDVRTPSEYAQGHIAGAVNLDYYASFENSLFALDKNKTYLVYCRSGNRSVSASQLMVDNGFTSIYNMLGGINVWIANGLPLAT

SEQ ID NO: 21626 - protein, 317 aa, Dehalococcoides sp. BAV1
MCRRRKVNTKDLLSISDLSPDDIGRLLSDAVELKARGWNNSLSGKTLALVFEKPSLRTRVSFELAMKQMGGEALYLSPAEVGLGKREPVADVARVLSRFVDVIACRTFGHETLVQLAKYADIPVINALSDLEHPCQALADILTIYEKKGDLKGLSLAYIGDGNNCANSLLLACAMTGINCRLASPKGYLVDKDLFARAEAYAEDSGAELYSETDLKTALRGADVIYTDVWTSMGQEAETEKRLKDFTGFQVNAKLVSMAKKDAIIMHPLPAHYGEEVDREILECPQSVIFDQAENRLHAQKAVLRDMLGGLEIGGRH

SEQ ID NO: 21627 - protein, 370 aa, Leifsonia xyli subsp. xyli str. CTCB07
MLPSPKPHSRQWRGVLHEYADRLSVSASTPIVTFGEGGTPLIPAPALSARTGATVYVKFEGMNPTGSFKDRGMTMAISKAVEHGAKAVICASTGNTSASAAAYAARAGVQAVVLVPEGKIAKGKLSQAIAHNGRLLQVQGTFDDCLDIARDLAASYPVHLVNSVNPDRIEGQKTAAFEIVEALGDAPDFHVVPIGNAGNYTAHHRGYTEELQRGEATKLPRMFGFQAAGSAPIVLGHPVKDPDTIATAIRIGNPASWELALNARDDSGGYFGAIADAKILEAHRILSAEAGVFVEPASAISVAGLLERSEAGVIPAGATVVLTVTGHGLKDPQWALRTADGSEVQPTFVPVDTAAVAETLGLTSNTGVSA

SEQ ID NO: 21628 - protein, 462 aa, Xanthomonas campestris pv. campestris str. ATCC 33913
MSFESLGLAPFLLRALAEQGYETPTAIQQQAIPLVLAGHDLLAGAQTGTGKTAAFGLPLLQHLGTTPQPVNGPRKPRALILTPTRELATQVHDSLRGYSKYLRIPSAVIYGGVGMGNQLDALRRGVDLLIACPGRLIDHIERRSVDLSGIEVLILDEADRMLDMGFLPSIKRILTKLPRQDRQTLLFSATFEENIKQLALEFMRNPMQIQVTPSNTVAESITHRVHPVDGARKRDLLLHLLAQDSREQTLVFARTKHGSDKLALFLEKSGIKTAAIHGNKSQGQRMRALSDFKAGRVTVLVATDIAARGIDIDQLPKVINYDLPMVAEDYVHRIGRTGRNGSTGEAISLVAQDEAKLLRQIVRMLGRDVEIRDVPGYEPQTPIRWGNSAPGRAEQPGGDRAPRKSHARRPHGDAPRQAHAHAGPKKPGGQRSSGPRQATAGAGAGRRDGGRGGSGRPASRGA

SEQ ID NO: 21629 - protein, 359 aa, Dehalococcoides sp. BAV1
MSKVCIIGTTTWGITLGTIIAHKGREVMLWARTEDEAVLLSTQRRPADFLPENYHFPEFMNVTASLEEAIAGADMVLLAVPSQRMRPNIRLVAPLLTKSMLICSAAKGLEIGTAKRMSQVITDEISPDFAKNICVLSGPNLAMEILKGLPAVTVLAADTEKTAKKAAKLITAANFSAYTNTDIIGVELGGSLKNIIALGAGIVDGLNLGNNAKSALITRGLTEISALGAALGANPLTLSGLAGLGDLIATCSSNLSRNHFVGVELTKGRSLNDIMYNMSNVAEGVSTTAVAYEMARSMDLEMPVTENIYNVLYNNADPKEAARILMDAQATHELAGRKWNLFKMFRKRKARKTPELNPD

SEQ ID NO: 21630 - protein, 359 aa, Dehalococcoides sp. BAV1
MVNKRDYYEVLGLERSASDEDIKKAFRKMAMKHHPDRNHEEGAADKFKEVNEAYEVLSNPEKRAAYDRFGFSAGADSFGQGGFENFDFGGLGSIFETFFGGATQGAKRGPRRGPDMSYDIKISLEEAATGVEKDITTERLEYCTECSGTGAKAGTSPVKCTSCNGTGQVYQVQKSVFGRFTSVTPCPKCRGEGTIIGEPCTKCRGTGKEYVKRTVQVKIPAGVADGNQIRLNGYGGVGDKGASAGDVYINVGIAEHADFKRDEDDVIYELEINFAQAALGTEVNVPGLNTEHKLKIPSGSQNGKYFVLKGKGIPHLNRFGSGDEMVHLNVVTPEKLSRKQKQLFEELEKSFAEDKKQAT

SEQ ID NO: 21631 - protein, 531 aa, Mycobacterium smegmatis str. MC2 155
MTALHSTIDATSPGFNEAAAVMTAKLSELDAEHAKALGGGGPKYVDRHHARGKLTARERVELLLDPDSPFLELSPLAAWGTDFAVGASVVTGIGAVEGVECLIVANDPTVKGGTSNPWTLKKILRANQIALQNRLPVISLVESGGADLPTQKEIFIPGGQMFRDLTRLSAAGIPTIALVFGNSTAGGAYVPGMSDHVVMIRERSKVFLAGPPLVKMATGEESDDESLGGAEMHARTSGLADYFALDEPDAIRIGRRIVARLNWRKQGPAPAEVVEPRYNAEELIGIVPADLRVPFDPRDVIARIVDDSDFDEFKPLYGSSLVTGWARLWGYPVGILANARGVLFSEESQKATQFIQLANRADTPLLFLHNTTGYMVGKQYEEGGMVKHGSMMINAVSNSTVPHISLLIGASYGAGHYGMCGRAYDPRFLFAWPSAKSAVMGGTQLAGVLSIVSRAAAEARGQTVDEDADAALRAAVEAQIEAESLPMFLSGRLYDDGVIDPRDTRTVLGMCLSAIANAPVEGTSNFGVFRM

SEQ ID NO: 21632 - protein, 500 aa, Medicago truncatula
MSDRTKVVIRHLPPTITQDSLLPLIDSSFAGRYNWFSFHPPKITSHNHTSRAYIDFNTPDDVIDFAHFFNGHLFLNQKGTHFKVTVEYAPSQRVPNHSSKKPEDARDGTIFKDPDYLQFLQQIAKPVENLPSAEIQLDKREAVRKDIPIVTPLMDFVRHKRATKNGPRQQQHRSLSNGKVTRRSLTTSNGSSTSAPSRRGYTKNRLSTTMYVARDPGKSSTVQDKSTYILVPRQGDQNPSNKSSNTASSDGNQTFDENGIAGSNDSGKKKLLLLKGNERETITVSDSDSMSQHHTSSTKTILSSTALKQNQRHEGRGRIIKSILTNKDFRQSQSSRAHSERQIQTSNLEREKQSTRPVHVQLILKGTDGAPENRITVHGLHVSSERQERRFRHKDRPDRGVWTSRSNGGGESLSSSASSQVDPLEGGHTELKHDTPSARSGEVKSLGSFRASHSSENGFSKHFGRRGPIYGVKDVDGYSILSEGKHPRKSSTSAYGSNEC

SEQ ID NO: 21633 - protein, 170 aa, Candidatus Pelagibacter ubique HTCC1002
MFYDLEDKKVKNLGDNWSASNASIIGDVTLEKNTSIWFNVTLRGDVENIHIGEGSNIQDGSVLHTDPGYPLKIGKDVTIGHLVMLHGCTIEDNSLIGIGAVILNGAKIGKNCIIGANALITENKVIPDNSLVVGSPGKIVRQVSKEEAKSITENAIHYQDNWKKYSKSVF

SEQ ID NO: 21634 - protein, 440 aa, Burkholderia vietnamiensis G4
MHETLWYLIVGAVLMGMGVATSALRHLPCSSAMIYLALGIALGPAGAGLLHLDIERDAALLREIVEIALLVSLFAIGLRLRVPLSDKLWLVPCRLGLLAMIVTVPLLAGCAMLALGLGWGPALLLAAILAPTDPVLAHDVQVHDPGDRDLVRFALSGEGGMNDGIALPFALAGLALCGAAEMPHGQPALSGTFLLAALWGTAGAAAIGGVLGASATRAIGWLRTRYAQALGFEGFFALALIVLSFGAAQLAQTFGFIATFAAGVAMRRVEYRASGGRRPREVIGRIDSEDVVATEKHPEKVHAFMTESVLDFTIELERIAEAVVMTMIGSVLGTLTAPLVTWGAAALAALLFFAVRPLAVSLTLAGSRATPAQRRLMAWFGIRGIGSFYYLLFALEHGPSSAVRPLAAPVLAVVSASVIAHGISATPLMDWYYRLQQRRR

SEQ ID NO: 21635 - protein, 294 aa, Lactobacillus acidophilus NCFM
MKVRKAIIPAAGLGTRFLPATKAMPKEMLPIVDKPTIQFIVEEAKAAGIEDILIVTGKNKRAIENHFDSNPELEQDLEATGKVKLLKLTQDITNLGINLYYTRQPHPAGLGDAIYRARSFVGEEPFVVMLGDDLMKDKITLTKQLMNDYDKIHASTIAVMQVPHKEVSKYGVIDPEGKVDKDLYNVKKFVEKPAVDKAPSDFAIIGRYLLTPEIFEILENQKPGRGGEIQLTDAIDTLNQTQRVFAHVFRGQRFDVGNKEGYLETSIQYGLRHPETRDALKKYIIDLGKKLEKE

SEQ ID NO: 21636 - protein, 421 aa, Zymomonas mobilis subsp. mobilis ZM4
MNNPSWLKDGLSHIWLPYTQMQTMTAPIPAIATKESRIYLADGRELIDGIASWWTACHGYNHPYIYKKAEEQLREMPHIMFGGIVHEPALRLASRLAKILPDNLNHVFFSDSGSVAVEVALKMAMQYWLNKGDTKRKKLLAFRGGYHGDTMATMAICDPEEGMHSLFTGILPEHYIVDLPKDEESIARFDLFLEQHHSGIAAIITEPLIQGAGGMLFHSPEVLKRLRYFADKYNLLLIFDEIFTGFGRTGSMFAFEQANVAPDIITLSKALTGGTMALAATVATTSIFNSFLSDNPIHALMHGPTFMANPLACACALASLDLFEQENRLEQVAKISQQMTDELAPCRALPGVKDVRVMGAVGVVELEKITDMNKLKSQLLEQNVWIRPFRNIVYLTPAFTITPKELQNLTAAIYKVLSQAI

SEQ ID NO: 21637 - protein, 320 aa, Candidatus Pelagibacter ubique HTCC1002
MDCTDRHERFFLRLISKNTLLYSEMVVSEAIHRGDKKKLLEFNINEKPIALQIGGSSPTLLAEATKAGEDFGYDEINLNLGCPSKKVEKNKFGACLMKEPNLVADCLSKMQSVTKLPVTIKTRIGYDDTEDYENLHHFISTLKSTGVKTFIIHARKAILGKFTPKQNLNIPPLKYDFVYRLKKDFPNEEIIINGGITTTDQMKDHLDKVDGVMIGRAAYHTPYLLADIERDIFNNENVPSRQDVIEQLLPYVREEIKKGTRLNQIMRHTLGLFHGQTGSSFWKRYLSENMCVRDADVKKIDHIMDKIKYNNVDTSVSQSA

SEQ ID NO: 21638 - protein, 440 aa, Pseudomonas aeruginosa UCBPP-PA14
MPAPLSPLIVRMRHAIEGCRPIQIRGRVTQVTGTLLKAVVPGVRIGELCQLRNPDQSLALLAEVIGFQQHQALLTPLGEMLGVSSNTEVSPTGGMHRVAVGEHLLGQVLDGLGRPFDGSPPAEPAAWYPVYRDAPQPMSRRLIERPLSLGVRAIDGLLTCGEGQRMGIFAAAGGGKSTLLASLVRNAEVDVTVLALVGERGREVREFIESDLGEQGLRRSVLVVATSDRPAMERAKAGFVATSIAEYFRDQGRRVLLLMDSLTRFARAQREIGLAAGEPPTRRGYPPSVFAALPRLMERAGQSERGSITALYTVLVEGDDMSEPVADETRSILDGHIVLSRKLAAANHYPAIDVLHSVSRVMNQIVDDDQRHAAGRLREWLAKYEEVELLLKIGEYQKGQDSEADQAIEKIGAIRQWLRQGTHETSDYAQACAQLRSLCA

SEQ ID NO: 21639 - protein, 187 aa, Pseudomonas syringae pv. tomato str. DC3000
MPIINSQVKPFKATAFKNGSFVDVSDADFKGKWSVVFFYPADFTFVCPTELEDLADNYDTFQKLGVEIYSVSTDTHFAHAAWHNTSPAIGKIQYTMIGDPTLAISRNFDVLIEEAGLADRGTFVINPEGQIKIVELNDGGVGRDASELLRKIKAAQYVAAHPGEVCPAKWKEGEATLAPSLDLVGKI

SEQ ID NO: 21640 - protein, 143 aa, Triticum aestivum
  misc_feature (13)..(13): Xaa can be any naturally occurring amino acid
RVGGRGWVHYAKXTEECGVEVQIVGDDLLVTNPTRVAKAIQEKSCNALLLKVNQIGSVTESIEPAKMSKHAGWGVMTSHRSGETEDTFIADLAVGLSTGQIKTGAPCRSERLAKYNQLLRIEEELGDAAVYAGLKFRAPVEPY

SEQ ID NO: 21641 - protein, 188 aa, Candidatus Phytoplasma ulmi
MLSIKSLDEIVIMKEAGKILSFIRKELLKFLKVGISTFDLDMIAFDLMKKNGVVSAFKGYQGFGGYICISVNEVVVHGLPSKTRILKLGDIVTLDIGIKHKGYCVDSAWTYSLGSVSNEIKQFIENTKKSLFLGIEQVKPGNKISDISRAIGKFGNKHNYGIIEIFSGHGIGKKLHEEPYIFNFDFVF

SEQ ID NO: 21642 - protein, 124 aa, Brassica napus
MAGRLTAAGSRILGGGGARAAASALRHRAGMGLPVGRHIVPDKPLPVNDELVWDNGTPFPEPCIDRLAPHIGKYEALAWLCGGLGFFAALGMAAVVNDKASNIPYTPKVYPYDNLRAELGDRPK

SEQ ID NO: 21643 - protein, 536 aa, Candidatus Pelagibacter ubique HTCC1002
MIKTTLSSFAKSIGFNSQNYIPKEGASFSLFRIEVLSGLTVALALVPEAIAFAFVAGVAPLSGLYAAFIVGLITAVFGGRPGMISGATGALAVVMVSLVMDHGAQYLFATVVLMGILQLLAGVFKLGKFIRMVPQPVMLGFVNGLAIVIGISQLSQFKTLNAMGQLEWISGNTLYYSVGFVILTMLIIWLLPKITKAVPATLAAILVTSVLVLALKIDIPSVGDLASVKGGLPIFSIPSVPLNFETLKIIFPYAFILSAIGLIESLLTLNLVGEITNKRGGASQECLAQGFANTVTGFFGGMGGCAMIGQSMINVKSGGRTRIAGIAAAVFLLIFILYTSNYIEMIPIAALVGVMFMVVIGTFAWNSLKILFFVPKSDALVIVLVTVVTVLEDLAVAVIVGVIVSALVFAWKSASRIRAVERPSVREQGAKVYEIEGPLFFSSTDSFLELFKPEEDPEVIIIDFAGSKVIDQSALKAIEDIADKYNSFGKKVKLRHLTKDCHRLLSRAGQLVVDSDDDPDYGIAVDYDVKLGIFGR

SEQ ID NO: 21644 - protein, 276 aa, Ralstonia solanacearum GMI1000
MTDTQPAVTLGDGARMPQLGLGLWRTPAGETAGLVRTAIEAGYRLVDTAAAYGNERGVGEGVRAAGAEPAVFVTTKLWNEDQGYDRTLRAFDESLRCLGLPAIDLYLIHWPAPSRGRYVESWRALIRLRDEGRARSIGVSNFGAEHLARIIDETGEAPAVNQIELHPWFQQRALRAFHARHGVRTESWSPLGQGGLLHDLTVREIAARHGKTPAQVVIRWHLDNGLIVIPKSAHPDRIRENIAVFDFCLTPADQAAIAGLDRADGRIGPDPVAAGF

SEQ ID NO: 21645 - protein, 375 aa, Chlamydomonas reinhardtii
MAQAPQAGSSSGSSNIPVKQDCPIPGKARYVLWRSTFEIDDKYVPIKAIGKGAFGVVCSAKDTKTGEKVAIKKIGNAFENLIDARRTLREIKLLRHLRHENIIQVKDVLKPPSRDNFNDVYIIYELMDTDLHQIIRSSQTLTNEHFQYFVYQVLRGLKYVHTANVLHRDLKPSNLLLNASCDLKIADFGLARTGTEKQNFMTEYVVTRWYRAPELLLSCDTYTTAIDVWSVGCILAELLGRKPLLPGKDYVDQLKLIIKTLGPPSEEDLGFITSSKARAYIRALPPSEKINFRKLFPDADPLAIDLMEKMLQFDPRKRIDVIQALKHPWLAQLHEEAAEPAAAGEFVLDFDEMTLNETGVRQMIYDEAVNHYGHK

SEQ ID NO: 21646 - protein, 602 aa, Yersinia pestis CO92
MEGTGLLTAVLVFLFAAVVAVPIAQRLGIGAVLGYLIAGIAIGPWGLGFIRDVDEILHFSELGVVFLMFIIGLELNPAKLWQLRRSIFGVGAGQVVITAAVLGALLYFTQFAWQAAVIGGVGLAMSSTAMALQLMREKGMNRNEGGQLGFSVLLFQDMAVIPALALIPILAGNEGGANDWVKIGLKIAAFAGMLIGGRYLLRPLFRYIVASGVREVFTAAALLVVLGSALFMDALGLSMALGTFIAGILLAESEFQHELEIAIEPFKGLLLGLFFISVGMALDLGVLFTHLLDVLLGVLALVFIKSAILYGLARVFGLRRSVRLQFAGVLSQGGEFAFVLFSAAFSQRVLNAEQLALLLVVVTLSMMTTPLLMQVIDRILVRRYNAQEESDEKPFVEDNDPQVIIVGFGRFGQVIGRLLMANKMRITVLERDVSAVSMMRKYGYKVYYGDATELELLRAAGAEKAKAIVITCNEPEDTMALVHLCQQHFPNLHILARARGRVEAHELLQNGVKDFTRETFSSALELGRKTLLELGMHPHQAYRAQQHFRRLDMRMLRELMPQHHGDVAQISRIKEARRELEDIFQREMLHESRQLDGWDEYE

SEQ ID NO: 21647 - protein, 452 aa, Pseudomonas syringae pv. tomato str. DC3000
MAFDFDLFVIGAGSGGVRAARFAAGFGARVAVAESRYLGGTCVNVGCVPKKLLVYGAHFSEDFDHAKGFGWSLGEASFDWSTLIANKDREINRLNDIYRKLLVDSGVTLLEGHAKIVGPQQVEINGQTHSAERILIATGGWPQVPDVPGREHAITSNEAFYLKALPKRVVVVGGGYIAVEFASIFNGLGADTTLVYRGELFLRGFDGSVRSHLHEELLKRHMTIRFNSDIERIDKQSDGSLLLSMKGGGTLETDCVFYATGRRPMLDNLGLDSVDVKLDEHGYIKVDEHYQTSEPSILALGDVIGGVQLTPVALAEGMAVARRLFKPEQYRPVDYNHIPTAVFSLPNIGTVGLTEEDAIKAGHDVQVFESRFRSMKLTLTDDQERTLMKLVVDAKTDRVLGCHMVGPDAGEIVQSLAIAIKAGATKQVFDDTIGVHPTAAEEFVTMRTPAKR

SEQ ID NO: 21648 - protein, 279 aa, Pseudomonas syringae pv. tomato str. DC3000; identical to SEQ ID NO: 1267

SEQ ID NO: 21649 - protein, 514 aa, Oryza sativa Japonica Group
MAMAAAMGVASPYHAAHAAASTSCDSLRLLVAEGRPRRPRGVASSSSSSSSAGRRRRPLVFSPRAVSDSKSSQTCLDPDASTSVLGIILGGGAGTRLYPLTKKRAKPAVPLGANYRLIDIPVSNCLNSNISKIYVLTQFNSASLNRHLSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLPSGTVI

SEQ ID NO: 21650 - protein, 187 aa, Leifsonia xyli subsp. xyli str. CTCB07
MFRVCEDLGNARKHDPAARGPVEVAIVYSGLHAVWAYRVAHRLWRAGLRTPARMLSQFARFLTGIEIHPGARIGRRFFIDHGMGVVIGETAWIGDDVLLYHGVTLGGRGSEHGKRHPTVHDGVVVGAGAKVLGAITIGARTVIGANAVVVHDAPPDSVLTGVPARPRPHLGREQIAGDDWLDPALYI

SEQ ID NO: 21651 - protein, 1859 aa, Gibberella zeae PH-1
MAPRIEFSIEQIRNKARKDLLYLLEGVRGKKNVILDQSLVGPIGTIVKVATLQEYGVDKFFILENDNADTSQRNVVFISRGECGRHAETIAAQIKRIQRESQTGHEFHIFWIPRRTLVSDKLLEDAGVLGDVNISELPLSFFPLEKDVLSLELDGSFRDLYLSKDVTPNFLMAKALMEIQQNHGLFPRVIGKGDNAKRVADLLSRMRQELLAGEGTAEANKIGLTPSTTNESVIIIDREVDFVTPLLTQLTYEGLIDEVFEIHNNQTKVDTTVVGAPAQASAATSQSRKRTIQLDSTDKLYEQLRDANFAIVGSLLNKVARRLQKVQSDYESKHKTKTIAELKDFVSQLPGYQQEQQSVKTHTGLAEEIMKHTRTDEFKGLLEVQQNLAAGADPSSQFDGIEELISRDAPIAQTLRLLCIYSCISGGIRPKEFDQFKRLILQGYGYQHLLTLSNLEKLQLFLSKSSPLAGMIPIPGTNVGAVTIGSKTNYTYLRKQLRLIVDEVQEDDPNDVSYVYSGYAPLSIRLVQCILQKQYLLSVTKGNNASAAGAPPGVGTQGWQGFDEAVKHVRGQTFYEHQKGEDKAVKARALLSGSGNKQTVFVVFVGGITFTEIAALRFIAKQEEGRRNIVICTTSIINGNKMMESAIEKESFTKEKYCQLAGCCFGMFYVGASRLIKKRQDTWLRRAQDQENNDKTMLVVRVEVRIVAVMGTRPTAESISKRSWYRNEPINYKFLSLVIDSLTSNDNGSSQTNRDQYQKKPRTNAAMGTDFGQSFRKGIGIRKRDVDEGNVIDSVPPSDTSPISGVPGRISPPITPDVVSVPQSRQTSMEIASEIAPEIVVWTEDMDIDMDIDNASPVESDDELSSLKTDPEEEPLQVDADPTPMQTSTNGGAVGSFPSSLSNLTELSDLSSIPSTASSKATTPTPVEAEGSQDQEQPIDEQPPSHQQSPSHEAERYNFNIRSKASIPTDISPYRYASECISAAESSRLNPYALHPEEYHLLRHHISYAQVTTYLNVRNGILRLWSKRPWVGVTRLEAVGCANARWFDAASVCYDWLVRRGYINYGCVQVPETETEDSIAPVRRQKTIAVIGAGISGLACGRQLEGLFKQFADRFHERGEPPPRVVVLEGRSRVGGRVYSREFQTKPKEPMPAFKGKRHTAEMGGMIITGFDRGNPINILLRGQLSLPYHALTADTTIYDSSGRAVDPVRDQLVEKLYNDCLDRVSEYKHKNRTAKLIEGRRDLIEEGRDSPGDGSKTMFQEEEAAAAQPYAAPVAQQNVPEKVNLIPVSSDKLTGRVHMEPGTPATIKASDKAKLMGWTIRDSADGENIDLVPAVNEEGATLGSVLDSAISQYKQIVGLNAQDHRLINWHVANLEYSNATSLHNLSLPLWDIDAGNEWEGSHTMVVGGYQSVARGLAQCPSPLDLKTKFPVKSVSYHTGEGMASAAIECEDGSVVDADAVVCTVPLGVLKQNNIVFNPPLPSWKTDVVERLGFGILNKVVLVYDEIFWEQDRHIFGVLRESTNRHSTSQKDYATSRGRFFQWFNVSNTTGLPCLIALMAGEAGFETEHSSNDSLVAEATEVLRRVFGKDVPYPVEAMVTRWGSDRFARGSYSSAAPGMQPEDYDVMARPVGNLFFAGEHTIGTHPATVHGAYLSGLRAASEVLEALIGPVEVPTPLILPRDSVLLRKRKEPAKDLKPARLQAYEQDIQAHIQAKIGDRPSRPAKVASNPYILYSKDLFDVARKRCEENRKPGRGGRAVPNEVRIMTSKMWKEATPEERKPYEDQATEMKRGYAEAVQSWNQATEKWDRESAALRTAYEKENPFDSYKIQMEDPREASYKQRRTRNISYAEDGDSDVGF

SEQ ID NO: 21652 - protein, 145 aa, Prochlorococcus marinus str. MIT 9211
MLNPSRYRILAIGKTRKAWIQNGLNLYIKRLPGLTITELKDSDLKKEAQSIRSSIKTNELLIILTEEGESLTSLGFANRLKSLGSSRLLFVIGSANGLDSEIKAMANWSISLSPLTFPHEIARLLLIEQLYRAKNICEGGSYHRN

SEQ ID NO: 21653 - protein, 432 aa, Corynebacterium diphtheriae NCTC 13129
MSHPPIHGENASSPELEPTPQGANSVLIFSTVSFTMMFAVWLMFGILGTPIQKEFGLSDTQLSWILAVAILNGSMWRLPAGILADKIGGRKVMLGITLFSAVASLGVAFSQNYTMTLVLAFLVGFCGNSFTAGAAWASAWFPKHKQGFALGVFGAGNVGASVTKFIGPVIIASTAGATYFGFIPAGWRLIPIIYSVTLVIVAILMMIYTPKVDRFGSSGRSLAEMLLPLKQVRVWRFSLYYVVVFGAYVALSATLPKYYISNYDVSLAAAGLLTAIFIFPASLLRPVGGWFSDRYGARRAMYGTFFVMGTAAGLLCLPSNIINIFVFTLLIFSLGCAMGVGKAAVYKHIPEYFPHDVGAVGGLVGMLGGLGGFFLPPLFAYTKAWTGWSTSPFIVLLILVAVSALWMHVTVHRMLHSHVPELKHHMEVPATQ

SEQ ID NO: 21654 - protein, 259 aa, Rickettsia prowazekii str. Madrid E
MTIKIHTEKDFIKMRAAGKLAAETLDFITDHVKPNVTTNSLNDLCHNFITSHNAIPAPLNYKGFPKSICTSINHVVCHGIPNDKPLKNGDIVNIDVTVILDGWYGDTSRMYYVGDVAIKPKRLIQVTYDAMMKGIEVVRPGAKLGDIGYAIQSYAEKHNYSVVRDYTGHGIGRVFHDKPSILNYGRNGTGLTLKEGMFFTVEPMINAGNYDTILSKLDGWTVTTRDKSLSAQFEHTIGVTKDGFEIFTLSPKKLDYPPY

SEQ ID NO: 21655 - protein, 158 aa, Gibberella zeae PH-1
MAGATRDRRLVKELGKMHKDGMPPGITLIERNDSVAGDWFVDIQVLDENPLYKDQIYRLKFHFPKMYPIEPPEVTFNKQTDRPIPMHPHIYSNGIICLDLLGQQGWSPVQSVSSVCMSIQSMLTSNDKDERPPGDEDFVRGNRQRPRDIEFLYHDNTV

SEQ ID NO: 21656 - protein, 264 aa, Streptococcus pyogenes MGAS315
MENMFSLQGKIALITGASYGIGFEIAKAYAQAGATIVFNDIKQELVDRGMAAYRELGIEAHGYVCDVTDEAGIQQMVSQIEDEVGVIDILVNNAGIIRRTPMLEMAAEDFRQVIDIDLNAPFIVSKAVLPSMIAKGHGKIINICSMMSELGRETVSAYAAAKGGLKMLTKNIASEFGEANIQCNGIGPGYIATPQTAPLRERQADGSRHPFDQFIIAKTPAARWGTTEDLAGPAVFLASDASNFVNGHILYVDGGILAYIGKQP

SEQ ID NO: 21657 - protein, 456 aa, Xanthomonas campestris pv. campestris str. ATCC 33913
MAIHSSVLELIGNTPIVKAQRLDTGVCELFLKLEASNPGGSIKDRIGLSMIEAAEQRGDLKPGATLVEGTAGNTGLGLALVAQQKGYRLILVVPDKMSREKIFNLKAMGADVVLTRSDVAKGHPEYYQDLAAKIASETPGAYFINQFGNPDNPAAHEFGTGPEILAQMDGQLDAIVFGCGSSGTMTGLSRAFATASPQTELVLADPVGSILTQYIEEGTVSEKSGSWLVEGIGEDFLPDISDFSRVKKAYSISDAESFHTARELLAKEGILGGSSTGTLLAAALKYCREQTTPKRVLVFVCDTGNKYLSKMYNDYWMLDNGFLEREQHGDLRDLILRPYNKRDTVVVGPKDLLTTAYQRMKLYDVSQLPVIDNGELVGIVDESDVLLHVYGDEARFRDPISTAMVSKLDRLDVASPIEALLPVFDRGQVAIVMDGNQFLGLITRIDLLNYLRRRVQ

SEQ ID NO: 21658 - protein, 333 aa, Streptococcus pyogenes MGAS315
MFKLLLVGEPLIRVSPNQFQPLTNACDAQLFFGGSEVNIARTLGGFGLETRLFTALPDNSVGHAFHQFLKQIGVDMTLTAWQGNRVGLYYLENGFGCRASQVYYDRCGSSFSALDKDSLDLAAIFEGIRHFHFSGISLALGKKTQDLIEILAREARKRQVCVSFDLNFRSNMIAVADAKRLFSHFAQYADIIFGMEPLLLDSDDFDMFDRNKADATMIRERLAGLYQRYQLQAIYHTERSNDAQGSNRFKAYAYDGQFYESCEVTTPVLQRVGSGDAFVAGLLYQLLEGNEKQRNLDFAVATASLKCTVAEDQLYHSVQQVEAVLANQRDVQR

SEQ ID NO: 21659 - protein, 330 aa, Dehalococcoides sp. BAV1
MANEKNLYETLGVPKTASADEIKKAYRKLARKYHPDLNPGDKASEETFKKINQAYEILSNPENRTKYDKYGEQWQYGEQYEKARASQQQTQGSPFGGYDFNFGSSEGGGFEDILSQMLGGRTGRRRSHPQPGQSIEQPVDISLEEAASGTSRLLSFQMQKPCETCGGSGAKDKKVCPTCQGTGINPGIERLEVKIPAGVNTDSKIRLAGKGGYGQAGGQRGDLYLRIHVRPHEKFERKDDDLTVNVPVNLTTAMLGGEIFIPSLKGKLALKIPAETQNGRTFRLKGQGIPHLGKDGSGDLLAKVSIVLPEKLTDTERDLFEKLRQLRPDS

SEQ ID NO: 21660 - protein, 135 aa, Oryza sativa Japonica Group
MAGKKEEEEAVVYRGDKLILRGLRFHGTHGVKPEEKKLGQKFVIDVDAWMDLAAAGDSDDISDTVSYTEIYRIAKNVVEGPSHNLLESVAQSIANSTLLKFPQISAVRVKVEKPHVAVQGVLDYLGVEIFRQRKA

SEQ ID NO: 21661 - protein, 346 aa, Hydrogenophilus thermoluteolus
MRHTKIVATLGPASSDPATLERLLLAGVDVVRLNFSHGTADEHRARASLVRALAQQTQRPVGILGDLQGPKIRIGRFTTNAVTLSKGQRFRLDCDLAPGDATRVGLDYPELIDDVEVGDILLLDDGKIRLQIVEKCADALITQVLVGGTLSNHKGINKLGGGLSAPALTAKDRAVPISRSLPKSASITVAVSFVKHAEEMHEARHLARAAGSRARLIAKIERVEAIANLDAILEASDGVMVARGDLAVEVGDAAVPALQKRILRRAREMNRLSITATQMMESMVHSPVPTRAEVSDVANAVLDGTDAVMLSAETAAGQYPVEAVEAMARVCAEATRRTTPTSTRSS

SEQ ID NO: 21662 - protein, 188 aa, Candidatus Phytoplasma ulmi
MLSIKSLDEIVIMKEAGNILSFIRKELLKFLKVGISTFDLDMIAFDLMKKNGVVSAFKGYQGFGGYICISVNEVVVHGLPSKTRILKLGDIVTLDIGIKHKGYCVDSAWTYSLGSVSNKIKQFIENTKKSLFLGIEQVKPGNKISDISRAIGKFGNKYNYGIIEIFSGHGIGKKLHEEPYIFNFDFVF

SEQ ID NO: 21663 - protein, 271 aa, Triticum aestivum
  misc_feature (97)..(97): Xaa can be any naturally occurring amino acid
  misc_feature (118)..(118): Xaa can be any naturally occurring amino acid
  misc_feature (154)..(154): Xaa can be any naturally occurring amino acid
  misc_feature (171)..(171): Xaa can be any naturally occurring amino acid
MSAFVGKYADELIKTAKYIATPGKGILAADESTGTIGKRLASINVENVESNRQALREMLFTAPGALEYLSGVIPLRGDALPDGPPDGTPFVDILKAXATVIPGIKVDKGTVDIAGTSXARTTTQGLDSLGARCAKYYEAGARFAKWRAVLKIGXPAPGPSELAVKQNAEGXLARYPLICQGERAWSPSWSPRILPDGPHDIPGLPPPPPSAFLAPAFRSFNDHQVPPQGTFLSPLGHPRSNSPSWREVKRDHCGRLCHCAAGCPGVSFCAK

SEQ ID NO: 21664 - protein, 383 aa, Chlamydomonas reinhardtii
MSQTGDKPPTGSQAGSQGSSSSNIPVPQECDIPGKARFSLWRTTFEIDTRYVPIKAIGKGAYGVVASAKDSVTGEKVAIKKIGNAFENLTDARRTLREIKLLRHLKHDNIIAVKDILKPPAKDKFNDVYLVYELMDTDLHQIIRSSQPLTNEHFQYFVYQVLRGLKYVHTANVLHRDLKPSNLLLNASCDLKICDFGLARTGSERNFMTEYVVTRWYRAPELLLSCEHYTSAIDMWSVGCIMAELLGRKPLLPGKDYVDQLKLIIKSLGPPSEDDLTFINSQKARAYIRALPPAEKVNFRKKFPEADPLAIDLMEKMLQFDPRKRIDVHGALKHPWLAQLHDEAAEPAAPGEFVLDFEESTLTEQNVRDLIYEELVNHYHPND

SEQ ID NO: 21665 - protein, 108 aa, Oryza sativa
  misc_feature (22)..(22): Xaa can be any naturally occurring amino acid
  misc_feature (64)..(64): Xaa can be any naturally occurring amino acid
  misc_feature (103)..(103): Xaa can be any naturally occurring amino acid
MFRPEDTLAADVHYDDTEARKXTTSSRIQKIQASMTRRALKLLDLKSPSLILDVGCGSGLSGEXIWSSVEPEKGGPHTWMGMDVSPSMLDIALQRDVEGDLMXADMGQ

SEQ ID NO: 21666 - protein, 314 aa, Geobacter sulfurreducens PCA
MNQKIRVFSGNSNRSLAESICANLGLPLGKANVKTFSDGEVMVEIGENVRGRDTYVVQSTCAPTNNNLMELLIMMDALKRASAATITAVIPYYGYARQDRKVAPRTPITSKLVADLITTAGADRVVTVDLHAGQIQGFFNIPVDNLYAAPVILEHLKQRFPENSIVMVSPDAGGTERARAFAKRLGCTLAVIDKRRTGPNVAEVMHLIGDVTDKTAIILDDMIDTAGTLTQAARALKEHGAKTIYACATHGVLSGPAIERINNSDIEAVVITDTVPLGDKEQQTSKVKVLSVANLLAEAIRRIHEDESVSSLFV

SEQ ID NO: 21667 - protein, 510 aa, Pseudomonas syringae pv. tomato str. DC3000
MGLSRGSAEQKAEVAPPTTLFLFGAHGDLVKRLLMPALYNLSRDGLVDEGLHIVGVDHNAISDADFAKKLENFIRDEAAGKIAGGGKDPLDPALWGTLAERISYVQGDFLDDSTYQDIASKIESTGAKNAVFYLATAPRFFSEVAQRLGSSGLLQETDDGFRRVIIEKPFGSDLASAVALNGCLLKVMSEKQIYRIDHYLGKETVQNILVSRFSNGLFESFWNNHYIDHVQITAAETVGVETRGSFYEHTGALRDMVPNHLFQLLAMVAMEPPAAFGADAVRGEKAKVVGAIRPWNKEEALANSVRGQYAQGTMGDKEVVGYRQEDRVEPDSTTETYVALKVMVDNWRWVGVPFYLRTGKRMSARSTEIAICFKPAPYAQFRDTEVDRLKPNYLRIQIQPNEGMWFDLFAKRPGPTLDMEDIALGFAYKDFFEMQPSTGYETLIYDCLTGDQTLFQRADNIENGWRALQPFLDAWASQPEVQPYEAGKNGPDAGDELLSRDGREWRDLNV

SEQ ID NO: 21668 - protein, 94 aa, 'Chlorella' fusca
YKVTLKTPSGEETIECPEDTYILDAAEEAGLDLPYSCRAGACSSCAGKVESGEVDQSDQSFLDDAQMGKGFVLTCVAYPTSDVTILTHQEAALY

SEQ ID NO: 21669 - protein, 267 aa, Methanosarcina mazei Go1
MTSNSNFLKLCQEAFKAAYDATFELVGTDSASSFVGMGADGTPTTSIDQVAEDAIVEALKADGRSMRILSEELGELIIGKSPEFSVVLDPLDGTYNASSGIPFYSVSIAFASHDLSDLRFGYVSNLALKEEFHAEAGKGAYLNGKTIRPSHNSDLKSLCASVYGYRQNVERTRKIYSNIRRVRLFGSVALELCYVASGRLDAFVDVRRALRVTDVAAGQLILEEAGGRVTDGYGNLLRLPDNVTARVDMVASNGHVHEKILHLLSGG

SEQ ID NO: 21670 - protein, 497 aa, Arabidopsis thaliana
MAMEQRPKTKIVCTLGPASRSVPMVEKLLMAGMSVARFNFSHGSYEYHQETLDNLRQAMLNTGMLCAVMLDTKGPEIRTGFLKDGKPIQLKQGQEITISTDYDLKGDEKTICMSYKKLAQDVNPGMVILCADGTISLKVLSCDKEKGTVRCRCENTSMLGERKNVNLPGVVVDLPTLTEKDKQDILEWGVPNQIDMIALSFVRKGSDLVQVRKLLGKHAKTILLMSKVENQEGVANFDDILINSDAFMIARGDLGMEIPIEKIFLAQKVMIYKCNFMGKPVVTATQMLESMIKSPRPTRAEATDVANAVLDGTDCVMLSGETAAGAYPELAVRTMAKICVEAESTLDYGDIFKRIMLHAAVPMSPMESLASSAVRTATSSRATLMMVLTRGGSTARLVAKYRPGIPILSVVVPEITSDSFDWACSNEAPARHSLIYRGLVPVLYAGSARASIDESTEETLEFASEYGKKKQLCKTGDSVVALFRTGNAIVIKILTVK

SEQ ID NO: 21671 - protein, 510 aa, Ehrlichia ruminantium str. Gardel
MRFIGLQSLKDKKLNSYNGGGLSKIEQQHLKGKLTARERLRVLLDDNSFEEYGVFVEHRSVNFSMDQSKILGDGVVVGYGTINGRRVCVYSQDFTVFGGSLSESNAKKICNIMDKASVLGVPIIAINDSGGARIQEGVDSLSGYGEIFQRNVDLSGVVPQISLIMGPCAGGAVYSPALTDFIFMVRNTSYMFVTGPDVIKKVTYEQVSKEELGGATVHAAKTGIADLVFNNEIEALLQIRKFMQFIPSNNIMKPLKLDTNLDTFTEDISLNTLVPKNSSTPYNMYELIEKVCDERLFYEIKPDFARNIIIGFGKIGGCNVGIIANQPLQLAGCLDIDASRKGARFIRFCDAFNIPIISFIDVPGFMPGVNQEHSGIIVHGAKLLYAYAEATVPKISVIVRKAYGGAYIVMNSKHLCGDINYAWPDAEIAVMGAEGAVEIIFRNEADEEKRRYIIDEYRSKIVNPYVAASRGYIDDIIIPSHTRKHLFKSLQLLQEKKVQKISRKHDNLPL

SEQ ID NO: 21672 - protein, 148 aa, Mesembryanthemum crystallinum
MAATTAALSGATMSTAFAPKTPPMTAALPTNVGRALFGLKSSASRGRVTAMAAYKVTLVTPEGKQELECPDDVYILDAAEEAGIDLPYSCRAGSCSSCAGKVTSGSVNQDDGSFLDDDQIKEGWVLTCVAYPTGDVTIETHKEEELTA

SEQ ID NO: 21673 - protein, 322 aa, Ehrlichia ruminantium str. Gardel
MKLRNVSKNNLNKEDTKLSIEQFGGNVEWFNITKTLSESLPYIQQFSGETFIIKYGGAAMTDKKLAESFAHDVVLLKQLGINPIVVHGGGNKINEFLEKINKKSTFINGLRITDAETLEIVEMVLCGLVNKNITQLINNAGGNAIGLCGKDANLIEAKKICYTYKENQSNNVEKILDMGFVGEPHDINTDLLFFMEESDFIPVIAPVCSGENNLTYNVNADLVAGALANAMAAAKLIILTNVSGVTDSNGNLISELSVSHAENLIDNGTAHTGMIPKLQTCVKVVKEGYGSAHIIDGRIPHVLLLELFTIHGTGTMVVNSGV

SEQ ID NO: 21674 - protein, 408 aa, Azoarcus sp. BH72
MALIVQKYGGTSVGSPERIKNVASKVAKFRAEGHQVVVVVSAMSGETNRLIALAKDVAAKPDPRELDVVVSTGEQVTIGLLCMALQDIGVPAKSYTGAQVKILTDSAHTKARILNIDEAPIRKDLDAGAVVVVAGFQGVDEHGNITTLGRGGSDTTGVALAAALKADECQIYTDVDGVYTTDPRIVPEARKLDTITFEEMLEMASLGSKVLQIRSVEFAGKYKVKLRVLSSFQEGGQGTLITVEEDKNMEQPVISGIAFNRDEAKVTVLGVPDKPGIAYQILGPVADANLDVDMIIQNVGHDGTTDFSFTLARGDLEKAVAILEGVKTHIGARAIEGDKTMCKVSIVGVGMRSHPGVASKMFRTLAEEGINIQMISTSEIKISVAIDEKYLELAVRVLHKAFGLDQPV

SEQ ID NO: 21675 - protein, 200 aa, Ehrlichia ruminantium str. Gardel
MKLKSIMSQCQFIIGATSIKSLPDFSIPEVALAGRSNVGKSSLINAITNNRKNARISSKPGCTRQINFYLINKGLMVLVDLPGYGYSKADRATVNSYICLMEYYLLNRKNLSKVVLLIDAKVGFKEIDLDFIRWLEVHQILYQLVLTKIDRVQSNVLDVIVSDVQNFNLNFIIYPIINVSSKCKQGIEELIYEIAQCIKK

SEQ ID NO: 21676 - protein, 401 aa, Cucumis melo
MDYVYAPGKNHLFVPGPVNIPEPVLRAMNRNNEDYRSPAVPALTKTLLEDVKKIFKSTTGTTFLIPTTGTGAWESALTNTLSPGDRIVSFLIGQFSLLWIDQQQRLNFNVDVVESDWGQGANLDVLESKLATDGGHTIKAICIVHNETATGVTNDLSKVRFLLDKYKHPALLLVDGVSSICALDFRMDEWGVDVALTGSQKALSLPTGLGIICASPKALEASKTSKSVKVFFDWKDYLKFYNLGTYWPYTPSIQLLYGLRAALDLLFEEGLDNVIARHSRLGKATRLAVEAWGLKNCTQKEEWFSDTVTAVLVPSYIDSAEIVRRAWKRYNLSLGLGLNKVAGKVFRIGHLGNLNELQLLGCLAGVEMVLKDVGYPVKLGSGVAAASAYLQNNIPLIPSRI

SEQ ID NO: 21677 - protein, 397 aa, Streptococcus pyogenes MGAS315
MPKLSKRVLEMKESVTLAAGARAKALKAQGRDVLNLTLGEPDFFTPKHIQDKAIESIQNGTASFYTNASGLPELKAAIATYLKNQYGYHLSPDQIVAGTGAKFILYAFFMAVLNPGDQVLIPTPYWVSYSDQVKMAEGQPIFVQGLEENQFKVTVDQLERARTSKTKVVLINSPSNPTGMIYGAEELRAIGEWAVHNDILILADDIYGSLVYNGNQFVPISTLSEAIRRQTITVNGVAKSYAMTGWRVGFAAGEPEIISAMSKIIGQTTSNLTTVSQYAAIEAFCGSQSSLEEMRLAFEERLNITYPLLCQVPGFEVVKPQGAFYFFPNVKKAMEMTGFSDVTSFANAILEEVGLAVVSGAGFGAPENVRLSYATDIKTLKEAVRRLHVFMESNEIN

SEQ ID NO: 21678 - protein, 407 aa, Kluyveromyces lactis NRRL Y-1140
MSDLHHLLTFPERPISESSYLPELTRLLSAGIPATYTLEQAAAFERGEEVTEEDSNTTPLHILCRSLPSFEGSSKLSEDEESVVLKLMDTLLEYGAGWNFLDYENKHIGDLVLERKYPQDHCIYQRIVDAGVSAELLLRKIDGGEIEFIEDPEDAATEAATEAATEAEVIEGVTKGSEEAPFEDATAADQATYLKTDLEYTDDALVTKENRDGVMMDWETDIMSMAAKSLVSTRSTDECVVLNIGFGMGIIDNFIQDEKVTKHYICEAHPDVLAKMKETGWFDKENVVILEGRWQSRLNELLDQGEVFFDGIYYDTFSEHYQDMLDLYDVIVGLLKPEGTFSFFNGLGADRPVCYDVYRKIVELDVANYGMECRYQVINLRTLPNWNDVKRSYFNCTYYYHPEIRFA

SEQ ID NO: 21679 - protein, 267 aa, Arabidopsis thaliana
MGSAFDPLVTATEDLAAVNSAPPLSNLTQEELKKIAAYKAVEFVESGMVIGLGTGSTAKHAVARISELLREGKLKDIIGIPTSTTTHEQAVSLGIPLSDLDSHPVVDLSIDGADEVDPALNLVKGRGGSLLREKMIEGASKKFVVIVDESKLVKYIGGSGLAVPVEVVPFCCDFTRGKLEELFRDSGCVAKLRMKIGSNGEEAAPAVTDNRNYVVDLYLERDIGDLEVASEAILRFPGVVKHGMFLGMATTLIVAGKFGVTVKDRFG

SEQ ID NO: 21680 - protein, 527 aa, Kluyveromyces lactis NRRL Y-1140
MSTKSESVVVKVFEAAQAVLGQFLAFSIAQQISIVILLPFVYTIVWQLLYSMRKDRVPLVFYWIPWVGSAVSYGMRPYEFFEECREKYGDIFAFVLLGKVMTVYLGPKGHEFILNAKLADVSAEAAYTHLTTPVFGNGVIYDCPNHRLMDQKKFVKGALTTDAFRKYVPLIAEEVQKYFLTSKNFSIGEKDHGKINVMVTQPEMTIFTASRSLLGSEMREKLNTDFAYLYSDLDKGFTPLNFVFSHLPLDNYRKRDNAQRVISSTYLSLIKKRRDTNDIQDRDLIDSLMKNSTYKDGVKMTDQEIANLLIGVLMGGQHTSAATSAWVILHLAERPDIQEKLYEEQMKVLDNGTKELTFDLLQEMPLLNQTIKETLRLHHPLHSLFRKVMNDMPVPNSSYVVPKGHHVLVSPGYCHLQDKYFPNASEFNPNRWDNDAASSYASNEKVDYGFGSISKGVSSPYLPFGGGRHRCIGEHFAYMQLGTILSNYIRTLTWKFADPSATVPTPDFQSMVTLPLEPSEIEWTLRK

SEQ ID NO: 21681 - protein, 621 aa, Coccidioides immitis RS
MAVVRDTYQGVDGHCEDVNVVVEAMLLKVPKFKLLYQADRDNIFCALWKIDHGEDANPSSVGSWSSQQTAVITELSPRDPSVAALGIKGAPFPSLISLNTSRDVVYQEKTKAFLQHPAIKVKPASTLPPSLALREVVTRAVTTAALKEIEKWSKSVTSKVAGRLQHGARNGRTARLGAVLATADKGLLTGRRREKGGGGANLNLVIYSLLLTPPSLQTAEGHDHRVYRSSTTAPVNIAVIKYWGKRDATLNLPTNSSLSVTLSQANLRAHTTASCSDSYPHAEGDTLVLNSKPQNIHASKRTLACLADLRILRRALEDADPSLPRLSAFPLRIVSENNFPTAAGLASSAAGFAALVRAVADLYDLPQSPSELSRIARQGSGSACRSLMGGYVAWKSGAKEDGSDSLAEQVAPASHWPEMRALILVVSDAKKDVPSTEGMQATRATSTLFPFRVTSVVPERMAAMEKAIQNRDFASFAEITMRDSNNFHATCLDTWPPIFYMNDVSRAAVRVVHDVNRAAGETICAYTFDAGPNAVIYYLEKDSDRVLGTFRKILKSDTEGWGETKPAQDAKSLLGEVDPRAVDMLTVGVNRVILSGVGEGPMKVVEHLVSESGDILTGAGN

SEQ ID NO: 21682 - protein, 364 aa, Geobacter sulfurreducens PCA
MGFNCGIVGLPNVGKSTIFNALTSAGAESANYPFCTIDPNVGIVQVPDVRLDRLAEIVSPERILPTTIEFVDIAGLVKGASQGEGLGNQFLGHIRSVDAIVHVVRCFEDENVVHVSGSVDPLRDIDIIQTELALADLDSVDKKLQRVEKQAKSGDKRLKEESEFYARLKAALEQGIPARHVQVADEELPWLRDLHLLTDKPVLYVANVAEDDLDGAHPAVAKVRELAEREGARVVTICGRIEAEIAELDGDEKRVFLEEMGLAESGLDRLIRMGYELLGLITYFTAGKKEVRAWTIPTGTKAPQAAGVIHTDFEKGFIRAEVIAYADYIAAGGETGAKEKGLMRLEGKEYVVQDGDVMHFRFNV

SEQ ID NO: 21683 - protein, 130 aa, Oryza sativa
MASAAIYSLFIINKSGGLIYYKDYGSAGRTDTNDSLRLASLWHSMHAISQQLSPTHGCEGIDLLQAHNFDLHCFQSLTGTKFFAVCETGAQNIETLLKVIYELYTDFVLKNPFYEMEMPIRCELFDLNLA

SEQ ID NO: 21684 - protein, 464 aa, Oryza sativa Japonica Group
MAALLLWLSWLLLSLLSIYLLDLLAHSRRCLPPGPRPLPLIGSLHLLGDLPHRSLAGLAKTYGPLMSLRLGAVTTVVASSPEVAREFLQKHDAVFATRSTPDATAPARSAPTSSGQEKVPELVDHVAGLARDGTAVDIGRVAFTTSLNLVARTIFSHDLTSLDDHGASKEFQRLITDVMEAVGSPNLSDFFPALAAVDLQGWRRRLSGLFARLHRLFDAEMDHRRLHGMKEKDGDFLEVLLRLAARDDDTARLDGDTLRSLFTDLFTAGSDTSSSTVEWAMAELLQNPISMAKLCDELRRVVGSRRRIEESEIGQLPYLQAVIKETFRLHSPAPLLLPRQATRTIQIMGYTIPKGTRVLINVWAMGRDEDIWPEAGKFIPERFLERTIDYKGGDLELIPFGAGRRICPGMPLAVRMVHVLLASLLIHFKWRLPAEVEGNRIDMTEKFGVTLAKANHLCAMAAPT

SEQ ID NO: 21685 - protein, 378 aa, Ralstonia solanacearum GMI1000
MLPSFPPAILALADGTVFRGYSIGAAGHTIGEVVFNTAITGYQEILTDPSYSRQIVTLTYPHIGNVGVNREDVEATKVHAAGLIIKDLPILASNFRQEHSLSHYLKGEKVVAIAGIDTRKLTRILREKGAQNGCVLAGEDNPQKAIDLARSFPGLSGMDLAKVVSVTQPYEWNQTEWALGRGYGVQDKPQFHVVAYDFGVKYNILRMLAERGCRVTVVPAQTSAADALAYNPDGVFLSNGPGDPQPCDYAIAATKDFIERRIPTFGICLGHQIMGLAVGGKTLKMKTGHHGANHPVKDLQDGRVIITSQNHGFAVDPESLPANARVTHVSLFDGTLQGFELTDRPAFCFQGHPEASPGPHDIGYLFDRFTAAMAERKQ

SEQ ID NO: 21686 - protein, 760 aa, Zea mays
  misc_feature (47)..(47): Xaa can be any naturally occurring amino acid
GDQDNEPPQEEDIDQGGDEDDQEIQYQRPPHPRVHQTIQRDHPIIHXGIDDALRDSDWVVAMQEELNNFMRNEVWHLVPRPNQNVVGYSQVEGLDFDETYAPVARLDSIRILLASTYHGFKLYQMDVKSAFLNGPVKEEVYVEQPPGFEDSEYPNHVYKLSKALYGLKQAPRAWYECMRDFLITNGFKVGEADPTLFTKTIAKDLFICQIYVDDIIFGSTNKSSCEEFSSIMIQKFEMSMMGELKYFLGFQIKQLQEGTFISQTKYIQDILKKFGMKNAKPIKTPMGTNGHLDLDTGEGEVDPCPPVLLLWSEAEATEGLYDGVEVTRWKGPGFQGLEHLPFAVDDEVEAGHPELGEESVENAERSYIQSSMAGVIGGEMPEAEWNDEHTRIVCELFEEQVRAGNRPNTHLNNIGYRQVAAKFQQRTELLYTKLQLKNKWDKFKNDYITWRKLLVVGKGLPWDTAKGTFVADEEWWKKINKELPGARKFRHGGLHHEDKLNVMFDYITSNGVDPSPPAPESPKNGVNHSPPAATGLPSAPDCALNGVDHSPVTAHGLPSGPYSPMNGMDQLPLPAHDLRSVQEIPMNGVNLDGLDNNTEDNDDIYQEPVFQYTSNRKKRPISFSATKKNKKNKAETALLMQAHLYRITELAQKAQDTFKKFSSQADLVPWPSIQDVMTLVWECGARCGSNEHFIATELFVSREQREMFLTMETAEERFQWLRRKYIVKYLSGAGPWVGIARCTAEAGIRWGGIVFMQRAS

SEQ ID NO: 21687 - protein, 435 aa, Pseudoalteromonas tunicata D2
MNFKSFSFAPEILRAIDECGYTELSPVQRLAIPHVRRGHDVLANAQTGTGKTAAFALPILQKLIDTPTPRVASNAKALVLAPTRELAEQIANSFERYGKYLDISVAAIFGGVSHKGQAIKLKAGADIIVATPGRLLEHIQMCNVSLSNVSFLVLDEADRMLDMGFINDIKMLMAAVNDERQTLLFSATYPSSMKQFSASVLKQPKIVQATKDNSTAETVQHVVYPVEERRKNELLSELIGRKNWHQVLVFVNMKETASSVVEELNQFGISAAVCHGDKTQGARRRALREFKEGKVRVLVATEVAARGLDIVGLERVINVDLPFLAEDYVHRIGRTGRAGNIGQAVSFVSREEEHTLANIEALIGTSIRRIYYPGFEVSSRDNLIKTIHSTPSHRRRKARVNSVGGQEQGEARIKNRSKIANVRNAIKNTKPTLKK

SEQ ID NO: 21688 - protein, 625 aa, Bradyrhizobium japonicum USDA 110
MQSRLLSQPSASRVAQFSVDTTPVAAGASLLTMKLETVSVDFTDEQKRYLEGFTTGLQISRVGRGLGGGSGKANAEPTGPDAVHIKAQDKVIASGKKLADQEKFKRDEHPFDAYPRLRQQALDNAPPSPADNFRWRYYGIFYVAPTQDSYMCRLRIPNGIMKHWQLSGLADLADDLCGPYSHVTTRANLQLREIPPKHAVKLIEGIQDLGLCSRGSGADNIRNVTGTPTAGIDPQEIIDTRPFAREWHYHILNDRSLYGLPRKFNVAFDGAGRIAVLEETNDIAFTAFEVKDGFGVEPGVWFRLGLGGITGHKDFAKYSGIIVKPEQATAVADAIVRVFIDHGDRTNRNKARLKYVLDAMGHDGFLKLVEERLKTPFTRVPEEAFAPRPAADRMAHIGVHKQKQDGLNWIGVSLTLGKLTCDQMRSLAKVARDLGDGEIRLTVWQNLLIPGVRDENVELAIAAIKQIGLAVEASHIRAGLIACTGNAGCRFAASNTKRHAAEIGDWCEPRVEMDKPVNIHVTGCHHSCAQHYISDIGLIGARVPVNEDDTVEGYHLFTGGGFGPDADVGQEVYHDLKAEDAPKTVEALLKAYIAHRASPDETFLSFARRHDGETLRKLADAQVSA

SEQ ID NO: 21689 - protein, 144 aa, Solanum lycopersicum
MASISGTMISTSFLPRKPAVTSLKAISNVGEALFGLKSGRNGRITCMASYKVKLITPEGPIEFECPDDVYILDQAEEEGHDLPYSCRAGSCSSCAGKVTAGSVDQSDGNFLDEDQEAAGFVLTCVAYPKGDVTIETHKEEELTA

SEQ ID NO: 21690 - protein, 308 aa, Burkholderia mallei ATCC 23344
MPATFPDVLALGEAMVEFNQARLGEPNYLQGFGGDTSNFCIAAARQGARAGFVSAVGGDHFGRLLLDLWRGERVDTSYVRVDDGAPTGVYFVSHGEHGHAFDYLRAGSAASCYAIRDLPLDALAAARFVHLSGVSLAISTSACDAAFAAIAHARANGARVSFDTNLRLKLWPLPRARAVMTEALRHTDVCLPSWDDVTALTGLDERDAIVDALLALGPRVVALKLGREGAYVATPGERRVVPGFVVDALDATGAGDCFGGAFVARLAAGDDPFSAARYANAAAALSTQGFGAVAPIPSRDAVERLLGA

SEQ ID NO: 21691 - protein, 99 aa, Leptolyngbya boryana
MPSFKVTLINETEGLNTTIEVPDDEYILDAAEEQGIDLPYSCRAGACSTCAGKITAGTVDQSDQSFLDDDQIQAGYVLTCVAYPTSDCTILTHQEEDLY

SEQ ID NO: 21692 - protein, 515 aa, Ehrlichia ruminantium str. Gardel
MLRFYCNVRYRMSSLTGKVKGRARKIKGDADIRVNESTENVGLVIRVMTAVVDIKFPSGKVPKILNALESKEIYNGKKLVLEVSQHISDSIVRCIALDSTDGLSRNDEFIDTGAPISVPVGRATLGRVFDVLGNPIDNCGPLTKSDYSIKPIYSEVPKLTDQKVTTEILVTGIKVIDLLAPYLKGGKVGLFGGAGVGKTVLIMELIHNIAKAHKGVSVFAGVGERTREGNDLYHEMIESGVINLEEKDKSQAVLVYGQMNEPPGARLRVALSALTMAEYFRDVENQDVLFFVDNIFRFTQSGSEISALLGRIPSAVGYQPTLAAEMGAMQERITSTNRGSITSVQAIYVPADDLTDPAPATSFAHLDSTTVLSRQIAELGIYPAVDPLDSASQALSIDIVGEKHYEVSKEVQRILQTYKSLQDIIAILGMEELSEEDKLIVARARKIQRFLSQPFHVAEVFTGTPGVFVSLEDTVSSFKDIVEGKYDHLPEAAFYMVSNINEAVKKAELLQKEGK

SEQ ID NO: 21693 - protein, 100 aa, Brassica napus
MEKFSYNSYPDSTDSSPRSREIDFDNPPPWDDQNHHHHQQTQSYKVKFMCSYNGKIQPRPHDNQLTYVNGETKILSVDRGIRFPVLASKLSAVCDGGGGG

SEQ ID NO: 21694 - protein, 137 aa, Zea mays
  misc_feature (92)..(92): Xaa can be any naturally occurring amino acid
  misc_feature (101)..(101): Xaa can be any naturally occurring amino acid
SVSQTLLLCCCTCLSATAHTERSTTASCAYLDQNFALSMGCSLEATLCGNTGVAQVNIASAIPTLASVRMLPWAKANINLTGQALIVSTMEXMAYFIFADXKILFVERRHSFEQDPEHLKNTSFQGTGRPHPVFFRP

SEQ ID NO: 21695 - protein, 581 aa, Oryza sativa Indica Group
MDSILLLPLVALLVVAISWLWDYTVVRLIWRPHCIAKEFREKQGIRGPAYKFLGGNNGEISRLKEEADGQVLDNLRDHNYLPRIAPHFLKWRAQYEVFNSGSRNREAFLFWYGAKPRICIFDYELARQILSSKSGHFLKNDAPPTLVALMGKGLVLLEGTDWVRHRRVINPAFNMDKLKVTVTPPSISSHTNRFRTSPMMISTMTGCAQSLAKELEDVAAKNKDRVTEVDLNQKFRELTADIIAHTAFGSSYQLGKEAFQAQHELTEITMATLFQVQLPWLNYLPTERNRRKWRLQKNLRDTLMQIIRSRLSSKDGEYGNDLLGLMLGACASDEQGEASSLSMDEIVDECKTFFLAGHETTSLLLTWTVFLLSVYPEWQERLRNEMTMVLLETLRLYNPALFIQRKPTADITVGSLAIPAGVAVYIPVPIMHRDREVWGHDAGEFNPLRFRDGAARAAAAAGIPHALLSFSIGPRSCIGQGFAMLEAKLLTGRGPDEEGWSLLLVENLQLLVLLITSLAVLVGCGITLLVCHSSISTPAAKPQEAHPRALTPAKKKQETKPDPARKRWQWRGFIFIRVSPH

SEQ ID NO: 21696 - protein, 208 aa, Corynebacterium diphtheriae NCTC 13129
MPGRERRDGGRSADDNQKKNDRRGGRRDDRRNQQQDERSQYIERVVTINRVSKVVKGGRRFSFTALVIVGDGKGMVGVGYGKAKEVPAAIQKGAEEARKNFFRVPMVAGTITHPVQGEAAAGIVMMRPAAPGTGVIAGGAARPVLECAGVQDILCKSLGSDNAINVVHATVAGLKQLNRPEEVAARRGKTLEEVAPARMLRARAGQEA

SEQ ID NO: 21697 - protein, 419 aa, Dehalococcoides sp. BAV1
MYELSVLPSGLRVISYHMPASRSVTICVYIGVGSRYEKDCEAGASHFIEHMVFRGSAKYPNSQLISSAIEGVGGILNAATDRESTLYYAKVGSDKFALALDVLSDMLVTPVFDPEDLEKERKVVYEEISMSMDNPSHRVGLLIDEILWPNHPLGRDIAGSRQSVAGLDRQRLLSFMHCHYNPANVVVAVAGDIKHAPAVSAISQAFSGLGGQNIVQTFEPYHSGNPCPVGVDKRDAEQINLMLAMPGMNRLDNRRYAFSILNTILGDGMSSRLFAHVRDNLGLAYSVQSGTEFLHDTGAFSIFAAVDPANLTACIEAILSEMEAAKTTITAEELTKAKEMSKGRIQLAMEDSRYMAKWIGSQELLCRRVNTHEDVIRLIDGVTLTSVMELAGEYFRKPEMRLALVGQIDKEKVSCLLKD

SEQ ID NO: 21698 - protein, 366 aa, Exiguobacterium sibiricum 255-15
MKADLLGVINLSGEEGFFKELTEHRNLAAVPFAGRYRLIDFTLTNMVQNEIANIGVFTLEKYRAMMDHLGSGKEWDLDRSNGGLYIFPPALSQDAHEFRGDLSNFHLHRDFFLRSKENYVVISGSNILSAVDYRDVLREHKASNADITVVYTKRDLPCNYCRPIRFSDQNRVTAIGSRGYEPSDETFYMETVVLSKNLFVRLVDEAIGRGEYDLLQSIIRSQLNRLHVHGYEYTGTSQVIHSLRSYYRESMLLLEQWGAINDFQHVYTKIKHEPPTRYLPGSTIKNSLVANGCKLEGTATDSILFRGVKVGKHARIKNSIIMQKSVIEEGAVVEYAILDKEVTVKRGQVIRGTAEEPIVIKKQTIV

SEQ ID NO: 21699 - protein, 386 aa, Exiguobacterium sibiricum 255-15
MAKKNVVAMLLAGGEGKRLGALTKHTAKPAVAFGGKYRIIDFPLSNCTNSGIDTVGVLTQYEPLELNRYLGIGSAWDLDRRNGGLTILPPYQAQNGKNWYEGTANAIYRNMSYINQYDPDYVLVLSGDHIYKMDYEKMIEEHRQGGADVTISVREVPWEEAPRFGILNTDEDLRINEFEEKPENPKSNLASMGIYVFNWDVLKRHLIQDAGDAESSFDFGKNIIPNMLYENLNIRAYKFKGYWKDVGTIQSLWEANMDLLEADPEFDLYEPSWKVHSVNPNQQPQYIGNNASIETSIINEGCHIEGEINHSVLFYGVDVAEGSLVKDSVIFPNVKIGKDVTIHRAILADGVVVEDGATIGTPNGEVFVIEANSVIPKNEVVKEAIQ

SEQ ID NO: 21700 - protein, 459 aa, Mycobacterium smegmatis str. MC2 155
MSHKQSRGPHVAPAYTGRLAMAPVPSLRLPDEAMDPSAAYRFIHDELMLDGSSRLNLATFVTTWMDPEAEKLMAETFDKNMIDKDEYPATAAIEARCVSMVADLFHAEDLRDDDPASAVGVSTIGSSEAVMLAGLAMKWRWRAKAGDWKGRTPNLVMGANVQVVWEKFCRYFDVEPRYLPMAEGRYVITPEQVLDAVDEDTIGVVAILGTTYTGELEPVAEICEALDKLAAGGGVDVPVHVDAASGGFVVPFIHPDLVWDFRLPRVVSINVSGHKYGLTYPGVGFVVWRNKEHLPEELVFRVNYLGGDMPTFTLNFSRPGNQVVGQYYNFLRLGRAGYTQVMQCLSQTARWLGDELRDSEHFELISDGSAIPVVAFRLKGDPGYTEFDISQALRAHGWQVPAYTMPEGAEDVVVLRVVVREGFSADLARALKDDIITVLGQLDALKPRGQFDQLQPFAH

SEQ ID NO: 21701 - protein, 538 aa, Coprinopsis cinerea okayama7#130
MLSRHIDPEEIIQKCREHPHKKHGSEGGRRGYHQSWRRDEDASTIPKYVMPRVGIPAKSAYQVLHDETALDGNPLLNLASFVHTWMPEEADKLIMENINKNIVDLDEYPAASIIHNRCVSMLADLWKAPKEGKVIGTATAGSSEAIMLGGLAMKKRWQEARKAEGKDYYHPNIVFGANAQVALEKFARYFDVEARLVPVKEENGFIMDPHDALKYIDENTIGVIVILGSTYTGHFENVELMSKLLDDLQERTGLDIPIHVDGASGAFIAPFAFPKLKWSFDVPRVVSINTSGHKFGLVYAGIGWVLWRDEKYLHKDLVFELHYLGSTEYTFTLNFSKPAAPVIAQMFNFLNLGFEGYRKIAYKDLRNARMLSKALESTYFTVMSNIHRRIEADPHENRNNHEDSPEGYEPGLPVVAFRLSDEFKQEYPHVQQVWIQQLLRAKGWIVPNYNAPKGAEEVEILRVVVRETLSEDLIERLIIDILEVTESTMNSKESFIAVSAASQVRAHPDHDQARPELENFADGTTIGGPEQMGFSSQC

SEQ ID NO: 21702 - protein, 177 aa, Cryptococcus neoformans var. neoformans B-3501A
MVKLRVLISMELDGVTNVQPADDYYEYFFTVMCGSCREVHSKTVSLNQKDEHEISGSKGTASFVWRCSNCKKEHSANFLPSAPPPSKSKSTAPIPYTSSSSGQFSPFIALDCRGLEFTEFHFAGKWKAEGEESGAVFDIDWDQLRKEQGGEERWDDYDEQGGVPLAVSELKSKIERV

SEQ ID NO: 21703 - protein, 92 aa, Triticum aestivum
MAGKARVLMCAALVVLLLLVETTAPTGQAHAVDCGSACSYRCSKSSRPNLCNRACNTCCRRCDCVPPGTAGNEGVCPCYANMTTHNGRHKCP

SEQ ID NO: 21704 - protein, 528 aa, Fusarium heterosporum
MALTVFEHASALWYRLQGSVSLAVLSTLAVVIAGWYILSSISLYFSRRQFIALHGCKPIANRYPSKWFGINFILEAGRTYKERRYLDALTWNFRNIGYTHEVRALGGTSVWTVEPENIKAVLTSKFKDYSLGNRPAVMGPLLGRGVFVTDGEEWSHSRALLRPNFAKDQVADLSMIERHLQQLLKMIPDDGKAIDLNDLILSFTMDSSTEFLFGESTETLTSGINRQFSDAFAYSLHDISSGLRLGPWYKFRRTDPKAVQSHRICREYADKYVEKALEYRRNYIKSVEDGATDKPSIDGGDSRRTFLRELALATDDREKLRDELLSLLLAGRDTTASLIGSLLFSLAKKPECWEKVRSEIEETLHGDLPSYEQLRNFKYAKYRVNEALRLYPPVPNNAKIGIRDTVLPRGGGPEGRDPIIVPKDAPVIYTVYALHRRYDLFGDDADDFRPERWENQRYTWEFLPFNGGPRICLGQQYALVETLYVLVRFAQHFSKIESMDPEPWTESLALTVSSGNGVKVKLERGSSE

SEQ ID NO: 21705 - protein, 488 aa, Aspergillus nidulans FGSC A4
MVKDEEKIAVGEDPTSSPEVAPLENLNKSRWERSWPTIACGAGLFSDGYLNGVIGSVNTMLSMIYAEAYTKSSASKNVSSIAFAGTVVGMLFFGVLSDHWSRKGSLLVSTLVLILFAILCTAAYGYNGSTYGLFAALAAYRFFLGIGIGGEYPAGSVAAAESSGELKKGHRNRWFIMFTNLQIDFGFVTSALTPMILVLIFTENHLRAAWRMALGLGIIPPLSLLYLRLKLNEPEEFNRERMHKFPVWLIIKFYWKRLAVVSLIWFVYDFSAYSFSTYSSAWLAIILGDEYPLWKSFGWNTVINLFYIPGSVAGAFASDWLGPRKTLAIGVGLQGVIGFIMSGCYEYLNTPKNVAAFVVVYGIFLALGEFGPGDNIGLCAAKTSATSIRGQYYGIAAAFGKVGAFVGTYIFPIIQDNAPNAIRRGQDPFFVSSSLCIFSAALAIFCLPHIGQDTITDEDRKFRKYLQEHGYDTSTMGQTQTPQPTEEA

SEQ ID NO: 21706 - protein, 441 aa, Salmonella enterica subsp. enterica serovar Paratyphi A str.
MYHGQLKNILLLSLRFIMDKLSYASDSSTSAWNTYLQQIERVAPYLGELSPWVDTLRHPKRALIVDIPVQMDDGTIRHFEGYRVQHNLSRGPGKGSVRYHPDVDLNEVMALSAWMTIKCAALNLPYGGAKGGIRVDPFSLSEGELEHLTRRYTSEIGIIIGPQKDIPAPDVGTNGKVMAWMMDTYSMNHGTTITGVVTGKPIHLGGSLGREKATGRGVFVSGLEAARRANIAVEGARVAVQGFGNVGSEAARLFAGAGARVVAIQDHTATLFNATGIDMKALTAWQTEHKQIAGFPGAETIASDAFWRLEMDILIPAALEGQITRQRAEALTCKLVLEGANGPTYPDADDVLASRGILVVPDVVCNAGGVTVSYFEWVQDMASFFWSEEEINARMDKIMTDAIVHVWEKAAEKSCSLRTAAYIVACERILLARKDRGIYPG

SEQ ID NO: 21707 - protein, 338 aa, Burkholderia sp. 383
MNLQRFPRYPLTFGPTPIQPLKRLSEHLGGKVELYAKREDCNSGLAFGGNKTRKLEYLVPDALEQGADTLVSIGGVQSNQTRQVAAVAAHLGMKCVLVQEHWVNYEDPVYDRVGNIQLSRMMGADVRLVSDGFDIGIRRSWEEAMESVRQAGGKPYPIPAGCSEHPLGGLGFVGFAEEVRAQEAQLGFKFDYIVVCSVTGSTQAGMVVGFAADGRANRVIGIDASATPERTHEQITRIARHTAELVDLGRPITTADVVLDTRYAGPEYGLPNDGTLEAIRLCARLEGMLTDPVYEGKSMHGMIDKVQLGEFEPGSKVLYAHLGGVPALSAYHETFRNG

SEQ ID NO: 21708 - protein, 394 aa, Zymomonas mobilis subsp. mobilis ZM4
MKIAKRAERIEPFYVLEVAKAAAQLSQDAGNDTKPMIHLTIGEPDFTAPPLVQEAAIRAIRAGATQYTPAIGLGLLRERISDWYRQRFGIDVPARRIVVTAGASAALQLICTALIEAGDEVLMPDPCYPCNRHFVIAAEGCPVVVPTTAAERYQLSAEKVAENWSDKTRGVLLASPSNPTGTSIHPEELRRIHAFVQSKGGITLLDELYLGLSHDDAFGQTGLTLDENVISINSFSKYFSMTGWRLGWLVAPEPLVPVIERLAQNFFLCPSTVSQHAALACFEPESIAEYERRRAEFKARRDWFIPALEKIGFKVPVAPDGAFYAWADCSEWFHAWDVPSSWEFAFEAMKRARVAISPGRDFGAAETARFVRFSTANSMDNLQEAVARLSALRP

SEQ ID NO: 21709 - protein, 825 aa, Burkholderia mallei ATCC 23344
MTYQVLARKWRPKDFASLVGQEHVVRALTHALDGGRLHHAYLFTGTRGVGKTTLSRIFAKALNCETGVTSQPCGVCRACREIDEGRFVDYVEMDAASNRGVDEMAALLERAVYAPVDARFKVYMIDEVHMLTNHAFNAMLKTLEEPPPHVKFILATTDPQKIPVTVLSRCLQFNLKQMPAGHIVSHLERILGEERIAFEPQALRLLARAAQGSMRDALSLTDQAIAYSANEVTETAVSGMLGTLDQTYMVRLLDALAAADGPQILAVADEMALRSLSFSAALQDLASLLHRIAWAQFAPASVLDEWPEAADLRRFAELLSPEQVQLYYQIATVGRGELGLAPDEYAGFTMTLLRMLAFEPATTGGGAPAGGVPARVAGAAPKSGARAAAAVGASAVPAVTGATGATGAALAPKAAAARAATRAEAPPAAPARPATAERGDDASDGDAPVPAKANARASADSRCDERDAQPPADSGSASGAASSAPPDTAFESAPRAAAPSAATPAAVPDARAPAAASAEDAVEAAAPAAPESRPPTPAAGAPVSRATGAAAALDVLRNAGMRVSSGRGAGAARPAAGPAASPTKPAPRAQVSVPTPRARAATGDAPPNGAARAEARAESRGAPPPWEDIPPDDYVPLSMDDGFIPPDDGFVPVFDSGPDDVRVAPKPAPAPPVDTRPLPEPIPLDAIGYDGEWPTLAASLPLKGVAYQLAFNSELTAADGGTLKLAVPVPQYADAAQVAKLKAALADALGKPVDVAVEVGPARRTAAALAAAERAKRQREAEQEMSADPFVQQLLREFGASIVEGSIRPVGAEAGAADGASPTLH

SEQ ID NO: 21710 - protein, 376 aa, Oceanobacter sp. RED65
MSDTFIKSKAAIAWGPGQPLSVEEVDVMMPRKGEVLVKIIATGVCHTDAFTLSGEDPEGNFPAILGHEGGGIVEAVGEGVTSVAVGDHVIPLYTPECGECKFCTSGKTNLCQKIRETQGKGLMPDGTSRFYKDGKPIYHYMGTSTFSEYTVLPDISLAKVNKSAPLEEVCLLGCGVTTGMGAVMNTAKVQAGDSVAIFGLGGIGLSAIIGATMAGASRIIGIDINESKFELAKQLGATDCINPNDYDKPIQEVIVELTDGGVDFSFECIGNVDVMRSALECCHKGWGESVVIGVAGAGQEISTRPFQLVTGRVWRGSAFGGVKGRSELPGIVEKYLAGEFKLNDFITHTMGLEDINEAFDLMHEGKSIRSVIHYNK

SEQ ID NO: 21711 - protein, 485 aa, Leuconostoc mesenteroides
VSEIKTLVTFFGGTGDLAKRKLYPSVFNLYKKGYLQKHFAIVGTARQALNDDEFKQLVRDCIKDFTDDQAQAEAFIEHFSYRAHDVTDAASYAVLKEAIEEAADKFDIDGNRIFYMSVAPRFFGTIAKYLKSEGLLADTGYNRLMIEKPFGTSYDTAAELQNDLENAFDDNQLFRIDHYLGKEMVQNIAALRFGNPIFDAAWNKDYIKNVQVTLSEVLGVEERAGYYDTAGALLDMIQNHTMQIVGWLAMEKPESFTDKDIRAAKNAAFNALKIYDEAEVNKYFVRAQYGAGDSADFKPYLEELDVPADSKNNTFIAGELQFDLPRWEGVPFYVRSGKRLAAKQTRVDIVFKAGTFNFGSEQEAQEAVLSIIIDPKGAIELKLNAKSVEDAFNTRTIDLGWTVSDEDKKNTPEPYERMIHDTMNGDGSNFADWNGVSIAWKFVDAISAVYTADKAPLETYKSGSMGPEASDKLLAANGDAWVFKG

SEQ ID NO: 21712 - protein, 167 aa, Yersinia pestis CO92
MSHIEKQAGELQEKLIAVNRVSKTVKGGRIFSFTALTVVGDGNGRVGFGYGKAREVPAAIQKAMEKARRAMINVALNNGTLQHPVKGAHTGSRVFMQPASEGTGIIAGGAMRAVLEVAGVHNVLAKAYGSTNPINVVRATIAALEDMKSPEMVAAKRGKSVEEILGK

SEQ ID NO: 21713 - protein, 398 aa, Bradyrhizobium japonicum USDA 110
MTTATHPYDALMDITARPKAVFVRGAGSYLWDDSRKRYLDFVQGWAVNCLGHSPSAIADALAAQAKRLLTPSPAFYNEPSLKLAQALVANSAFDQVFFANSGAEANEGAIKLARKYGSLHKGGAFEIISFEGGFHGRTLATMSASGKKAFEPLFEPKVAGFKKAKLNDIASVEKLINDNTVAVMLEPIQGESGVWPATDQFLQELRALTKAHGLLLILDEIQTGMGRTGKLFHYEHTGIAPDIMTLGKGIGGGVPLAALLATERAACFEHGDQGGTFNGNPIMCAAGLAVLDEVGKPDFLKSVTETGLLLESELQKVSARHGLGGVRGRGLLLALDLKLPIAPGIVAQAFEAGVLLNAPQVDTLRFMPALNVTRAEIAEMIDCLDAILTKAGAARRVA

SEQ ID NO: 21714 - protein, 324 aa, Bradyrhizobium japonicum USDA 110
MTKAVRVHKVGGPEALVYESVEVPAPGPGEVRIRQHAVGLNFIDVYYRTGLYKAPELPFIAGNEASGEVIAVGPGVTNFHPGDRVAYYHNLGAYTGERNIPWEKLVKLPDHITHEQGAVLMLKGLTVWYLLHKTFKVEPHHRVLIHAAAGGIGLLACQWARALGAHVIGTVGSREKAELAEANGCDHVILYNEEDFVARVKQISRNEGCDVVYDGVGKATFPGSLSCLKPRGMFVSFGNASGPVPPFSIAELNNHGSLFATRPKLNDYVGTRKELLEGADTLFSAVINGKLHVPINHAYALKDAAKAHIDLESRKTTGASILKP

SEQ ID NO: 21715 - protein, 385 aa, Solanum tuberosum
MGSLCSSRNKHYSQADDEENTQTAEIERRIEQETKADKHIQKLLLLGAGDSGKSTIFKQIKLLFQTGFDEAELKNYIPVIHANAYQTIKILHDGSKELAQNELEASKYLLSAENKEIGEKLSEIGGRLDYPRLTKDLVQDIEALWKDPAIQETLLRGNELQVPDCAHYFMENLERFSDIHYIPTKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSCMLFLNKFDIFEQKVLKVPLNTCEWFKDYQSVSTGKQEIEHAYEFVKKKFEESYFQCTAPDRVDRVFKIYRTTALDQKLVKKTFKLVDETLRRRNLFEAGLL

SEQ ID NO: 21716 - protein, 392 aa, Solanum tuberosum
MLSVVLENMGSLCSRNKHYSQADDEENTQTAEIERRIEQETKADKHIQKLLLLGAGDSGKSTIFKQIKLLFQTGFDEAELKNYIPVIHANVYQTIKILHDGSKELAQNELEASKYLLSAENKEIGEKLSEIGGRLDYPRLTKDLVQDIEALWKDPAIQETLLRGNELQVPDCAHYFMENLERFSDIHYIPTKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSFMLFLNKFDIFEQKVLKVPLNTCEWFKDYQSVSTGKQEIEHAYEFVKKKFEESYFQCTAPDCVDRVFKIYRTTALDQKLVKKTFKLVDETLRRRNLFEAGLL

SEQ ID NO: 21717 - protein, 386 aa, Thermococcus kodakarensis KOD1
MNWDRVRGLVLEGKPVVLIDNRREFEADLIYPAEIASPEIVNFMLSMKGLLCLTMDMDEALKRGFFPLPSKEGETNFLVPVDYKETFTGITAEERALTARKIAEGLGVGAFRYPGHLHLLGGIGLNRRRGHTESSLELMEILGFKRYALMVEILDEKGDSHNREYALKLAEEHGLPVLTTDDVWKEFVRRKQLMRIYASARLPTRYGDFRIIAFDNELDFKEHVAIVKEPYGEVPLVRVHSKCLTGDTFASLKCDCGSQLANALRMIAQEGGILLYMDQEGRGIGLKEKIKAYELQDKGFDTVEANKALGRGEDERTYEAAFQMLRALGVSKIRLITNNPRKAKALEEFGIEVVETVPAPGEVTEHNKPYLKVKAEKLGHKLPFKV

SEQ ID NO: 21718 - protein, 156 aa, Thermococcus kodakarensis KOD1
MEVRVIEGEFKGEGVKIGVVVARFNDLLTNELLSGALDCFERHSVEEVDVVKVPGSFEIPLVAKKLAESGKYDAVLALGAVVRGETKHFDLVANEVAKGVAKVSLDSGVPVIFGVITVEDELQGFNRAGVKSNKGFEYAMAALEMANLMKKLREKE

SEQ ID NO: 21719 - protein, 198 aa, Listeria innocua Clip11262
MNLIPTVIEQTSRGERAYDIYSRLLKDRIIMLGSAIDDNVANSIVSQLLFLDAQDPEKDIFLYINSPGGSISAGMAIYDTMNFVKADVQTIGMGMAASMGSFLLTAGANGKRFALPNAEIMIHQPLGGAQGQATEIEIAARHILKIKERMNTIMAEKTGQPYEVIARDTDRDNFMTAQEAKDYGLIDDIIVNKSGLKG

SEQ ID NO: 21720 - protein, 278 aa, Oryza sativa Indica Group
MRKNFRKRNLEADDAADHSDDDDARRVALEEIKYMQKLRERKLGIPAAAAAAGASSAASADGASPRGRGGGGGGGLAAGGDAEKEDLVLQDTFAQETAVTIEDPNMLRYVENELLKKRGKKVDVKDKEEKDQVDELYIVPDHLKVRKKNSEESSTQWTTGIAEVQLPIEYKLRNIEETEAAKKMLQEKRLAGKTKSDANIPSSYNADFFHRGKDYTEKLRREHPELYKDQGSQANGTGGKSMGGNHPDGAGAGRREAATDELLLERFRKREKFRVMRR

SEQ ID NO: 21721 - protein, 463 aa, Listeria innocua Clip11262
MTKVNSFFRKKSFHNPATDKHHLNKTLGAFDLTMLGVGAVVGGGIFILPGQVASVIAGPGIIISFIIAGIACCLAALCYSEFASKLPVAGSAYTYSYHVFGEGVAWILGWSLILEYGLAVAAIASGWSSYMKSLLAGFDLHIPTAISSAYNPSAGTYFDLLAFVVVMVIGILLSFGIRESTRVNNIMVLVKIAVVVLFIIVGAFYVKPDNWTPFLPFGVQGVITGASTVFFAYIGFDAVSSAAEEVKNPQKNMPIGIIASLAVCTLLYILLSAVLTGVVPYTDLVGVSAPVAFALQAINQNWIAGLLSVGAIVGMTTVVLVMSYGGTRLLFAMGRDGLLPKSFSKISKNDTPVRNTMIFATVMGLIASTVPMEDLAQLINIGTLFAFAMVSVGIFFLRRNPELNQKGFKTPFYPVVPALSFLLCVYLMLNLSKTTWIAFGVWFVLGIIVYTFYGRKHSALRLK

SEQ ID NO: 21722 - protein, 148 aa, Rhodospirillum rubrum ATCC 11170
MSSAAQSVTIVMIEDDLGHARLIEKNIRRAGVNNEIIAFTDGTSALNYLFGDDKSGRVSAGRAQLVLLDLNLPDMTGIDILKLVKENPHTRRSPVVILTTTDDQREIQRCYDLGANVYITKPVNYENFANAIRQLGLFFSVMQVPETN

SEQ ID NO: 21723 - protein, 625 aa, Vitis vinifera
MSGPLDRFARPCFEGFSGHDERRERKSDFENSEDERRTRIGSLKKKAINASTKFKHSLKKKSSRRKSDGRVSSVSIEDVRDVEELEAVDAFRQALILDELLPTKHDDYHMMLRFLKARKFDIEKAKHMWTDMIQWRKDFGADTILEDFEFKELNEVLKYYPHGHHGVDKEGRPVYIERLGKVDPYKLMQVTTMDRYVKYHVQEFEKSFALKFPACTIAAKRHIDSSTTILDVQGVGFKNLTKAARDLIMRLQKIDGDNYPETLCQMFIINAGPGFRLLWNTVKTFLDPKTTSKIHVLGNKYQNKLLEIIDASELPEFLGGTCTCADQGGCLRSDKGPWNNPDILKMMHNGDARRARQVVKVLNSEGKVIAYAKPQYPMMKGSDTSTAESGSEAEDIASPKMTKSYSQLRLTPVREEAKVVGKVSYAGSFGGYDEYVPMVDKAVDAGWKKQAALQRPSSSKGTLPLLDTQKSPEGIHTRILSALLAFFMTLFTLFCTVALRVTNKLPDRVDHDENIPQLAPDATHKEDFRPPSPIPAFTEADLLSSVLKKLSELEEKVDTLQAKPSEMPYEKEELLNAAVCRVDALEAELIATKKALHEALLRQEELLAYIDSQEEAKFRKKKFCW

SEQ ID NO: 21724 - protein, 356 aa, Xanthobacter autotrophicus Py2
MKAARFHARRDVRVEDIPTPTDQPAPRQVLVKNRFCGICGTDLHEYAAGPIFIPTQPHPYTGAKAPQILGHEYGGTVVAVGSSVTNVAVGDRVSVQPMVSPRDDYFGQRGLYQLSESLAIIGLAWPWGGMAEYSLVNDYNVFRVPDSVSDAQAALIEPTAVTVYAAERGGVKPGDSVLVTGAGPIGQLQVLAARAAGATRIFLSDTNDNRLAMARQILPDVITLNPRSDKVPEAIRDQTEGGVGVDVALECVGAEAALGTCIEAVRRQGVVVQVGLHVGKPAVDGFTVTFKDIDVRGSWCYTTLMWPRVAALIGSGILPAEKVVTRRIRLDEVVENGFEALLSPAGTELKILIDLQ

SEQ ID NO: 21725 - protein, 487 aa, Vitis vinifera
MDRKNFQMPSTKTMISAAASLAGSAMLIRSIIRDLIPPELQHYLFSRFRGLLGSFTSEFTLVIEEFDGFGHNQLFRAAEVYLGSVISPNAQRLRVTLPNKESKMSVTMDRNEDVADTFNGVSLKWTFISRSIPTRYFNDPDNYYSMAKSELKFFQLSFHKKHKQTVLEAYLPYVLEKYKAMKETNKTLKIHTLNSDPWQSVKLDHPATFDTLAMDSELKRTLMNDLERFVRRKGFYRKVGKAWKRGYLLFGPPGTGKSSLIAAMANYLNFDIYDLELTDLRCNSELRKLLISTANRSILVVEDIDCSLELQDRLAQARMMNPHRYQTSQVTLSGLLNFIDGLWSSCGDERIIVFTTNHKDKLDPALLRPGRMDMHINMSYCTPCGFKMLASNYLEITNHPLFPEVEDLILEAKVTPAEVGEQLMKSEEPDITLEGLIRFLVEKKESDAAKAREAELEAARASDKEEKEKDENGKPEKGGEVEIKMIR

SEQ ID NO: 21726 - protein, 446 aa, Coprinopsis cinerea okayama7#130
MTRGLRRIESIPGIDHDDVEEDEESSESSDDGSSDEEMEITQTPSRRKGKGKATTDDDNEHNIIVQTNFDAYFTYAASRPQTSTNVYSELVLPMTPEEYAAGIKAAERRAKTLQTSIFDPKRKRELHSRFMFELQEGFNIVCYGIGSKRTFLNEFASNVCSKRGHVVIANAFQPAFTIKDLLARIEEVPGLEDFEGSAGTVDKQATRIHEFFANPAQKHHLYLIIHNIDAAPLRTTRSKAVLGLLAMNPKIHIVASIDHLNATLLWSSSEVFARKPAEASSTTAVRGFSWLWHDLTTLAPYDAELAYADRSSISGANIGARRKADLAMAQNPAAMSETAASHILASVTQKAKKLFILLGKKQLESIEDAGDKATNDLQQHGMSYDALFNAARDDFIAVNDTALRALLGEFRDHSLVLSAPTASGEVLWIPLRKERLHAVLNSLQAT

SEQ ID NO: 21727 - protein, 259 aa, Vitis vinifera
MSQQQRPRPTQPTTEPIKYSDVFPVSGSLASKPIAPQDAATMQSAENTVLGNTQKGGPAAVMNSAATKNERAGLVSHEQVTDVVATDGVTISQANVAGSRIITEAVGDQVVGEYARPPPVAMTSPASALDRDAITIGEALQATALSAGNKPVDQSDAAAIQVAEMRATGSSEVVPGGIAAQAQSAATTNARVILDENKTKLSDILTDATAKLPDDKPATREDAERVIGAELRNDPNMVTYPGGVAESVAAAARLNQSTK

SEQ ID NO: 21728 - protein, 109 aa, Oryza sativa
MMQVQPLTPPNTHIDVLDAYGGYKRCGFSLESSPNVATEAAFTPDGQYVISGSGDGTLHAWNINTIQEIACWNSHIGPITALKWAPRRAMFATASTALTFWIPNNSSSN

SEQ ID NO: 21729 - protein, 567 aa, Zymomonas mobilis subsp. mobilis ZM4
MMVETFMSYQSQPAIPVKESRVTLLRNPLLNKGSAFSAEERKAFQLEGLVPAQIESINIQAERCYQQYKEQKTDLDRYIFLRALQDENETLFFHLVADHIADMMPILYTPTVGSACQNYSHLFRKSRGLFIAYPDRDKIGDILKQTEQENIKIIVVTDGERILGLGDLGVGGMGIPIGKLALYTACGGIDPATVLPIVLDVGTNNENLLNDPLYMGWHHKRITGDEYYSFVDRFVQAVMQQWPDVFLHFEDFAQKNALPLLKKYRDQYCCFNDDIQGTSAVALATLYSACKTRKTSIRDQRIIFLGAGSAGCGIAEQIVSAMVAEGLDEATARGQVYMVDRNGLITDDMQDIPDFQKKLAQPLSKLKNWKSQDQGFFLLDVVKQSKATVLIGVSGQKGLFTEEVIKTLASQCEAPFVMPLSNPTSHMEAIPEDILKWTEGKALVATGSPFSPVVINGKSFPIAQCNNAYIFPGIGLGVLAAKATRVTDNMMVAAAYALADTAPAAQNKGNAILPSFDDIEEVSYVIALAVAKAAVKDGVAEQKDETALLALIKGYYWHPEYRAYQLA

SEQ ID NO: 21730 - protein, 122 aa, Triticum aestivum
GETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 21731 - protein, 637 aa, Geobacter sulfurreducens PCA
MSTLLDTITCPADLKKIPRDQLPALAEEIRAFLLETVSRTGGHLASNLGVVELSIALHYCFDSPTDRFVWDVGHQAYTHKILTGRRDRFHTQRQYGGISGFPKRSESSHDAFDTGHSSTSISAGLGMAMARELRGGSNKVVAVIGDGSMTGGIAFEALNQAGHLKKNLIVVLNDNEMSISPNVGAFSSFVSRKLTGSYFRELKKEVQGLLQNIPAIGKDILQFARRAENSLKGFLTPGMLFEALGFDYIGPIQGHNLPQLLEVFENARGLDGPVVVHVMTTKGKGYVPAETNPSAFHGVGPFDVATGKTTGSKPGAASYTGIFGDTLAQLARENEKIVAITAAMPDGTGLTGFAKEFPERFFDVGIAEQHAVTFAAGLAAEGFRPVTAIYSTFLQRAYDQVFHDVCLQNLPVVFALDRGGVVGDDGPTHHGVFDLSYLRHLPGMTLMAPKDENELRHMLKTAVSHDGPIALRYPRGAGCGIPLDQELREIPIGTGEILAEGDDVAIIAIGITVLPALEAARTLAEKGIRATVINARFVKPLDREMILQAARRTGCIITAEENALQGGFGSAVLELLADEGMTGVRVKRLGIPDRFVEQGPQPQLRADLGIDAAGIAAATEAFLAAKGAPAPALSMVK

SEQ ID NO: 21732 - protein, 363 aa, Salmonella enterica subsp. enterica serovar Paratyphi A str.
MGFKCGIVGLPNVGKSTLFNALTKAGIEAANFPFCTIEPNTGVVPMPDPRLDQLAEIVKPQRILPTTMEFVDIAGLVKGASKGEGLGNQFLTNIRETEAIGHVVRCFENDNIIHVAGKVNPAEDIDVINTELALADLDTCERAIHRVQKKAKGGDKDAKAELAALEKCLPHLAEAGMLRSLDLTDEDKAAIRYLSFLTLKPTMYIANVNEDGFENNPYLDQVREIAAKEGSVVVPVCAAVEADITELEDDERDEFMAELGLEEPGLNRVIRAGYRLLNLQTYFTAGVKEVRAWTIPVGATAPQAAGKIHTDFEKGFIRAQTIAFDDFITYKGEQGAKEAGKMRAEGKDYIVKDGDIMNFLFNV

SEQ ID NO: 21733 - protein, 714 aa, Pseudomonas aeruginosa UCBPP-PA14
MTDAIRYEKGQDNVVVLTMDMPGQSANTMNGVYREAMAKTIARLEAEKEGIAGVVLTSAKKTFFAGGDLNELIKVTKADAPAFYQGILELKGQLRRLETLGKPVVAAINGAALGGGWEICLACHHRIALDNPGVQLGLPEVTLGLLPGGGGVVRMVRLLGLEKALPYLAEGKKVRPAEALKAGLIHELADSPEEMLEKARAWILANPAAKQPWDSAGYKIPGGTPASPNVAQMLAIAPSVLRDKTKGCFPAPEKIMCAAVEGAQVDFDTAQLIEARYFTELTTGQVAKNMIGTFWFQLNEINAGKSRPQGYPVRATKKVGVLGAGMMGAGIAYVSAAAGIEVVLKDVSLEAAEKGKAYSARLLDKKVARGHLSAEKRDAFLARIVPSVSEADFEGCDLIIEAVFEDRALKGKVTAEAEKHALADAVVASNTSTLPITGLAQAVARPEKFIGLHFFSPVDKMPLVEIIRGEKTSDETLARGFDYVLQIKKTPIVVNDSRGFFTSRVFGTFTNEGIAMLGEGVSAAMIDNQARQAGMPVGPLAISDEVSLSLMTHIRNQTARDLEAEGKALPTHPAFAVIDLMVNEYKRPGKAAGAGFYDYPANGRKHLWAELKSRFEKPDAQISAEDVRDRLLFIQAIETVRCVEEGVLHSTADANIGSIFGIGFAAWSGGALQFINQYGLKDFIARAQYLVEQYGERFEPPALLLEKAAKGELF

SEQ ID NO: 21734 - protein, 561 aa, Salmonella enterica subsp. enterica serovar Paratyphi A str.
MNKLFSSHVMPFRALIDACWKEKYTASRFTRDVIAGITVGIIAIPLAMALAIGSGVAPQYGLYTSAVAGIVIALTGGSRFSVSGPTAAFVVILYPVSQQFGLAGLLVATLMSGFFLILFGLARLGRLIEYIPVSVTLGFTSGIGITIGTMQIKDFLGLQMAHVPEHYLQKVSALFMALPTVNIGDAAIGVVTLGTLIFWPRLGIRLPGHLPALLAGCAVMGIVNLLGGNVATIGSQFHYVLADGTQGNGIPQLLPQLMLPWSLPGSDFTLSWDSLRALLPAAFSMAMLGAIESLLCAVVLDGMTGTKHKANSELIGQGLGNMVAPFFGGITATAAIARSAANVRAGATSPVSAVIHAILVILALLVLAPLLSWLPLSAMAALLLMVAWNMSEAHKVVDLLRHAPKDDIIVMLLCMSLTVLFDMVIAISVGIVLASLLFMRRIARMTRLAPVNVDMPEDVLVLRVIGPLFFAAAEGLFTDLESRIKGKRIVVLKWDAVPVLDAGGLDAFQRFVKRLPEGCELRISNLEFQPLRTMARAGIKPIPGRLTFFPNRTEALADLLS

SEQ ID NO: 21735 - protein, 315 aa, Salmonella enterica subsp. enterica serovar Paratyphi A str.
MPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVTGRDCVLVDDMIDTGGTLCKAAEALKERGAKRVFAYATHPIFSGNAANNLRNSVIDEVVVCDTIPLTDEIKALPNVRTLTLSGMLAEAIRRISNEESISAMFEH

SEQ ID NO: 21736 - protein, 304 aa, Geobacter sulfurreducens PCA
MVVTGLGQCCWDTLAEVEEYPSPDSKAESGQWVEQGGGPAATALVTVARLGLQCRFAGVVGDDAAGALIRHALHAEGIDVTHLLTRPGAASQRAFIMVERTGGRRTIVWQRPTGAHLAPAELEEPFWSGSAFLHLDGLMEEASLHGVREARRRGIPVMVDAGRMRPGMRELAKLCDYLVAAEQFFLDLGWDGSEEQFARLADGLGAPTVTVTLGDRGSLTRHDGTTCHVPAFPVTTLDTTGAGDVFHGGYLFGLLKGWPLRETVIFASAAAALSCLHLGAQRGAPRLDEVIRFLVDRGIPVPAV

SEQ ID NO: 21737 - protein, 190 aa, Staphylococcus aureus
KIVLPEGEDERVLTAATQLQATDYVTPIVLGDETKVQSLAQKLDLDISNIELINPATSELKAELVQSFVERRKGKATEEQAQELLNNVNYFGTMLVYAGKVDGLVSGAAHSTGDTVRPALQIIKTKPGVSRTSGIFFMIKGDVQYIFGDCAINPELDSQGLAEIAVESAKSALSFGMDPKVAMLSFSTKG

SEQ ID NO: 21738 - protein, 571 aa, Burkholderia thailandensis E264
MARIGGRAEPIADACPPTEPIREGCYNNALSAGAPAGRSLARGPDGLKRRRRPAARRGFVFIPKWVASPVSRASRSCAGCPAAPFERNATMSDSVAKPVDATFDQFGLAAEILRAIAEQGYTTPTPIQANAIPVVLSGRDVMGAAQTGTGKTASFSLPIIQRLLPQANTSASPARHPVRALILTPTRELADQVAANVHAYAKHTPLRSAVVFGGVDMNPQMAELRRGVEILIATPGRLLDHVQQKTANLGQVQILVLDEADRMLDMGFLPDLQRILNLLPKERQTLLFSATFSPEIKKLASTYLRNPQTIEVARSNAAASTVTQIVYDVAEGDKQAAVVKLIRDRSLKQVIVFCNSKIGASRLARQIERDGIVAAAIHGDRSQSERMQALDAFKRGEIEALVATDVAARGLDIAELPAVINFDLPFNAEDYVHRIGRTGRAGASGDALSLCSPNERKQLADIEKLIKRTLSLETLELDLPRHRHDERGGRRERERDERRGASAGRRSAGGERAHHPRREAPIDDFFLKPYVPSSSANQPEEAKPAQPEKKAPKQPLAALLGGFGMPRKTSS

SEQ ID NO: 21739 - protein, 192 aa, Staphylococcus aureus
VKIVLPEGEDERVLTAATQLQATDYVTPIVLGDETKVQSLAQKLDLDISNIELINPATSEFKAELVQSFVERRKGKATEEQAQELLNNVNYFGTMLVYAGKADGLVSGAAHSTGDTVRPALQIIKTKPGVSRTSGIFFMIKGDEQYIFGDCAINPELDSQGLAEIAVESAKSALSFGMDPKVAMLSFSTKGS

SEQ ID NO: 21740 - protein, 171 aa, Triticum aestivum
  misc_feature (96)..(96): Xaa can be any naturally occurring amino acid
HASASAPGRAVASSPPPRPLGPQQEEHGSPPQLLRLKDEVMKITPGQKQTRVGQRTRFKTFVGGGDGNGHVDLNVKCAKEAATAIRGAIIHAKPAXGSGIGAARVPKKVLQFVGIDDVFTSSRGSTKTVARVLHYASGMADAHVGLPGVAPSSPGRPISARPSARPSRKRP

SEQ ID NO: 21741 - protein, 264 aa, Corynebacterium diphtheriae NCTC 13129
MGFRSKRKVIPAKTPGELDAMQAAGEIVGEALQAVRAAAAVGVSTLELDAIAEQAIRDRGAIPTFKGYGGFPGSICASVNDVIVHGIPNKETILKEGDLVSIDCGATLDGWVGDSAWTFGIGTIADDVRALNEATEWVLYEGMKAMIPGNRLTDVSHALEMATRAAEKKFNVQLGIVDGYGGHGIGHEMHEEPYLANEGKGGRGPMIQEGSVLAIEPMLTLGSVDSIVLADEWTVVTDDNSWSSHWEHTVAATNDGPRILTPRK

SEQ ID NO: 21742 - protein, 540 aa, Candida glabrata CBS 138
MTVEESKKRKLTDDVAIKQNEKKIKKDKKVKDKKDKKDKKDKKDKKEKKEKKEKKEKNDKKDKKDKKDKKAEQVDKLSETTEQPSKQVKIGAYVENEELSKQPQSVIDEFFKENEVSVEDPSKLNLRPLLAFNQISLDKEVQNEIAKFPKPTPIQAVSWPYLLSGKDVIGVAETGSGKTFAFGVPAINNLLTSSSKPKGIKVLVISPTRELASQIYDNLVLLTQKVGIDCCVVYGGVPKDDQRRQIAKSNVVVATPGRLLDLIEEGSVDLSPVDYMVLDEADRMLEKGFEEDIKRIIGQTKSKDRQTLMFTATWPKEVRELASTFMKEPVKVSIGNRDELSANKRITQIVEVVDPRSKERKLLDLLKKYQSGPKKNDKVLIFALYKKEASRVERNLNYNGYKVAAIHGDLSQQQRTQALNEFKSGKSNLLLATDVAARGLDIPNVKTVINLTFPLTVEDYVHRIGRTGRAGQTGTAHTLFTEQEKHLAGGLVNVLNGANQPVPEDLIKFGTHTKRKEHGAYGAFFKDIDMSKKPKKITFD

SEQ ID NO: 21743 - protein, 804 aa, Arabidopsis thaliana
MRCDNNYSFSILFSLLLILILDSKVVSLSTSCQSKSVCGNINIPYPFGIEKGCYLNEWYKIECKNATYPFLFKMGMAVVNISLPGDDGYNNPVSYGSIRVKIPITSIGCSRDGKESGSVLNFTDSPFYFGIGNSLVAVGCNSKASLTNINPSKVGCELNCTASKETLPSKSIPFFDKTGCSNNKLPYYSSLCTKNNGEDERSCDGNGCCIAGLLDSEAPQVIGINIESFDHGNSTKLECRVAFLTDDVSPFSNASEPKRLFAKRYATVSLGWVIQTKNLSFVNSLSCKNTKEYDNSTYNIKLVTSCICNNVTISGTDYANCGCSQGYEGNPYLPGGCKDINECLRNSYGQRQNCRESDTCVNLPGTFNCIGNKTRVTMIGVGSAFGILVLVVGIWWLRKFLKKRRMSKRKRKFFKRNGGLLLQQQLNTNKGNVEKTRIFSSRELEKATDNFSESRILGQGGQGTVYKGMLVDGRTVAVKKSKVVDEDKLEEFINEVVILSQINHRHVVKLLGCCLETEVPTLVYEFIPNGNLFQHIHEESDDYTKTWGMRLRIAVDIAGALSYLHSAASSPIYHRDIKSTNILLDEKYRTKVSDFGTSRSVTIDHTHWTTVISGTVGYVDPEYYGSSQYTDKSDVYSFGVVLVELITGEKPVITVSNSQEIRGLADHFRVAMKENRFFEIMDARIRDGCKPEQVMAVANLARRCLNSKGKKRPCMRKVFTDLEKILASQEDSLVNIENDDGADDEEEGMTMINIDDSQTIYVTAPAPKVGNYKEIGVCVCLGIGVGLLVRTYQSTTRTFRRRLL

SEQ ID NO: 21744 - protein, 368 aa, Corynebacterium glutamicum ATCC 13032
MSTVVPGIVALSKGAPVEKVNVVVPDPGANDVIVKIQACGVCHTDLAYRDGDISDEFPYLLGHEAAGIVEEVGESVTHVEVGDFVILNWRAVCGECRACKKGEPKYCFNTHNASKKMTLEDGTELSPALGIGAFLEKTLVHEGQCTKVNPEEDPAAAGLLGCGIMAGLGAAVNTGDIKRGESVAVFGLGGVGMAAIAGAKIAGASKIIAVDIDEKKLEWAKEFGATHTINSSGLGGEGDASEVVAKVRELTDGFGTDVSIDAVGIMPTWQQAFYSRDHAGRMVMVGVPNLTSRVDVPAIDFYGRGGSVRPAWYGDCLPERDFPTYVDLHLQGRFPLDKFVSERIGLDDVEEAFNTMKAGDVLRSVVEI

SEQ ID NO: 21745 - protein, 772 aa, Cucumis melo
MTVTPKISVNDGNLVVHGKTILTGVPDNIVLTPGSGLGLVAGAFIGATASNSKSLHVFPVGVLEGTRFLCCFRFKLWWMTQRMGTSGRDIPFETQFLLMESKGNDGEDPDNSSTIYTVFLPLLEGQFRAALQGNEKNEMEICLESGDNTVETNQGLSLVYMHAGTNPFEVITQAVKAVEKHTQTFLHREKKKLPSFLDWFGWCTWDAFYTDATAEGVVEGLKSLSEGGAPPKFLIIDDGWQQIEAKPKDADCVVQEGAQFASRLSGIKENHKFQKNGNNYDQVPGLKVVVDDAKKQHKVKFVYAWHALAGYWGGVKPASPGMEHYDSALAYPVQSPGMLGNQPDIVVDSLAVHGIGLVHPKKVFNFYNELHSYLASCGIDGVKVDVQNIIETLGAGHGGRVTLTRSYHQALEASIARNFSDNGCIACMCHNTDSLYSAKQTAVVRASDDYYPRDPTSHTIHISSVAYNSLFLGEFMQPDWDMFHSLHPTAEYHGAARAIGGCAIYVSDKPGNHNFDLLKKLVLPDGSVLRAQLPGRPTRDSLFNDPARDGISLLKIWNMNKCSGVVGVFNCQGAGWCRITKKTRIHDESPGTLTTSVRAADVDAISQVAGADWKGDTIVYAYRSGDLIRLPKGASVPVTLKVLEYDLLHISPLKDIASNISFAPIGLLDMFNTGGAVEQVNVQVVEPIPEFDGEVASELTCSLPNDRPPTATITMKARGCRRFGLYSSQRPLKCSVDKVDVDFVYDEVTGLVTFEIPIPTEEMYRWDIEIQV

SEQ ID NO: 21746 - protein, 305 aa, Methanosarcina acetivorans C2A
MVKPEKFIPKAIEKISQEIKEGKAIIALSGGVDSSVCAELAYRAIGDRLQPIYIDTGLMRKGETERIKHIFSHMNLHVVYAKDRFLEALAGVTDPEEKRKAVGETFIRVFEDEAKRIAADYLIQGTIYPDRIESEGGIKSHHNVGGLPSVMDFEKIVEPIEDLYKDEVREVAWALQLPEEICERMPFPGPGLAVRILGEVTEEKLEVVREANFIVEEELLERFCPWQTFAAVLGKGTGVKGDIRAYGWIVAVRAVGSRDGMTAEALELPWEVLKHLEARITSEIPKVARVVYDITPKPPATIEFE

SEQ ID NO: 21747 - protein, 571 aa, Coccidioides immitis RS
MDKSEKGIVVAGNDQSNLPAYESSEDARDAIENQEQLGFWTRMGCTPESFKQRTLADKHNQLNRTLKGRHLHMIAIGGSIGAGLFVGSGSALHDGGPATLIIDFMIIGVMMFNVVFALGELAIMYPVSGGFYTYSTRFIDPSWGFAMGWNYVFQWAIVLPLELTVAGLTIGYWQVDVSVGVWITVFIIAIILINIFGVLGYGEEEFWSSCLKLAAVVIFMLIALVCVLGGGPSHGKYGEYWGARLWYDPGAFRNGFKGVCSVFVTAAFAFSGTELVGLAAAESKTPVQSLPSAIKQVFWRITLFYILGLFFVGLLVDSNDERLLGSGLIDVTASPFVIAAKDAGLDGFDSFMNVIILISVLSIGNSGVYGGSRTLTALAEQGYAPKMFAYVDRAGRPLYSTIFLIAFSLLAYVNLSASGAEIFDWLQALSGLAALFTWGSICLAHIRFRSAWKYHGHTLDELPFKAALGVVGSWIGLTLVIIVLIAQFYTAVWPLGGGVNNAEGFFKSYLAMPVVLFFWACGYFWKGKGWLKLSQIDVDSGRREIDWEAHNAMMEKRRNAALIKRIMYFLF

SEQ ID NO: 21748 - protein, 162 aa, Azoarcus sp. BH72
MRQHATTTLAREMQMTVTVRQILEEKGSRTYSVRPDCSVFEALGVMAEFDIGSVIVVDNERLVGIFTERDYARKVVLKGLGSRDVSVSELMTPNPCTVTPTHTVDEVMAIMTENRFRHLPVVDHGRIVGMVTIGDMVKSVVSQQQATIRHLSSYIAGDIAVN

SEQ ID NO: 21749 - protein, 203 aa, Glycine max
  misc_feature (82)..(82): Xaa can be any naturally occurring amino acid
  misc_feature (115)..(115): Xaa can be any naturally occurring amino acid
  misc_feature (124)..(124): Xaa can be any naturally occurring amino acid
  misc_feature (167)..(167): Xaa can be any naturally occurring amino acid
  misc_feature (172)..(172): Xaa can be any naturally occurring amino acid
  misc_feature (175)..(175): Xaa can be any naturally occurring amino acid
  misc_feature (178)..(178): Xaa can be any naturally occurring amino acid
  misc_feature (180)..(180): Xaa can be any naturally occurring amino acid
  misc_feature (182)..(184): Xaa can be any naturally occurring amino acid
  misc_feature (186)..(190): Xaa can be any naturally occurring amino acid
  misc_feature (193)..(193): Xaa can be any naturally occurring amino acid
  misc_feature (197)..(197): Xaa can be any naturally occurring amino acid
  misc_feature (199)..(201): Xaa can be any naturally occurring amino acid
GVLLLENPRFYKEEEKNDPEPAKKLASLADLFVNDAFGTAHRAHALTEGVTKYLKPSVAGFFLQKELDYLVGAVSSPKRPFXAIVGGSKVLFKIGVIESLLEKSDILLFGGGMIXTFYNAHGFXVGSFLVEEDKLVLATSLLAKAKEKGVSLLLPSDVVIADKFAPXANSKXVPXSTXPXGXXXPXXXXXLKXFQEXLXXXPH

SEQ ID NO: 21750 - protein, 342 aa, delta proteobacterium MLMS-1
MPRKNKLPMHPDFCDQEQCATEPCPGKEPDSGLGHRARLPEVVERIVATCQDRSCFEHVEAEPLPSRRRAIAILDSCREIIFPGYFGHQGIDRVNLEYRIGLEVSELFDRLATEIANAIRHECTRHGHTCQHCDEAGQEKALHFLQQLPQLRAVLASDVQAAYQGDPAAAGYDEIIFSYPGLHAITIYRIAHALLRLEVPVLPRIMTEHAHSITGIDIHPGASIDQAFFIDHGTGVVIGQTAVLGKRVKIYQGVTLGALAFRRDEQGGLQRDIKRHPTLEDDVTVYAGSTILGGETVIGARSVIGGNIWLTHSVPPDTKVVLNPPELVYKPQKNGQQPAGGK

SEQ ID NO: 21751 - protein, 328 aa, Listeria innocua Clip11262
MMSIVVLGGAGYIGSHAVDELINRGYEVVVVDNLRTGHKESIHKKAKFYEGDIRDKAFLSTVFEKESIDSVIHFAASSLVGESMEVPLEYLNNNVYGTQVLLEVMEQFGVKHIVFSSSAATYGEPERVPITEDMPTSPESTYGETKLIMEKMMKWCDKAYGMKFVALRYFNVAGAKADGSIGEDHKPETHLVPIILQVALGQREKLAIYGDDYNTPDGTCIRDYVQVEDLIDAHIRALEYLKKGGESNIFNLGSSNGFSVKEMLEAARIVTGKEIPAEVVPRRAGDPGTLVASSDKAREILGWQPTYTDVKDIIATAWNWHVSHPNGY

SEQ ID NO: 21752 - protein, 250 aa, Zea mays
MGRKFFVGGNWKCNGTTDQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 21753 - protein, 527 aa, Vitis vinifera
MDSCCVTFKAKAHLAKASRGGLSNGDNEFWGERIRGSLNNSGWVSQLAKGLKTEKRPRKIKPGVACSVITSNNGKETVTIQAPIFERRRADPKNVASIILGGGAGTQLFPLTIRQATPAVPVGGCYRLIDIPMSNCINSNINKIFILTQFNSASLNRHIARTYFGNGVNFGDGFVEVLAATQTPGEAGMKWFEGTADAVRKFIWVFEDAKNKNIENILILSGDHLYRMDYMDLVQNHIDRKADITVSCVPVGESRASDYGLLKMDNRGRIIQFAEKPKGADLKAMKVDTTRLGLSPQEAMKSPYIASMGVYVFKTDILLNLLRWRYPTSNDFGSEIIPLAVMEHNVEAFLFRDYWEDIGTIKTFYEANMGLTEEFPKFEFYNPKTPIFTSPRFLPPTKIEQCQVVDAIISHGCFLRECSVKHSIVGERSRLDYGVELKDTLMMGADFYQTESEIASLLAEGNVPIGIGRNTKIRNCIIDKNAKIGKDAVIVNKDGVQEADRPDDGFYIRSGITIILEKATIKDGTVI

SEQ ID NO: 21754 - protein, 525 aa, Prochlorococcus marinus str. MIT 9211
MPTKNNATFFNQWFSSPKEDLLSGLVVAFAMIPEAIAFSGIAGVDPQVGLFGAFCLSITIALVGGRLGMITSATGSTALLMTGVVATGNAQGEGLGLSYLIAAGLLTGVFQILWGYLRLAYQMRFVPTGVLSGFVNALALLIFQAQLPQLGLNLQYGEHIHNEQMSQMLPTGIQIPIVWGLVILGLIIIYGLPKITKAIPSQLIAILVLTLISIGLDLQIPTVQDLGQLPVGLPSISLPFGSIDNGKIPFNMETFGIILPTALAISLVGLMETFLTQDILDEITDSNSNKNVEARGQGIANIVSSLFGGMAGCALVGQSVMNVENGGRSRLSTFSSGISLLILILLCKPWLKEIPMAALVSVMITIAISTADTNGLKNISRIPRSDTAVMLMTFSVTMLTTPHNLALGVIAGVALAGILFSRKVAKVIKVTSSKVNEEEIIYKVSGQLFFVSKIYFAQGFDTHDHVKKITIDMTNAHIWDQSGVAALDQIIRKLTLGGSNVNVIGLNKESLDLFDRLGGQEPSHG

SEQ ID NO: 21755 - protein, 725 aa, Vibrio fischeri ES114
MIYQGENLSVDYIEPGIAHLVFNAKGSVNKLNLATLQSVGEAIDALYSQKDLQGLLLSSDKSAFIVGADITEFLGLFDIPTEELSDWLHQANAIFNRLEDIPVPTLSAITGFALGGGCECVLATDFRLADETASIGLPETQLGIMPGWGGSVRLPRLIGADPAMEVITTGKPKRAKDALALGMVDGVVSRETLITDSVTMLKKAIEGQLDWQSRRTQKKAPLKLSPLEAAMSFNVAKGMIMKMAGKHYPAPMTAVKSIENSAFMDRDAALEVENKNFVALTQTDVAKSLVGIFLNDQLVKSKAKQAIKNSEPVTSAAVLGAGIMGGGIAYQSASKGVPVLMKDIAQQSLDLGMSEASKLLNKQLERGRLSGLKMAKVLSSITPSLNYASIENKDIVVEAVVENPKVKAAVLAEVENEVNEHAILASNTSTIPISLLAKSLKRPENFCGMHFFNPVHRMPLVEVIRGEKTSQQTIDRVVAYASQMGKTPIVINDCPGFFVNRVLFPYFAGFSLLLRDGGDYQQIDNVMEKEFGWPMGPAYLLDVVGIDTAHHAQAVMAQGFPERMAKNGRDVIDAMFESDRYGQKNGSGFYAYSIDRKGKPKKNIDESTAGIIATVTNTTQPYTSEQISARMMIPMINEVIRCLDEGIIASPAEADMALVYGLGFPPFKGGVFRYLDAIGLTTYLDMAKEFEHLGAVYQVPESIKQKAADDECYYPAPQSLSAPSA

SEQ ID NO: 21756 - protein, 118 aa, Panax ginseng
LCEGGELFDRIVARGHYTERAAAAVVRTIVEVVQLCHRHGVIHRDLKPENFLFANKKENSPLKAIDFGLSIFFKPGEKFSEIVGSPYYMAPEVLKRNYGPEIDIWSAGVILYILLCGV

SEQ ID NO: 21757 - protein, 413 aa, Arabidopsis thaliana
MGSLSTILRHPDELYPLLKLKLAITKAQKQIPLEPHLAFCYSILHKVSKSFSLVIQQLGTELRNAVCVFYLILRALDTVEDDTSVPVEIKVPILIAFHRHIYDGDWHFSCGTKEYKLLMDQFHHVSAAFLKLEKGYQEAIEDITKRMGAGMAKFICKEVETIDDYDEYCHYAAGLVGLGLSKIFIASELEILTPDWKQISNSTGLFLQKTNIIKDYLEDINERPKSRMFWPREIWGKYVDKLEDFKNEEKATKAVQCLNEMVTNALNHVEDCLKSLASLRDPAIFQSCAIPQIVAIGTLALCYNNVQVFRGVVRLRRGLIAKVIDRTKTMDDVYGAFYDFSCMLQTKVDNNDPNAMKTLNRLETIKKFCKENGGLHKRKSYVNDETQSKAIFVVMFVLLLAIVVVYLKANQRK

SEQ ID NO: 21758 - protein, 349 aa, Arabidopsis thaliana
MSSNTASSSAGAAGSGDSSAARKNSKRPKYSKFTQQELPACKPILTPGWVISTFLIVSVIFIPLGVISLFASQDVVEIVDRYDTECIPAPARTNKVAYIQGDGDKVCNRDLKVTKRMKQPIYVYYQLENFYQNHRRYVKSRSDSQLRSTKYENQISACKPEDDVGGQPIVPCGLIAWSLFNDTYALSRNNVSLAVNKKGIAWKSDKEHKFGNKVFPKNFQKGNITGGATLDPRIPLSEQEDLIVWMRTAALPTFRKLYGKIESDLEMGDTIHVKLNNNYNTYSFNGKKKLVLSTTSWLGGKNDFLGIAYLTVGGICFILALAFTIMYLVKPRRLGDPSYLSWNRNPGGR

SEQ ID NO: 21759 - protein, 177 aa, Populus trichocarpa x Populus deltoides
MTRLQIPDTTRGSGTRHPAYRGVRKRRWGKWVSEIREPRKKSRIWLGSFPVPEMAAKAYDVAAYCLKGRKAQLNFPEEADDLPIPSTCTARDIQAAAAKAAHSVLIPMKKSSETNNDGGGDGEVAGDDFWGEIELPELLLSNSGYSWDSCGWNTTLASDNSTWQPDGEGLQPSMACL

SEQ ID NO: 21760 - protein, 157 aa, Staphylococcus aureus
GHSERRELFHETDEEINKKAHAIFKHGMTPIICVGETDEERESGKVNDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGASLKVEDFVQLLEGA

SEQ ID NO: 21761 - protein, 507 aa, Cryptococcus neoformans var. grubii
MLPGPVIEANTGDTVIVHVNNYLHEGQGIHWHGLRQNGTALMDGVPGITQCSIPPGGSFTYQFTVSHQSGTFWWHSHYSNSMADGIWGPLIVHSPNEPLQRGRDYDEDRIVAVTDWMHDESETIVEALISSEGYRGRPFPPQGDAILINGRGQTNCTATGSPSCTYPPPPEIHVPVNCRVRLRFISAASHPMYRISIDNHSMEIVETDGTAVYGPTIHEISISSGERYSVIINTTEGKEGDAFWLRTSVALDCMAQGVTQVGLAVVRYTGNGSITTAEPRTEAWTDLARPDTPCVGLDEMYHLSPRELVNASQTALESRVLDSKLGKFVDVYGNSFEGYGFNNVTYQNQINDPLLYVVQRGGTCNSSLIANATFADIGPVNIIINNLDSHIGHPYHMHGTEFQLMGRGTGALTLDDLPNTNLTLDNPTRKDTIWMQGGSWALLRIISDNPGVWALHCHIGWHLAKGKMAVVVVQPEAIKKIQWPESWMDLCANTDPNAFGPARRSVS

SEQ ID NO: 21762 - protein, 594 aa, Cryptococcus neoformans var. grubii
MGGIIKLSFLFCSLISLVNSENTGKLPTAISDHSVPKATATTDPSVFVLSNDFEITDVPTTREYTFNLTEALASPDGYERLVYAVNNMLPGPVIEANTGDTVIVHVNNYLHEGQGIHWHGLRQNGTALMDGVPGITQCSIPPGGSFTYQFTVSHQSGTFWWHSHYSNSMADGIWGPLIVHSPNEPLQRGRDYDEDRIVAVTDWMHDESETIVEALISSEGYRGRPFPPQGDAILINGRGQTNCTATGSPSCTYPPPPEIHVPVNCRVRLRFISAASHPMYRISIDNHSMEIVETDGTAVYGPTIHEISISSGERYSVIINTTEGKEGDAFWLRTSVALDCMAQGVTQVGLAVVRYTGNGSITTAEPRTEAWTDLARPDTPCVGLDEMYHLSPRELVNASQTALESRVLDSKLGKFVDVYGNSFEGYGFNNVTYQNQINDPLLYVVQRGGTCNSSLIANATFADIGPVNIIINNLDSHIGHPYHMHGTEFQLMGRGTGALTLDDLPNTNLTLDNPTRKDTIWMQGGSWALLRIISDNPGVWALHCHIGWHLAKGKMAVVVVQPEAIKKIQWPESWMDLCANTDPNAFGPARRSVS

SEQ ID NO: 21763 - protein, 270 aa, Physcomitrella patens subsp. patens
MRVAFQYLETLMRSRDVPRLVKRYAEVLVLDPERKMAPMVNYLISLGVQRDNIGKVILKRPQLLGYTIPGLQPTVQYLIELGVKPESLGKVVSTSPQVLTLNVEEKLKPVVEFFRSMGLNKERDIEMLLVRNAQILCCSIEKNLRPKFLFFKGLGLTENSIADMIVLFPSMLGQSIEGSLAPKFNYLIHEMNRPIEELVEFPQYFGYSLERRIKPRHELLKGKAITTSLASMLACVEDDFKARYLSGQPPSRAPYNKRVKTDRSDPTRTE

SEQ ID NO: 21764 - protein, 615 aa, Burkholderia thailandensis E264
MRGGRGPGRSRGGRARARRAHARQSAVLYATRHAGRSAAILIVPPRRRAPRPPACRAPARRRGPPPIHAVSLLIAMTLNSLPVWPALQAHYEEIRDAHLRDWFAPANDRAPTRAERFTFEGGGLAADFSKNLITDATLALLVRLAREAGVEARRDAMFAGETVNPTEGRAALHTALRANSPDAPFHAQVAAERAKMARFADAVRAGAWTGYTGKRIRHVVNIGIGGSDLGPKMVVHALHHVATPDIATHFVSNVDGADLARVLERIDPQETLAIIVSKTFTTLETMTNARSLREWFVANGCPEDALAKHFVGVSANPAEVVKFGIAEANVFEMWDWVGGRYSLWSAVGLSIMIAIGPERFAELLAGAHDMDEHFRTAPLERNLPVLQGLVGIWYRNFFGAQSYLVAPYSEALHYLPSYLQQLEMESNGKSAQIDGAFVDYPTSAVTWGEPGTNGQHAFFQMLHQGPTLVPIDFIAVLTPEHPLASHHPKLLANCFAQSEALMLGRTLDEARKIAGPAHPELAPHLTFPGNRPTTTLLVDALTPRTLGALIALYEHKVLVQAAVWNINPFDQWGVELGKILGKVVEADLTAPQVDPAKHDSSTSALIARARKALGE

SEQ ID NO: 21765 - protein, 400 aa, Klebsiella pneumoniae
MKQVYLDNNATTRLDPMVLEAMMPFLTDFYGNPSSIHDFGIPAQAALERAHQQAAALLGAEYPSEIIFTSCATEATATAIASAIALLPERREIITSVVEHPATLAACEHMEREGYRIHRIAVDGEGALDMAQFRAALSPRVALVSVMWANNETGVLFPIGEMAELAHEQGALFHCDAVQVVGKIPIAVGQTRIDMLSCSAHKFHGPKGVGCLYLRRGTRFRPLLRGGHQEYGRRAGTENICGIVGMGAACELANIHLPGMTHIGQLRNRLEHRLLASVPSVMVMGGGQPAVPGTVNLAFEFIEGEAILLLLNQAGIAASSGSACTSGSLEPSHVMRAMNIPYTAAHGTIRFSLSRYTREKEIDYVVATLPPIIDRLRALSPYWQNGKPRPADAVFTPVYG

SEQ ID NO: 21766 - protein, 163 aa, Azoarcus sp. BH72
MRHVISLLIENESGALSRVSGLFSARGYNIESLTVAPTEDASMSRMTIVTTGSDDIIEQITKQLNKLVEVVKVVDISEAAHIERELMLIKVRATGKDREEMKRTADIFRARIIDVTDASYVIELTGNQSKLDAFIGAIDPALILETVRSGVCGIGRGDRVLKL

SEQ ID NO: 21767 - protein, 580 aa, Vitis vinifera
  misc_feature (274)..(274): Xaa can be any naturally occurring amino acid
  misc_feature (492)..(492): Xaa can be any naturally occurring amino acid
  misc_feature (554)..(554): Xaa can be any naturally occurring amino acid
MGNNCVGSMVPEHGLFESISNSIWWTRASECMTSHSTGEGVSETQSKEQKSPPPVQNKPPEEVELINPPEVMKITKEETKPTPTPKRPLLMKRLPSAGLEVDLVLKDKTDHLKEHYNLGRKLGHGQFGTTFLCVEKETGKEYACKSIAKRKLLTRDDIEDVRREIQIMHHLAGHSNIISIKGAYEDAVAVHLVMELCTGGELFDRIAKRGHYTERKAAQLARTIIGVVEACHSLGVMHRDLKPENFLFVNEQEESLLKTIDFGLSVFFKPGEIXTDVVGSPYYVAPEVLRKCYGPEADVWSVGVIIYILLSGVPPFWAESEQEIFQEVLHGDLNFSSDPWPHISESAKDLIRRILVRDPKKRLTAHEVLCHPWIQVDGVAPDKTLDSAVISRLKQFSAMNKLKKMALRVIAENLSEEEIAGLKEMFKIIDTDNSGQITFEELKAGLKRFGANLKEAEIYDLMQAADVDNSGTIDYGEFIAATFHLNKIEREXHLFAAFSYFDKDGSGYITPDELQKACEEFGMEDVHLEEMIQEVDQDNDGRIDYNEFVAMMQXGNNNDFGKKGLQNGISFGFRQPLPVY

SEQ ID NO: 21768 - protein, 352 aa, Oryza sativa Japonica Group
MADSPSPRLDEEDAFGRDFNSSPSPTAPPARSGEKRPFGDLDDDDEDVFASKKGKTKVEESAPGAATGMILSLRERATRIIYIVCLEHGTDFSPHPEVCRTVKIILRHVRWNGRLPNQKFKSGIQHFRTFQLYLLEPIQLEKAKKREAAFIVTFAKREQEIAELKSAVRDLKTQLRPPSMQTRRLLLDPAIHEEFTRLKNLVEEKEKKIKELQDNVAAVNFTPSSKHGKMLMAKCRTLQEENEEIGAMASEGKIHELGMKIAVLKTRNNELRNQFNELYKHMDGLTNDVERSNEMVAILQDELETKDVELRRLKEMLAQKEATDENKIPQENDVAGDDIVAAAESQPIKVET

SEQ ID NO: 21769 - protein, 130 aa, Methylobacterium extorquens
MADRILVHRLAVFARHGVLPEEERLGQRFYISLECRLDLAPAGRSDDVAATVSYADLAEIALEIASNRRFALIEALAEAIAETCLARFPRIETIAVRIDKPSAPIPAVLDYAAIEIVRGRSDSVATTETR

SEQ ID NO: 21770 - protein, 207 aa, Triticum turgidum subsp. dicoccoides
VPRLSELLGIAVKKAEDVIGPEVEKLVADLENGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVP

SEQ ID NO: 21771 - protein, 118 aa, Synechocystis sp. PCC 6803
MDTLNVKGIRAYGYTGYFDAEQFLGQWFEVDLTIWIDLAKAGQSDDLNDTLNYADAVAIVQKLIRESKFKMIEKLAEAIADAILGTGKTQQVKVALTKCQAPIPDFDGDVTLEILRSR

SEQ ID NO: 21772 - protein, 176 aa, Candida glabrata CBS 138
MSLRLVAKRSIAVPRVSRLVVRPMLTRFNSTAAEAGVSEVDPKISKIVEDISKLTLLETSALVTELKSKLNIPDISFPAAGSAPAAAPADGAAKAEEAEEAKPEEKTVFGIKLESFDAKSKAKIIKEIKGLLGLSLVEAKKFVEAAPKILKENVAKDDAEKIKTTLEGLGAKVSLE

SEQ ID NO: 21773 - protein, 326 aa, Lactobacillus plantarum WCFS1
MNATRNVIIDCDPGIDDSLALLLALKSPALNVIGITIVCGNVPTHIGAENALKILDLADRLDIPVYLGANRPLEVAYTSAQDTHGDDGLGNSQIPAVTAVRPIQDAAGFIEETLIEAPDTSILALGPLTNIATVLQRDPHLFEQVDQFTLMGGSYRSHGNCSPVAEYNFWCDPDAAKVVFDLMPVPIQMVGLDVTRNIVLTPSLLTYIKDVNPAMGAFVEKITKFYFDFHWEYERVIGCVINDPLAVAGMLDPTILSGFESYTTVVTDGVARGQSIVDDHDFWHNTPNSQIMTKVDVVAFWRLFLTTVVGATDPDLTQVLHQLVSA

SEQ ID NO: 21774 - protein, 388 aa, Lactobacillus plantarum WCFS1
MDYVGSLALILIVTAVAGHLSVRMGLPAVIGQLLSGIILGPAVLGWVSATSFIKDFAELGVIILMFMAGLESDLKLLKKYWRPSLLVAVLGVILPVAVIDWCSQLFHLNATESLFLGVTFAATSVSISVAVLKELGALDGKEGTTILGAAVVDDVLAVLILSLMISLFGSEVSGGGSHASTNLGLSLAIQLAFFVALYFVVKWVVPHLMAVGNALLVPTSITLMSLVICFGLSYLADAIGLSAVIGAFFAGIAVGQTDYHEVIDEHIQPIGNAVFIPVFFVSIGLNMSFNGFLNDFWFIVVITVAAIATKLIGAGVGARLAGFNWLSGYEIGAGMVSRGEMALIIAQIGYQGKLLSADRYSAVITAIILTTLIAPLLLRQAVKRQREA

SEQ ID NO: 21775 - protein, 459 aa, Rhodospirillum rubrum ATCC 11170
MADYDYDLLTIGAGSGGVRASRLAGGFGARVAVVEGSRIGGTCVMRGCVPKKLLVYGAQYANDLEDMIGYGWSMGGVAFDWPSLITAKNRELDRLEGVYRTMLRNGNVALLEGRARFLDAHSVDIDGKTVTADKILIAVGGWPQMPVIPGIEHAITSNEALDLMVMPERLTIVGGGFIAVEFASIFNALGVDVSVVIRKDKILRGFDADIRDTLTEELVRRGITIVPGTVINRIDKRPGGGYRLIRTPGEAIDTDLVMYATGRAPNTAGLGLEAAGVKVAASGAVIVDEWNRTTVDTIYAIGDVTDRIALTPVAINEAIAFAHTVFNDTPRVMDYENVASAVFSQPPVGTVGLTEEQARARGPVRIFRTRFRAMKHVLAGRDEKTMMKLVVDARTDRVLGCHMVGADAPEIIQGLAVALKCGATKAQFDATIGIHPTAAEEFVTMRDPVPEPVFAQPAD

SEQ ID NO: 21776 - protein, 495 aa, Candida glabrata CBS 138
MDLRVGRKFRIGRKIGSGSFGDIYHGTNLISGEEVAIKLESIRSRHPQLDYESRVYKYLSGGVGIPFIRWFGREGEYNAMVIDLLGPSLEDLFNYCHRKFSFKTVIMLALQMICRVQYIHGRSFIHRDIKPDNFLMGVGRRGSTVHVIDFGLSKKYRDFNTHRHIPYRENKSLTGTARYASVNTHLGIEQSRRDDLESLGYMLIYFCKGSLPWQGLKATTKKQKYDRILEKKLCISVETLCAGLPLEFSEYMNYCRNLKFDERPDYLYLARLFKDLSIKLEYHNDHLFDWTMLRYTKAMVEKQKDVLMLDTSSTANANKESGNNNNESNTTSNTKDSKNDSFNKVKLLAMKKFASHFHYCKNDDKHYPTPEEIKQQTVQNNNAAASLPPELLSAIDKGMENLKQQQNQQQQQSQQVQMQPLASAELNQDQLPPQGPEPLLQRQRKETQGQFVPTQEPVNRATHYPPNVQTNNMPQVQQQNISPQNPKPSGDNIWL

SEQ ID NO: 21777 - protein, 194 aa, Zea mays
MASLWKTKVLPGLNKIFDKDGKKAAAAGFFKSFNKEEIGKEIEEKKAELEPKVAEAYEASPPEVKALFKDKKPVKISKKNSTAVTKFLDELAKIDFPGAKVVSEAVAKSGASPLSPAITFILDKVAPYIPKEEPKAEDAVAEATSREVAVEVEDAEPAIADAAAETPSEAKKGEEEKPAAEEAAPPAAAATEEK

SEQ ID NO: 21778 - protein, 540 aa, Cryphonectria parasitica
MADPFAPRSMKRKNVKGLALTPAAPKPPPTAENANFSHSRNNQSEDTSAQLEIGIEFNLDLRPEDLEIIKDLGSGNGGTVSKVKRIPTNTTMARKVIHVEAKREMRKRIVRELQIMHNCHCEHIVTFYGAFLNDNNDVIMCMEYMDVGSLDRVSRVFGPVRVDVLGKIAEATLGGLTYLYYKHHIMHRDIKPSNILVNSRGHIKLCDFGVSGELINSVADTFVGTSTYMAPERIQGEKYTVKSDVWSFGLSIMELAIGKFPFAASEQLSDAEAAPAGILDLLQQIVHEPAPKLPKSDAFPQILEDMIQKCLLKTPDDRPTPQELYDRDPFVQAAKRTPVDLREWAVSLMERDNRKSHLAPQLSPGTQELLRSNNSPDGAAEDRALATPTSGEIPIVGALLQSPRDQYNSASNRSPTRSDRGPGSSSAGRPGGPPVHPGLGSRVSTTNSIPKMAPPPPPRPGRHSPNLSAGSGSGRQATFALPVRPAPAGPLPNPPMRKQTPDETTSGRGPMRRQATWGASSGSMGAQGMGGYPANQVRRE

SEQ ID NO: 21779 - protein, 388 aa, Bradyrhizobium sp. ORS278
MFERLSRQPDDPLLALIGIFKADPRTDKVDLGVGVYRDEAGHSPIFRAVKAAEQRIWASQDSKAYVAPEGDQGFLDLLWTMVGGKASPVHAAGVQTPGGSGALRLAADLIRQAGTGRIWLGLPSWPNHAGIFAAAGLAIETYPYFDVPSQTLLLDGMLEALQRAQPGDAVLLHASCHNPTGAPLGAADWARITDVIATRGLVPLIDSAYQGFGAGFEGDVAGLRALVAAIPEALVAVSCSKSFGLYRERTGALFAVAGTTAAVETARSNLVAIARTSYSMPPDHGSAIVKTILGTPELYDDWRAELESMRQRLASLRRSFAEALGGRWSNSLAIGKQEGMFSLLPLTPAEVMTLREKHGVYMPTSGRINVAGLKLSDVTRVAGLFKAI

SEQ ID NO: 21780 - protein, 335 aa, Bradyrhizobium sp. ORS278
MLQLGRSLQRNRFSAMPVQLDADAAAVYKAFQEAGRPAYETLTPQEARDYYLAARTVSNPEPPELAEVKELAISGPHGAIPARLYRPKSVRQTNGLAPGLVFLHGGGWVIGNLESHDVVCRTLAHEGELIVVSVDYRLAPEHKFPAAVDDAVAATQWVAGNAASLGIDAARLSVGGDSAGGNLAAVVALSARDGNGPKLSGQVLIYPATDFTMSNPSHSEPETSVLLTHSVIRWFRDHYLNSAADIHDWRASPAKAESLVGLPPAYVLTAGADPLRDEGDDYARRLREAGVPVTYRTHPGQFHGFFTMGKLLDQANVAARDIGAWLKQLDRPVGI

SEQ ID NO: 21781 - protein, 257 aa, Bradyrhizobium sp. ORS278
MSDSIRLDGRVAVVTGAAGVIGRATMQLLAARGARIVAIDRREADLHDATRALPAVAETLAISADVTDEAQVIGYVRKTCDRFGTIDVFFNNAGVEGEIKSITDYPLDAFRRVLDVNVVGVFLGLKHVLPIMLKQNRGSIINTASIAGLIGSPQIAVYSASKHAVIGLTKSAAWECTGTNVRVNCICPGLIDSRMLSAIIEGRSGAPVPVDKVVDRVPARRLGQGSEVAAIVAFLASDDASYVSGAAYTVDGGRTAA

SEQ ID NO: 21782 - protein, 445 aa, Brassica juncea
MTKKTRKLGKYEVGRTIGEGSFAKVKFARNTDSGENVAIKIMAKSTILKNKMADQVKREISIMKIVRHPNIVRLYEVLASPSKIYIVLEFVTGGELFDRIVHKGRLEESEARKYFQQLIDAIAHCHCKGVYHRDLKPENLLLDTNGNLKVSDFGLSALPQQGVELLRTTCGTPNYAAPEVLNGQGYDGSAADIWSCGVILFVIMAGFLPFSETDLPSLYRKISAAEFSCPQWFSEDVKSLIQRILDPNPKTRIQIQRKLGKHSWFRLNYMPTRARKEEESNLDDVRAVFDGIEGSYVAENIERKYEGPLMMNAFEMITLSQGLNLSALFDRRQDFVRQTRFVSRREPSVIIANIEAVATSMGFRAHTRNFERRLEGLSSIEGKGEFAVVIEYEVAPSLFMVDVREAAGETLEYHKFYKKLCEKLENIIWRATEGMPKPELRTITF

SEQ ID NO: 21783 - protein, 425 aa, Arabidopsis thaliana
MKPSSPISLTSSSIARKARFSPYLFTLLAFILFVSVLYGEDFMCIFGQLEPNFVLPPSRTPEKNKKSEKLAFAIGKTEESCDVFSGKWVRDEVSRPLYEEWECPYIQPQLTCQEHGRPDKDYQFWRWQPNHCDLPSFNASLMLETLRGKRMMYVGDSLNRGMFVSMICLLHRLIPEDQKSIKTNGSLTVFTAKEYNATIEFYWAPFLLESNSDDAIVHRISDRVVRKGSINKHGRHWKGVDIIIFNTYLWWMTGLKMNILQGSFDDKEKNIVEVSTEDAYRMGMKSMLRWVKNNMDRKKTRVFFTSMSPAHAKGIDWGGEPGQNCYNQTTLIEDPSYWGSDCRKSIMKVIGEVFGRSKTPITLLNITQMSNYRKDAHTSIYKKQWSPLTAEQLENPTSYADCVHWCLPGLQDTWNELLFAKLFYT

SEQ ID NO: 21784 - protein, 461 aa, Mycobacterium smegmatis str. MC2 155
MTAIQESTLLPNGLTVDTAKAEAARAYELDRAHVFHSWSAQEEISPMTVTAAQGSYLWDGDGNRLLDFSSQLVNTNIGHQHPKVVAAIAEQAAKLCTVAPQHANAARSEAARLIAERTPGELNKIFFTNGGADAVEHAVRMARLHTGRYKVLSRYRAYHGGTDTAINLTGDPRRWPNDRGNSGIVHFNGPFLYRSSFYAETEEQESQRALEYLEKLIQMEGPSTIAAIILESIPGTAGIMVPPPGYLAGVRELCTRYGIVFIADEVMAGFGRSGKWFSINHFDVVPDLMTFAKGVNSGYVPLGGVAISPEIYETFAHRAYPGGLTYSGHPLACAAAVATINAMEDEGMVENAAKVGAEVIGPGLAELAAKHRSVGEVRGLGVFWAVELVKDQKTREPLAPYGSSSPAMNAVIAACKSGGLLPFANFNRIHVVPPCNVSADEAREGLAILDSALDVADEHTV

SEQ ID NO: 21785 - protein, 585 aa, Zea mays
  misc_feature (461)..(461): Xaa can be any naturally occurring amino acid
  misc_feature (552)..(552): Xaa can be any naturally occurring amino acid
MASAAAGTPKRCYYEVLGLSRDCSPTDIKLAFRRLALSLHPDKQPPGSDLAAATAAFQELQHAHSVLSDPQERAYYDSHRSQILFSDPASAGAKSASIVPDLFAFFSSSAFSGFSDTGRGFYKVYGDVFDKVFAQELAYARRMGVPDPAAPPVIGNLDSPYAQVTAFYSYWLGFGSVMDFGWAAEWDAARGESRRVRRLMEEDNKKAMRKARREYNDAVRGLAAFCKKRDKRVVDMVLKKKLEEERRKAEEKERKKEEDKRKKERAMACQEPEWARAEEVEEGLYDEDEEEEMRAKKEELYCVACNKKFKSDKQWKNHEQSKKHRDKVSELRMAFREEESLKEAEEGEGDWNEVDVGFDFKPTQESDDESAFSDAAEELAEEFEEGLEVHDKENGDKDFDSAEQEVGSYDEASVLEAMLSSCKNRKGGYVAPPEEALSGTAEDDDHHRSSEVNNAKRKGRXRRAAKKEQDESNYAGNEHHGKCEVQPEGSVHGNDVDDIMEGPSSSNVNNGSVSKGDKQNGENTNPKKNKKGTKKKPTVSTDQKSMSKADQXSTSKGKKQKPRMVYNKLVVWEEKPSVLLAPVAF

SEQ ID NO: 21786 - protein, 624 aa, Triticum aestivum
MMGPAWWAVLVLLAMADAVAGRFVVEKNSVQVTSPESLKGKYECAIGNFGLPQYGGTLQGWVVYPKDNRQACKEFDVSFKGHKSGARPNFVLIDRGECFFTTKAWNAQLAGAAAILVVDSKDEPLITMDNPEDTGTKHLENITIPSVLITKKLGEDLKKSAENGDMVSVLLDWRESLPHPDERVEYEFWTNSNDECGPKCDMQMDFVKSFRGTAQVLEQKGYTQFTPHYITWYCPEAFTVSKQCKSQCINHGRYCAPDPEQDFSKGYDGKDVVVQNLHQVCVFKVANDTGKPWLWWDYVHDFAIRCPMKEKKYTHECASHVIKSLGLDMDKINKCVGDPEADEENPILKAEQDAQIGHGKRGDVTILPTLVVNNRQYRGKLDKGAVLKAICSGFEETTEPAICLSEDVQTNECLENHGGCWVDKANNVTACKDTFRGRVCECPIVKGVKFVGDGYTNCEASGVGRCEINNGGCWKETKNGKTISACSHEESEGCKCPQGFKGDGVKSCEDIDECKAKSACQCNGCSCENTWGSYECSCGGNNMLYMREQDTCISKQAASSVGWSFMWVIFFGLVFAGVGAYAVYKYRLRSYMDSEIRAIMAQYMPLDSQEGANQQQHVAHAGDI

SEQ ID NO: 21787 - protein, 308 aa, Salmonella enterica subsp. enterica serovar Typhi str. Ty2
MARAMDNAILETILQRVRPLIGQGKVADYIPALASVEGSKLGIAICTVDGQHYQAGDAHERFSIQSISKVLSLVMAMRHYPEEEIWQRVGKDPSGSPFNSLVQLEMEQGIPRNPFINAGALVVCDMLQGRLSAPRQRMLEVARALCGVSDITYDATVARSEFEHSARNAAIAWLMKSFGNFHHDVPTVLQNYFHYCALKMSCMELARTFVFLANQGEAFHLDEPVVTPMQARQINALMATSGMYQNAGEFAWRVGLPAKSGVGGGIVAIVPHEMAIAVWSPELDPAGNSLAGIAALEQLTQTLGRLVY

SEQ ID NO: 21788 - protein, 285 aa, Populus trichocarpa x Populus deltoides
MGKDIEVGGEFSAKDYHDPPPAPLIDAEELTQWSLYRAIIAEFIATLLFLYITVLTVIGYKSQTDTTKNSDACGGVGILGIAWAFGGMIFVLVYCTAGISGGHINPAVTFGLFLARKVSLVRAVLYMVAQCLGAICGCGLVKAFQKSYYTKYGGGVNELATGFSKGTGLGAEIIGTFVLVYTVFSATDPKRNARDSHVPVLAPLPIGFAVFMVHLATIPITGTGINPARSFGAAVIYNEDKAWDDHWIFWVGPFIGAAIAALYHQYVLRAAAVKALGSFRSSSNI

SEQ ID NO: 21789 - protein, 308 aa, Spinacia oleracea
MATTATTTPSATSLTTLHRRIPLFPTTTTLLSLSSSSKPLFLSLSSTRSFPTHLYCIKKDDIDITFFEQDNPDEEITFDPPEKPEGYIPPRAVDEPPFESEEEIALAYEELYGAAYSGESLLGNDVYAMDSKIKKATGFGSKSKKEKIRDGFEENVVQVRRVTKVVKGGKHMRFRAIVVVGDKKGQVGVGVGKAKEVVSAVQKAAVDARRNIITVPMTKYLTFPHRNEADYGAARVMLRPAAPGTGVIAGGAVRTVLEMAGVENALGKQLGSNNALNNARATIVAVQTMRQFSDVARDRGIPMEELWK

SEQ ID NO: 21790 - protein, 254 aa, Oryza sativa
SIIAASDGAMVARGDLGAELPIEEVPLLQEEIVRTCRSMQIPVIVATNMLESMIDHPTPTRAEVSDIAIAVREGSDAIMLSGETAHGKFPLKAVKVMHTAAQRTESSLYNPTTSPSLVAHPQALLNEEFSQSQLSKMFGSHATMMANTLCTPIIVFTRTGSMAVLLSHYRPSSTIFAFTNEERVKQRLALYQGVVPIYMKFSDDAEETFSRAISSLLNAQFVKEGDYVTLVQSGVKSIWREESTHHIQVRKVQG

SEQ ID NO: 21791 - protein, 353 aa, Corynebacterium glutamicum ATCC 13032
MSISVKALQKSGPEAPFEVKIIERRDPRADDVVIDIKAAGICHSDIHTIRNEWGEAHFPLTVGHEIAGVVSAVGSDVTKWKVGDRVGVGCLVNSCGECEQCVAGFENNCLRGNVGTYNSNDVDGTITQGGYAEKVVVNERFLCSIPEELNFDVAAPLLCAGITTYSPIARWNVKEGDKVAVMGLGGLGHMGVQIAAAKGAEVTVLSRSLRKAELAKELGAARTLATSDEDFFTEHAGEFDFILNTISASIPVDKYLSLLKPHGVMAVVGLPPEKQPLSFGALIGGGKVLTGSNIGGIPETQEMLDFCAKHGLGAMIETVGVNDVDAAYDRVVAGDVQFRVVIDTASFAEVEAV

SEQ ID NO: 21792 - protein, 453 aa, Bacillus licheniformis ATCC 14580
MHILVVGLDYKSAPVDIREKLTFQPDELGQAMAQLKEEKSILENIIVSTCNRTELYAVVDQLHTGRYYMKMFLANWFGLSKEDISPYLKFYENDGAVEHLFRVSCGLDSMVIGETQILGQVRTSFKLAQEEKTIGTVFNYLFKQAVTVAKRCHAETDIASNAVSVSYAAVELARKIFGDLSDKHVLILGAGKMGELAVQNLHGHGIGQVTVINRTFSKAKELAGRFSGAAKSLNELQCALMEADILISSTGASGYVVTKEMIEHVNKLRKGCPLFMVDIAVPRDLDPALSEVEGVFLYDIDDLEGIVEENLKERQAVAEEVELIIEAEIVSFKQWLNTLGVVPVISALREKALTIQAETMQSIERKLPHLSTREKKLLNKHTKSIINQLLRDPILKVKEFASEADAEEKLALFTQIFDIEEAAFPDGERQDERQPVHAFKRQNPQGLTSIASE

SEQ ID NO: 21793 - protein, 279 aa, Campylobacter jejuni RM1221
MQKYLEKANVLIEALPYIRKFNSKIILIKYGGSAMENEELKHCVMQDIALLKLVGLKPIIVHGGGKDISAMCEKLGVKSEFKNGLRVSDKATTEVASMVLNHINKNLVHSLQNLGVKAIGLCGKDGALLECVKKDENLAFVGTIQKVNSKILEELLEKDFLPIIAPIGMDENFNTYNINADDVACAIAKALRAEKLAFLTDTAGLYEDFNDKNSLISKISLEQAKILAPKIEGGMHVKLKSCIDACENGVKKVHILDGRVKHSLLLEFFTDEGIGTLVG

SEQ ID NO: 21794 - protein, 165 aa, Physcomitrella patens subsp. patens
MVLLLLEIKAELENITNLVPKGGSDGTEYTYYFKIKCGGCGTVSDKETSVTPSELYDIPKSKGSANLVQKCKFCAKVGNITAIPGREKPYTMEDSESGKFVPIGCFDCRGIEPVEFSFKDGWAAEGLTGTKFVDIDLSEEWSEYDEKAAESVGILNMQHRFVVTK

SEQ ID NO: 21795 - protein, 393 aa, Campylobacter jejuni RM1221
MDYKEQSHIVPTYKRFDIVLEKGQGVYLFDDKAKKYLDFSSGIGVCALGYNHAKFNAKIKAQVDKLLHTSNLYYNENIAAAAKNLAKASALERVFFTNSGTESIEGAMKTARKYAFNKGIKGGQFIAFKHSFHGRTLGALSLTANEKYQKPFKPLISGVKFAKYNDILSVEKLVNEKTCAIILESVQGEGGINPANKDFYKALRKLCDEKDILLIADEIQCGMGRSGKFFAYEHAQILPDIMTSAKALGCGLSVGAFVINQKVASNSLEAGDHGSTYGGNPLVCAGVNAVFEIFKEEKILENVNKLTPYLEQSLDELINEFDFCKKRKGLGFMQGLSLDKNVKVAKVIQKCQENALLLISCGENDLRFLPPLILQKEHIDEMSEKLRKALKSF

SEQ ID NO: 21796 - protein, 195 aa, Bacillus licheniformis ATCC 14580
MKVTKSEIVISAVKPEQYPEGGLPEIALAGRSNVGKSSFINTMINRKNLARTSSKPGKTQTLNFYIINDVLHFVDVPGYGFAKVSKTEREAWGRMIETYLTSREELKAVVQIVDLRHAPSQDDVMMYDFLKHYEIPVIVIATKADKIPKGKWEKHAKVVKETLNIEKEDRLILFSSETKKGKQEAWSAIEQMIAR

SEQ ID NO: 21797 - protein, 391 aa, Halobacterium sp. NRC-1
MREDFLLLNPGPVPVAREVREAMSAPMVSHRSAAFEAVYERAQEHVEYVFEGSTPSGDTTSAGGTALLLNGTATMGMEAAVGNLVGDGGEVVAVVNGKFGRRFARVAERYADVTRVTADWGAPVDLDAVADAVTTETDVVTMVHNETSTGLLNPVDAVGDIAADADARYVVDGVTSIGGDEFRIDDWGVDIAVTDAQKALAAPPGLSAVYVTDDVVPALDGEAAPFYEDIEWHLRKAESNQTPFTSAVPLFRGLAAAAARIREEGMADRIARHRRQAAAFRDGFHEMGLASFPELNDAAAYSNTLTAIRLPAGARGADAAAFMDAVTARGVSISGGQGHLGGEIFRVSNMGQLTAQQVVRGVRTVGDALDEVGVDVAVHDGVAAARATLEQ

SEQ ID NO: 21798 - protein, 182 aa, Campylobacter jejuni RM1221
MLIKFKNHSPKLGQNVFVAEGAKIIGEIEIGDESSIWFNCVLRADVNFIKIGKRTNIQDLSTVHVWHREFDKKGKLKDAGFPTIIGDDVTIGHNCVIHACVIKNRVLIGMNAVIMDSALIEEDSIVGAGSVVTKGKKFPPRSLILGNPAKFVRELNDEEVSFLKQSALNYVDFKNEFLKDLQ

SEQ ID NO: 21799 - protein, 310 aa, Triticum aestivum
  misc_feature (87)..(87): Xaa can be any naturally occurring amino acid
  misc_feature (104)..(104): Xaa can be any naturally occurring amino acid
EKLPGSVVDLLRAHVITLHHYLMLFMMLGFSVLFDCIKAPGLGIATRYMFTMAVGRLLRTATFVGTILPSARPWCAAGRYQIPGHPXPGARKYCVPYASDSHAXRAVIDTDMAYADVQAYPDEYSPDWGRMSFLVDILRPTPGEGPAWYHLLKKASGGCNDLMYSGHMLVAVLTAMAWTEAYGGWISVAIWFLVLHSAQREIRERHHYTVDCVAAIYVGILLWRMTRFIWSARDASRARRLAKLEEVQSRLIHAAKDADVNEIRDLLKEVELAGHDKPGFSQRAILAFAAATIIFTLTCVVLALTLTSDG

SEQ ID NO: 21800 - protein, 244 aa, Arabidopsis thaliana
MDIAISKLNNGGWVHIFPEGSRSRDGGKTMGSAKRGIGRLILDADTLPMVVPFVHTGMQDIMPVGASVPRIGKTVTVIIGDPIHFNDILSTEGAQHVSRKHLYDAVSSRIGQRLYDLKAQVDRVYIEQQSMMSHNAKTPSDRAAEIFHRVDWDSFGMGAQFSEESSPSSKPIGQSDDRIVRSPKRRVSPEGGVSLKIKKLMDSTEMMGFAARGLLMNEYKSRVESANVGRPLKAWREYFMNRGL

SEQ ID NO: 21801 - protein, 594 aa, Xanthomonas campestris pv. vesicatoria str. 85-10
MSFDPPFSHGSTASGLSRRRFVQGLALGGVAAASGLWRYDARAAAQATTPVLRGSSQSLQIGRLPVNFTGHTRSAITVNQSLPAPTLRWREGDTVGVRVRNALADQATSVHWHGLLLPANMDGVPGMSFDGIAPGQEYHYRFTLRQSGTYWYHSHSMFQEQSGLYGAIVIDPLTPPPYRHDREHVVLLSDWTDLDPAALFRRLKQMPSHDNYAQRTVVDFLRDARDDGLRATLADRGMWGRMRMIPTDLSDVNANTYTYLLNGVAPAGNWTGLFKPGEKVLLRFINGSSMTYFDIRIPGLRMTVVAADGQYVHPVSVDELRIAAAETFDVIVEPLGQDAFTLFAQDMGRTGFACGTLAVQHGLQAPIPALDRRAILTMQDMGHGDGMHHALPAMHGAPGMLAAHGTHTMHSHDDAQAHDKAPHHPASETGNPLIDMRSNATAPRLDDPGVGLRDNGRRVLCYADLHSVFEDPDGREPGRDIELHLTGHMEKFAWSFDGIAFASAQPLRLQYGERLRIVLVNDTMMQHPIHLHGMWSDLEDAHGNFQVRKHTIDMPPGTRRTYRVRADALGRWAYHCHLLYHMEAGMMREVRVEA

SEQ ID NO: 21802 - protein, 254 aa, Vibrio fischeri ES114
MTDKMNMAEETTHFGFTTVAKEEKVAKVAEVFHSVAAKYDIMNDLMSGGVHRVWKRFTIDCSGVRPGHKVLDLAGGTGDLTAKFSRIVGEKGQVILADINNSMLNVGRDKLRDMGIVGNVNYVQANAEELPFPDDHFDCITISFGLRNVTDKDKALRSMFRVLKPGGRLLVLEFSKPILEPLSKIYDAYSFHLLPKMGEIIANDADSYRYLAESIRMHPDQETLKGMMEDAGFEQANYYNLTGGIVALHRGYKF

SEQ ID NO: 21803 - protein, 533 aa, Aspergillus nidulans FGSC A4
MADTIPHNTFDTILVLDFGSQYTHLITRRLREINVYSEMLPCTQKLADLGWKPKGIILSGGPYSVYEEGAPHADPAFFELGVPILGICYGLQELAHRLHADNVVAGTAREYGHADLKATKFGGHVDKLFENIEGDMTVWMSHGDKLRNLPEGFHTIGTTQNSEYAAIAHKSDPIYGIQFHPEVTHTPQGGQLLKNFAVGICGAEQKWTMAEFIGQEIQRIRSLVGPDGQVLGAVSGGVDSTVAAKLMTEAIGDRFHAVLVDNGCMRLNECEKVQEVLQEQLGINLTVVDAGEQFLAGLKGVHDPEQKRKFIGGKFIDVFEDEARKIEAKSNGKVEWFLQGTLYPDVIESISFKGPSQTIKTHHNVGGIAERLMRGHGLKLIEPLRELFKDEVRELGRQLGISPELVGRHPFPGPGIAIRVLGEVTREKVEMARQADHIFISMIREAGIYDEIGQAYAALDPSRAVGVMGDKRVYANIILLRAISTKDFMTATPYPFSYEFLSKVSTRIVNEVAGVCRVCYDYTSKPPGTIEME

SEQ ID NO: 21804 - protein, 370 aa, Corynebacterium efficiens YS-314
MTRTPRTPLATILPDFPWDSLATAKARAGEHPDGIVNLSVGTPVDPVAPGIQIALSEAAGFSGYPQTIGTPELRSAIRAALERRYGMTGLVDASVIPVVGTKEAIALLPFMLGLAGHTVVIPEIAYPTYEVSAVAAGARVLRSDSLLKLGPEVPSMMFLNSPSNPTGKVLGVEHLRKVVGWARDNDVIIAADECYLGLGWDDDNEPLSILDPRVCDGDHTNLLAIHSLSKTSNMASYRAGYIVGDTALVGELTEARKNLGLMVPYAIQQAMIAALNDDEQEAGQKLIYARRRATLMKALLGAGFRIDDSEAGLYLWATRDEPCRDTVDWFAERGILVAPGDFYGPRGTHHVRVAMTETDERINAAAARLA

SEQ ID NO: 21805 - protein, 399 aa, Bradyrhizobium sp. ORS278
MVDATVIPTLEQRLASLTAPSARSNVPPFMVMDVMAAAERIEAGGGHVIHMEVGQPAAPAPRTAIAAAHAALDQARIDYTSALGLSSLRQRIARHYHETHACEIDPARIVITTGSSAGFILAFLAMFEPGDRVAVTVPGYPPYRHILTALGCEPVLIETTAENRHALTGEALLAAHRETPLKGVLVASPANPTGTMMSREALGGVIAAARGAGIRFISDEIYHGLDYAFPAVTAAELSPDALIINSFSKYFCMTGWRIGWMVVPDALVRPIERLQQNLAISVPTLSQIAAEAAFDGRPEMDAIKHGYQENRRILIEGLPKAGLSRFLPADGAFYLYADVSDFTTDSFDFAKRMLEETHVAATPGVDFDPIHGRSFVRFSYARSADDMREAVARIARWLG

SEQ ID NO: 21806 - protein, 103 aa, Triticum aestivum
  misc_feature (43)..(43): Xaa can be any naturally occurring amino acid
  misc_feature (69)..(69): Xaa can be any naturally occurring amino acid
  misc_feature (72)..(74): Xaa can be any naturally occurring amino acid
  misc_feature (77)..(77): Xaa can be any naturally occurring amino acid
MASSDGQTEAAAPSVPKNPAMASCRKKKTDDATFLEDLKDHIXEFIHASMDEHKTCFKKTIQKILGCRXCCXXXAAXAKELELKCLQLRQCLALFTLEFLTRF

SEQ ID NO: 21807 - protein, 82 aa, Zea mays
EPVLSTKHIALAVNEDLTLHTRLIDALEDHVDVTNSRLQRVQKRLAILNKRTKGGCSCTCLLLSVVAIVILAVIVWLLVKYL

SEQ ID NO: 21808 - protein, 515 aa, Mycosphaerella graminicola
MGLLQEVLAQFDAQFGQTSLWKLVGLGFLAFSTLAILLNVLSQLLFRGKSSDPPLVFHWVPFIGSTITYGIDPYKFFFSCREKYGDVFTFILLGKKTTVCLGTKGNDFILNGKLKDVNAEEIYSPLTTPVFGKDVVYDCPNSKLMEQKKFVKYGLTTSALQSYVTLIAAETRQFFDRNNPHKKFASTNGTIDLPPALAELTIYTASRSLQGKEVREGFDSSFADLYHYLDMGFTPINFMLPWAPLPQNRRRDYAQKKMSETYMSIIQKRRESKTGEHEEDMIHNLMQCKYKDGNAIPDKEIAHMMIALLMAGQHSSSATESWITLRLASRPDIQDELLQEQKDMLGVNADGSIKELTYANLSKLTLLNQVVKETLRIHGPVHSILRKVKSPMPIEGTAYVIPTTHTLLAAPGTTSRMDEHFPDCLHWEPHRWDESPSEKYKHLSPTTALGSIAEEKEDYGLVSKGAASPYLPFGAGRHRCIGEQFAYVQLQTITATMVRDFKFYNVDGSDKVVGT

SEQ ID NO: 21809 - protein, 151 aa, Ralstonia solanacearum GMI1000
MKVSDILHVKGNTLYTVAPETKLQVAVQTMAEYDIGSLVVMEYGELVGMLTFREIILVLARNNGKVDDGTTIRKVMDDHPLTCTPETEVNEVRRMMLERHARYLPVLDNRTLMGVISFYDVAKAVFEEQNFENKMLKAYIRDWPKEEASED

SEQ ID NO: 21810 - protein, 130 aa, Pseudoalteromonas tunicata D2
MSKFNTLDEFERYVIEEKGTERPFSGQYNDFFVQGHYCCKRCNAPLYRSEHKFSSHCGWPSFDDEIEGAVARVPDADGRRVEIVCANCQGHLGHVFEGELLTEKNIRHCVNSVSMTFISADIQSPDILSE

SEQ ID NO: 21811 - protein, 89 aa, Magnetospirillum magnetotacticum MS-1
LDLDLPGGRLCCRSTPRAEHWVVVRGCARVTVDDTVADYRESEHIFIPLGSIHRLENPGNDNVELIEVQLGSYLGEDDIVRLEDAYHRA

SEQ ID NO: 21812 - protein, 738 aa, Cryptococcus neoformans var. neoformans B-3501A
MNPVSPTSSRGMREYIPQGMEDEDLDGEYLDMEEPIEGDFTLRAILAGLGVGVVLCMTNIYFGLQTGWVSMMSLQSALLGFAIFRVPTFLPRLFPSMRPFTPQENVVLQTTAVATGTMPLAAGLVGIIPALSMMSPEIDGREPLFMGWGDLIMWCLAVAFFGVFLAVPLRKQVIVKEKLVFPSGTATAQLISLLHHTPPVEVQGVRTTAYRRLRRSSTSVSPNRSRRHDNDEEDEWGEDREAEWEEEKDVDIMTGKGWWALGASFIASGSLTVLSFLFPILFSIPVFDVLSLPFGSSLAASWMWWQVHAFTILWIIMGFPVTVSMNIGMVVGWAMLSPLSKHLGWAPGPVSSTTDGARGWILWVALAIMIAESIISLLPITFSYVSTAFRQYRQRNYRPGIFASAPRSPSSQVSAEDDYFTPPDKDEEPEHEPPERLVPNSWVLWGLGVSGVMGVILVWFVFGSDGIHPWATAIGLLLASVLSLIGVRALGETDLNPVSGIGKISQLFFAILQPGNVVANIIAGGVAEAGAQQAGDLMQDLKTGHLLRASPRSQFYGQMIGSLASVFVATAGYKFYTSAYTIPGPEFAVPSAGIWLNLARLLNNGHLPSHVIPFMLGFGALFACLSFVKAFRSSFPASIASSRLVTLLPSGIAFAVGFLNSPSFSIARLIGGYIAYRAAKATRTGETPLLMIVVASGFVLGEGVVSVITLGLTSAGVGAISCWGCGINGGGYCSGGCS

SEQ ID NO: 21813 - protein, 333 aa, Zymomonas mobilis subsp. mobilis ZM4
MMSEAYAIIAEKAGGPEVLVKKPLDLGKMKPEAGQVLLRHQAIGLNFIDIYHRSGLYKQDFPANLGCEAAGVIEVVGDKVKGFKAGDRVAVFTSKPGAYATHRIVDASELVALPDDISAETAAAVLLKGMTSWMLAEKCLAHAAIEGEAPKVMVLAAAGGVGSLLIPWLKYLGVTVFAHTSTEEKAAKVKANGADYVTTLPYSDLPDWVRKQNHGEGVHAVLDSVGADSWKSSIASLRKKGLWVVYGNASGPVPALSPLELSKAGSIYTSRPRLIDYVDNSVDLTTASQKLFALLRKNILKVEINQRFPLTEVAKAHQLLESRKTTGSTVLIP

SEQ ID NO: 21814 - protein, 464 aa, Mycobacterium tuberculosis CDC1551
MRIAQHISELIGGTPLVRLNSVVPDGAGTVAAKVEYLNPGGSSKDRIAVKMIEAAEASGQLKPGGTIVEPTSGNTGVGLALVAQRRGYKCVFVCPDKVSEDKRNVLIAYGAEVVVCPTAVPPHDPASYYSVSDRLVRDIDGAWKPDQYANPEGPASHYVTTGPEIWADTEGKVTHFVAGIGTGGTITGAGRYLKEVSGGRVRIVGADPEGSVYSGGAGRPYLVEGVGEDFWPAAYDPSVPDEIIAVSDSDSFDMTRRLAREEAMLVGGSCGMAVVAALKVAEEAGPDALIVVLLPDGGRGYMSKIFNDAWMSSYGFLRSRLDGSTEQSTVGDVLRRKSGALPALVHTHPSETVRDAIGILREYGVSQMPVVGAEPPVMAGEVAGSVSERELLSAVFEGRAKLADAVSAHMSPPLRMIGAGELVSAAGKALRDWDALMVVEEGKPVGVITRYDLLGFLSEGAGRR

SEQ ID NO: 21815 - protein, 338 aa, Yersinia pseudotuberculosis IP 32953
MYVLVTGGSGYIGSHTCVQLIEAGYKPVILDNLCNSKSSVLARIHSLTGYTPELYTGDIRDRTLLDSIFAAHPIHAVIHFAGLKAVGESVNRPLEYYNNNVFGTLVLLEAMRAAQVKNLIFSSSATVYGDQPQIPYVESFPTGSPSSPYGRSKLMVEQILQDVQLADPQWNMTILRYFNPVGAHPSGLMGEDPQGIPNNLMPFIAQVAVGRRESLAIFGNDYPTPDGTGVRDYIHVVDLADGHVAAMKTLHGKPGVHIFNLGAGVGHSVLQVVAAFSKACGKPLAYHFAPRREGDLPAYWADATKAAEQLGWRVSRSLDEMAADTWHWQSKNPQGYPD

SEQ ID NO: 21816 - protein, 625 aa, Pseudomonas syringae pv. phaseolicola 1448A
MSFASLGLSEALVRAIEAAGYTQPTPVQQRAIPAVLQGRDLMVAAQTGTGKTGGFALPILERLFPNGVPDKSQRHGPRQPRVLVLTPTRELAAQVHESFKLYARDLKFVSACIFGGVGMNPQVQAMSRGVDVLVACPGRLLDLAGQGSVDLSHVEILVLDEADRMLDMGFVHDVKKVLARLPAKRQNLLFSATFSNDITSLAGKLLHNPERIEVTPPNTTVERIEQRVFRLAANHKRSLLAHLITVGAWEQVLVFTRTKHGANRLAEYLDKHGLAAVAIHGNKSQNARTKALADFKAGDVRIMVATDIAARGLDIDQLPHVVNFELPNVDEDYVHRIGRTGRAGRSGEAISLVAPDEEKLLKSIERMTKQKIADGDLMGFDITAVEAEKPEVRERPDVRNSRGARPAGDKNNGGRRDKGKDKGKEKPAAAAATGERPARQPREKKPREGTPRSEQRASQPSIPRPAADRAPDEFRDDEVDNFGNRADYVSPYQGKGQNRGRRPAAAPGAAPAAGGAARPANSGRPAGGARNGSGTGAPKRNGSGSSAPRSRDGQPRGRRPAREDQPLPREGQEPAVRAPRDGQPQPKIVHKESKIDRFPSAEQLDQLPTRPRGEKPALLTRNRDS

SEQ ID NO: 21817 - protein, 269 aa, Oryza sativa
TKPASSSSSSSSPNSVCFARAEAVDATISPTVSALRPSKTMAITDQATALRQAGVPVIGLAAGEPDFDTPHVIAEAGMNAIKDGYTRYTPNAGTLELRKAICNKLQEENGISYSPDQVLVSNGAKQCITQAVLAVCSPGDEVLIPAPYWVSYPEMATLAGATPVILPTSISENFLLRPELLASKINEKSRLLILCSPSNPTGSVYPKELLEEIADIVKKYPRLLVLSDEIYEHIIYQPAKHTSFASLPGMWDRTLTVNGFSKAFAMTGW

SEQ ID NO: 21818 - protein, 513 aa, Zea mays
MHAHEFNSRVVKSPMGSPADDKLRRRRPAGRLLMHCAKATPRGQAHPACMLDYKYPAGCTGQFHPAIDSPPVHRHSSRKRQELKNMANRGLHLALFLVLLGLSSNLAAGQILFQGFNWESWKQNGGWYNFLMGKVDDIAEAGITHVWLPPASHSLAEQGYLPGRLYDLDASKYGNEAQLKSLIEAFHSKGVKVIADIVINHRTAEHQDGRGIYCIFEGGTPDSRLDWGPHMICSDDRAYSDGTGNPDTGADFGGAPDIDHLNPRVQQELTGWLNWLKTDVGFDAWRLDFAKGYSADVAKVYIDGTQPCFAVAEIWTSLAYGGDGKPFYDQNAHRQELVSWLDRVGGKASPATTFDFTTKGILNVAVDGELWRLRGADGKAPGLIGWWPAKAVTFVDNHDTGSTQHMWPFPADKVMQGYAYILTHPGNPSIFYDHFFDWGLKNEIAHLVSIRDRHGIQADSELRIIEADADLYLAEIDGKVIVKIGSRYDCGHLIPEGFQVVAHGDGYAVWEKN

SEQ ID NO: 21819 - protein, 418 aa, Geobacillus stearothermophilus
MMKCCRRVALVLLGLWFVFCISVLGGRAEAAASRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLRVTTIATPHDGTTLVNMVDFTDRFFDLQKAVLKAAAVASNVPYTSQVYDFKLDQWGLRRQPGESFDQYFERLKRSPVWTSTDTARYDLSVPGAEKLNQWVKASPNTYYLSFATERTYRGALTGNYYPELGMNAFSAVVCAPFLGSYRNATLGIDDRWLENDGIVNTFSMNGPKRGSTDRIVPYDGTIKKGVWNDMGTYNVDHLEVIGVDPNPLFDIRAFYLRLAEQLASLQP

SEQ ID NO: 21820 - protein, 370 aa, Bacillus licheniformis ATCC 14580
MKKRIALLPGDGIGPEVLDAAVDVLKSVAEHYQHEFEFEYGLIGGAAIDEAGAPLPEETVAACKAADAILLGAVGGPKWDQNPSELRPEKGLLAIRKQLDLFANLRPVKVFESLAGASPLKTEYIEGVDFVIVRELTGGLYFGKPSEQYVNQNGEEEAVDTLFYKKSEMERVIREAFQMAQSRKGKVTSVDKANVLESSKLWRKTAEEVAKEFPDVKLEHMLVDNAAMQLIYAPGQFDIIVTENMFGDILSDEASMLTGSLGMLPSASLSSSGLHLYEPVHGSAPDIAGQNIANPLAAILSAAMMLRTSFGLEAEAQAVEHAVDQVLRAGKRTKDLAKGSEHCTTQSITGEVKAALADDNAISNIMTAYV

SEQ ID NO: 21821 - protein, 415 aa, Halobacterium sp. NRC-1
MTDLSLAGETPACATDGVWLACVECGGTLAPFADVVYRCPECSGLLEARYADYPGFEAFSGRGVWRYADALPVDAGVSVQEGDTPLYEAPDVAAAAGVADVRVKHEGMNPTGSFKDRGMTVGVRVAERLGVDRLACASTGNTSAALAAYGGRADTPVLVLLPAGKVAAGKIAQAALHGARICEVDGNFDDCLDVVAELAARGEAYLLNSLNPFRLEGQKTIAFEILEQSRTATGEWPDRIVLPVGNAGNTAALYKAFRELVAAGAMTDDEMPALTGVQAAGAAPMVEAVEAGRGRTERWTDVETRATAIRIGNPVNAPKALPGVYETGGTAVAVSDDRITDAQRMLAGDGIGVEPASAASVAGLLALRERGEISADERVVCLTTGHLLKDPAAAAAAGGDTTPVPADADGVLDAL

SEQ ID NO: 21822 - protein, 172 aa, Bacillus licheniformis ATCC 14580
MKRIITLTVLNQSGVLNRITGLFTKRHYNIESITVGHTETAGISRITFVVHVADEKETEQLTKQLNKQIDVLKVTDITNQSIVQRELALIRVVSPPSSRTEINGVIEPFRASVVDVAKDSVVIQVTGESSKIEALIELLKPYGIKEVARTGTTAFARGTQQKPASIKTISIV

SEQ ID NO: 21823 - protein, 486 aa, Corynebacterium efficiens YS-314
MAMSEVPAAAQPGAAPGSSETTSDPNRRQELGTGLRTRHLTMMGLGSAIGAGLFLGTGVGIRAAGPAVLLAYIAAGVIVVLVMQMLGEMAAARPHSGSFSKYAEDAFGHWAGFSLGWLYWFMLIMVMGAEMTGAAAIMGAWFGVDPWIPALVCVVFFAIVNLAAVRGFGEFEYWFAFIKVAVIVVFLIVGVGLIFGLLPGSTFVGTSNFIGDHGFMPNGLSGVAAGLLAVAFAFGGIEIVTIAAAESDQPRRAISLAVRAVIWRISLFYLGSVLVITFLMPYESIDNAETAAESPFTRILDMANIPGAVGLMEAVIVLALLSAFNAQIYATSRLVFAMSRNQDAPRVFSVLSRSGVPTAAVLLSMFFAFVSVALQYFNPAGLLDFLLNAVGGCLLVVWAMIALSQLRLRPKLEHNGEISTVRMWGHPWLGILTLVLLAGLVLLMLGNEGSRSQVFSVAVVYGFLVALSFTTTRSPLRGKRTGLIDR

SEQ ID NO: 21824 - protein, 225 aa, Brassica napus
  misc_feature (199)..(199): Xaa can be any naturally occurring amino acid
MVKICCIGAGYVGGPTMAVIALKCPHVEVAVVDISVPRINAWNSDQLPIYEPGLEDIVKQCRGKNLFFSTDVEKHVREADIVFVSVNTPTKTTGLGAGKAADLTYWESAARMIADVSVSDKIVVEKSTVPVKTAEAIEKILMHNSKGIKFQILSNPEFLAEGTAIADLFNPDRVLIGGRETPEGFKAVQTLKEVYANWXFPEGQIITTNLWSAELSKLAENAFWA

SEQ ID NO: 21825 - protein, 526 aa, Oculimacula acuformis
MGILEAVSVPLAQQVSQRGLGVVIAAGFAAFLVVSVVLNVLSQILFKNPNEPPVVFHFFPIIGSTVTYGIDPYKFFFDNKAKYGDIFTFILLGKKTTVYLGRNGNEFILNGKIKDVNAEEIYTVLTTPVFGKDVVYDCPNSKLMEQKKFMKIGLTTEAFKTYVPIIQDEVETFIKRSAELKGHSGTVNIPAQMAEITIYTASHALQGKDCRDKFDSSFAELYHALDMGFSPINFMLHWAPLPHNRARDHAQRTVAKTYMEIMEARRKDKKSLDNMDIMSQLMRSTYKNGVPVPDMEIAHMMIALLMAGQHSSSSSSSWIMLRLASRPDIMEELYQEQLEVLGSDLPPLQYDDLAKLTKHQNVLKEVLRLHTPIHSIMRKVKTPMPVTGTKFVVPTSHVLLASPGFSSRDDTYFPDAMKWEPHRWDPESGGVLGTDVEEESFDYGYGLISKGAKSPYLPFGAGRHRCIGEQFANVQLITITAVMVRHFKFKNLDNSTKVVETDYTSLFSRPLAPAVVEYERREKVKV

SEQ ID NO: 21826 - protein, 460 aa, Bacillus licheniformis ATCC 14580
MHTLEKMEQTNFQTARDYVTQAYETVQKRNFYESEFLQAVKEIFDSLVPVLARHPKYIEHRILERIAEPERMITFRVPWVDDEGNIRVNRGFRVQFNSAIGPYKGGIRFHPSVNASIIKFLGFEQIFKNSLTGLPIGGGKGGADFDPKGKSDREIMSFTQSFMNELYRHIGPDTDIPAGDIGVGAREVGFMFGQYKKIRGRYDAGVLTGKGLEYGGSLTRKEATGYGLVYFVEEMLKDQGMRFENSTVVVSGSGNVALYAMEKAAQFGAKVVACSDSDGYVYDEKGICLETVKRLKEDGNGRIREYVSEHPEAHYFEGCTGIWSIPCDIALPCATQNEIDEEAAEVLISNGVKAVGEGANMPSEEGAVKRFLDAGVLFGPAKAANAGGVAVSALEMAQNSARLHWTAEETDAKLRAIMADIHKRSVEAASEYGRPGNLLDGCNIAGFIKVADAMIAQGVV

SEQ ID NO: 21827 - protein, 590 aa, Zea mays
MEGLSWRTVCCLSVLCAVLFLRPAEGIRFVIDREECFSHNVEYEGDTVHVSFVVIKADTPWHYSEEGVDLVVKDPNGAQVRDSRDKTSDKFEFIVQKRGVHRFCFTNKSPYHETIDFDVHVGHFSYFEQHAKDEHFAPLFEQIGKLDEALYNIQFEQHWLEAQTDRQAILNENMSRRAVHKALFESAALIAASVIQVYLLRRLFERKLGTSRRINGCAELKAARRISSFSCRLSRWSAFEAAGVRVYFASRLENNTGSMKAGNGFVDDSNEKTADAIREMPLAALCKCKVQRMMGSHAQLRAPSSPPSCLAFKSQAGLDLKLRPRCVSGQRRRRDGPAATAAQDSQPEASSANAIRMSNGRCNNQSRSSRAADVDGEAGTRRHWALWWWWCLLLLAAWCCAAAAQSPPAADPLQSKCQGDFGKLTDCMDYATGHAASPSSTCCGDAGDTEKARPECLCYIIQQTHTGRNQVQSLGLRFDRLMALPAACNLPNSNVSLCITLLNLKPGSADYALFANASKITPSAGGNPASDSAAGSGVKLRAGVSGGVALAVVSAIASSLFGRAPPPSKGGGGVFFYPPPGKFFPGGGPP

SEQ ID NO: 21828 - protein, 576 aa, Bradyrhizobium sp. ORS278
MHELIGDITLCILFAWVLGLAAHKWRQPSILAYLVAGFAIGPFGTGWVKSQESISVISELGLIFMLFMIGLEIDLKKIIRAGPVILIAGGVQLLGGAALGILFFVAIGMRMGAESYDALYLCVACALSSTVIIVKVLYEKRELDTLPGRITLGVLVLQDVFAILFLAVQPSLDDLHFGVILLSFARAGALVAIALLLSRYVLPPVFHRIARTPELILLGALAWCFLIGEIAERLHLSREMGSLIAGVSLSTFPYALDVTAKVTTLRDFFITLFFVALGMTIPIPTMSVVGLALVIALFTVASRLVTAFTPLYIMRQGLRASLLPALNLAQISEFSLVVIQTGAAAGHLKAGTSSAASFAFVLLAVASTFVIVRSDPIVRRTIPLLKRVGLHDLDDAKEGEAGHEGGGHGAGRPIVLLGFFRTASALLSEIERTQPALLDQIGVVDFNPVVFRTLSDRGLQVTYGDISNVDTLVHAGVGQAELIILSIPDSLLKGANNEKLVRHVRSINASAKIVATADLLADVNDLYDAGADYVTVPRLSDAQVLLNLIQDASAGLLSERRRQAEALLADRREVLP

SEQ ID NO: 21829 - protein, 164 aa, Penicillium chrysogenum
MASRTRGIDTRQRLMKELKAYNKEGENETFLYLRPVNDEDLLHWEAVLKGPAASPYEGGLWGLDIRIPSDYPYAPPTIHFTTKIAHPNIAWSTGEICSSLNNDWKPTVNLSGILAAIQLLLTVPDPDSPLNPDIAVLMRNGDLAGWESVVRYWTEEERWQGVRW

SEQ ID NO: 21830 - protein, 247 aa, Helicobacter pylori
MKKTFLIALVLATSLIGAENTKWDYKNKENGPHRWDKLHKDFEVCKSGKSQSPINIEHYYHTQDKADLQFKYATSKPKAVFFTHHTLKASFEPTNHINYRGHDYVLDNVHFHAPMEFLINNKTRPLSAHFVHKDAKGRLLVLAIGFEEGKENPNLDPILEGIQKKQNFKEVALDAFLPKSINYYHFNGSLTAPPCTEGVAWFVIEEPLEVSAKQLAEIKKRMKNSPNQRPVQPDYNTVIIKSSAETR

SEQ ID NO: 21831 - protein, 289 aa, Arabidopsis thaliana
  misc_feature (117)..(117): Xaa can be any naturally occurring amino acid
  misc_feature (140)..(140): Xaa can be any naturally occurring amino acid
  misc_feature (218)..(218): Xaa can be any naturally occurring amino acid
MEGKEEDVRVGANKFPERQPIGTSAQSDKDYKEPPPAPFFEPGELSSWSFWRAGIAEFIATFLFLYITVLTVMGVKRSPNMCASVGIQGIAWAFGGMIFALVYCTAGISGGHINPAXVTFGLFLARKLSLTRALYYIVMXQCLGAICGAGVVKGFQPKQYQALGGGANTVAHGYTKGSGLGAEIIGTFVLVYTVFSATDAKRNARDSHVPILAPLPIXGFAVFLVHLATIPITGTGINPARSLGAAIIYNKDHSWDDHWVFWVGPFIGAALAALYHVVVIRAIPFKSRS

SEQ ID NO: 21832 - protein, 380 aa, uncultured gamma proteobacterium
MIASKLPNVGTTIFTRMSALANACGALNLSQGFPDFDAPPALLEAMARHVRAGHNQYAPMPGVPALREQITNQLLRHRGVVCDPEDEITVLPGATEGIFCAVMACIHPGDEVLVFDPCYDSYEPAILLAGGHARHIPLEPGSFRIDWQQVAGAINARTRLVIINSPHNPSGATLSREDLLHLQSLAEEHDLLVISDEVYEHLVFDGQQHHSALQHPGLRQRSFVMFSFGKTFSVTGWKTGYCVAPAALTAELRKVHQFVCFVAVTPVQMAIADFMAAEPDYPATLPAFYQRKRDLFCGALWDSRFRFTPSAGTYFQLLDYSGITQTPDCQLAEDWTREKGIAAIPVSVFYQEPPDQHLLRFCFAKNDQVLLEAAERLCKI

SEQ ID NO: 21833 - protein, 426 aa, Yersinia pseudotuberculosis IP 32953
MTPSDLVFDQQHIWHPYTSMTEPLPCYPVVGAEGVELQLADGRRLIDGMSSWWAAIHGYNHPVLNFAAHQQLDKMSHVMFGGITHPPAVKLCRQLVAMTPPPLECVFLADSGSVSVEVALKMALQYWQAKGEQRQRILTLRHGYHGDTFGAMSVCDPQNSMHSLYQGYLAENLFANAPQCGFDDPWDPQDIANFVALITQHANEIAAVILEPVVQGAGGMRIYHPSYLREVRALCDKHQILLIADEIATGFGRTGKLFACEHAQIVPDILCLGKALTGGYLTLSATLTTRAVAETISKGDAGCFMHGPTFMANPLACAVASANLSLLAENSWQQQVSKIEDQLKRELLPLAQEDTVADVRVLGAIGVVEMKKPVNVARLQRSFVEQGVWIRPFGKLIYLMPPYIISQHALTRLTAAVAAAVVDRGS

SEQ ID NO: 21834 - protein, 323 aa, uncultured gamma proteobacterium
MVQAVRISRTGGPEVMALEEVQLEPPGPGMVTVANRAIGLNYIDTYHRSGLYPLPLPTGIGLEGAGEIQAVGEGVTLREGDRVAYCSAGFGAYAQALNLPAARLVKIPEDISFEQAAAVLLKGQTTEYLLQRTYPLQPGETCLFHAAAGGVGLLFGQWAKSIGANVIGTVGSDEKARLALAHGFAHVINYRTEDVVQRVLEITGGEKVPVVYDGVGRDTFDISLDCLRPRGLMVSFGNASGAPDPLNLQILANKGSLFLTRPTMLTYTATEEELQQSSRDVFSRVLSGDVKIEINQRYPLADVQQAHRDLESRKTSGSTVLLP

SEQ ID NO: 21835 - protein, 340 aa, Glycine max
  misc_feature (160)..(160): Xaa can be any naturally occurring amino acid
  misc_feature (324)..(324): Xaa can be any naturally occurring amino acid
  misc_feature (327)..(327): Xaa can be any naturally occurring amino acid
MDHSADAHRTDLMTITRFVLNEQSKHPESRGDFTILLSHIVLGCKFVCSAVSKAGLAKLIGLAGETNVQGEEQKKLDVLSNEVFIKALISSGRTCILVSEEDEEAIIVEPSKRGKLYCVCFDPLDGSSNIDCGVSIGTIFGVYALKDVHEPTIEDVLLPXKNMVAAGYCMYGSSCTLVLSTGAGVNGFTLDPSLGEFILTHPDIKIPKKGKIYSVNEGNAKNWDGPTTMYVENCKYPKDGSSPKSLRYIGSMVADVHRTLLYGGIFLYPADKKSPNGKLRVLYEVFPMSFLMEQAGGQAFTGNQRALDLVPKKLHERSPIFLGXKKXLGEKKFNPFGGKN

SEQ ID NO: 21836 - protein, 394 aa, Prosthecochloris aestuarii DSM 271
MHELYLKPGEHRRLFKGHLWSFSNELQSLPRDIAAGETVQLFTYDKKLVGTGFYNPQSLIAVRLLSRKRELPNEIFFRRKIEEANTLRKKIYPLHETNAYRLVHGESDGLPGLIIDRFDNACVIQSFSAGMDLHLPLICDVLTSIFQPSSIIIRNESVLRELEGIPLYKKIVLGSETDAQPIIYDTGIRYKTHLFEGHKTGFFLDQRENRRMIRKLAANADTLDVFSSDGGFGLNALHGGASALTMVDVSVDALARAEENARLNNFGNCCALQGDAFDVMKNLIKEGKSYDLVILDPPSFTKSRKNLPTALQAYKKLNKLGLQLVKDGGFLATASCSRHASESDFLHAIQQASQPLGKHLRMICKNSQPADHPVLLSMPETSYLKFACFYVTNT

SEQ ID NO: 21837 - protein, 763 aa, Chenopodium glaucum
MGVVLLPDLGTEILIPVCAVIGIVFSLVQWYIVAQVKLSPDSGRSNSNKNGYSESLIEEEGLNDPAVVAKCAEIQNAISEGSTSFLYTMYQYVGVFMVAFAVLIFVFLGSVEGFSTKSQECTYDKSKTCKPALATAVFSTVSFLLGAITSLASGFLGMKIATYANARTTLEARKSVGKAFIVAFRSGAVMGFLLAANGLLVLYITILLLKLYYGDDWEGLFEAITGYGLGGSSMALFGRVGGGIYTKAADVGADLVGKIERNIPEDDPRNPAVIADNVGDNVGDIAGMGSDLFGSYAESSCAALVVASISSFGINHEFTAILYPLLISSVGIVICLITTLFATDFFEIKAVKEIEPALKKQLVISTGLMTVAVAVISWVALPSSFTIFDFGTQREVKNWQLFLCVAVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHSIRERTDALDAAGNTTAAIGKGFAIGSAALVSLALFGAFVSRAAISTVDVLTPKVFIGLLVGAMLPYWFSAMTMKSVGSAALKMVEEVRRQFNEIPGLMEGTTKPDYANCVKISTDASIKEMIPPGALVMLTPLIVGTLFGVETLSGVLAGSLVSGVQIAISASNTGGAWDNAKKYIEAGASDHAVSLGPKGSDAHKAAVIGDTIGDPLKDTSGPSLNILIKLMAVESLVFAPFFATHGGLLFKIF

SEQ ID NO: 21838 - protein, 303 aa, Streptomyces coelicolor A3(2)
MTQSHPRISKAVIPAAGLGTRFLPATKATPKEMLPVVDKPAIQYVVEEAVTAGLGDVLMVTGRNKRPLEDHFDRNYELESALQKKGDASRLAKVQESSDLAMMHYVRQGDPKGLGHAVLCAAPHVGHEPFAVLLGDDLIDPRDPLLQRMIDVQEQYGGSVIALMEVAPEQIHLYGCAAVESTADSDVVKVGGLVEKPDPADAPSNYAIIGRYVLDPHVFDILRKTEPGRGGEIQLTDALQQLAEDESVGGPVHGVVFKGRRYDTGDRGDYLRAIVRLACEREDLGPDFRTWLRSYVAEEMQGR

SEQ ID NO: 21839 - protein, 416 aa, Burkholderia thailandensis E264
MALIVHKYGGTSMGSVERIKNVAKRVAKWHQAGHQMVVVPSAMSGETNRLLGLAKEISSQPSPRELDMIASTGEQVSVGLLSIAMQEIGVEAVSYAGWQVPIKTDSAYTKARIHSIDDERVRRDLDAGKVVIITGFQGVDPDGHITTLGRGGSDTSAVAVAAALEADECLIYTDVDGVYTTDPRVVEEARRLDSVTFEEMLEMASLGSKVLQIRSVEFAGKYRVKTRVLSSLTDPQIPLDEEMRSGTLITFEEDETMEKAVISGIAFQRDEARIAVMGVPDKPGIAYQILGPVADANIDVDMIIQNQSVEGKTDFTFTVGRGDYQKAMDILTNQVKGHVNAEQVLGDPKVSKVSVVGVGMRSHVGVASTMFRTLSEEGINIQMISTSEIKISVLIDEKYMELAVRALHKAFELDQA

SEQ ID NO: 21840 - protein, 484 aa, Candida glabrata CBS 138
MMSAAGRHVRRYTPGATLGAAAAAAKAIKMTDNVSLETHTDIQAAAKEQADVRASAQGQSGDEVLKSGETVLHHAYKEDSGYGTRPIYMDMQATTPTDPRVLDVMLKFYTGLYGNPHSNTHAYGWETNKEVETARDHVAKVIRADPKEIIFTSGATESNNLAIKGVGRFYKKTKKHIITTRTEHKCALEAARGMINEGFDVTFLSVDNQGLIDMKELEEAIRPDTCLVSVMAVNNEIGVMQPLKEIGALCRKNKIYFHTDAAQAYGKVPIDVNEMNIDLLSVSSHKIYGPKGIGALYVRRRPRVRLEPLLSGGGQERGLRSGTLAPPLVAGFGEAARLMHEEYNADIAHIDKLSSKLVNGLLSLEHTSLNGSAEKRYPGCVNVSFAYVEGESLLMALRDIALSSGSACTSASLEPSYVLHALGKDDALAHSSIRFGIGRFTTEEEVDYVLKAITERVKFLRELSPLWEMVQEGIDLNSIQWSGH

SEQ ID NO: 21841 - protein, 303 aa, Nicotiana tabacum
MEKYEKLEKVGEGTYGKVYKAKDKATGQLVALKKTRLEMDEEGIPPTALREISLLQMLSNSLYIVRLLCVEQIDKNGKPLLYLVFEYLDTDLKKFVDSHRKGPNPRPLPPSLIQSFLYQLCKGVAHCHSHGVLHRDLKPQNLLVDKEKGILKIADLGLGRAFTVPIKSYTHEIVTLWYRAPEVLLGSTHYSTAVDMWSVGCIFAEMVRRQALFPGDSEFQQLLHIFRLLGTPTEKQWPGVSSLRDWHVYPKWEPQNLASAVPALGPDGVDLLTKMLQYDPADRISAKAALDHPYFDSLDKSQF

SEQ ID NO: 21842 - protein, 451 aa, Desulfitobacterium hafniense DCB-2
MSISQRIEKLPVKRFHYILLISAGLGWMFDSMDTGIISFVLPVLMKTWGLTPEQVGNIGSVGLLGMALGAILSGSVADRIGRKKVFAFTLVVYSLATGLCGLAWSYASLLFFRFLVGFGLGGQLPVAVTLVSEFTPAKHRGKFLVLLESFWAIGWLLASVISYLIIPNYGWHIAFFIGAIPALYVFYLWKYIPESPRFLEEQGRIQEAEAVYRLVAGEAGPDVKAGRTAEEAKREHRQPQKGTAKTKVLKRVTVAELFSRKFLRRTVFLWLLWFGIVYSYYGIFTWLPSILALKGFSLTKSFSYVIIMTLAQIPGYFSAAFLVDRIGRKPTLAAFVLGTAISAYFFGLGNSVMMILVFGSLMSFFNLGAWGILYTYTPELYPTRARGTGAGWAAGFGRIGGILAPMVVGRMLGAEMPTETVFLMFAGVLILVVFNVLILGEETKGRPMDEL

SEQ ID NO: 21843 - protein, 426 aa, Azoarcus sp. BH72
MTTIAVIGLGYVGLPLAVAFGKQFRTIGFDLSAEKVAAYKDFIDPTGEVSSEELKAAEHLSCHTDPAVLREADFVIVAVPTPVDEAHNPDFTPLVKSSETVGRNLKPGAIVVYESTVYPGATEEVCIPILERESGLKWKEGFFVGYSPERINPGDKERTVTKIVKVVSGDTPETLATVERVYGAVITAGVYPASSIKVAEAAKVIENTQRDLNIALMNELAVIFHKIGIDTLEVLKAAGTKWNFLPFRPGLVGGHCIGVDPYYLTYKADMLGYHPQVILAGRRINDGMGKYVAEQTVKQMIAAGSSIKGAKVVVLGLTFKENCPDLRNSKVIDVIRELQSYGCDVIVHDPVAAAAEAVHEYGVDLVAWDALPTAEAVVAAVSHREYLDMPLAQMLGKLKPGGVFVDVKSAYDPAELTAAGARLWRL

SEQ ID NO: 21844 - protein, 126 aa, Euglena gracilis
MTDVNDKAFPLAPEKLTQTLLDLTQQCAHLKQLKKGANEATKQLNRGTAALIILAADAMPIEIVLHLPLLCEDKNVPYVFVPSKAALGRACGVTRNVIACAILHAQGSQLQSQIDTIRGEVEKILI

SEQ ID NO: 21845 - protein, 300 aa, Candida glabrata CBS 138
MIRTVLSNSVKRSLVRHSSSSTSAMTYKQLHKHTARPPLPVVDTPAWDANSAVSSILYETPAPSRQPRKQHVLNCLVQNEPGVLSRISGTLAARGFNIDSLVVCNTEVKDLSRMTIVLKGQDGVIEQARRQIEDLIPVYAVLDYSNSEIIKRELVMARVSLLGSEYFEDLLVHHHKSTANLEDSHEIVSEIREKKFHPSNLQASEVLRLKHEHLNDITNLAKNFGGKIVDIGETSCIVELSAKPSRISAFLKLVEPFGVLECARSGMMALPRTPLQTEVDEEDIDGKISDIVDISQLPPG

SEQ ID NO: 21846 - protein, 504 aa, Glycine max
MSSTTQNRRSSFTPSTASSLAKAKRHPSSVSSSSSGKAKVVSTQNLAVKRAPLANLTNQRNAPYSSSSSSLVQGSNKVAKTKKEAPARTSVSKSTISGNKSSQLKSVNSSSVVIPKANSLSQKKDAAPTVATFAVPVRSGIDVSPSKSDGRFVSMDETTSSCDSIKSPDEVEYLDNRDVSDVDSIQKKIISNLNISDTTEPEGNVCSREIIVELEERVDKIVNIDNIYSDTQLCATYVCDIYKHLRESEEKKRPSTDFMDTIQKDINVSMRAILVDWLVEVAEEYRLVPETLYLTVNYLDRYLSGNAMNRQRLQLLGVSCMMIASKYEEICAPQVEEFCYITDNTYLKEEVLQMESAVLNYLKFEMTAPTVKCFLRRFVRAAAHDVQEIPSLQLEYLTNFIAELSLLEYSMLSYPPSLIAASVIFLARFILFPSKKPWNSTLQHYTLYRPSDLCACVKDLHRLCCSSHDSNLPAIRDKYSQHKYKCVAKKHIPPSIPREVFQIN

SEQ ID NO: 21847 - protein, 405 aa, Euglena gracilis
MLALYELPGGYALFKVIEGGGFKLVGQHHFKDSEHAVEAAKALMNSELHESLKKFLKKSKIQDTLAVQDAKLGGLIKKKLDIPCIFDGEVEEIMRNIREQITTLVEGLTDQNMLQMSLGLAHTLNRHLLKFSADKIDVMVIQAIGLLDDLDKELNTYAMRVKEWYGWHFPEMAKIVVDNLQYARVILKMGTRENAATTDLVDVVDEDTAAQVRDAAIHSMGVGLTPEDITNIKMLCEEVVSTSEYRVQLFEYLRNRMNAIAPNLTTMVGELVGARLISHAGSLMNLAKMPSSTVQILGAEKALFRALKAKQATPKYGLIYHATLVGQAKANHKGKIARIAACRTALATRVDALAENVTGPTIGVEGRESVEFKLRKLEGGQIFTKAQKSHQYVEAETSTQPSTAT

SEQ ID NO: 21848 - protein, 249 aa, Exiguobacterium sibiricum 255-15
MMLDYDYDALREIGRIVAIARDEMADAVKPGITTKELDEIGARILKEHEAESAPIVMYDFPGATCISVNEVAAHGIPGAYVIKEGDIVNVDVSAVKNGYYSDTGKTVIAGQARRPEDVRLVEVSLSALEKGLEKVKAGTKVNQIGKAIYAETRKSGFTVIRNLAGHGLGKTLHGEPESISNYFSREENDLLKEGQVIAVETFISTGDEFCMEDEKDGWTLYTPNKSLVSQFEHSVIVLKDGYEILTKVD

SEQ ID NO: 21849 - protein, 468 aa, Xanthomonas campestris pv. vesicatoria str. 85-10
MSQGKIVQIIGAVVDVEFQRNEVPKVYDALKVEGTAITLEVQQQLGDGVVRTIALGSTDGLKRNLVATNTERAISVPVGAGTLGRIMDVLGRPIDEAGDVQASDHWEIHRSAPSYEDQASTTELLETGIKVIDLMCPFAKGGKVGLFGGAGVGKTVNMMELINNIAKAHSGLSVFAGVGERTREGNDFYHEMKDSNVLDKVAMVYGQMNEPPGNRLRVALTGLTMAEYFRDEKDASGKGKDVLLFVDNIYRYTLAGTEVSALLGRMPSAVGYQPTLAEEMGVLQERITSTKSGSITSIQAVYVPADDLTDPSPATTFAHLDSTVTLSRNIASLGIYPAVDPLDSTSRQMDPLVIGHEHYDTAQRVQQTLQKYKELKDIIAILGMDELSEEDKQSVSRARKIERFFSQPFHVAEVFTGSPGKYVSLKDTIRGFKAICDGEYDHLPEQAFYMVGSIEEAVEKANKMSAKA

SEQ ID NO: 21850 - protein, 527 aa, Mycobacterium smegmatis str. MC2 155
MGASLLAALVVAVLVAAVARRFDVSAPLVLVVAGLAGSTLPGFGDVALDPDLVLFVILPPLLWSAGMESSYVALRRNMRSIGLLAVGLPLVTTFVVGIVAYHTVPELTLAAALTLGAIVAPPDAVSATAVGRRLGLPRRTMTLLGGESLLNDATALTAYKVALAAAIGAATSWGTALGTFALAAVGGLVVGLVLGMLVHYVRTRLDDPLVESAIGLVAPFSIYLIAEEAHGSGVIAVVVAALLLGQRETQASYATRLQDKAVWKALQLVLESFAFLLIGLQLPAVVGELAGISAATLAISSAAVLAAVIGVRIVWVYGCTYLGRLFTKNHEPPPSHAQVFILSWAGMRGVVSLAAAFGIPLITLSGEQFPGRAQLCFLTFVVVVGTLLLHGLTLPWFIRVLGAEGDEAHSDAIATAAAQDKAARAAAERLDALLAEQPASAEVSHRAADVLRAWNTRRRNAAWERLGRDEEDIGESPTSAFRRLRLEMLAAERETFIAERDAGHIDDEVLRTVLHGLDLEEATLNRD

SEQ ID NO: 21851 - protein, 346 aa, Lactobacillus plantarum WCFS1
MKAATFIEPGKVEVKEYDKPTIQKPTDAIIRVLRACVCGSDLWWFRGISQRQAGSTVGHEAIGIVESVGSAVKDVQAGDFVIAPFTHGCGHCAACLAGFDGDCLNQEAGGNGGYQGEYLRFTNANWALVKIPGQPEDYSDDMLNNFLALADVMATGFHAATSAEVKKDDTVVVMGDGAVGLSGVLSAKLLGAKRIIAMSRHEDRQKLAKAFGATDIIAERGDEAVAKVMALTETGADAVLECVGTEQSVDTAVKVGRPGAVVGRVGVPQKAEMNTNNLFWKNIGLRGGIAAVTTDDKQVLLDAVLTGKIQPGQVFTKRFMLDDIQAAYEAMDQRNAIKSLVIVSDK

SEQ ID NO: 21852 - protein, 375 aa, Corynebacterium efficiens YS-314
MMSQVTESAVRSALSRVEDPEIGKPITELGMVKSVAIDGSDVQVEVYLTIAACPMKTTIVSNTEAAIKDIEGVGDVQVTTDVMSDEQRRELRVSLRGNTADPVIPFAQPGSTTRVYAVASGKGGVGKSSMTVNLATALAAKGLSVGILDADIYGHSVPGMLGSDARPHQVDDMIMPPQAHGVKMISIAHFVEGNAPVVWRGPMLHRAIQQFLSDVFWGDLDILLLDLPPGTGDIAITIAQLLPNAELLIVTTPQAAAADVAERAGSISLQTNQKVAGVIENMSAMVMPDGSTMEVFGSGGGEKIAQRLSMLTGEDVPVLGSVPLDPSLRVGGDVGNPIAISEPYSPTTAAINAIADTLAKRKVSIVGKTLGLGVK

SEQ ID NO: 21853 - protein, 245 aa, Mycobacterium smegmatis str. MC2 155
MTPSDPLKQQRSLSFGSEAAAYERGRPSYPPEAIDWLLPDGAHDVLDLGAGTGKLTTRLVERGLNVIAVDPLAEMLELLSNSLPDTPALLGTAEEIPLPDNSVDAVLVAQAWHWFDPELAVKEVSRVLRPGGRLGLVWNVRDERLGWVKDLGNIIGHEDPFAHEVTLPAPFTDLERHHVEWTSYLTPQALIDLVASRSYCITSPEQVRTRTLGQVRELLSTHPALANSNGLALPYVTVCMRATLA

SEQ ID NO: 21854 - protein, 631 aa, Exiguobacterium sibiricum 255-15
MLLKVDQLKKEFADKIVFEDVTFSVSPGDRIGIIGVNGTGKSTLLHILAGQETPDAGELQHPNDYRIRLLSQSTDYPEDQTVMQVLLSGNTPTINALRHYEVARLALEQDPANETLLTRFISAQTEIDAANAWDTESRLKMILNKLGITNLEATIGSLSGGQRKRVGLAEALLDEADLLLLDEPTNELDAETITWLESQIKEYRGAILLITHDRYFLNRVTNHMMEIANGTAYFYVGNYESFLEKRAERRERTASMEEKRQNILRRELAWLRRGAKARTTKQKARIQRVDALQELSYEEDEAALEVQVGSTRLGKKVIEAVDVSQQFGDRTLFNDFSWLFGRKERYGIVGRNGSGKSTLLSILAKRLEPTSGEVIHGETVKVGFYGQFAEFSHPNRRVIEEVERIAQVITTLDGQEITASQMLEQFLFKPEAQYKPIGKLSGGEKRRLKLLTILMDEPNVLFLDEPTNDLDTETLSVLEDYLDSFPGTVITVSHDRYFLDRVVNRLLAFENGEIVSYYGQYTDYLEQRELPSVIEAPIVKDVPTVEAPPAETPKKLSYQEQLDWKTIESQIEEAELQAESLEQQLASSGSDLGQVNDLYQQIEQAKAKIDQLMEYWTYLSEKVEAYENYKN

SEQ ID NO: 21855 - protein, 532 aa, Prunus persica
GYWVLKEKFRGGINVQEKVKIQKEPMKLFMENGIEELAKTSFEELEKSKDSKDDIDVRLKWLGLFHRRKNHYGRFMMRLKLPNGVTTSAQTKYLASVIRKYGEDGCADVTTRQNWQIRGVVLPDVPEILKGLAEVGLTSLQSGMDNVRNPVGNPLAGIDPEEIVDTRPYTNLLSQYITANSLGNPTVTNLPRKWNVCVVGSHDLFEHPHINDLAYMPATKDGRLGFNLLVGGFFSPKRCAEAVPLDAWVSADDVIPLCKAVLEAYRDLGTRGNRQKTRMMWLIDELGIEGFRAEVAKRMPFQELERASSEDLVQKQWERRDYVGVHPQKQEGLSYVGLHIPVGRLQADDMDELAHVADKYGTGELRLTVEQNIIIPNVENSKLEALLKEPLLKNRFSPEPSILMRGLVACTGNQFCGQAIIETKARALKVTEEVERHVAVTRPVRMHWTGCPNTCAQVQVADIGFMGCMARDENGKPCEGADVFLGGRIGSDSHLGDVYKKSVPCKDLVPLVVDILVKHFGAVPREREEGED

SEQ ID NO: 21856 - protein, 672 aa, Legionella pneumophila subsp. pneumophila str. Philadelphia 1
MNNYKHWDLQRDKDAILWLGLNRRDAAVNSINEEVLDELNSLLHEISHDKKAMGLIIYSLKEKGFIAGADVNAFSQFESSSQAVDFLQKGQTVFARLQALSIPSVAMIDGFCMGGGYELALACTYRIATDDKDTRIGLPEVMLGIHPGWGGTVRLPQLIGGFKALSQVILTGSAIPAAKAKSLGMIDEVVPVRQLRRAAVYFIKNKPPRHRASFIESLTNSSLLRKAIAYLLRYNVAKRVRKEHYPAPYAVIDLWEKEGGVGERAYLKEVDSIEKLVSQNDTAKNLIRAFLLRERLKGFAKDSHFKATHVHVIGAGVMGGDIAAWCALRGLQVTLQDKSYEQIAPAIGRAHKLYSKKLRKPRLIQAAMDRLIADPHGHGVKRADVIIEAVFENLVVKHEIMKTVEKNAKKDAIIATNTSSIPLDEISSVMSKPERLVGIHFFNPVAKMDLVEIVSSSSTTKKVQQSACAFVNQIGKLPLPVKSSPGFLINRVLMPYLMECVQLLDEGYSAETIDEAALQFGMFMGPVELADTVGMDVCLAVAENLTSHFGGTIPQRLRDLVKEGKLGRKTGEGFYKYKNGKVIKKKAPSHVDKTIADRLILRMVNESAACIREKVVEDSDLLDAGMIFATGFAPFRGGPMNYANDFGKDKLETLFKTFESKYGERFKVDTSL

SEQ ID NO: 21857 - protein, 250 aa, Zea mays
MKLNIANPTTGCQKKVEIDDDQKLRNLYDKRISQEVVGDLLGEEFKGYIFKIMGGCDKQGFPMKQGVLTSGRVRLLLHRGTPCFRGFGRRNGERRRKSVRGCIVSQDLSVINLVIVKKGENDLPGLTDTEKPRMRGPKRASKIKKLFNLGKDDDVRSYVNTYRRTFLNKKGKKVSKAPKIQRLVTPLTLQRKRARIADKKKRIAKKKSEAAEYQKLLAQRLKEQRDRRSESMAKRRSKLSAATKAPAASA

SEQ ID NO: 21858 - protein, 326 aa, uncultured gamma proteobacterium
MSRLYQNNAETIGGTPLVKINHISDGNIYAKLESRNPAMSVKCRIGASMVAAAEQDGSLKPGMTIVEPTSGNTGIALAFVAAAKGYGCILTMPNTMSLERRMLMKSLGAEVILTDGAKGIPAAIERAENIITSDPSKYWGPHQFENPANPAIHEQTTGPEIWEDTGGGIDILVSGVGTGGTITGISRYLKRICGKDVLSVAVEPDSTTMITAAKAGETPSHAPHKIQGIGAGFVPQNLDLEMVDQVEQVSSEEAMEWAHKLMQQEGILAGISSGAAMAVAHRLSQQEVHRGKMIVAILPDSGERYLSSALFAGRFSENETVQAAVS

SEQ ID NO: 21859 - protein, 161 aa, Narcissus pseudonarcissus
LKKGSSTDQDVEVYRGEEFDDDGRPRRTGTVWTASAHIITAVIGSGVLSLAWSMSQLGWIAGSVTLFLFSIVTFFTSSLLTDCYRSPDPVHGKRNYTYMSAVKSNLGSTKVWFCGICQYVILVGTAIGYTITASISAAAISKSGCFHKKGHEADCAVSDSL

SEQ ID NO: 21860 - protein, 515 aa, Streptomyces coelicolor A3(2)
MRCARERERPLTVHHLNQLLLVCSLVLLIAVAAVRISSRSGLPSLLVYLAIGVAMGQDGIGDIQFDNAELVQVIGYGALVVILAEGGLGTKWKEAKPALPAASALALGGVAVSVGVTAAGAHYLTGLEWRQALIVGAVVSSTDAAAVFSVLRRIPLPKRITGTLEAESGFNDAPVVILVVAFSTAGPIEHWYVLLGEIALELAIGAAIGLAVGWLGSWGLKHVALPASGLYPIAVMSIAIAAYAAGAMAHGSGFLAVYLASMVMGNARLPHWPATRGFADGLGWLAQIGMFVLLGLLVTPHELGDDILPALVIGLVLTMVARPLSVVLCLVPFRVPWQEQALMSWAGLRGAVPIILATIPMVEGVAGSHRIFNIVFVLVVVYTLVQGPTLPWLARKLRLGKGDEAADLGIESAPLERLRGHLLSVTIPEGSRMHGVEVNELRLPTGAAVTLVVRDGTSFVPLPTTGLRRGDELLVVATDPVRDAAEARLRAVGHGGKLAGWLGTGGTEGARGNRR

SEQ ID NO: 21861 - protein, 940 aa, Arabidopsis thaliana
MIPASMEEAHQLESRSDDLSQRRSYWRWRKQDFFPEFSFQSFSTYKSALSATCPRLADRLLSRSSDAYELDAARRESENPMRRCLTWWDLLWLSFGSVVGSGVFVITGQEARVGAGPAVVLSYAISGVSALLSVLCYAEFGVEIPVAGGSFSYLRVELGDFIAFIAAGNILLEAMVGAAGLGRSWSSYLASLVKNDSDYFRIKVDSFAKGFDLLDPVAVAVLLVANGIAMTGTKRTSWLNLITSMVTVCIIVFIVVVGFTHSKTSNLVPFFPYGAKGVVQSAAVVYWSYTGFDMVANMAEETEKPSRDIPIGLVGSMSMITVVYCLMALALTMMVKYTEIDANAAYSVAFAQIGMKWAKYLVGICALKGMTTSLLVGSLGQARYTTQIARSHMIPPWFALVHPKTGTPIYATLLVTILSSIISFFTSLEVLSSVFSFATLFIFMLVAVALLVRRYYVKDVTPEAGLLKFLGFLFLIIASSIGVSALWNSGVKGWIAYTVTGVIWFIGTLGLALLPKYRVPKVWGVPLVPWLPSFSIAMNLFLIGSLGYVAFLRFIICTMVMLLYYLFVGLHATYDVAHQPLEEANEKFPYSCDFAEKKKNLEEEEETGDMGERKVLNKYYPPDFDPAKLQRLRRPKNQQIKVRMMLPMSVRCGTCGNYIYKGTKFNSRKEDVIGETYLGIQIFRFYFKCTKCSAELTMKTDPQNSDYIVESGASRNYEPWRAEDEEVDKDKQKRDAEEMGDAMKSLENRTLDSKREMDIIAALDEMKSMKSRHATVSVDAMLEALQRTGAEKVKRIEEEDEAVIKSIFGKQKEVIRRIADEEIDDDYDDDDIDDYPSLQKEKKGSSSDLSKKRKATEVSPSNPTDILTSSSAENPKEPKKQAISKQPFKSVHIKVIKKQPQPTSSSTPAPAKPEEKKSDGAANTSLASLFQNYGSDEDED

SEQ ID NO: 21862 - protein, 275 aa, Bacillus cereus ATCC 10987
MNIGIIGTGNMGNILIDAFLETRAVKPSCLTIINRTPAKAYHIKEKYPSVHIAKTIDEAIERSHLIFICVKPIDIYPILQKYAEHFSDEKCLVSITSPISPSQLETLVPCHVARIIPSITNRALSGASLFTFGSNCSEEWQQKLFRLFKNISTPLVIEEDITRVSSDIASCGPAFFSYLLQCFINAAVDKTNITHEEATTLVSEMVVGMGKLLEKGIFTLPTLQEKVCVKGGVTGEGIRVLEEHVGDMFHKLIERTHEKFDEDLKCVDQQFNKHT

SEQ ID NO: 21863 - protein, 624 aa, Oryza sativa
MESAHGGSDRPGSMDSQEPRVDAEQKPVLSDNPEEQTIPSKDEKVLEPTISHDSNGINLPSEGQAQAGTSNIGGGHNAAYPQTMYSSQAQPFYYQGPGYDNPSNEWDGYPPYVSVEGLEAGPAVVYNDDPQLMYHGGYGYDPYAHYSPISTPVPAAVSGDGQLYSPQQFSFSAPYYQQSVPPGMPYLSSPTPISQGEAMVPIDPTQGAFIAETLSPNSFLFGPRPEWFRSSEGNGSFPSPAASPQPAGGVSGPFGQSNFPMASGMQSPQHRPFYGFGTPSDSYGRVFSHGGYFPQATNYGGPFPSFGLNGTSSIPMEKGRRRGRGNALLCSCNGSLDFLNEQSRGPRATRPKKQPEDGGKDEKPSAGVDCELYNRPDFVTEYKNARFFIIKSYSEDNVHKSIKYGVWASTTNGNKKLDSAYREAKEKEEHCPIFLLFSVNASAQFCGVAEMIGPVDFEKSVDYWQQDKWTGQFPVKWHIVKDVPNNLFRHIILENNDNKPVTNSRDTQEVKLEQGMEMLKIFKDHEEDASILDDFDFYEERERALLENKARLHQQHQLPSSTVVEPKKPLTVATDLVGHITKSFAQAVRLGEAKNVSPNSADKGASGDSSVAAKPLEVKEAGLA

SEQ ID NO: 21864 - protein, 68 aa, Populus trichocarpa x Populus deltoides
MTTSKRLSERKVAKFHKNITKRGSVPETSTKKGYDYPVGPILLGFFVFVVIGSSLFQIIRTASSGGMA

SEQ ID NO: 21865 - protein, 2340 aa, uncultured bacterium
MKWGFFMHLIRKKHPIFKVIVSLIILCFSFSTVMPAGLSYAQIAPVLNLPVPGAMVNPSIAFVPPLLKGMTIYPDEPLRFDFIIDSGNSKFDEEEVKTESEKLVKYFLAALTVPKNDLWVNLSPQEKDRIIPDYLGKTTLGRDMLAQDYLLKQLSASLIHPETELGAKFWDRIKELTFIRYGTTDLPMNTFNKVWVLPEKANVYEYNNTVYITHSRLKVMTDSDYLATKEDTRHKTQDTSIEQRATSHEQQNLESEILREIIIPEIEREVNEGKNFAPLRQMYHSLILAKWYKETIKDSLLSQIYVDQNKTAGVEVDDVTIKEQIYEQYIEAYQKGVFNYIREDYDRLAQDIIPRKYFSGGVVGDVEIDRDTALFSDRSVGQRFMVQMEASPQRSSIDGAMMTKEDARVRLREFLPPATDIPQESVEYTRIYNGDLQKALEALETKLANLSVDDFSDSAFRDGGFIEASVYYEGAQDELREAISVLRMALDSERRAKEAQAMEAALKEGEADTMIKERLDPKHHHLIGRRHKLKAIDLKGKFIVVYHEEAVTGEFSGELIVEGERIEIVSIEEFKNSFFEKVGDGYAAFALIKPDALRLGMAEEIISALEERGFMVIRGETIRFNEEQAREHYVVHKGKPFFEDLVAYMASSESIPLFLLTQEVGAVEKLRSALPEIREEFGAGPTENRIHASDSVRNTLVEAALAFKISDQAMAGLSMSEMAWVAAVDPKLAEPGALDRLFRDEERLEGLRKDLRELPPADKGSRDRAKVDLAIVKAQLETVRVKIRAFSDGAMLGDFTNLVVLDAAPRATAAEFTAPKRLEEIDEAMLGGPETLEDARAVLDGFSFNYENNKKAERIIIEEGDKSDIDRLLKMLRLSDEDIVQEIEDKLVSLGATKEQIVDAFIFRLDYQNHSTSTERNNKTIEKLVELGHARAIHILVRLLGTSSHEEASAALERLGATEKQLVDELVEYSRLSPGSSLEILEMIEGDYALAFKKVANKLRASIPKGKHYDADFKFMGHLNDVWELYKKGYDFDVRYVPEHDPVWITDLKQTGNIMRHGARITLSNGEVYEHPDVFWSDFQINPKNQIESIPNWLWEQIRFDMNVGQCVKGSFDSIEIIHGEPLEKSDGAILSGLVVFDPDPRATAAEFTAPERLEEIDEAMLGGTFKTARALALAAGLCIGAGCSDSSTGPPVDVTAPEISERITSSITENSFTLGVTTNEESTVVVEYGEDTSYGNRVEGNVLSVTHTISISGLKSGTTYHYRIIVKDASNNERASIDYTITTIDITAPEISEMAIRDITGNSFILEITTNEESTVVVEYGEEASYGNRVEGNVLGTSHTISISGLEPITTYHYRITVIDKSGNERSSADRRVTTAADLTSWSIEELIQGLDSELWNIRKAAAQELFKRDHVEGIALAQEKLVWPLFSPWNLIPGKTGILIELGRISIDPIKQFIFDSGTSNILVIGPLMDVLRNLYTFDEYFEFLVHLHQTMGQHRVTNYLLGEKLTALMSSGSTPMEKLVEIGSTHSIDRFRVAAISAIGRRGDVSYIDFLVGLANDQSNTTNVRNSAWGAANAIFLREDISDLAPDSVILMLYSGNFDVQKKATQELFQRGHQAGMAKARELVIVPRIDQLPSATARDQLIAIGEIVIELVRQNIFNSTTAPESISASIEVLEAFYTFDETIDLFVSLYQSIGNHSFTEEMIVDEAGKLINMQAAPLTSAVDLTSHKSDIIRVAAVTYLGDQGDPSHIDLLVGIENNDSSAKVRIAAQEAFYKIMVKEDPSSLSSDALITLLDIGMFDVQVEAAKELFNRGHTEGIDLAREKLVWPRILSLRSSTGPGGTLFIQIEQLGLITVEPLIDNLLNNPRGANTDSRKWSARLLGRIGLFDDVVDVLTYVIDHEYNLYSWWHVTEAKRGLSDLMSRQTLDRLIEVLDYDNGRHYEVRLRSAIELGKRGGLPAVNALIKALKDPHSSVRIHTIRALKAIGDPSAIPALEYVRDNDPDEQVRAEAAAAINAILNSSSSTSQSPDAAMVGEENFVVLDANPAATAAEFTAPERLEAIDEAILGAGEIVLIAAGATAITVGITLWKSWYAANIIAEAKRKTVEAAKGRPFYYLVTKLVLREGYSKTDVGGVYADPFTGLMGGAPQYEYRDRFGHRVSPEEALVSVKEIVTWGTENRSNDEYEKAIFEIVELLLRSEIGFGYYDYNSFIAKAQKALEEMIGTNSELQFRVGKECLKSLWKPIQEWAQEMIDRSGHDSAMITTPGGIDMNEIDVDRTGEGVQIRFDQESLQPLLNMPIDGFAPVIINIIPLQSILPLLGLEPTKEPDLVARLD

SEQ ID NO: 21866 - protein, 341 aa, Zea mays
MTSGLRDPTRVRPSGAAKAATKVSKKKSSSGEDDETSEESSDDEDTEQVETKETSVVTTQKPAHNEPKTPAKSQSQATGSKTIFVGNLAYSIEREQVKEFFEEAGEVVDVRLATFDDGSFKGFGHVEFATVEAAQKALEFVGHDLMGRPLRIDMATERGAYTPSSGKDNGSFKKFAPRSGNTVFIKGFDTSGGEDQIRTALEEHFGSCGGTTRISIPKDYDTGVSKGMAYMDFKDPDSLNKAYELNGTDLGGYSLYVDEAKPRPDNSGGFSGGLSGGRGRSGGFSGGRGGRSDRGRGGSRGRGFGGRGGRGDRGRGGRGTPFRQTAGTASTGKKTTFGDDD

SEQ ID NO: 21867 - protein, 345 aa, Candida albicans SC5314
MMSSVRTITTTRLLSTTPIKATASSQTPRHLINIAQLTNDEFSSLINKAYQFKQLVKSDKPSIENHQKLLGKLVALLFTKRSTRTRISTEGAASFFGAQPMFLGKDDIQLGVNESMYDTTKVISSMTSCIFARVNKHQDILDLCQHSSVPIVNSLCDKYHPLQAIADLLTIKEQFGDNLKGLKLTWIGDANNVINDLSIACLKLGINVSISIPKDITFDQDVVEIAEKLAKEQNLTFEIVNDPIIALNNANIVVTDTWISMGEEEQKLAKLKQFQGYQITQEMCKLGKVNSNWKFMHCLPRHQEEVADDVFYSDNSVVFEEAENRLYAAMAVIDGFVINKGDLLK

SEQ ID NO: 21868 - protein, 278 aa, Pseudomonas syringae pv. phaseolicola 1448A
MIMSAEDPRFAGIARLYGIEGLARLRAAHVAVVGIGGVGSWAAEAMARSGVGEISLFDMDDVCVSNSNRQLHALGSTVGRPKVEVMAERIRAINPDCIVHAVSDFVTRDTMAECITPDMDFVIDCIDSVNAKAALISWCKRRKIQMVTTGGAGGQIDPTLIQIADLNRTFNDPLASKVRSTLRRDYGFSRTPNRHYSVPCVFSSEQLRYPKPDGSICLEKKFVGEGVKLDCAGGFGAVMMVTATFGMVAATRAVDKLVAGARRPSERVKPAVATPDQA

SEQ ID NO: 21869 - protein, 396 aa, Physcomitrella patens subsp. patens
MSDFQIQVAKRLEQFKTTIFTEISILALKHNAINLGQGFPNFDGPDFVKKAAIEAIQDGGKNQYARGFGIPPLNAAIAESFKKESGITVNPETEVTVTSGCTEAIAATILGLVNPEDEIIVFEPFYDSYQATVSMSGATLKTVTLRAPNFDVPEQELRAAFSSKTRAIMVNTPHNPTGKVFSRQELELIASLCKEHDALAFCDEVYNKLVFNGEHVSLASLDGMYERTVTMNSLGKTFSLTGWKIGWAVAPPHLMRGVRLAHSYITFATATPFQWAAAEALRAPDSFYAELIKDYSAKKDILVEGLKSVGFEVYEPDGTYFVMVDHTPFGFESDVAFCKYLIEEVGIAAIPPSVFYTNPVDGKNLVRFAFCKDEETLKAAVEKLKTKLKKPVASSS

SEQ ID NO: 21870 - protein, 483 aa, Burkholderia thailandensis E264
MQDISMLIGGERRSATGGATFERRNPLDGEVATRASAATADDARAAVDAASAAFAPWAALGPGARRALLLKAAAALEAKRDAFVAAMAAETGASAIWARFNVELAASGLVEAAALTTQIGGELIPSDVPGSLAMGVRQPAGVVLGIAPWNAPVILGVRAIALPLACGNTVVLKGSELCPATHGLIVDALHEAGLPRGVVNFVTNAPADAGAVVDAMIAHPAVRRVNFTGSTRVGRIIAERCAQHLKPAVLELGGKAPFVVLDDADLDAAVAAAAFGAFANSGQICMSTERIIVDERIADAFVAKLADKAATLPLGDPRNGPVVLGSVIDRQTVERCNALIDDALAKGAVLLCGGKAASTLMPATLVDRVTPAMRIYEEESFGPVKGIVRVAGEEAAIACANDNAFGLSSAVFSRDIARAMRVAARIESGICHVNGPTVHDEAQMPFGGVKDSGFGHFGGKAGIAEFTDLRWITVQTAPRHYPF

SEQ ID NO: 21871 - protein, 241 aa, Idiomarina baltica OS145
MKVLITGATSGIGQQLVADYACEGHNVVACGRNADALKKLADEFPDYVETLQFDTVDRDKTIELLGSINQIDVAILSAGVCEYLDIESFDAELFERVFTVNVQGTMNCVQGLLRTLQPGSKLVLVGSLARLLPFTRAQAYGGSKAAIHYISRSLEVDLAPKGIRVLSISPGFVKTPMTDANDFEMPMRVSVDYASQCIRKGIDKNKRDIGFPTIFTLMLKTMSILPQAWQVALSKRMSKGN

SEQ ID NO: 21872 - protein, 288 aa, Burkholderia thailandensis E264
MSRTDAIATLHDVTPQPSGELDADRARRFGGVARLYGANALAAFERARVAVIGIGGVGSWAAEALARSAVGELTLIDLDNVAESNTNRQIHALDGNYGKPKVDAMAERIALIDSACRVVKIEDFVEPDNLDTLLGGGFDYIVDAIDSVRTKVALIAWCVARGQPLVTVGGAGGQLDPTRIRIDDLAQTIQDPLLSKVRAQLRKQHGFARGPKAKFKVSAVYSDEPLIYPEAAVCDVDEVAMHAATDAQAPGPTGLNCAGFGSSVCVTASFGFAAAAHALRALAARAQR

SEQ ID NO: 21873 - protein, 45 aa, Desulfitobacterium hafniense DCB-2
MTADWVRLPYDLMEKISTRIVNEVKGVNRVVYDITSKPPGTIEWE

SEQ ID NO: 21874 - protein, 181 aa, Roseovarius nubinhibens ISM
MAASEYSLPRAEFDKPVKLLIVVAPFYRDIADQMIAGATAEIEASGGSYEIAEVPGALEIPTAIGIAERLSNFDGYVALGCVIRGETTHYDTVCNDSSRAITLLGLQGLCIGNGILTVENMAQAEARANPEKMNKGAGAAAAALHLVALTRKWGAPRKGVGFAPAAEEYKLAGDPKDTPTA

SEQ ID NO: 21875 - protein, 215 aa, Vibrio fischeri ES114
MSKTIHYQKTHFITSAPDIRHLPEDEGIEVAFAGRSNAGKSSALNRLTNQKSLAKTSKTPGRTQLINLFKVEENCHIVDLPGYGFAQVPLEMKKKWQKSLGEYLQKRQCLQGLVVLMDIRHPLKDIDQQLVFWAVDQNIPVQILLTKADKLKSGARKAQVLKVREAAVDFGGEVEVDAFSSLKGIGVDKLRAKLDEWFAPAFELDDEFIEDLDAE

SEQ ID NO: 21876 - protein, 607 aa, Xanthomonas campestris pv. vesicatoria str. 85-10
MAVIEIKVPDIGDYSDVPVIEVLVAVGDSVAKDQGLVTLESDKATLEVPSSAAGVVKELKVKVGDTLSEGALVLLLETEGEAAAPAKAEPKAAPAAAAPAAAPGSKPPVTPSHRAPAEPAAPKPALASGKPADIECKMVVLGAGPGGYTAAFRAADLGLETVLIERYASLGGVCLNVGCIPSKALLHAAAVIDEVAHAGDFGVDFGQPKIALDKLREYKEKVVGKLTGGLASMAKQRKVRTVTGVASFVSPNELEIVGDDGKTQLLRFEHCIIAAGSQAVKLPNFPWDDKRVMDSTDALELHDIPKTLLVVGGGIIGLEMATVYSALGSKVTVVEFMDQLMPGADKDLVKPLADRLKKQGVEVHLKTKATDVKADKAGITVSFEAAVEGEKPGLQATTYDRVLVAVGRSPNGKKIGAEKAGVTVTERGFIPVDRQMRTNVPHIFAIGDIVGNPMLAHKATHEGKLAAEVAAGEKKEWVARVIPSVAYTNPEIAWVGVTETEAKAKGLKVGVAKFPWAASGRAIGIGRTEGFTKLIFDEQTHRVIGGAIVGVHAGDLLAEIGLAIEMGAEAEDIGHTIHAHPTLSESVGMAAEVYDGTITDLYIPKKK

SEQ ID NO: 21877 - protein, 388 aa, Roseovarius nubinhibens ISM
MSDTVPFEKPGPVEAGLRDAIATTEEIIEEARAGRMYILVDHEDRENEGDLVIPAEHADAAAINFMATHGRGLICLPMTAERVETLGLPMMAVNNSSRHETAFTVSIEAREGVSTGISAADRALTIATAINEQKSAADIATPGHVFPLRARKGGVLVRAGHTEAAVDISRLAGLHPSGVICEIMKDDGTMARLPDLVEFAQKHEMKIGTISDLIAYRHKHDNLIHEVRREKVTSSHGGAWDMAIYADQITGTEHVVLSKGDITDGAPVLARTHALDALEDVLGIGLEATGSGPTGKLPRAMEIIAAEGRGAVFLFRQPRPRLASEMEDDDTPRTIKHTGLGAQIMSYMGLHELILLTDSPDTRYLGLDAYGISIVGTRPISGAKAETN

SEQ ID NO: 21878 - protein, 587 aa, Xanthomonas campestris pv. vesicatoria str. 85-10
MAEIKEALVPDIGDYSDVPVIEVLVSVGDTVSKDQSLVTLESDKATMEVPSSVAGVVKELKVKVGDSLSQGALVALIEVADAGAETAKPAAAAPAKAAPAAAPAPAAKAESAAPAASSDGGLIEARVPDIGDYTDIPVIEVLVAVGDTVAKDQSLVTLESDKATMEVPSSAAGVVKELKVKVGDTLSQGNVVAIIAASDGGTGAAQSPAKPTTDTAETAGKVEPVAVPAEPDKLAQREIAQVQGARSGAGTQAAQGGQPSAGNPSSPPVTFDADSVLPSKVPYASPVVRVFARELGVDLNQLKGSEKGGRITREDVQRYVKAALSGGAPAAAGAAPAGGGNGLNLLAWPKVDFSKFGETETQPLSRIKKISGANLARNWAMIPHVTQFESADITDLEALRVALNKENEKAGIKLTMLAFLIKASAAALKKFPEFNASLDAAGENLTLKKYFHIGFAADTPNGLVVPVIRDVDKKGVLQIAQESGELAKKARDGKLGPADMSGGCFSISSLGGIGGIAFTPIINAPEVAILGVSKSAMQPVWNGKEFAPKLMLPLSLSYDHRVIDGALAARFTTYLSQVLADMRRVLL

SEQ ID NO: 21879 - protein, 512 aa, Coprinopsis cinerea okayama7#130
MKDTENATARATRATVRGKVAGATTAVTSRVTAPTVASKAKAVSTDAEGNVGKRKRGALVEVTGVNKNSTHTTAAKGKEAAPTKPTTGATQRVLRRAPASSTAARTAKVAESAAIKKKESSKPPSRTLAPKVYRDDAPVEEQAPADDDEADVERVSKRRHMEAVPEDTSQRDAERVARDLVAAAKEEEIAVDQQETFEPEPQLWEDLDADDWDDPLMVSEYVHDVCAYWKKTELATLPKANYMEGQQELTWDHRGILIDWILQVHARFNLLPESLFLTVNLLDRFLSARPISLNKLQLVGLACFFIASKFEETCAPSVNEIVFLADNQYTVAEVLKAEMYILRVLDWDLSCPGPMSWLRRGSKADECESTARTVAKYLLEIGCLEHRLVGIVPSHMAAAALWLGRLAVGREEWTPTLEHYTTFTEKEILPVATIMLEYIITNPIQHESLYKKYAHKRYLKCSAYMRQWALERWPENSDVHLKRDLKRIKAEIRQHNEELAAEAAAEAVRPAH

SEQ ID NO: 21880 - protein, 517 aa, Oryza sativa Japonica Group
MSGGSGDSSPSSGRASFSSLSGLKDLELSSESGCLSIVVLGASGDLAKKKTFPALFHLFQQGFLQSGEVHIFGYARSNISDDGLRERIRGYLKGASDEHISQFLQLIKYVSGSYNSGEGFASLNNAISENETSKNNKPGSSRRLFYLALPPSVYPSVCKMIRSYCMNPSSHSGWTRVIVEKPFGKDLESAEELSAQLGELFNEQQLYRIDHYLGKELVQNLLVLRFANRLFLPLWNRDNIANVQIVFREDFGTEGRGGYFDQYGIIRDIIQNHLLQVFCLVAMEKPVSLKPEHIRDEKVKVLQSVTPIKHDEVVLGQYDGYKDDSTVPDDSNTPTFASLVLRVNNERWEGVPFILKAGKALNNRKAEIRVQFKDAPGDIFKCKKQGRNEFVIRLQPSEAMYMKLTVKKPGLEMATEQSELDLSYGLRYQDVKIPEAYERLILDTIRGDQQHFVRRDELKAAWEIFTPLLHDIDDGKVKALPYKPGTRGPPEADELSKRMGYVQTHGYVWIPPTLSKF

SEQ ID NO: 21881 - protein, 719 aa, Triticum aestivum
MARGATTMEVRADGVAVITISNPPVNALSFDVIASLQSNYGEALRRNDVKAIVLTGAKGRFSGGFDINGFGNKPKNEKPGSFSIDFLTGVVEDAQKPSVAAIDGVALGGGLELAMVCHARVSTPSAQLGLPELQLGIIPGMGGTQRLPRLVGLQKALEMMLMSKSIKGVEAHKFGLVDAIVSADKLVSTACSCALEIHEHKKPWLKSLLRTDRLTDIVEAKKILKSARVQALKQSANLQHPLVCIDVIEEGILFGPRAALMKEVLSGKMLEQSQTSKSLRHVFFAQRATSKIPNITNLGLTPRRILKAAIVGGGLMGSGIATAFILSDIVVVLKEVNEKFLNTGINRIKANLQSFVKKGRMTKDDYENKLSLLSGVLDYEQFRDADVVIEAVIEDISLKQQIFSDLERSCHSNCIFATNTSTIDLQLIGQQTACQDRIVGAHFFSPAHVMPLLEIVRTQQTSSQVIVDLLDVAKKIRKTPIVVGSCTGFAVNRMFFPYGQVAGLLVDYGLDVYHIDHVITQFGMPMGPFRLADLVGFGVAVATGKQYYKSYPERCYKSRLTEIMLEENRTGESSHRGFYLYNDKRQASPDPDIKKYVEKSRNMAGVAQDPKLMKLTDKDIVEMVFFPVVNEACRVLDEGIALKASDLDVASIMGMGFPSFRGGVMFWADSLGAEYVYRRLDAWSKDYGEFFRPCEYLAARASRGTSLAATTADGTKSRL

SEQ ID NO: 21882 - protein, 490 aa, Yersinia pseudotuberculosis IP 32953
MSRYGLQKLYINGAYTDSTSGDTFDAVNPANGECIAQLQAANAQDVDKAVAAAKQGQPVWAAMTAMERSRILRRAVDILRDRNDELAAIETADTGKPLSETRSVDIVTGADVLEYYAGLIPALEGQQIPLRGSAFVYTRREPLGVVAGIGAWNYPLQIALWKSAPALAAGNAMIFKPSEVTSLTALKLAGIYTEAGLPAGVFNVLTGSGDQVGQMLTEHPGIAKVSFTGGIASGKKVMANAAGSTLKDVTMELGGKSPLIIFADADLDKAADIAMMANFYSSGQVCTNGTRVFVPLALQAAFEQKIVERVKRIHIGDPSDERTNFGPLVSFQHRDSVMRYIDSGKREGATLLIGGYSLTEGALAHGAYVAPTVFTHCRDDMQIVREEIFGPVMSILSYQSEEEVIRRANDTEYGLAAGVVTQDLNRAHRVIHQLQAGICWINTWGESAPEMPVGGYKHSGVGRENGISTLEHYTQIKSIQVELSSFNSVF

SEQ ID NO: 21883 - protein, 231 aa, Magnetospirillum magnetotacticum MS-1
MRARMRDDGATWPTEAEMGSGTNDPSEVVAVVGGGSWGTALANAAAAAGRPVTLWMRDADAAARMQAERVNARYLPGVGLHAQVRATAEARALAEAGTVLLVVPAQTLRGVLSALAPSLRLGAQVVLCAKGIERGSDAFMSAVAAETLPAGMPVAVLSGPSFAADVARGLPTAVTLASEDGARAARLAGLLSGPAFRLYHTDDVRGVEIGGAGKNVLAIASGSSPARLSEA

SEQ ID NO: 21884 - protein, 118 aa, Oryza sativa Japonica Group
LGVVENMSGLRQVLSDFRFVKQGEGGEMDATEWALNYIKEKAPELLTMVACSEVFDSSKGGAEKMCNEMGVPFLGKVPMDPQLCKAAEEGRSCFVDQKCSASAPALKSIVKKLIENQD

SEQ ID NO: 21885 - protein, 337 aa, Oryza sativa Japonica Group
MGKIKIGINGFGRIGRLVARVALQSEDVELVAVNDPFITTEYMTYMFKYDTVHGQWKHHEVKVKDSKTLIFGTKEVAVFGCRNPEEIPWAAAGAEYVVESTGVFTDKDKAAAHLKGGAKKVVISAPSKDAPMFVVGVNEKEYKSDVNIVSNASCTTNCLAPLAKVINDRFGIVEGLMTTVHAITATQKTVDGPSMKDWRGGRAASFNIIPSSTGAAKAVGKVLPALNGKLTGMAFRVPTVDVSVVDLTVRLEKPASYDQIKAAIKEEAEGKLKGILGYVEEDLVSTDFQGDSRSSIFDAKAGIALSDTFVKLVSWYDNEWGYSTRVIDLIRHMHSTN

SEQ ID NO: 21886 - protein, 484 aa, Bordetella parapertussis 12822
MENLGYPARLELYVAGQWRGVEGRRTQVVVNPSTQQPLGELPLASAEDIDDALAAADQAFGDWARTTAWERADILQRAAALIEARRDRLAVVLTLENGKPLADSHGELDRVVETILWCAEEGKRTYGRVLPARAQRLSQSSLKRPVGPVAAFVPWNFPAALAARKLAAAMAAGCTVVLKPAEETPAICIELVRAFVDAGTPAGVVNLLYGVPAQVSERLIASPIIRKVSFTGSVAVGRLLASMAAGHLKPATMELGGHAPVVVFDDVDADRVAKMCVGFKYRNAGQVCLSPSRFYVHERIADRFAESFVRHAGLLRVGDGMEEGVQMGPLNNVLRLQAAERLVEQAVGAGASLALGGRRIGQRGYFYPPTVLEGVPDAADILAEEPFCPVAPIMRFGSMDEVIGRANHPSLGLAAYAFTNRMATSAEFAERIEAGWIGINNFVPALADAPIGGMKDSGLGYEGGPEGLDAYLHARFVSQLNVEV

SEQ ID NO: 21887 - protein, 563 aa, Azoarcus sp. BH72
MTIPFRPKLLDTLRGYDRAGFTADLSAGITVGVLALPLAMAFAIASGLSPSAGIWTAIVAGFLIAALGGSRVQIGGPTGAFIPIIYAIVADYGVQNLLIATMMSGVMLFAMGAFRLGSMIRFIPLSVVIGFTNGIAVVIFLSQVKDFLGLRIEHLPGEFFARMKALGAALPTLHLPTVLVAVASLAVLLLWNRQATRTPWMRRLPGPLAVLILATAANALLALPVETIGSRFGGIPQEMPPFGLPELSLGTLGKLIVPALTIALLGAIESLLSARVADSQIDDRHDPNQELMAQGLANVAAPLVGGFAATGAIARTATNIRTGGRTPVAGMIHALVLLAVVLALAPLASAIPLATLSAIVVVVAVNMGEWHAFAPAELGRYSLQYRTILLGTFVVTVVFDLTLAVELGMVLASLFFIYRMSDLTRVERIALEDHYGVAALARADGTPRILAYSMFGSLFFGAANKLENLLLMQDGHPDVVILDLAKVINIDTTGLDILQTLHRNLQKRGAHLILCGLNAQPESLLMRSGFGERVGRENLAANITDALLRAQWLSGKQTEVSYA

SEQ ID NO: 21888 - protein, 324 aa, Azoarcus sp. BH72
MTHAIRFHQTGGPEVLQWEEVEPGAPAAGEARIRQHAVGLNFIDTYHRSGLYPVPLPSGLGSEGAGVVEAVGEGVTDLAVGDRVAYATGPLGAYAEVRNLPADRLVKLPDAISFEQGAAAMLQGLTVQYLLRRTYRVQAGDTILIHAAAGGVGTIVCQWAKALGATVIGTVGSDEKAALARAHGCDHPIVYTRENFAERVREITGGEGLPVVYDSIGKDTFMDSLSCLRPLGMMVLFGASSGPVPPFDCGVLAKMGSLFLTRPSLFTYAAKRADLLAMADELFEAIISGKVKIEINQRYALKDAAQAHRDLEARRTTGSTVLLP

SEQ ID NO: 21889 - protein, 597 aa, Magnaporthe grisea 70-15
MKSFVKSLVHLALGATALATPLKPISVSPQRFSHSLSPRQECENGPNSRQCWGKYSIDTDFYKVVPDTGVTREYWLSIEEKNDCNSDGYKRYCQTINGTSPGPLITADWGDNLVIHVTNNMQTNGTAIHWHGIHQRNTVEYDGVPGVTQCPIAPGKSLTYKFRATQYGSTWYHSHFTLQASDGMFGPMIINGPATDNYDIDMGMLFLQDHFHQSAFEGWATSASKGAPPAPENTLINGTNTFDCSGSSDPNCVGGGKKFEMVFEPGKKHLIRVVNVAADAHFEFSIDGHELTVIGADLVPIKPYKTKVVQVSIAQRYDIIVEANATPGNYWLRSGADCSPAVDPTAWRDASTAIVRYDASSTAEPTSVSDVKRSGSCGDEVPSTLVPHLPLNVGPISGMTTQTLGFSATGDDLGHNWFQWTLNSSSLVLDWSKPVLQKVFDREPIFPTPYNMVRAEKAAALANSTQWFGLVIDGSSLGIRIDHPIHLHGHDFWILSQDTTPFTNETALNTINPIRRDTANLPAGGHLAIAFELDNPGAWIVHCHIAWHASQGLSLNFVESQGSIALAMPDHDVFQQTCRDWDAVKDSMPFHQDDSGI

SEQ ID NO: 21890 - protein, 415 aa, Halobacterium sp. NRC-1
MEATEQGPIDVEAVRADFPILEREVAGGEDLVYLDNAATSHTPEPVVDAIADYYRRYNSNVHRGLHELSQEASVAYEDAHDKLAAFVGGEDREEMVFTKNTTEAENLVAFAWGLNELGPGDEVVLTQMEHHASLVTWQQVADETGAEVKYIPITDDGHLDMDAAADMITDDTALVNAVHISNTLGTVNPVGELADIAHDHGAYIFVDGAQAAPTRAVDVQEIDADFYAFSGHKMLGPTGIGCLYGKRHLLAEMEPFLYGGDMIERVSYEDATWNDPPWKFEAGTPVIAQGIALAEAVDYLQDIGMDAIRAHEEALTEYAYDQLTMTDDVDVYGPPGDDRGAVVSFNVDGIHAHDLSSILNDYGVAIRAGDHCTQPLHDTLGVPASARASFYLYNTRDEVDALVAAVDEARQIFAP

SEQ ID NO: 21891 - protein, 271 aa, Rhodospirillum rubrum ATCC 11170
MNQTAQRAQQVTIHGLEGFEGMRRAGRLAAETLDFITPYIVPGATTEDLDRLCAEFMADNGAISATLNYRGYPKSICTSINHVVCHGIPSEDKILHDGDIMNIDVTPILDGWYGDSSRMYYVGEPKVKAKRLVEATYECLMRGIAVVKPGATLGDIGYAIQSYAEGLKFSVVRDFCGHGLGQVFHQPPNVMHFGRKGQGMTLREGMIFTIEPMINTGRADTKILSDGWTAVTRDKSLSAQFEHSIGVTADGCEIFTLSPKGWHCPPYTEAP

SEQ ID NO: 21892 - protein, 178 aa, Erythrobacter sp. SD-21
MDEGSPVNVGRMTMSTHSGTHADAPLHYAEDGLDAAGMELDPYIGTCLVVDARGVSGEVDVADLPHIESVDRVLFRTWDAFPHAQWRSDWLPIAAETVEWLALQGVRLIGTDAPSVDPQESKTMDAHHAVLKHDMRILEGLVLDNVPEGQYELVALPLKVGGGDAGLCRAILRELPDA

SEQ ID NO: 21893 - protein, 924 aa, Cryptococcus neoformans var. neoformans B-3501A
MLRRSHIPRAALNINRAPAARAFTKPSLPLSASSQLTKKDSSNVLFEFDAHKVGNEIRKRGLGNLLGVQREGGMDRDTIIRLLYSLGSRHEVERYLRIFTQSSRASPGGVLPEAKFAVLKIGGAILSNELDDLALSLSFLNRLGLFPVVLHGAGPQLNEILESEGVIPDYEDGIRITDAKTLAIARRVFLQENLKLTTALERLGTRARPIPTGVFTADYLDKSKYGLVGKITRVDKAPIEAAIKAGCLPILTSLAENAEGQILNVNADVAAGELARVLEPMKIVYLNEKGGLFHGVTGKKISTINLDEEYDALMKESWVKFGTKLKIREIKELLDTLPRTSSVAIISTDMLQKELFTDAGAGTLIRRGYKLYKQPSVEAVGSTQLRQVFTERDPEVESGRKSVAEIFSELKNSPHTIYGDEPFDVVAVVSHPAGETPVMTKFLPSRNGILNKIVDNVFDAIKKDHKRLFWTAKADDENRAWHFERADGSFTRAGRSLFWYGVPNVKEVERIIEGFEENGRIERVFLPVGPSVPPHRRAAAAPAAGATPAGARAFSTSTRPHLAGTSNTGARGYATVADAAPRKRVALIGARGYTGQNLISLIDNHPHLDLTHVSSRELAGLPLKDYKKSAVNYSNLSVEDVGKMAEANEVDAWVMALPNGVCKPFVDAIDKASKKGGKSVIVDLSADYRFENDWTYGLPELYGRDLVKQANRVSNPGCYATNTQLLLAPLMPHLDKVQMPSVFGVSGFSGAGTKSGEKDAEGRPKTVPKISAEDLKGGIRPYSLTDHIHEREASRHLSSLIPSSTNPFSLAFIPNVAPWFSGIVSVLTAPLDKSMRASEIIELYEEKYGKEPLIQVQKTVPDVTEVMGKHGWRVGGVQVHSSGKRVVVVGALDNLLKGAATQAMQNLNLALGYEELAGVPTDKF

SEQ ID NO: 21894 - protein, 323 aa, Shigella flexneri 2a str. 2457T
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTLTGVSRYIKGTKGKTDLISVAVEPTDSPVIAQVLAGEEIKPGPHKIQGIGAGFIPANLDLKLVDKVIGITNEEAISTARRLMEEEGILAGISSGAAVAAALKLQEDESLTNKNIVVILPSSGERYLSTALFADLFTEKELQQ

SEQ ID NO: 21895 - protein, 225 aa, Triticum aestivum
MGSYSTSEVLNAAAVGVHHPALRLHELDLKGSMSAEELPTTSGLENGHQAPFVIGVAGGASSGKSTVCKMIIDQLCDQRVVVVTQESFYYGLSDEELVHVHDYNFDHPDAFDTGVLTTCTGIVEYPLFVVPPPSPLLFFFFFILHHTHACCCDSPWGTPRSLVVFVPGLPHSKTSHFGSSHPSGRTHGKARAPPGHNAADRLARDGRGPDGRWGGAPARWMLFAS

SEQ ID NO: 21896 - protein, 618 aa, Coprinopsis cinerea okayama7#130
MATNIPTRRVATRTTTRSTSAAVKENENALARPSRITRSKLTATSGALAPAGGMTRTTIASRAKALANQAENSGKPTDNAPVKRKREALGEVAVAGNRPTRSTTLKGKEKENGVTGKAGASESAGKDKFDGVVIKTKPLAVRQPLRTVATRQVASTRTTRAAAEKEKEKERERVPVKEKVKEPATSDHAMAVDAPQIPSIAVRRSEVVKDQKVMGPKRHGSQRALRPTQPKIEEEDEEEQERVFKKRRTSSDAPEPEPKIEEPRVEEQDPEALLMARLEAEMEAFANEPEHDPETSAWDDLDADDGDDPLMVSEYVGEIFNYMKKLELTTMANPNYMESQKELAWKMRGILTDWLVQVHVRFRLLPETLFLCVNIIDRFLSARVVSLAKLQLVGITCLFIASKFEEIVSPGVSHFLSVADSTYTEAEILQAERYVLKTLDWNLSYPNPVHFLRRVSKADDYDVAVRTVGKYLLEIGCLEWRLIAAPPSLMAAAAIWLARLAMGHEEWTPNLAHYSSYRESALVPTANLMLNYILKPIKHEAFFKKYAGKRFSKASVYMREWALSQWPENSQVDLGKELPRIKASIKLQREAEELALARAGNSEAEFFEGETFAKPRAR

SEQ ID NO: 21897 - protein, 114 aa, Arabidopsis thaliana
MTKTMMIFAAAMTVMALLLVPTIEAQTECVSKLVPCFNDLNTTTTPVKECCDSIKEAVEKELTCLCTIYTSPGLLAQFNVTTEKALGLSRRCNVTTDLSACTGNQFHFLRSPIF

SEQ ID NO: 21898 - protein, 154 aa, Narcissus pseudonarcissus
KVMKKASFIGVSTTTTFYLLCGCLGYAAFGNKAPGNILTGFGFYEPFWLVDIANLCIIIHLVGAYQVFSQPIFSAVETWITNRHPNINFLNHDRVLVIGKCFRYKINLFRLIWRTLFVIACTFIAILMPFFNDILGFLGAVGFWPLTVYFPTEM

SEQ ID NO: 21899 - protein, 387 aa, Arabidopsis thaliana
MNSILSSVLPAPEDPVLSVYSKGFSSISLISFLDDPSPVKLNLSAGTYRTEEGKPLVLDVVRRAEQQLANDLSRDKEYLPLNGLPEFNKLSTKLILGDDSPALKENRVVTTQCLSGTGSLRVGAEFLATHNKESVIFVPNPTWGNHPRIFTLAGLSVQYFRYYDPKSRGLDFKGMLEDLGAAPPGAIVVLQACAHNPTGVDPTFEQWEKIRRLVRSKSLLPFFDSAYQGFASGSLDADAQAVRMFVADGGECLIAQSYAKNMGLYGERIGSLTIVCTSEDVAKKVENQVLLVVRPMYLTPPIHGASIVATILKNSDMYNDWTIELKGMADRIISMRQQLYAALEARGTPGDWSHIIKHIGMFTFTGLSEEQVRLMAKEYHIYMTYDG

SEQ ID NO: 21900 - protein, 555 aa, Mycobacterium avium subsp. paratuberculosis K-10
MTTARPAKARNEGQWALGNREPLNPNEEMKQAGAPLAVRERIETIYAKNGFDSIDKSDLRGRFRWWGLYTQREQGYDGSWTGDENIEKLEARYFMMRVRCDGGAISAAALRTLGQISVDFARDTADITDRENIQYHWIEVENVPEIWRRLDAVGLRTTEACGDCPRVILGSPLAGESLEEVIDPSWAIAEIARRYIGQPDFADLPRKYKTAISGLQDVAHEVNDVAFIGVNHPEHGPGLDLWVGGGLSTNPMLAQRVGAWVPLHEVPEVWAAVTSVFRDYGYRRLRSKARLKFLVKDWGIEKFREVLETEYLKRPLIDGPAPEPVAHPIDHVGVQRLKNGLNAVGVAPIAGRVSGTILLAVADLAQQAGCDRIRFTPYQKLVLLDIPDDKLDEVVAGLEALGLQSQPSHWRRNLMACSGIEFCKLSFAETRVRAQGLVPELERRLADVNRQLDVPITINLNGCPNSCARIQVADIGLKGQMVDDGEGGSVEGFQVHLGGSLGQDSGFGRKLRQHKVTSDELGDYIERVARNFVKYRGEGERFAQWAMRADEDDLR

SEQ ID NO: 21901 - protein, 438 aa, Triticum aestivum
  misc_feature (210)..(210): Xaa can be any naturally occurring amino acid
MGKNGNLCCFSLLLLLLAGFASGHQVLFQGFNWESWKQSGGWYNMMMGKVDDIAAAGVTHVWLPPPSHSVSTQGYMPGRLYDIDASKYGNAADLKSLIRALHGKGVQAIADIVINHRCADYKDSRGIYCIFEGGTSDGRLDWGPHMICRDDTTYSDGTANLDTGADFAAAPDIDHLNDRVQRELKEWLLWLKSDLGFDAWRFDFAKGYSXRRMAKVYIDGTSPSLAVAEVWDNMATGGDGKPNYDQDAHRQNLVNWVDKVGGAASAGMVFDFTTKGILNAAVEGELWRLIDPQGKAPGVMGWWPAKAVTFVDNHDTGSTQAMWPFPSDKVMQGYAYILTHPGIPCIFYDHFFTWGFKDQIAALVAIRKRNGITATSALKILMHEGDAYVAEIDSKVLVKIGSRYDVGAVIPAGFVTSAHGNDYAVWEKPGAAATRQRS

SEQ ID NO: 21902 - protein, 451 aa, Yersinia pseudotuberculosis IP 32953
MSFDSLGLNADILRAVEEQGYLVPTPIQRQAIPVVLEGRDLMASAQTGTGKTAGFTLPLLQLLSQDQQPIKGRRPVRALILTPTRELAAQIDENVQSYSKYLKLRSLVVFGGVSINPQMMKLRGGVDILVATPGRLLDLEHQNAVDLSKIEILVLDEADRMLDMGFIHDIRRVLAKLPAKRQNLLFSATFSDEIKGLASKLLHNPASVEVARRNTASEQIAQSVHFVDKNRKRELLSQMIGEGNWQQVLVFNRTKHGANHLAEQLNKDGITAAAIHGNKSQGARTRALADFKDGKIRVLVATDIAARGLDIDQLPHVVNYELPNVPEDYVHRIGRTGRAERTGEAISLVCVDEHKLLRDIERLLKREIPRIALDGYEPDPSIKADPIQNGRQGRGAQRPGMGRGSSAGRPQNGGGAAGRGDSRNSRPRSQADGQRRPAGPSSRGRSRNPGE

SEQ ID NO: 21903 - protein, 466 aa, Mycobacterium tuberculosis CDC1551
MVDGGGGASDLLVIFGITGDLARKMTFRALYRLERHQLLDCPILGVASDDMSVGQLVKWARESIGRTEKIDDAVFDRLAGRLSYLHGDVTDSQLYDSLAELIGSACRPLYYLEMPPALFAPIVENLANVRLLERARVAVEKPFGHDLASALELNARLRAVLGEDQILRVDHFLGKQPVVELEYLRFANQALAELWDRNSISEIHITMAEDFGVEDRGKFYDAVGALRDVVQNHLLQVLALVTMEPPVGSSADDLNDKKAEVFRAMAPLDPDRCVRGQYLGYTEVAGVASDSATETYVALRTEIDNWRWAGVPIFVRSGKELPAKVTEVRLFLRRVPALAFLPNRRPAEPNQIVLRIDPDPGMRLQISAHTDDSWRDIHLDSSFAVDLGEPIRPYERLLYAGLVGDHQLFAREDSIEQTWRIVQPLLDNPGEIHRYDRGSWGPEAAQSLLRGHRGWQSPWLPRGTDA

SEQ ID NO: 21904 - protein, 454 aa, Saccharomyces bayanus
MSEPEFQQAYDEVVSSLEDSTLFEQHPKYRKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRTYKNSWEGVLTGKGLNWGGSLIRPEATGYGLVYYTQAMIDYATNGKESFEGKRVTISGSGNVAQFAALKVIELGGTVVSLSDSKGCIISETGITSEQVADISSAKVNFKSLEQIVGEYSTFTENKVQYISGARPWTHVQKVDIALPCATQNEVSGDEAKALVAQGVKFVAEGSNMGSTPEAIAVFETARATASTLKESVWYGPPKAANLGGVAVSGLEMAQNSQRITWSSERVDQELKKIMVNCFNECIDSAKKYTKEGNALPSLVKGANIASFIKVSDAMFDQGDVF

SEQ ID NO: 21905 - protein, 344 aa, Mesorhizobium loti MAFF303099
MTETLATDDDREELDLLLRGFQVSRMLRLIADLGVADKIPTDGQVTVKDIAAACAVLPEPMLRVLRALAAFRIFEVTADGSVAHTPRSRLLRTDTLNSLHHAARFWTGPGSWGAWNKLDVAMTGGTPHEAAWSTGRFAYLKQHPDEARLFDAMMANFPDNRHAAVAAAYDFSGASLIADIGGGNGAALRQILARFSTPRGLVFDREDVITAVTSNDLMQGRITVQGGSFFDQVPCGADIYMLIRVLHDWPDEDCLRILRACRAAMGPQARLLLGEQILEPDPARGRATGYLIDVQMMTMFGDARARSEAEFRGLFDQSGFSLRQVIPTASPVSIIEAAPIAGPF

SEQ ID NO: 21906 - protein, 200 aa, Streptomyces coelicolor A3(2)
MSAPTGTRAGAAPRVAVIDNYDSFTYNLVHYVAELGGRPTVFRNDAVTVAELAGFDLLLLSPGPGTPAGAGICVDAVRALGARLPVLGVCLGHQAVAVAYGGSVVRGEQVHGKASAVHHDGGGVFAGLPDPFSATRYHSLVVEPAGLPDELTVTARTADGTVMGLRHRTHPVHGVQFHPESVLSPEGKQLIANFLECADD

SEQ ID NO: 21907 - protein, 124 aa, Glycine max
  misc_feature (64)..(64): Xaa can be any naturally occurring amino acid
  misc_feature (105)..(105): Xaa can be any naturally occurring amino acid
EYRNPLLPPSPASYIEDVEYMKDTSAVISIVRTPLSMARPDSIMSHTVADIRELSFSWVSKYRXEKPLVGKASFRGMSAALTAASAHFVSFGPSAAMPPKRKPRXILEEMDISEQSSVKSEHRV

SEQ ID NO: 21908 - protein, 409 aa, Bacillus licheniformis ATCC 14580
MGLIVQKFGGTSVGSVEKILNVAYRVIEEKQRGHDVVVVVSAMGKSTDSLVALAKEITEQPSSREMDMLLTTGEQVTISLLTMALQNKGYDAVSYTGWQAGIETENIHGNARITNIDTAKLKERLNEGKIAVVAGFQGVTAEGEITTLGRGGSDTTAVALAAALKADKCDIYTDVPGVFTTDPRYVKTARKLAGISYDEMLELANLGAGVLHPRAVEFAKNYQVPLEVRSSTEKEAGTLIEEESSMEQNLIVRGIAFEDQITRVTVCGLASGLTTLSTIFTTLAKQNINVDIIIQSVTGTSKTSISFSVKTEDLKRTVEVLEEYKDALDYEQIETENRLAKVSIVGSGMISNPGVAAEMFAVLAEKNIQVKMVSTSEIKVSTVVNEGDMVKAVEALHDAFELSKQTAVI

SEQ ID NO: 21909 - protein, 306 aa, Thermus thermophilus HB8
MRFFVLGDVSVDLLFFLERIPEPGEEVPSRRALMKPGGAGGTLAAQLASLGHRVFLAGRVGKDPFAELALSRVREVGVDLRHLQEDPEHTTSSVLILVVPGGERAMVSAEGASRYLDPALFKPRFLDQVDAVVLSAYALVGGPSRSYAAEVLEAARRRELPVFADLGAGAVRAAGKELLKHLRGVGWLLMNEGELKTLTGASSISQGVARLRQEGFQHLAVKVGAMGSIVVTPEGEELIEPFPVEDIVDSTGAGDAYTAAFAHAILEGLSPVEAGRLANLAGALAATAIGAQGRLVTLEDLKVAAG

SEQ ID NO: 21910 - protein, 107 aa, Zea mays
  misc_feature (95)..(95): Xaa can be any naturally occurring amino acid
MKLNISFPATGCQKLIEVDDERKLRTFYEKRMATEVAADALGEEWKGYVVRISGGNDKQGFPMKQGVLTHGRVRLLLSKGHSCYRPRRTGERKRXSVRGCIVDGNLS

SEQ ID NO: 21911 - protein, 482 aa, Cicer arietinum
DDKKPQEEEKKEEVAEEKKEEVEEEKKKEEVEEEKKKEEVVVEKKVEEEVEKKEEKQGSSSEEPKTEAKPETEAVEKKVDVTVVELVEKIATSAEEDGAKTVEAIQESIVSVTVTNGDGEQPAADVELPPSTPEEVEIWGIPLLADERSDVILLKFLRARDFKVKEAFTMIKQTVIWRKEFGIEGLLQEDLGTDWEDLGTDWDKVVFTDGYDKEGHPVCYNVFGEFENKDLYQKTFSDEEKRNKFIRWRIQFLEKSVRKLNFAPSAISTFVQVNDLKNSPGLGKRELRQATNQALQLLQDNYPEFVAKQIFINVPWWYLAFSRMISAFLTPRTKSKFFFAGPSKSADTLFKYIAPEQVPVQYGGLSREGDQEFTTADPATEVTIKPATKHAVEFPIPEKSTLVWEVRVVGWDVSYGAEFVPSAEDGYTVIVQKNRKIAPADETVINNTFKIGEPGKVVLTIDNQTSKKKKLLYRSKTIPISE

SEQ ID NO: 21912 - protein, 367 aa, Salinibacter ruber DSM 13855
MGIDPRGVGGGGAVHRAGHPRPGADRGGLVRGPEVHAVCDDHPRARVGPVQHHRGSAHGRLSRVGPRGVASAWGRAGTHLCPCGRDGLCDRVELGHHGHPDAAGGSTGVGGSRPERDGRPVALSHSVLVGVVRAGRIGVGGPLFAHFGYDDSLVNGQRLRPRGARAHAVAVRAQRGDRGHRVWHTARRLRHAVVGRALGRGGAPVRPAEGGRHARRYGRGPCGGPGVSQWQPPRRRGARLSPFLFVHQSTSLSMFLDADDRPWGRWEEYLNEPGYRVKRIIVHPGQRLSLQKHEQRQEHWVVVRGTGVFTRNEEEIAVSEGDTCFIDEGDVHRIENTGDGPLVFIETQMGRCVEDDIIRLEDDYGRE

SEQ ID NO: 21913 - protein, 258 aa, Bacillus licheniformis ATCC 14580
MAALSYAVDGHVATITIQHPPANALSTQVLEDLSACLDELSERQDVRSVVIHGEGRFFSAGADIKEFTSLMDGSDYANLADKGQQIFEKVESFPKPVIAAIHGAALGGGLELAMACHIRIAEESAKLGLPELNLGIIPGFAGTQRLPKYVGTAKALEMIGTSEPISGKEAFEYGLVTILAANEEEVLQKAKELAQKFAEKSPQTMAYVIELLNSSKVYSYEGGLKLEGKYFGEVFQSEDAKEGIQAFLEKRKPHFKGK

SEQ ID NO: 21914 - protein, 406 aa, Rhodospirillum rubrum ATCC 11170
MARIVMKFGGTSVGDVDRIRNVARRVKAEVDAGNEVAVVVSAMSGETNRLVGFCDSMTNMYDAREYDAVVATGEQVTIGLLAIALQDIGVEARSWMGWQIPIHTDEAHGKARILSIDTTVLEQRLASGQVAVVAGFQGLGPNNRVTTLGRGGSDTSAVALAAALKADRCDIYTDVDGVYTTDPRIVPKARKLDRITYEEMLEQASLGAKVLQTRSVEMAMKHRVRVRVLSSFSDAPGTLVCDEDEIVEKELVSGIAYSRDEAKITLVKVSDRPGVAARIFGPLADANINVDMIVQNVSEDGHSTDLTFTLPRSDLARALKVLEGARDDINYRELTTSSAVVKVSVIGVGMRSHAGVAQTMFRALSEKGINIHVISTSEIKVSVLIAEEYMELAVRALHSAYGLDAA

SEQ ID NO: 21915 - protein, 540 aa, Lactobacillus plantarum WCFS1
MLTVNNVSMQFSTRKLYEDVNLKFTPGNCYGVIGANGAGKSTFLKILEGKLQPTTGTVSMGPNERMSSLNQNHFAFEDEEVLATVIRGHEKLYEIMTEKDALYAKPDFSDEDGIRAAELEGEFAEMDNWNAESEADQLLQNLGIDESMQHLKMSELTEPQKVKVLLGQALFGSPDVLLLDEPTNGLDVQSISWLEDFLAGYEKTVIVVSHDRHFLNQVCTHMCDVDFGKITLFVGNYDFWMESSQLAAKLQANANAKKADQIKELQEFVARFSANASKSKQATSRKKQLEKITLDDIKPSSRKYPFIKFTPDREIGNDLVKVENVSKSIEGVKILDNISFTLRPNEKTALISRNDLATTTLMQIIAGSMAPDSGTVTWGQTTSRTYLPKDINEEYAGSELPIIDWLRQFASKEESDNTFLRGFLGKMLFSGSDVERPVNVLSGGEKVRGMLSKMMLSRANVLLLDDPTNHLDLESITALNDSLIDFKGAIVFTSHDHEFIQTIADHIVEVSAKGVVDRGDTTYDEYLAHEATQGRVQDLY

SEQ ID NO: 21916 - protein, 260 aa, Salinibacter ruber DSM 13855
MLVAGNWKMNTDVPEGRALADAIAEGLSSTAADRGDVDFLVCPPYVHLPAVREALADVPVAVGAQDMHAQDEGAYTGDVSAPMLSSIGCDAVILGHSERRTYYDETDAEVNAKAQQARAHDLVPIVCVGETLEQRKAGEADTVVRSQVDGALSDVSIDGADELIVAYEPIWAIGTGESAAAEQAQAMHAVIRDDLRERYGGDVADEVPLLYGGSMKPHNAYGLLSQPDIDGGLIGSASLEAESFLGIAEKAAEVLETSGH

SEQ ID NO: 21917 - protein, 215 aa, Brassica napus
  misc_feature (19)..(19): Xaa can be any naturally occurring amino acid
RHEDQVPSVSAIFSLYTSXSAITMLFRTILNEIVPKRIREYVALKAMDFFSSYFQSNFTFVIEQRWEFVENQTFRAAEVYLPTRLAGLSTGKLLVGSSNLKNPAAEPKLGIPVNTKIIDEFEGIHLEWTLHSVETKKYLPEKRYFHLTCKKEFREKIMTDYFTYLAKSAEKIMSHRENLKIYTYNQDRSKWESAIFEHHTTFETLAVEPQLKNTL

SEQ ID NO: 21918 - protein, 290 aa, Erythrobacter sp. SD-21
MSKTIAIIGAGQMGSGIAQTIARHGMDVLLSDVSLEVAEKSVAGIDKALGKLVGRGKIEIAEAEAAMKRITPVGDYDRMTEAEFIIEAATEKEAIKQAIFEKVGEKLAADAIMASNTSSIPITRMANYSPDPARFIGLHFFNPVPVMGLIEVIPGLATAATTTDRTKAFAEALGKDVVLSQDEPGFVVNRILLPMINEAVFVLGQSTAGIEDIDKGCRLGLNHPMGPLQLADFVGLDTCLDILMVLYKTTRDTKYRPAPLLVKYVEAGWLGRKTGRGFYDYSGEEPQPTR

SEQ ID NO: 21919 - protein, 303 aa, Shigella flexneri 2a str. 2457T
MSTLEQTIGNTPLVKLQRMGPDNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSCFMREQSKPVTIVGLQPEEGSSIPGIRRWPAEYLPGIFNAALVDEVLDIHQRDAENTMRELAVREGIFCGVSSGGAVAGALRVAKANPGAVVVAIICDRGDRYLSTGVFGEEHFSQGAGI

SEQ ID NO: 21920 - protein, 441 aa, Rhodospirillum rubrum ATCC 11170
MAQERTAGCGVDGYVMVGVNHQTTPMALRDRLVLDDPALAALLVRLRARGVTEALALSTCDRVEIFGHGGDPRALRALLLAELCAVGPIEPAALAGQMVDLRGLAVVAHMFRITSALESQVLGEPHILGQVKAAHRIARDAGTVGSATEALMQAAYAIAKRVRSETRISEGPVSLAAVAAQIARDLHGDLGETCLLLLGTQEMGELIAEQLQMAGVGRLVVCAPRRPRAEAVAARLGASVGDHGALLDLLPNADIVVVGVGGGLLALGEEAMRRTLKRRRNRPVFIVDAGVPGNVEPSVQRLEAAFLYDLADLEAVAEEGRAARDQASREAHALVADAVAAFERHRAERAAVPAIAALRAHFEGERLRALAEAPDDAEKATRLLVGRLLHGPSEALRDLAAGSADKEFMTVRAEMLLRRLFDLPTSIAETGATDREDGSKG

SEQ ID NO: 21921 - protein, 318 aa, Malonomonas rubra
MAKWTELQDKSFLEATARERAVGIVDEGTFTEFCGPFDKIYSPHLPLMGEAIEYDDGLVAGVGKIGKKPIFVISQEGRFIGGSIGEVSGAKMVKTIQLASDLYEEMVSEKPDLPEEMRPAVVISFETGGVRLHEANAGLLAHAEVMDQIQNCRGRVPIISLIGSRVGCFGGMGFVAAATDVIIMSQFGRLGLTGPEVIEQEMGKDEFDASDRALVYRTTGGKHKYIIGDCNYLAADSIRSFRETTTAVLQKPMEEIETFRRIGSMEKIKEQIELVKLSVSLKPKDSMDVWAHAGNENPESLINMTLDEFLAQAKRLKA

SEQ ID NO: 21922 - protein, 476 aa, Corynebacterium efficiens YS-314
MKGVVGKASMSKKRVAIIGAGPSGMAQLRAFESAEKKGQEIPELVCFEKQDDWGGQWNYSWRTGTDHYGEPVHSSMYRNLWSNGPKEILEFAEYTFDEHFGKPISSYPPREVLWDYINGRAEQSDVKKYVKFAHAVRWVDFDEGTKLFTVRVENLRTGETTSDTYDNVIVAAGHFNFPNIPHFEGIETFPGQVMHAHEFRGAETLADKDILLIGASYSAEDIGSQAYKMGARSITYSYRTKPMGHGWPEEMEELPLVERFEGSTAHFKNGEKRDFDAVILCTGYKHHYPFLPSSLALESPNNIYPDTLYRGVVSEKNNQLFWLGSQDQWLTFNMFDAQAWYARDVILGRIELPTAEEQRAHMDQWLERFNAMEDEFDQIDFQCDYVKDLIEQTDYPMFDLDEVAKIQRQWLQSKKDDIMNFRDATYTSVITGTKAAEHHTPWMLELDDSLERYLSEPDEDEARQVFRGQIREGQAR

SEQ ID NO: 21923 - protein, 304 aa, Alteromonadales bacterium TW-7
MPDMKLFAGNATPELAQKVAKRLYIELGDAVVGRFSDGEISVQINENVRGSDVFILQSTCAPTNDNLMELIVMVDALRRASAGRITAVIPYFGYARQDRRVRSARVPITAKVVADFLSSVGVDRVLTVDLHAEQIQGFFDVPVDNVFGSPVLLEDMKERHFDDVVIVSPDIGGVVRARAIAKLLDDTDLAIIDKRRPQANVSQVMHIIGDVEGRDCIIVDDMIDTGGTLCKAAEALKEHGAKRVFAYATHPILSGKAAENLRDSVIDEVIVTDSIPLSDELKALDKVKVLTLADMLAETIRRIS

SEQ ID NO: 21924 - protein, 263 aa, Shigella flexneri 2a str. 2457T
MGKLTGKTALITGALQGIGEGIARTFARHGANLILLDISPEIEKLADELCGRGHRCTAVVADVRDPASVAAAIKRAKEKEGRIDILVNNAGVCRLGSFLDMSDEDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPEDPESVLTEMAKAIPLCRLADPLEVGELAAFLASDESSYLTGTQNVIDGGSTLPETVSVGI

SEQ ID NO: 21925 - protein, 95 aa, Zea mays
  misc_feature (63)..(63): Xaa can be any naturally occurring amino acid
RPTRITLTYSNEGALTEGPWLDLDGYYWKRWPAHGLINDTQFDKMSKRCYDTGHLSDTAKHVXRLNGHEARKVMMKHDNRIPHTHTGELHLTYIG

SEQ ID NO: 21926 - protein, 572 aa, Ustilago maydis
MGLLSYILLGFTHPSELRAMIGYKVWRDPLNDIKANPQASGWDRQRMRDCWGFLDLTSRSFAAVIKELKGDVSRVICLFYLVLRALDTVEDDMTIPAQRKIPLLVNFYKYLEQPGWNFTESGPNEKDRQLLVEFDKVIAEYQLLDVGYKTVISDITAKMGAGMASYIELSAKGPLKVAMWKHFDLYCHFVAGLVGEGLSRLFSESKLERPWLGHQLELSNHMGLFLQKTNIIRDYAEDCEEGRYFWPQQCWGDDFAKFESQPDVAKGIIEIKPGHFRPADNELGQRSMYVLSSMLLDAMSHATHALDYLALLKEQSVFNFCAIPQVMAIATLELMFNNPDVFKKNVKIRKGVAVGLILRAVNPRDVAYTFLHYSRKMHARLSPADPNFTRWSVELARIEQWCETYYPSFIAAASEGKPTDIRANALRTWSESRRTQALILKQAKLNGSDASTLDAKSVLEAAQNSALDPRDLMTEDERAAQDKRDRDQMVKFFLIILVGMVTFMGIVALITWEIVWWWTMDTPDPLSVYVKHAYYLVKTQGWSTVKEVLRTTRLSFEHVWKHGLTSPPKLEL

SEQ ID NO: 21927 - protein, 917 aa, Bacillus cereus ATCC 10987
MKKTTSTLLSMALVFSSFGALSAHAESLQKEKQFSPQLKTTIEQWGENKIAQNVETKTAKEISVIVELQHAPLAAQGNIQHAPDLQSNHAQSYHAELKKAQEDTTKKIKEKAPGAKIKEVYNTLFSGFSISVPGDQITALASLPEVKAVYPNLTYKLHETSKSTTNEEAPNIGGPTIGATEAWNLKDPSGKPLDGKGMKVAIIDSGVDYTHPDLKANYIGGYDTVDEDNDPMDGNVHGTHVAGIIAGNGKIKGVAPNASILAYRVMNDGGAGTTDDIIQGIERAIQDGADVLNLSLGQDLNVPDQPVTLTLERAAKLGVTAVVSNGNDGPKPWSVDAPANASSVISVGASTVSIPFPTFQVAGSTKTYQGLPLSKSDFPIGNDSPLVYVGYGNPSDYAKQDVKGKFALVLQGTSNTLVKAEQAKQAGAIGVLLISNEKEINIMPEYFARENLALPVMQLSNANGEELKNLITKRKKNIKIGQPVPTELIGNFSSRGPSQGSWLIKPDIVAPGVQITSTVPRGGYESHNGTSMAAPQVAGAVALLRQMHPDWTLEQLKASLANTAKTLKDVNENTYPVMAQGSGLINIPKAAQTDVLVKPNNVSFGLIKPNSGKVKLTQNITLQNLSSKKKSFSTRVELLDANTKTKVKTSVPSSISIQPNSSTEKPFTITVDSSLPQGVYTGNVYVKEQGKNEETRIPFTFSIDPKDYKRIDGLEIINSTFSPNGDQILDDNLINYYLVAPVDDVTLHANLVTKEHVTYQGIIHQAKNETAGYKPFKWNGTKTDGTPLADGLYQIEAVASNSGRETKQTAAVFLDRTAPKLTYEVDQENLVITGKVDDILLDWMTESGWVAPGIPVRMQYEINGNGVWESVFLNPWEKNYSIYFDRSQLQEGKNTIHIVATDAAGNTSNLNVDLDVK

SEQ ID NO: 21928 - protein, 180 aa, Oryza sativa Japonica Group
MGDYTIQISTKLIDQLARDDEKIKKKTRKPKPKKTVKQHQQEPQDNSRELPASEPKAPPGWPLQPPMYLPVTPAPPPPPPAFSELEAIRAVLEESEKVQEKLDKQHAGMRDELIKKSKDLRDKEFKLPYQNPTPCTEERSNCRQCYVSNAQDPLKCAEAVKRFEACVRLARQRGNTKVAQ

SEQ ID NO: 21929 - protein, 490 aa, Mycobacterium tuberculosis CDC1551
MTRITRANGCPDGTLENAVVALDGGANYPREILGNKGHGIDMMRRHHLPVPPAFCITTEVGVRYLAAPESTIAAIWDDVLDRMSWLETETSCTFGRGPNPLLVSVRSGATQSMPGMMDTILDVGMTDAVERVLARPGAADFAHDTRRRFTSMYRRIVGSAGPITDDPYAQLRASIEAVFASWNSPRAVAYRDHHGLDDQGGTAVVVQAMVFGNLTANSGAGVLSSRNPITGANEPFGEWLPGGQGDDVVSGLVAVAPITALRDQQPAVYDQLMAAARSLERMAGDVQEIEFTVEDSQLWLLQTRGAERSAQAAVRLALQLHHEGLIDDTETLRRVTPTHIETLLRPSLQTETRLAAPLLAKGLPACPGVVSGTAYTEVDEALDAADRGEPVILVRDHTRPEDVMGMLAAQGIVTEVGGAASHAAVVSRELGRVAVVGCGPGVAAALAGKEITVDGYEGEVRQGVLALSAWSESDTPELRELADIAQRISS

SEQ ID NO: 21930 - protein, 601 aa, Streptomyces lincolnensis
MLPSKPELSGTIGAVSATHWLASNAGMRILENGGNAFDAAVAAGFVLQVVEPHFNGPGGDVSIVALPAGAQDAAEICGQGPMPRAATPQAFSDLGLEHIPGSGLLPACVPGAFGGWLRLLAEFGTLRLADVLAPAITYAEEGYPLLPETAHAADVLAPLFRTEWTGSGQIYLANGAAPKAGSRFRNPALAQTYRQLLKEAEAASADREAQIEAAHQAFYQGFVAEAIQRFLDGGPRLDATGRRHSALLTADDLAAWTPSVTTATSRPYGAYRVHKPGPWSQGPVFLQQLALLEGFDLAGMRPDSADYLHTVVECAKLAFADRDAWYGDPAFTDIPLADLLSDDYTRERRRLVGPEAVNELQPGTPGGRSSWLPGAAPEPEPDLSGHTDEWMGQLRNGLPTILKATTAKGDTCCVTVTDRHGNTVAATPSGGWLKSSPAIAELGFPLGTRGQTMYLAEGHPNSLAGGKRPRTTLSPTVVQRDGQPHLAFGTPGGDRQDQWTLQFFLGVTAFGLDLQAATETLAFHTDQVPASFTPHQSRPGVVVVEENCAAATVAELTRRGHRVERVPAYSLGRVCATGLGTDGLVRAAASPRGRQPYAICG

SEQ ID NO: 21931 - protein, 142 aa, Mycobacterium avium subsp. paratuberculosis K-10
MRIADVLRNKGAAVVTINPDATVRELIAGLTEQNIGAMVVVGAEGVLGIVSERDVVRQLHVHGASVLSRPVSKIMTTTLATCTKTDTVDEISVLMTRNRVRHVPVLDGKKLIGIVSIGDVVKTRMEELEAEQQQLQSYITQG

SEQ ID NO: 21932 - protein, 347 aa, Burkholderia thailandensis E264
MNAPTSSHPPHVTNPAPRALPRIAVLATGGTIAGAAPDAAQTAGYHAGALGVDRLLAAVPALAQIATIEAEQIASIDSKDLSVALWTTLVERINALAASEAIDGIVITHGTDTLEETAYLLHLTVKTAKPVVMTAAMRPATALSSDGPLNLLNAVAVAGSAAARGQGVLVAFNNRIHSARDVVKTSTYAVDAFHSPELGALGWVQDGRIEFARRATRAHTLDTRFAIGAAWPQVDVVTSYAGASRVIVDACVAAGARGLVVAGTGNGSIHAAVQTALADAAAKGVAIVRASRVGSGHVMRNGAANDDALGFVSAGSLNPYKARVLLMLALAAGMTDVHELQQAFDTY

SEQ ID NO: 21933 - protein, 487 aa, Idiomarina baltica OS145
MTDSLQRSDLVLFGVLGDLSRRKLIPALFQLDRSGLLHQESKIIGVAREELSASQFEERVKDTLQTFVSNDELVDDVLARFCKRFHYVEMDFSQDEAYQALKASTSDEVDRVFYLATPPSLYATICAGLSRQSLIHDSTRVILEKPIGHNLASSQTINQAVAQYFQESQIYRIDHYLGKETVLNLLALRFANALFASNWDNSAIDHIQITAAEKVGVEGRWSYYDDAGQLRDMVQNHLLQVLSLIAMEPPSRLDAESIREEKLKVLKALRPIDTSNCKDVSVRGQYQGGFIGEQKVPGYLQEEGARENSDTETFVALKVNIDNWRWSGVPFYLRTGKRMPEKRSEVVITFKKQPHNIFSDTTADLQPNKLVIRLQPDEGVEVQMLNKIPGLGKQMHLKATTLDLSFDETFEKKRIADAYERLMLEAMQGNQYLFVHRDEVEYAWRWVDGILAAWEQNEQPPKPYHAGTWGPVSAVSLLAHDGRQWDE

SEQ ID NO: 21934 - protein, 834 aa, Oryza sativa
MSSMFLIILSCMLLLSNSGRTTTGAELGDTLGKGRNITDGERLVSAGGSFTLGFFSPASSSSSSTSRRYLGIWFSVSDDVVCWVANRDRPLTDTSGVLVITDAGSLLLLDGSGHVVWSSNTTTGGGASMAAQLLESGNLVVSDRGNGGAGAVVVWQSFDHPCDTLLPGMKIGKNLWTGAEWYLSSWRSSGDPSPGNYRYRTDTKGVPENVLWDGDGEVYRTGPWNGLWFSGIPEMGTYSDMFSYQLTVSPGEITFGYSANAGAPFSRLVVTGVGEVQRLVWEPSSRAWKNFFQGPRDLCDDYGKCGAFGLCDAGAASTSFCSCVEGFTPASPSPWKKMRDTSAGCRRDAALGCATDGFLAVRGVKLPDAHNATVDKRVTVEECRARCLANCSCVAYAPADIEGGGGGGAGSGCIIWADDLVDLRYVDGGQDLYVRLAKSELGKDGIRQRRPPAAVVIGASIASVVGVLLIILLVLLYVIRRRQRPRVSDDDAGVPAATAAVHARPNPALAAPSINLSSVKEATGNFYESNIIGRGGFGIVYQGKLPSGRKVAVKRLTQSLVTDKRKEDFIREVEMMSNTRHAYLVELLCYCQEGGEMILVYEYMENMSLDLYIFGEDRRLRASLNWVQRLDIIRGIAIGVEYLHNVKVIHRDLKPSNILLDDNWRPKVADFGTAKLFINDQTDPTLVLSAGYIAPEYAAQGNLTLKCDVYSFGVVLLEIISGKRNRTLPTFLRDTWESWKQHEIEDILDLGLIKPEPDLLLGLDRCIQIGLLCVQQSPDDRPTMNQVVSMLTKYSSQIAMPKNPMINSRCEPSVSQVVSDTEPASHDRPGPSLN

SEQ ID NO: 21935 - protein, 352 aa, Idiomarina baltica OS145
MPIRIAINGFGRIGKNIVRALYERGLTDHIELVAINDLGSPDVLAHLLQFDTVHGRFAAQVEAGIDSLSIDNHTVSVYAERDPSQLPWQALNIDVVLECTGLFTERDKAKAHIDAGAKKVIISAPGKNVDATVVFGVNDEILTADMDIISNASCTTNCLAPVAKILHESLGIESGLMTTVHAYTNDQRLTDSYHSDLQRARAAAQNMIPSKTGAAAAVGLVIPELQGRFDGLAVRVPTPNVSLVDLNFIAARDTTVEEVNAIVKAATNQAPMSQVLAINELPLVSSDYNHNDHSSIFDARQTRVNGRLVKVMAWYDNEWGFSNRMLDNTIALMNAASKKVVTNSKQEVNTTH

SEQ ID NO: 21936 - protein, 303 aa, Cicer arietinum
GVALAGLLGTVRSQGRPLSDFVNQKIVVAGAGSAGLGVLKMAINAVAKISGCSETAAKSQFFLIDKNGLVTTERNNLDPAAAPFAQNPRDIDGLTEGASIVEVVKKVKPHVLLGLSGVGGIFNEEVLKAMRESVSTKPAIFAMSNPTMNAECTAIDAFNHAGEHIVFASGSPFENVDFGNGNVGHVNQANNMYLFPGIGLGTLLSGAHLITDGMLQAAAECLASYMSEEDILKGILYPSVDSIRDVTAEVGAAVLRAAVEEDLAEGQGDVGPRELAHMSKEETVEYVRRNMWFPVYSPLVHEK

SEQ ID NO: 21937 - protein, 231 aa, Halobacterium sp. NRC-1
MDRPRIALVNAAHEPGETARNFRRELDAELVEFHAKGGRVPGHTEFDGVVVTGSKSSVYWDEPWIEALCDYVEDVHAAGVPVLGVCFGHQVLAEALGGTVEDMSGFELGYRTVERVADDPLFEGLPESMTAFTTHGDVVTELPAAATLLAENDYGIHAFRVGQSVGVQFHPEYDTETAERIATEKDVSEARRDAVLAGITPEAYAAACETKRLFENFTRQLGRGTDGGAEN

SEQ ID NO: 21938 - protein, 89 aa, Zea mays
MAQPVFLSSLRSRLCSAPPSPHHHLQPSRGYHVELGAREKTLLEEDVALKRFKSYKNSVKQVSKIGNVLTLAVVFGCSYELGLLAASMK

SEQ ID NO: 21939 - protein, 455 aa, Lactobacillus plantarum WCFS1
MDLKHTPSSSNTNLDEFGYQQELKRTLSVKDLVIYGLIFMVPIAPMGIYGAVISVSQGMIALTYAIGMLAMFFTALSYGQMSQAFPVAGSVYAYAKLGINKSIGFLSGWMIILDYIFVPALLYIIAANSLKSLLPTIPTWLWLVGFIAINTLINVGGIAFTAIANRIFLIGELIVLAFFIILGSYGLMRGIGNGFTLKPFYDASHFNLNFVMTATSVAVLSFLGFDGISTLAEETTGGNQAVGKGILWSLLIVGALFIIQTYLAALIVPNWHSFNDLNTAFYVVAGKVGGPFLTDLTTIATILSWGFANALAAQAAISRILFGMARDHNLPHVLARVHPRFKTPYMSTLLVAIISLLVGLTFMNDSGTLSEIVNCGALTAFLVIHIAVINHFFIKQHSHDYWHHLIVPIIGFIIIGFVMINLNVLAKEIGGIWLLIGIGYYLILRVLQRNTEMNL

SEQ ID NO: 21940 - protein, 754 aa, Erythrobacter sp. SD-21
MAEEKQTGFNTREALFYHETIRPGKIEIIASKPMATQRDLALAYSPGVAAPVEAIAANPQDAARYTARSNLVAVISNGTAILGLGNLGALASKPVMEGKAVLFKRFADVDSIDLELDTEDPEAFINAVALMEPSFGGINLEDIAAPECFIIEQALREKMNIPVMHDDQHGTAIISAAGLINACHLTGRDLDTVKMVVNGAGASALACTALIKAMGVRHENVIVCDRAGPIYPGRDNVDQWKSAHAVETPHRSLEEALEGADVFLGLSAAGALKPEWVAKMADKPIIFAMANPVPEIMPEDAKAVRPDAIIATGRSDYPNQVNNVLGFPFIFRGALDVQATAINEEMKIAAARAIAELARERVPEEVAAAYGVTHQFGEEYIIPAPFDPRLMDVVSSAVAQAAMDSGVAQKPIEDMDAYRHQLKARLNPTTGALTNIYEQAKANPKRMVFAEAEEDVALRAAIQYRDYGYGEPILVGRTEKVLAKLKELGVDDPDDWIIENSNVSDKVPAMVDYLYKRLQRRGYTERDVGRMVNQERNVFAALLVALGHGHGMVSGLTRTFAQTAREVARVIDPKPGATPFGIHMMVGKNQTTFLADTTINERPTAAELAHIAKETAAVARRMGHEPRVAFLSYSTFGNPSGQWLGNIRDAVALLDAEEGLDFEYEGEMAPDAALNPKVMALYPFSRLSGPANVLIMPGLQSANLSAKLLRELGGETTIGPMMIGSEKPVQIAPMTAIAPDLLTLAVLASAGVVG

SEQ ID NO: 21941 - protein, 417 aa, Synechococcus sp. CC9311
MSHPLALYLVAFGGLLLVSVLLDDVAARIRVPGILMVLLLGLLIENHVGVVGDEQITLLSLNQAHQISQAALVLVLFFGGLTTNWTAVRGVIKPAARLATVGVVITAALIGWAGFGLSAASGVGTNPAILPRVLFVGAMVASTDASAVLVLLRPLAGRLPKRLIDLIECESGFNDPMAVVLAGLALALAGGDGVGTEALVTDVVRQFVLGILLGFIGGTLTLQLLGTRLTLNHAAMLPVVSLALLMVLTGGTLLLGGSPLLAAYVAGLVLGNGPNLDRTALAEAHSSYAKMAELLLFLCMGLVVAPQDVVRAAGWAFVLFLLMQAVRFLMVHALLWRTTFTRNERIFVSCAGLRGAVPIAMAIDAWSSGIRWGASMPPLALAVVLFGLFIQGFALVPLAERMNLILPSHQHDPDAAA

SEQ ID NO: 21942 - protein, 685 aa, Salinibacter ruber DSM 13855
MQPVNELCWTLRFRTLRARVFLADALQAVPESILLNITVVVMLGIGAQWAAWRFRLPSILLLLLVGFLAGPVLGVLDPQSLRGDWLFAFVSLSIGIILFEGGLSLRLSELREVGSTVFNLITIGVLLTWGLGAAGAYYILEFDVGLSVLIGAILTVTGPTVIVPLLRHVRPKGRVGTIAKWEGITIDPVGAILAVLVLETLILMNDPARAGAGTSAAAEHVAIGLGLEIFVALGISVVATMLLVVILRRRMVPDFLRNPVTLMVVVVAFVVANVLQHESGLLATTLMGIALANQPYVSVQRIIEFKENLQVLLIGSLFVLLSARLEMSALEYIDLRVLIFLGILVVIVRPLAVFVSSFGSNLEWEEKAFLSWLAPRGIVAAAVASLFAYQLRPVYPGAVDGMVPVIFAVIVGTVAIYGLTLAPLARWLDLAEPNPNGLLFVGAAPWVRTVARHVQELGYSVALLDNNPVHVRSAREEGLTAHQGNALSENIVDEITLSGIGHLLITIPNDEVASLTALHFSEVFESTDIYQLAAQPDSRHGGEGVMPGHLRGRPLFGEDTSYQLLKACLNRGDTIEVLTLSDETSDETQEYYSHEDLSNEYEDESVIPLFILRENDTLEIVSETNQFRLRPQDRLLALVGAGTETRGRDHKTPEVEQTKGDGILEIEESSPEPPDDETADATETG

SEQ ID NO: 21943 - protein, 110 aa, Triticum aestivum
  misc_feature (21)..(21): Xaa can be any naturally occurring amino acid
  misc_feature (37)..(37): Xaa can be any naturally occurring amino acid
  misc_feature (42)..(42): Xaa can be any naturally occurring amino acid
  misc_feature (58)..(59): Xaa can be any naturally occurring amino acid
  misc_feature (64)..(64): Xaa can be any naturally occurring amino acid
  misc_feature (74)..(74): Xaa can be any naturally occurring amino acid
  misc_feature (83)..(83): Xaa can be any naturally occurring amino acid
  misc_feature (86)..(86): Xaa can be any naturally occurring amino acid
  misc_feature (94)..(94): Xaa can be any naturally occurring amino acid
  misc_feature (98)..(98): Xaa can be any naturally occurring amino acid
RARGLQFDPETLYNLEGIKRXKEYSKKLDGSRNEYIXVTILXAAKGALKFPKIKKPAXXLKAVXEKLNSIPNPXFRGVHVLWXPPXDRMNSFPXEKLXSGYPNLRPHNDY

SEQ ID NO: 21944 - protein, 154 aa, Xanthomonas campestris pv. vesicatoria str. 85-10
MSQFDLTPPSPAQRDALIAGLSDEEQRVLLHHGTEAPFCGVFLDNKLDGVYTCRLCGLPLFRSSAKFESGTGWPSFFAPYDPAHVREIRDTSYGMIRTEIVCARCDSHLGHVFPDGPPPTGERHCLNSVSLGFTENGQALPNPLQRQGAEAQPA

SEQ ID NO: 21945 - protein, 548 aa, Pavlova lutheri
MSFAPDSAAWKALQEHYDAQMKQAKMRELFASDPARFDKFSLGFESKLLLDFSKNIATDETMRLLRALAAEADVSGWTRRMFAGEKINNTEGRAVLHVALRNRASTPIIVDGADVMPGVNEVLAKMEAFVNKVHAGEWKGYTGKPITDVVNIGIGGSDLGPVMVTEALKNYSNRALKVHFVSNVDGTHIAETVPLPAESTLFIVASKTFTTQETMTNAHSAKAWFLASGAPEGAVAAHFVALSTNEQGCKAFGIDPGNMFGFWDWVGGRYSLWSAIGLPIALALGWANYSALLDGAHAMDQHFLSAPAEHNLPLTLALLGVWYNNFFGAETHAILPYDQYMHRFAAYFQQGDMESNGKYVRRDGSIVTASTGPVIWGEPGTNGQHAFYQLIHQGTKLIPCDFFAPAQTQNPIGEHHPILLSNFFAQTEALMQGKSLEDVKGELAASGKGAEEIAALAPHKVFEGNKPTNSILVEKLDPRTLGAVIAMYEHKIFAQGIIWGINSFDQWGVELGKALAKAILPELGGDAPVSSHDASTNGLINWYKAHRA

SEQ ID NO: 21946 - protein, 265 aa, Triticum aestivum
MHPTRWELSHMVDLQAAALVISVVAAEVSAPCVLFFDELDSIATQRGSSVGDAGGAADRVLNQLLTEMDGMNAKKTVFIIGATNRPDIIDPALLRPGRLDQLIYIPLPDVESRHQIFKACLRKSPLAKDIDLSALAKYTQGFSGADITEICQRACKYAIRENIEKDIERERRRKDNPEAMEEDEVDEVAEIRAAHFEESMKYARRSVSDADIRKYQAFAQTLQQSRGFGSEFRFPDQPAAGAASAAAADPFASAAAAAEDDDLYS

SEQ ID NO: 21947 - protein, 547 aa, Lingulodinium polyedrum
MASAQAWSELSAAASKMKATHLRTLLQDQARNDYMYVKCGGMTLDYCREKVDVDTMGKLFSLAEKAGVDTKKQKMFAGERINETEGRPVLHVALRAPRSAVINVDGKNVVPEVWQVLDAMKEFSDKVRSGERVGYTGKPLKDVVCIGIGGSYLGVEFVFEALKTDPAAAAAAEGRRLRFLANVDPIDVKRALDGLSAETTLVVIISKTFTTAETMLNAKTVKEWLIKELGTEACIPKHVVACSTALDKTKAFGIDPANVFGFWDWVGGRFSCWSAVGVLALSLQYGFGVVQQFLEGAHVMDEHFRTAPPTENLPLIMGLLAVWNCSVLGYEGIAVLPYCQALVRFVPHIQQLDMESNGKRVQMDGTVVPVGTGAIYFGEPGTNGQHSFYQLMHQGRAIPAEFIGFAHSQNPVELPGEPVSNHDELMSNFFAQPDALALGKTADELKAEGVPEKLVPHKTFTGDRPSLSLLLPVCNASWLGQLLALYEHRTAVQGWVWGINSFDQWGVELGKVLAKEVRSYLSTARKGPANDSKFISPTKMLLKKYLE

SEQ ID NO: 21948 - protein, 387 aa, Debaryomyces hansenii
MVSDGEFTRTQIFGTVFEITNRYTDLNPVGMGAFGLVCSAIDKLTGQNVAVKKIMKPFLTSVLAKRTYRELKLLKHLRHENLITLDDIFLSPLEDIYFVTELQGTDLHRLLTSRPLEKQFIQYFTYQILRGLKYVHSAGVIHRDLKPSNILINENCDLKICDFGLARIQDPQMTGYVSTRYYRAPEIMLTWQKYDTEVDLWSVGCILSEMIEGKPLFPGKDHVHQFSIITELLGSPPPDVIETICSENTLRFVQSLPHRDPIPFSERFAQCTHVEPEAIDLLAKMLIFDPKKRISALDALSHPYMEPYHDPTDEPVCEVKFDWSFNDADLPVDTWRVMMYSEILDFHQIIGAGANGTTQEQMAQIQQEGIQAPSSQYQQTNQEQKVE

SEQ ID NO: 21949 - protein, 606 aa, Oryza sativa
MLRRFAARRLRPPATAGYPSSAAAAAAAYAHGGGASVLPDGLDRASDAHARNAAAVGGLLSDLRARVSQVLAGGGAEAVRRNKARGKLLPRERIDRLLDPGASFLELSQMVSRPTDQLQLYEHFIPGLTTKLAGSGVYEEALPSGGIITGIGPVHGRLCMFVANDPTTKGGTYYPITVKKHLRAQEIASECKLPCIYLVDSGGANLPRQAEVFPDRDNFGRIFYNQAKMSSDSIPQIALVLGSCTAGGAYIPAMADESVIVKGNGTIFLAGPPLVKAATGEEISAEDLGGASVHCKISGVSDHFAQDELHGLTLGRNIVKNLHLAAKVPNVQNSACDYQEPLYDVQELRSIAPADMKQSFDIRQVIARIVDGSEFDEFKKLYGTTLVTGFARICGQPVGIIGNNGILFTESALKGSHFIELCAQRNIPLIFLQNITGFMVGSKSEASGIAKAGAKMVMAVSCSKVPKITIIVGGSFGAGNYGMCGRAYSPNFLFMWPTARISVMGGIQAAGVLAQIEKNNRKRQGVEVLSKMITFALTQWTKDEEEAFKAKVVEAYDKEGSPYYSTARLWDDGIIDPADTRRVLSLCLSAAAKPVPEDTKYGVFRM

SEQ ID NO: 21950 - protein, 108 aa, Aspergillus oryzae
MGVTEIKTPAEFQEKVIDSNEPVVVDFFATWCGPCRMITPAIERLSNENQGVKFYKVDVDGLNTVAADLGIAAMPTFVFFKDGQQIKELTIRGANPGGVQNSVKALLA

SEQ ID NO: 21951 - protein, 414 aa, Populus trichocarpa x Populus deltoides
MVAQAAAITTSSSHLLFSTSRSLSHPSPSQLCVFDSRTLVPYPNSTNTFKKKRGGDGLKCMAVSTASDAKTKKSTFEIQTLTGWLLKQEQAGVIDAELTIVISSISMACKQIASLVQRASISNLTGVQGAVNIQGEDQKKLDVVSNEVFSSCLRSSGRTGIIASEEEDVPVAVEESYSGNYIVVFDPLDGSSNIDAAVSTGSIFGIYSPNDECLADIGDDSTLDQTEQRCIVNVCQPGNNLLVAGYCMYSSSVIFVLTIGKGVFSFSLDPMYGEFVLTQENIQIPKAGKIYSFNEGNYQLWDDKLKKYIDDLKDPGPSGKPYSARYIGSLVGDFHRTLLYGGIYGYPRDKKSKNGKLRLLYECAPMSFIVEQAGGKGSDGHQRVLDITPSEIHQRVPLYIGSVEEVEKLEKYLA

SEQ ID NO: 21952 - protein, 504 aa, Mesorhizobium sp. BNC1
MADITDTNRDEWKAAAQKASIEGRAFIGGRYIDAADGDSFDCINPATGRVLGKIASCKSTDIDLAVRSARRAFDGGAWSCCDPSERRKVLIRLADLIEAARDELALLETLDTGKLIRDSVTLDIPSSAAVFRFYGEACDKLLHEVVPVGPYAFASITKEPVGVVGAVIPWNFPLKMAAWKCAPALAVGNSVVLKPAEQSPLTALKLAQLAVEAGVPEGVFNVVPGFGPEAGAAIGLHSGIDCVGFTGSTEIGKRFLAYAGQSNMKRVWLECGGKSACIVFPDAKNLEAAAKAAALGIFFNQGEVCSATSRLFVHRDLLDDFTTLLVEASNSFKPGDPLEVSSGMGSMISEEQTTRVMSYIEKGKEEADLIAGGSRVLQETGGYFIEPTIFRNVDPRSVIACEEIFGPVLSIIPFGSESEAVELANASIYGLGASVWTGDLDRAFRLSRRLHAGSISINAVDHVDLRTPFGGVKQSGNGRDLSLHALDKYCDLKTTWMAVQGSAA

SEQ ID NO: 21953 - protein, 396 aa, Bacillus cereus ATCC 14579
MIQTKDIIELTDTYGANNYHPLPIVISKAEGVWVEDPEGNRYMDLLSAYSAVNQGHRHPKIINALIDQANRVTLTSRAFHSDQLGPWYEKVAKLTNKEMVLPMNTGAEAVETAIKTVRRWAYDVKKVEANRAEIIVCEDNFHGRTMGSVSMSSNEEYKRGFGPMLPGIVVIPYGDLEALKAAITPNTAAFILEPIQGEAGINIPPAGYLKEAFEVCKKENVLFVADEIQTGLSRTGKVFACDWDNVTPDMYILGKALGGGVFPISCVAANRDILGVFEPGSHGSTFGGNPLACAVSIAALEVLEEEKLTERSLQLGEKLVGQLKEIDNPMITEVRGKGLFIGIELNEPARPYCEQLKAAGLLCKETHENVIRIAPPLVISEEDLEWAFQKIKAVLS

SEQ ID NO: 21954 - protein, 303 aa, Chlamydomonas reinhardtii
MQMESPFKSDILKGRVALVTGGSSGIGFEIARQLGLHGARLGISGRRQDVLDAAVAALKAEGVTAMGLQGDVRSSDACEGWVAALGAAWGPALDVLVNCAAGNFLATSEELSVNGFKTVMEIDAVGTFTMSRAAFPALKQSTCRHGACITNISATLQYGATWWQAHASAAKSAVDSLTRSLALEWGEFNVRVNGVAPGPIDGTAGMTKLAPGAKELVQSTIPLRGEMGRKWDIAMMCLFLASPAAAFVSGDTLVVDGANWMWKPRLVERGQVSRASRNVEGKSRAVGTAAGQAAPAAKPRSKL

SEQ ID NO: 21955 - protein, 290 aa, Candida albicans SC5314
MAACLVTHPLDLAKVRLQTATKPGQSLLSMIYQIITKEGFFKIYSGLTASLLRQATYSTTRFGIYEFLKEQYMESIATTGGTEQKKPSTAVLLPMSMIAGALGGLVGNPSDVVNIRMQNDSTLPINQRRNYRNAFDGIYKICQQEGINSLFRGLTPNLIRGVLMTASQVVTYDIAKSILVDHIHMDPSKKSTHFSASLIAGLVATTVCSPADVVKTRIMNSKGSTGGGSGGDGVNGNAISILKNAVKHEGIGFMFRGWLPSFIRLGPHTIVTFLVLEQLRKFKLGMSRSD

SEQ ID NO: 21956 - protein, 136 aa, Zea mays
  misc_feature (21)..(21): Xaa can be any naturally occurring amino acid
  misc_feature (68)..(68): Xaa can be any naturally occurring amino acid
  misc_feature (93)..(93): Xaa can be any naturally occurring amino acid
  misc_feature (112)..(112): Xaa can be any naturally occurring amino acid
  misc_feature (116)..(116): Xaa can be any naturally occurring amino acid
  misc_feature (118)..(118): Xaa can be any naturally occurring amino acid
KCNGTTDHVQKIGKTLNEGQXPPSNGGEVGATPPDGVLPVGKSHVRQEVHVAGQNCWLKNGGAYTGEXEMEMLVNLGVPGVMHGHSERRALQXESNEFVGYKAAYAQSQGLXALHXVXDTLDQRENGSTMQVVAAH

SEQ ID NO: 21957 - protein, 295 aa, Oryza sativa Indica Group
MAAAWAAAVAVMLLLAQVSAAAPVMGPAFLWAPNNYGFSSDETKEMVYYQTVSPKSLVKSVLEEGGWSNLVCSREDHAKSVDVAVLFLGSKLQSSDISKEKQADSTLVDMLKNSFASSEFSMAFPYVAMSDDDKLEKSLLSGFAENCNNGLGNNHITYTDTCSVSEDLKKHHDMDSIHGLVASQTKKNPSGQTDLVVFCDGGFKDNTKSEGELLSELVTLLKKSGAKYTILYASQPYGLLESPSNLPLGRLKPIMFSNKNSIILEGIVLLIILISGLKCMMGIDTPSKFDAPPES

SEQ ID NO: 21958 - protein, 348 aa, Prosthecochloris aestuarii DSM 271
MTTSRYSMPAEWAAHDATWLSWPHKEASWPGKFEPVPDVFAAMAAALCRYEAVHINVLDDEMERSICRLLDVREIASEERARISFHRIPTNDAWCRDHGPNFVFRDVGTKREKVIVNWEFNAWGGKYEPYDDDNSVPEKVAALRGCDLVLPGMVLEGGAIDVNGSGLLLTTEACLLNPNRNPSLTRQQIEQNLKTYLGIEQVLWLKDGIAGDDTDGHVDDMARFVNENTVVIAVEENPDDENYAPLQENYRLLQDFTCSDGSRLDVLTLPMPDPVYYENERLPASYANFYIANRQVLVPIYRCSNDRVALDILQGCFPDREIVGIDCTDLIWGLGAIHCVTHEEPSLL

SEQ ID NO: 21959 - protein, 108 aa, Zea mays
PDSVASFNAARDTTKTVIWNGPMGVFEFDKFAVGTEAVAKKLAELSGKGVTTIIGGGDSVAPVEKVGVADVMSPISPGGGASLELLEGKELPGVVALNEAAPVTRSKL

SEQ ID NO: 21960 - protein, 234 aa, Aegilops speltoides var. ligustica
SELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTI

SEQ ID NO: 21961 - protein, 489 aa, Halobacterium sp. NRC-1
MSDLDFGDVDWNVQYIDGEYVPPGDRGTLEVDDPSTRELFTEIPAGTTDDVDAAYEAAADAQTEWADTPPQERARIVAAASEILASHRDEVVDLLATESGTTYTKGAAEFEASVGITDEAASFPTRMNGDHKQSVVEGKENIVVREPQGVVGIISPWNFPLNLSIRAVAPAVAAGNSVVLKPASNTPVTGGLLIAKVFEAAGLPEGVFNVVTGKGSEIGDRIAGHPHADVISFTGSTAIGRQVAATAGENLALPAMELGGNNVHIVTEDADLDDAVDSGVFGSFLHSGQICISINRHVVHEDVYDEYVERLTERAAALPTGTAHDADTVVGPIIDESQRDQILDYIERTVDAGATLETGGDHDGLVVEPTVLSDATNDMAAACNEHFGPVAPVIPFSDDDEAVEIANSTEYGLSGSVHAGDTGRARDIADRIDTGMIHINDQPVNQEPHLPFGGYKNSGLGRYNGEYVLNEFTQEKWVSIQRETRDYPF

SEQ ID NO: 21962 - protein, 234 aa, Aegilops speltoides
SELLGIAVKKAEDVIGPEVEKLVADLENGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTI

SEQ ID NO: 21963 - protein, 498 aa, Arabidopsis thaliana
MSMFLGLLFLFPLFFILFKNLLPPRKKLPPGPTGLPLIGNLHQLGRLLHSSLHKLSLEHGPVMLVRWGVVPMAVFSSNEAAKEVLKTHDLETCNRPKLVANGLFTHGYKDIGFTQYGEEWREMKKFVGLELFSPKKHKSFRYIREEEGDLLVKKISNYAQTQTLVDLRKSLFSYTASIIFREAFGQNFRECDYINMDKLEELVQETETNVCSLALTDFFPRGLGWLVDRISGQHSRMNIAFSKLTTFFEDVIDELLKTKQLDDHSDLVTAMLDVINRPRKFGSLKITYDHLIAMMSDVVLAGVNAGTVTMIWTMTELTRHPRVMKKLQEEIRATLGPNKERITEEDLEKVEYLNLVIKESFRLHPPAPLLLPRETMSDIEIQGYHIPKNAHVKINTYAIGRDPKRWTNPEEFNPERFLNTSINYKGQHYELLPFGAGRRNCPGMTLGITILELGLLNILYYFDWSLPSGMTIKDIDMEEDGALNIAKKVPLQLVPTLP

SEQ ID NO: 21964 - protein, 277 aa, Pyrococcus furiosus DSM 3638
MSNDEIVAGIMRDYILNLLKEKKRIDDRGFEDYRPIEVEVGVIEKAEGSALVKLGNTQVLVGIKATLGEPFPDTPNMGVMTTNVELVPLASPTFEPGPPDERAIELARVIDRGIRESRALNLEKMVIAPGKIVRVVFIDVHVLDHDGNLMDAIGIGAIAALLNARVPKVLYNEETGEVEILEEKEPLPVEKIPISVTFAKIGNYLVVDPTLEEEQIMDGRLTITTDETGHISAVQKSEGGAFKLEEVMYAVETAFKKAEEIRKIILNALEKANNSEE

SEQ ID NO: 21965 - protein, 334 aa, Lactobacillus plantarum WCFS1
MTQSPYWQRIAAKAQAAQRPFFSLAPMEAVTGSVFRRVVMRAAAPDVFYTEFTNALSITHPKAKFTTRGRLYVDEAESPRPIVQLWGNSGEDFTKAAHEVKNQGYQAIDLNMGCPDMAVIKNHSGSDLIRHFDRAKEVIEGARQAELPVSVKTRLGFDDVHEYETWIPFLLQQQVPVLTVHVRTKMEMSKVPAHYELIDNLVQMRDTLAPATLLQINGDILDYQAGLKLAKAHPGVDGIMIGRGIFQNPYAFEPIPQPHSTRDMLELLRYQVDLYDQFIGLGLQGHFAPLQRFFKIYVRGMRHAAELRNELMQTKTTDDVRAIIDRLEAKLPAD

SEQ ID NO: 21966 - protein, 183 aa, Synechococcus sp. CC9311
MIPGLEPVPLRELQALGSARDWVFVGQLDELPSLTPVRGSIQAEHRGNILEVSGSAQTIVCLCCDRCLNQFNRKLSTDANELIWLGDSEAAEAMAEEGLDVSAINGLVECLDPRGSFEPERWVFEQLSLQMPAVNFCGDGCPGMPQLANQEQPASQTQAADPRWEALLNLRLDPGEESEVGCD

SEQ ID NO: 21967 - protein, 234 aa, Aegilops speltoides
SELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQIVPASAIPDGWMGLDIGPDSVKTFNDALDTTQTI

SEQ ID NO: 21968 - protein, 548 aa, Pyrocystis lunula
MAAMPPGWSELFEAATRIKGTHLRTLLQDEARNNSMFLTAGSLTLDYCRQKVDADIMAKLFKLAELSGVEAKKQKMFAGEKINETEGRPVLHVALRAPRDAVINVDGSNVVPEVWKVLDAMKAFSDKVRSGEWKGYTGKPLTDVVCIGIGGSYLGVEFVFEALKTDPEAEAAAKGRRLRFLANVDPIDVKRALEGLSAETTLVVVISKTFTTAETMLNAKTVKEWLVEGLGTADCIPKHVVACSTALEKTKAFGIDPANVFGFWDWVGGRFSCWSAVGVLALSLQYGFGVVQKFLEGGNAMDKHFQTAPLNENLPLIMGMLAVWNCSVLGHEGVAVLPYCQALTRFVPHIQQLDMESNGKRVQMDGTAVPVGTGAIYFGEPGTNGQHSFYQLMHQGRKIPAEFIGFSASQNPIDLPGEPVANHDELMSNFFAQPDALALGKTAEELKAENVPEKLIPHKTFTGDRPSLSLLLPVCDAGYLGQLLSMYEHRTAVQGWVWGINSFDQWGVELGKVLAKEVRSFLSDGRKGAGNDSKFISPTKALLKKYLE

SEQ ID NO: 21969 - protein, 395 aa, Glycine max
  misc_feature (366)..(366): Xaa can be any naturally occurring amino acid
  misc_feature (377)..(377): Xaa can be any naturally occurring amino acid
MASSVLSAASHSVSPSCSLSTTHKGKPMIRDNTLGFHRGPNSFSSSRSRGRISMAVAVNVSRFEGIPMAPPDPILGVSEAFKVDNSDVKLNLGVGAYRTEELQPYVLNVVKKAENLMLERGDNKEYLPIEGSAAFNKATAELLLGADNPAIKQQRVATVQGLSGTGSLRLGAALIERYFPGAKVLISAPTWGNHKNIFNDASVPWSEYRYYDPKTVGLDFEGMIEDIKSAPEGSFILLHGCAHNPTGIDPTPEQWEKIADVIQEKNHIPFFDVAYQGFASGSLDEDAASVRLFVARGMEVLVAQSYSKNLGLYAERIGAINVVSSSPESAARVKSQLKRIARPMYSNPPVHGARIVADVVEPSLFXEWNRMEMMAGXKDVDTLLMYTSKQEGCIL

SEQ ID NO: 21970 - protein, 437 aa, Haemophilus influenzae R2866
MEILMKSGDLNKYDLVKNTLVLVLAGGRGSRLHELTDKRAKPALYFGGNRRIIDFALSNCINSDLNRIGVVTQYAAHSLLRHLQTGWSFLPQERGEFIDMLPARQQIDDSTWYRGTADAVYQNMAIIKNHYRPKYILILAGDHIYKQDYSVMLMDHVNSGAKCTVGCIEVPRSEAHEFGVMAVNENLKVKAFVEKPKDPPAMVGKPDVSLASMGIYVFDADYLYKMLEREVNTPQTSHDFGKDVLPKCLAEETLYAHPFSRSCMGRNTEGEIYWRDVGTLDSFWQSNIDLVSENPQLDIYDQSWPIRGNPIQAYPSKFFYKHSNVHPVDNSLIGGGCVITDASISNSVLFDHIKIDAFSKVDHCVVLPQVKIGKNCVLKNCIIDRECEIPDGMQIGVNMEEDKKRFRISSTGKVILVTSKMLKILEGHEIGEEGHLD

SEQ ID NO: 21971 - protein, 116 aa, Zea mays
  misc_feature (30)..(30): Xaa can be any naturally occurring amino acid
  misc_feature (68)..(68): Xaa can be any naturally occurring amino acid
  misc_feature (98)..(98): Xaa can be any naturally occurring amino acid
  misc_feature (104)..(104): Xaa can be any naturally occurring amino acid
MGRKFFFGHSFFGNVTTDQVYKIVKTLNEXHVPPSDVVDVVVSPSYVFLPVVNIQLRQEFHVASQNCXVNKGCAFTVEVSADMLVNLGVPCVILGHSXRKALLXESNEFVGYKVAY

SEQ ID NO: 21972 - protein, 560 aa, Hanusia phi
MQRLLLLLLPAAAAAAIPTTSPGLMRLKGGSSMPTWSDNPAVIKLREIAKNPYDLSAKDAISPARINMMQASACGLKLLYATERVDEATVDALSNLAKERDVFGKMKAMMDGEVINKIESYESENRKVLHTAMRDVFDKRNEAPAAKEASDLEMTELSKLKDWCNKLDKEKTFTDLILIGIGGSDLGPRALYLALQGYKKDNRRVHFVSNVDPDDAAMVLKSIPDLSKTLVLVCSKSGGTLETLTNEQLVRDYFVKKGLDPKKHFACVTGKGSPMDNPAEYLISFYMFDYIGGRYSATSMVGGPMLAFGLGYQNYEMILKGAHDMDRNAIGEKDVRKNLPLLLALLGVWNRNFLGHQTLAVLPYSQALVRFTAHLQQLDMESNGKHIDREGRFVDYATGPIIWGEPGTNGQHSFYQLIHQGTDVVPCEFVGFTNSQFGMDLDVKGTTSQQKLNSNLLAQSLAMAQGHITSNPNKCFDGNRPNCVILGKKLDPYTLGALLALYEHKVAFQGFLWDINSFDQEGVQLGKVLANQFLDIYQKVNKGEAVPATDNLSALVQQMP

SEQ ID NO: 21973 - protein, 178 aa, Erythrobacter sp. SD-21
MRIDMIPVGDNPPESLNVIIEVPTGGEPVKYEFDKESGALFVDRILHTPMRYPANYGFVPHTLSDDGDPLDALVISRSPFIPGCVVRARPIGVLNLEDEHGGDEKLICVPVDTTFPYYSDVGQTKDLPSIIFQQIEHFFTHYKDLEAEKWVRIGNWGDADDAKRIVHECIERYEATKK

SEQ ID NO: 21974 - protein, 70 aa, Shigella flexneri 2a str. 2457T
MAEPEGRCVRMLSDSWSFPDSRHTLGCSTIGSSEAAMLGRLALKWQWCKKREVQGKSTEPDLRSCANMLA

SEQ ID NO: 21975 - protein, 263 aa, Cyanophora paradoxa
FLQGAHAVDRHFLTADLPHNVPALLGLFGVWNASFLGHASRALLPYAQALLRFPAHIQQVDMESNGKRVTLDGTALDFEAGEINFGEPGTNGQHSFYQLMHQGRVVPADFIGVAASQRGVELPGEPVSNHDELMSNFFAQPDALALGKTAEELRAEGCPEPLVPHRTFPGNRPSNMLLLPRLDAYTTGQLLALFEHRTVVEGFVWGINSFDQYGVELGKVLATQVRKELQAARAAPKAALSRSFNASTDALLLRYLKQSGAKL

SEQ ID NO: 21976 - protein, 553 aa, Chondrus crispus
MVSVVETDVAAALDALKNAASAADDMHLRDLLMDEDRCAAMVASHTGFLLDYSRQRLTKDSMSLLFDLARRVGLSDKIAAMFNGDKINTTEGRSVLHVALRAPKTASITTDGTDVVPAVHEVLDKIKGFTDKVRSGAWVGATGKTLTDVVAIGIGGSYLGPEFVFEALRMDPKASAAASGRRLRFLANVDPVDVARAREGLNPETTLVLVISKTFTTAETMLNARTMRAWIVKALGSDAVAKHMVAVSTNLKGVEAFGINPENAFGFWDWVGGRYSVSSAVGVVPLALQYGFDVVSNFLAGAHDMDEHFKTAPAEQNLPVIMGLIGVWNSTFLGYSTRALLPYQQALLKLAPHIQQVDMESNGKRVRLDGSELNMEAGPINFGEPGTNGQHSFYQLIHQGRLVPCDFVAVIKSQVPVSLPGEPVSNHDELMSNFFAQPDALAFGKSAEQCRVEGIREELVPHKTFRGNRPSSSMLIDELNAFTVGQLLALFEHRTVVEGFIWGINSFDQWGVELGKVLAKDVRTQLTASRSDGADVSGFNPSTTMLLKKYLSG

SEQ ID NO: 21977 - protein, 154 aa, Roseovarius nubinhibens ISM
MMLGAGLMALVPLRAARAATTGAEGGFEITRSEAEWRAMLSDLEYAVMREEGTERAGSSPLDKLYDDGVYHCRGCDLPLYSSAHKYDSGTGWPSFWQALPEAIGTKSDRKLFMLRTECHCRRCGSHLGHIFDDGPKPTGARHCLNGVSLVFRAA

SEQ ID NO: 21978 - protein, 437 aa, Streptomyces lincolnensis
MTDATHRVAVCGLWHLGSTAAAGLLTHGRAVVAYDPQEHLRAGAAAATPPTGEPGVGEVLRRGLREGRLRVADALAEWARNALCVLAYDSAVDADGGVDDARLAQAVAAFARHAPAGATLAVLSQVPAHTHVRWRRTLLAHRPDVNLVHIPENLRLGRAMDDFVAPARLVVGAEERCTAERTARSLFPRATPAYVTLTEAELVKHATNAYLGMCVSFGNELGWLAAHLGADPQVVARLLKADPRVADAAPLLPGAAFSGATLRRDLVALSRIGAKWGRPEFFDTVLTVNDRHAAFPLDLLGAELGNLKDRRIAVAGLTYKPGTATLRDSLPLRLVRTLLTDGAEVVAYDPVAEDLPDDVGARRAATLADAVRGADALLVAAALPELDGADWAGLRPAARLVVDGCGALDPAALSAAGWRCLGLHPRWQEVTGAHAAP

SEQ ID NO: 21979 - protein, 474 aa, Populus trichocarpa x Populus deltoides
MIWGIIRRNLASSQSVSRIKHPAIRPRGYGQNELLSNGKGCRHAVGSFSYCTSLGSQCCRAYSNKPRREITAMLRPEYFIPLRSRSFSSDTGDLVDAVVPFMGESITDGTLAKFLKNPGDRVEVDEPIAQIETDKVTIDVASPEAGTIQQLVAKEGETVEPGTKIAVISKSGEGVPQAAPPSQEKTASQPPPPAEKESIGKGTTKTETSSLKGKEKTLFPPQPAARAPSSPPKPSEPQLPPKERERRVPMTRLRKRVATRLKDSQNTFAMLTTFNEVDMTNLMKLRSDYKDAFVEKHGVKFGFMSGFVKAAVSALQYQPVVNAVIDGDDIIYRDYIDISIAVGTPKGLVVPVIRNSDQMNFAEIEKNINTLAKKATAGTISIDEMAGGTFTISNGGVYGSLLSMPIINPPQSAILGMHSIVTRPMVVGGNIVPRPMMYIALTYDHRLIDGREAVYFLRRIKDVVEDPRRLLLDV

SEQ ID NO: 21980 - protein, 444 aa, Yersinia pseudotuberculosis IP 32953
MSTDDQKVGLIPVTLMVAGNIMGSGVFLLPANLASTGGIAIWGWLVTIIGALALSMVYAKMSSLDDSPGGSYAYARRAFGPFLGYQTNVLYWLACWIGNIAMVVIGVGYLSYFFPILKEPMVLTITCVVFLWIFVGLNIIGPKMITRVQAVATSLALIPIVGIALFGWFWFKGETYMAAWNVSGLGTFGAIQSTLNVTLWSFIGVETASVAAGVVKNPKRNVPIATVGGVLIAAVCYVLSSSAIMGMIPNAELRLSASPFGDAARLALGDTAGAVVSLCAAAGCLGSLGGWTLVAGQTAKAAADDGLFPPIFGKVNKAGTPVAGLLILGVLMTIFQISSISPNAAKEFGLVSSVSVIFTLVPYLYTCSALLLVGHGHLGNQVKTYVGITLIAFVYCIWAVVGSGAEEVMWSFVTLMVITALYTFNYNRTHKNPFPLDAPVKNGQ

SEQ ID NO: 21981 - protein, 350 aa, Aspergillus oryzae
MRIGVLKGNGIGPEITAATIRVIEATGIQPEWDFIPIADEAVRLYGHALPPQVIQRIKDVKFCIKAPLLAEKLHGRISCTQTDGSVVTYPSINNAIRRELNLFVNPRPIRGYVGISGRHEKMDMVIMREITEDTYIGWEKPLEDGAAAEAIKRVTRSASWKVSQYAFEYARKHGRKKVSCLHKANVLHETDGLFLRTFQEVARLYPDIVGDDMMIDAACYSVVRDPCWFDVVVTVNQYGDIFSDLAAGLAGSLGLAPGANIGDSASTFEAAHGAAPDIAGTGAANPIALILSGAELLAHAGYGKGSEAIREAVTRVIEAGRTLTPDLGGRSTTEQVADAISVEVRAILGH

SEQ ID NO: 21982 - protein, 333 aa, Coprinopsis cinerea okayama7#130
MSAMETDEPSVVLSSTTSSGLSVSLAQTPIANPQRLGAPNKAEAPEERYKPVRFVVSRPASSGQLWLTITGREVEIVNTFELATEADGSTVDHGFLVSRRDQYKQVFPSLEFIGWYTVAPKPTARHIALHEQFTGYCSTPLLLLLQPSLSLGGGVNSQTLPFKAYEPTVEIKERTSRSVFVEVPYNVETGEAERIAVDWTARGGGSGTSLESHLSTQRSAVKMLHERILLLVKYVADVIAGTAKKDHDTLRSLAALVASLPASENKAFREEFDTEYEDVQLTSFLSSLTKSTNILNDLVDKHILLTSSREDRPGGFRRRGGRQGTIDWGDRLH

SEQ ID NO: 21983 - protein, 416 aa, Colwellia psychrerythraea
MTSKITVPSIGDKITVSNGKLSVPNNPIIPFIEGDGIGVDVTPPMIKVVDAAISKAYGSERKIAWMEVYAGEKATQVYDSETWLPDETLEMFKEYKVGIKGPLTTPVGGGMRSLNVALRQILDLYVCQRPVQWFTGVPSPVKRPSEVDMVIFRENTEDIYAGIEYQAGTDAAKKVITFLTEEMGVTKIRFTEDCGIGIKPVSKEGTQRLVRQAIQYAIDHNRDSVTLVHKGNIMKFTEGAFKDWGYELACEEFGAELIDGGPWCSVKNPKTGKEIIIKDVIADAMLQQILLRPAEYSVIATLNLNGDYLSDALAAQVGGIGIAPGANLNDEVAIFEATHGTAPKYAGKNKVNPGSVILSAEMMLRHMGWVEAADLLLKGMSGAIGAKTVTYDFERLMDDATLVTCSQFGDCIIEHM

SEQ ID NO: 21984 - protein, 460 aa, Ralstonia metallidurans CH34
MSDMQEHKVTPYDQFNYEVPENVFPREGISANAAAAIVISDEWTDTNPMLNMSSFVTTFAEPEAREVAARNIFKNYIDHDMYPRLFAMEGRMVRWLHELWNGPKGVEPYGTCTVGSSEACMLGGLAHKWNWRQRRQAEGKDATRPNMVTGGNVQIVWKKFLRYFDVEPRIVPLKPGNYCLTAEDLDKYVDENTICVVAIAGQTFTGEDDDIQGIHDWLDAYEKRTGISIPMHIDGASGGFVNPFLYPDYKWDFRLPRVQSINASGHKYGLTPPGLGWVVFRERKIFNEELVFYVNYLGGEMPTATLNFSRNAFQVAVQYYQFLRLGFDGYKRVMQHTLDNAIFLRQQLVDSGYFDIMNTTQRIPVVAVTLNKKYKNFNEFDVSNKVREKGWVLSAYTMPPNAESVTSLRVVVRPHVNHNVAQLLANDIINACKFLEANGGNAKPPALHKHAEAQSTSLKC

SEQ ID NO: 21985 - protein, 223 aa, Brassica napus
GKKMKAIIVGGSIAGVSCAHSLTLAGWDVLVLEKSSEPPARSPTGAGLGLDPQARTIIKSWLPHPHLLDETTLPLSIDQNQATDSEKKVRRVLTRDESFDFRAAYWSDIHGLLFNALDPTMFLWGHKFLSFAMSQDGSTVKVETLVMETQETVEIQGDLLVAADGCLSSIRKTFLPNFKLRYSGYCAWRGVFDFSGDENSETVAGIKRGYPELGRCLYFDLAR

SEQ ID NO: 21986 - protein, 250 aa, Pyrococcus furiosus DSM 3638
MMLKPEGLKLIDENGRRLDGRKKYELRPIKMKVGVLKNANGSAYIEWGKNKIIAAVYGPREIHPKHLQRPDRAILRVRYNMAPFSVEERKKPGPDRRSIEISKVIRGALEPALILEMFPRTAIDVFIEVLQADAGTRVAGITAASLALADAGIPMRDLVAACSAGKIEGEIVLDLNKEEDNYGEADVPVAIMPIKNDITLLQMDGYLTKEEFIEAVKLAIKGAKAVYQKQREALKEKYLKIAQEVEGSEQ

SEQ ID NO: 21987 - protein, 298 aa, Glycine max
MESPFKPEILKGKVALITGGASGIGFEISTQFGKHGASVALMGRRKQVLQSAVSVLQSLVIPAVGFEGDVRKQEDAARVVESTFKHFGRIDILVNAAAGNFLVSAEDLSSNGFRTVLDIDSVGTFTMCHEALKYLKKGGEGRSNSSSGGSIINISATLHYTASWYQIHVSAAKAAVDATTRNLALEWGTDYDIRVNGIAPGPISGTPGMSKLAPDEISSKARDYMPLYKLGEKWDIAMAALFLASDAGKFVNGDTMIVDGGLWLSRPRHLEKEAVKQVSRSVEKRSRNVPVGVPKSKL

SEQ ID NO: 21988 - protein, 234 aa, Aegilops speltoides
SELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVAASAIPDGWMGLDIGPDSVKTFNDALDTTQTI

SEQ ID NO: 21989 - protein, 495 aa, Staphylococcus aureus subsp. aureus MSSA476
MAVNVRDYIAENYGLFINGEFVKGSSDETIEVTNPATGETLSHITRAKDKDVDHAVKVAQDAFESWSLTSKSERAQMLRDIGDKLMAQKDKIAMIETLNNGKPIRETTAIDIPFAARHFHYFASVIETEEGTVNDIDKDTMSIVRHEPIGVVGAVVAWNFPMLLAAWKIAPAIAAGNTIVIQPSSSTPLSLLEVAKIFQEVLPKGVVNILTGKGSESGNAIFNHDGVDKLSFTGSTDVGYQVAEAAAKHLVPATLELGGKSANIILDDANLDLAVEGIQLGILFNQGEVCSAGSRLLVHEKIYDQLVPRLQEAFSNIKVGDPQDEATQMGSQTGKDQLDKIQSYIDAAKESDAQILAGGHRLTENGLDKGFFFEPTLIAVPDNHHKLAQEEIFGPVLTVIKVKDDQEAIDIANDSEYGLAGGVFSQNITRALNIAKAVRTGRIWINTYNQVPEGAPFGGYKKSGIGRETYKGALSNYQQVKNIYIDTSNALKGLY

SEQ ID NO: 21990 - protein, 635 aa, Porphyra yezoensis
MADMAFVGLAPAARQLPQTRRVRCTSSSRPLPRRWAVAGPAGGAPLRMVAAEPVPSDSSSPNPPTPPSTRLISHTPEWAALLAHKRDVIDPSHLRDLLADEPRTMALYAEHDGVSLDYARQRVTIDTMRLLFDLAKAANLPGKMAAMARGDRINSTEDRAVLHMALRAAKGDTLMVDGVNVNADVWGVLDRIRTFTDRVRSGEHRGATGKVIKNVIAVGIGGSYLGPDFVHEALKTDRDASKAAGNRTLRFLSNVDPVDVLRNTRDLDPEETVVVVISKTFTTRETKVNAKTLRDWLRNSMGRAPEVVAQHMVACSTNMEGTSEFGISPENVFPFWDWVGGRFSVCSSVGALPIALQYGFDSFERFLEGARSMDQHWQTASMERNLPILMGLLGVWNMSFLGYSTRALHPYTEALLKFPAHVQQVDMESNGKHVTLDGDLVDYPVGEVDFGEPGTNGQHSFFQLLHMGQTVPCDFIGFMESQNPICEEGEPVSNHDELVANFFAQPDALANGKTAEECRAEGRSEELIPHVTFLGNRPSVSLLLPICNAYSCGQLLALYEHRTAVEGFIWNINSFDQWGVELGKVLAIKVRQQINQTRYHNRPIKESFNVSTARLLDRFLNGSVGCAFEDIVVDE

SEQ ID NO: 21991 - protein, 443 aa, Arabidopsis thaliana
MGSGRDRDDPLSFTSNPCTASSPVTVSDYLDNFLGEPTSRSGSFQSESLLGGGGGESINDADFGFARPDFRSEQLAGTVQFYERHVFLCYKKPSVWPARIEAAEFDRLPRLLSAAVSARKGSMKKETRLTICEGHDGTETSNGDVLIFPDMIRYRRLTHFDVETFVEEVLVKDGEWLPGNPELLKGSYVFVCSHGSRDRRCGVCGPSLVSRFREELEFHGLQGKVSISPCSHIGGHKYAGNVIIYRSNINREVTGHWYGYVTPEDVPILLEQHINKGEIVDRLWRGEMGLSEEDQKKTQEGRFQLNGTVHSVKINGKVSQESSVHNADVSCCQSRAAEPNGCCQQNGNSSSCCQDDTTLMLSLGTSEDNQLESENNTEKLTPGRKIAEKTFFRINSDKGSSTRKVCGIPTWLESWEREDTYAALAVVCAAASVAVAYTCYKQL

SEQ ID NO: 21992 - protein, 498 aa, Bacillus halodurans C-125
MQKISTNDSKLNPRLVAFLNGGPKKLFINGEWVDSFSGQSFETMNPATGETLALVAEAGSEDIDFAVKAARKAFDEGPWSKMSAAERSRLIYKLADLIEDHKEALAQLETLDNGKPIRETANADIPLVIEHFRYFAGWATKIVGQTIPVQGHYFNYTRHEAIGVVGQIIPWNFPLLMAAWKLGAALATGCTVVLKPAEQTPLSALYLGELINEAGFPKGVVNIVPGFGHSAGTPLVNHPAVDKVAFTGSTDVGKLIMKQASESLKRVTLELGGKSPNIILPDADLSKAVPGSLMGIMFNQGQVCCAGSRLYVQKKQYDHVVADLVSLTNEIQQGDGLLEQTTMGPLISNQQQSRVKNYIDRGVEEGAELLTGGNIPYDQGYFVAPTIFADVDHSMTIAKEEIFGPVVAAMPFDSIDDLIDKANDSDYGLAAGVWTQDIKKAHYIAHRIKAGTIWVNCYNVFDAASPFGGYKQSGIGREMGSYALENYTEVKSVWVNMD

SEQ ID NO: 21993 - protein, 544 aa, Chondrus crispus
HLRDLMQDDDRVLALATEYDGIILDYSRQRVTKETIDLLLKLADAVGLKDRIHQMVSGDKINTTEGRAVLHTALRARKGEQVMLDGENVVDKVHEVLGRINKFSDQVRKGQFLGATGKRIKNFIAVGIGGSYLGPDFVYEALKTDAEAAAAGPKAGYTLQFLANVDPVDVRRACDGLDPEETMIIIVSKTFTTRETLVNAKTMRSWLWDAMGNDPAVVNQHMIACSTNLEKTKEFGIDTKNVFPFWDWVGGRYSVCSAVGAVPLSLMYGHEVFEKFLRGARSIDKHLVNMPLRRNIPVLMGLLGVWNMSFMGYKSRAMHPYTEALNKFPAHIQQVDMESNGKHVSRHGVDLDFEVGEVDFGEPGTLGQHSFFQLLHMGQVVPCTFIGFVESQTPSCQDGEPVSNHDELMSNFFAQPDALASGKTAEECRAEGRDEALIPHVTFTGNRPSLSLLMPVLNSYTCGQLLSIFEHRTAVQGFIWDINSFDQWGVELGKVLATKVRKQLNQSRYHDKKVEGFNASSRRLVERYIHGSVGCTFDEIMSDE

SEQ ID NO: 21994 - protein, 471 aa, Legionella pneumophila subsp. pneumophila str. Philadelphia 1
MNKGMNAFVFLIAVIAGFGGFLFGFDSSVIADVKDQVISQLALTDWQWAQVVSSSLLGCILGIPISGLVADKLSRRSLLKVVALGFILGSSLCALAPGFVSILLGRFIIGICIGIASYIAPLFIAEIAPPHQRGTLVLINGLTITFGQAIAYLIGYFLHDYSLMSWRYLFWIGSLPALVLFSGMYFVPHSPRWIMIKYGADATLKTLKQIRPVGYNIQQELTEISNNLVNPAPAYIQMFKKPIVFVLLLGVGLGLFQQFSGINALMYYGPVVFESFGFSPVKNAILATFFLGLVNFIFTVVTLFYVDKLGRRFLLISGTLIASISLYFVSLLSCHSLFVNKFWILGGLSFYVMGYCISLGSLFWVLISEIYPLSVRGLAMSIATMFQWGANFVVSLLFLPIYQFSGQTVTFAMFATFCLLACWFIYYFVPETTSVSLEKLEENLSSGKKVRDIGQPVSKNIKIAKFNLIMD

SEQ ID NO: 21995 - protein, 554 aa, Phaeodactylum tricornutum
MSDLTSSPAWKALEAHYGTMKNVHMKELFANDSERFHKYSMKFEDILLDYSKNRVADSTMDLLYALAEQQDVKGKAQAMFSGEKINSTEDRAVLHIALRNQSNKPIYVDGEDVMPAVNETLERIKAFTNQVRDGTWKGHTGKVITAIVNIGIGGSDLGPVMACEALKPYAADHLKMHFCSNVDGTHIAEILKLCDPETTLFLIASKTFTTQETMTNANTAKTWLVGNFDGDETSVAKHFAALSTNGDAVSAFGIDVNNMFGFWNWVGGRYSLWSAIGTPIALAIGFDNWMEMHAGAHAVDQHFLQYDGKDNLPLTLALIGLWYNNFFGAETVAILPYDQYMHRFAAYFQQGDMESNGKYVDMNGKRMQTQTGPIIFGEPGTNGQHAFYQLIHQGTKIIPCDFVAPCQSQNNLPEKLGAPVDHHPILLSNYFAQTEALAFGKDESQVKAELDKTDMSEAEKTALVPHKVFEGNRPSNSFLFKKLTPRTLGSLIAIYEMKIFCQGAIWNINSFDQWGVELGKQLAKAILPELDGDSPVSSHDSSTNGLINYYKTNK

SEQ ID NO: 21996 - protein, 484 aa, Cyanophora paradoxa
LEEKIKAMAAGEHINNSEDRAVLHMALRAKRDEVFNVDGKNVVKDIYEVLDKIKDFSERVRSGKFVGATGKPIKDIVAVGIGGSYLGPKFVYEALRTDAKGAKGGHGRKLRFLANVDPVEVARCVEGLNPETTLVIVISKTFTTTETLLNAKTMKDWFNKAGIMDVSKNMVAVSTNAEKVKEFGISTDNMFGFWDWVGGRYSVCSAVGVLPLALVFGYDVAEEFLMGARDIDRHFLSAPLEKNIPVLMGLIGIWNASFLGHSSRALLPYAQALLKLAPHVQQVAMESNGKRVCKDGTLLDYEVGEIEFGEPGTDGQHSFYQLIHQGRVVPCDFLGFAKSQYPVYLPDEHPVSNHDELMSNFFAQPDALAFGKTEAQVVAEGAPAELVPHKVFEGNRPSVSILFPESVTPFAVGQVLSLYEHRTAVEGFVWGLNSFDQWGVELGKVLATQVRMQLAKTRKEKAAIEGFVAPTTRLMERYINLTKN

SEQ ID NO: 21997 - protein, 341 aa, Glycine max
MSSTAGQVIKCKAVSWEAGKPLVIEEVEVAPPQAGEVRLKILYTSLCHTDVYFWEAKGQTPLFPRIFGHEAGGIVESVGEGVTHLKPGDHALPVFTGECGDCPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNG

SEQ ID NO: 21998 - protein, 520 aa, Pseudomonas fluorescens PfO-1
MRVSLISTTAKENIMRYAHPGTEGAKVSFKSKYGNYIGGEFVAPVKGQYFTNTSPVNGQPIAEFPRSTAEDIEKALDAAHAAADAWGSTSAQARSLILLKIADRIEQNLETLAIIETWDNGKAIRETLNADIPLAADHFRYFAGCLRAQEGSAAEIDGNTVAYHIHEPLGVVGQIIPWNFPILMAAWKLAPALAAGNCVVLKPAEQTPLGISVLLELIGDLLPPGVLNVVQGFGKEAGEALATSKRIAKIAFTGSTPVGSHIMKCAAENIIPSTVELGGKSPNIFFEDIMQAEPSFIEKAAEGLVLAFFNQGEVCTCPSRALVQESIYPQFMEAVMKKVSQIKRGDPLDTDTMVGAQASEQQFDKILSYLEIAKGEGAELLTGGKVEKLEGSLATGYYIQPTLLKGTNKMRVFQEEIFGPVVSITTFKDEAEALAIANDTEFGLGAGLWTRDINRAYRMGRAIKAGRVWTNCYHLYPAHAAFGGYKKSGVGRETHKMMLDHYQQTKNLLVSYDINPLGFF

SEQ ID NO: 21999 - protein, 175 aa, Pseudomonas fluorescens PfO-1
MSYSKIPAGKDLPNDIYVAIEIPANHAPIKYEIDKDSDCLFVDRFMATPMFYPANYGYIPNTLADDGDPLDVLVVTPYPVAPGSVIRARPVGILNMTDDGGGDAKVIAVPHDKLSQLYVDVKEYTDLPALLIQQIEHFFANYKDLEKGKWVKIEGWDGADAARAAITKSVAAYKG

SEQ ID NO: 22000 - protein, 298 aa, Alteromonadales bacterium TW-7
MAEIENRPSNFIRTRIDEDLASKKHAATHTRFPPEPNGFLHIGHAKSICLNFGIAKDYNGLCNLRFDDTNPEKEDINYVNSIKEDVQWLGFNWDGDIKYSSNYFDILYGYAVELINKGLAYVCFLTADQAREYRGTLTEPGKNSPYRDTSPEENLALFEKMRAGDFKEGECVLRAKIDMASSFMVLRDPIIYRVRFAHHHQTADKWCIYPMYDFTHCISDAIEGITHSLCTLEFQDNRRLYDWVLDNISIECHPQQIEFSRLNLEYTIMSKRKLNDLVVNNYVEGWDDPRMPTIAGLR

SEQ ID NO: 22001 - protein, 423 aa, Streptomyces lincolnensis
MSNPPTAAGVPEELERRLGVSDAVVIGLGSMIGAGIFAALAPAAHAAGSGLLLGLALAAVVAYCNATSSARLAARYPASGGTYVYGRERLGDFWGYLAGWAFVVGKTASCAAMALTVGSYVWPGQAHAVAVAAVVALTAVNYAGVHKSALLTRVIVAVVLAVLAAVVVAALTSDATDTARLDIGSDASVGGVLQAAGLLFFAFAGYARIATLGEEVRDPARTIPRAIPLALGITLVVYAVVAVAVLMVLGPKGLADAAAPLSDTARAAGVDWLAPVVRVGAAVAALGSLLALILGVSRTSLAMARDRHLPHALSAVHPRFKVPHRAELVVGAVVAVVAATADVRGAIGFSSFGVLAYYAVANASAWTLTPEEGRPARVIPVLGLAGCLILAFALPVSSVISGTAVLALGAVAYGIRRGLAARR

SEQ ID NO: 22002 - protein, 128 aa, Brassica napus
TDAWARKEGETDLVVLCSEGSQSHSERESISELVSSVEQSGSKYTALYVSDPYWYTSYKTLQRFLAESATGNSSSVGVSTTCDELCKFKSSLLEGILVGIVFLLILISGLCCMAGIDTPTRFETPQDF

SEQ ID NO: 22003 - protein, 322 aa, Mycobacterium avium subsp. paratuberculosis K-10
MTVCRDADPRQKARAPGLVWPPGRRLTSAPMTDVCVVGSVNLDLSLAVDALPRPGETVLASSLRQAPGGKGGNQAVAAARAGARVQFVGAVGDDAAAGQLRAHLQANGVGLDGAVEIPGPSGTAIVVVDANAENTIVVAPGANGRFTLNDERARAVLAGCDVMLTQLEIPVATAVAAARHARSGGAVVVVNASPAGRDPDSLSELAAAADVVITNEEEASEWPWRPRHLVVTLGSHGARYVGADGEYSVPSPDVDAVDTTGAGDVFAGVLAANWPLEPGSPDQRRLALRRACAAGALATLVPGAGDCAPRAEEIERALRGKS

SEQ ID NO: 22004 - protein, 698 aa, Arabidopsis thaliana
MDDLKVNLPFHEHPLTPVKMESKCDWCGIKFIHISDGYQCDSCFTPLFHKTCANDKNIAHPSQACGIILYHTVNFDSGKWRCAKCGEKIYDSLFFVCNDCVLKPRRKGSRFGGSSYFHFNCAKYPPSEVIDVPQHHDHKLKLEMVISSFTCAACGKDGDGYSYKCQECNLTFHVNCEKYPAEVTHFSHFLHPLKLFKGEPPAYTDGKCRLCGEKLANFEVFYHCSACNFSLDLQCVFHPPKQNPHDLNIHDHPLTLMPKSISFTCTTCGLNGDRSPYVCLPCDFTSHNDCSGYPWVININRHDHRVSRTSLIGVVNSVCGICRKKMDWSCGGYSCQKCSSYVFHTKCATREDVWDGKEMKDEPEEEEAIQPFTIIDENTIKHVSHKEHNLRLDKSGIFIEERICEACVYPIYHHSFYSCMSCSFILHESCAYLPLWKRHVVSNERHEYKYWDYFIRCSACRLLSNGFRYETTQTSLDLRCASTTEPFFHKTHPHPLFYTSPQGICSICKKDHLHVLRCVEDGCEYIMDYKCALLPYEKEMDPKTWFYTSKDCELTLHTDCVLGDFRGLKPESEESMYIDDFEMYVKVVRNNKFSEVYDLSKWCSSYVYESPMMDTSNGLEFAFLGEIKGTKEMELVSSEAKDMSQSQVEFSEDIMNLVVEESEIDEDCSIWGKPKRKGRVFSENIKERKRLQQPMKLS

SEQ ID NO: 22005 - protein, 326 aa, Synechococcus sp. CC9311
MAGSGYRDYFKVLGVERSADADTVKRAFRKLARQYHPDVNPDDQDAEARFKEVSEAYEVLSDPEKRRRYEQFGQYWNQAGMPGGGSGPAGVDVDFGRYGNFDDFINDLLGRFGGGAGGGSGPAGYGGGFPGGGFPGGGFPRGGSRGPLNLDAEAAVKVTFSEAFRGGERTLSVNDERVQVRIPPGVKSGSKLRLKGKGNVQPGTGRRGDLYLVIEVQSHPIWTLDGDQLRAELPVAFDELALGGMVKVMTPDGEADVTIPPGTAPGKSLRLRGKGWPGKSGRGDLLLTLDLQWPKQWSDEQRQLLEQLQSSRDGDIRQQWMQNASL

SEQ ID NO: 22006 - protein, 491 aa, Salinibacter ruber DSM 13855
MVVQGLGFVGAVMALVVANAPHEDYVVIGVDLPTHEGKQKVDALNKGVFPIESADPTVEELHEQALDQQNFLATCNEHAYEVADVVVVDVNLDVEKNTDSDRALRGYDVDLSPFKSACRTVAERCPSETLVIVETTVPPGTCRNVVKPIFDETFEKRGLAKTYRLGHSFERVMPGPDYVDSIRNFYRVYAGIDEDSADATRDFLESIIYTDEFPLTRLGSTTASEMTKVLENSYRAMNIAFVQEWTEFAEEVGVNLYEVIEAIRKRPTHRNLMFPGLGVGGYCLTKDPLLASWARSAHGKGDGEAHLPQSETAVEINDRMPRHTFERLQTALDDTVEGKTIVLLGVSYRKDVGDTRYTPAAYLYDLLEEHGAAVKLHDPYVEHWDERDREVRQDLEAVLTEKVDAVVFSTPHTEYEDNAELQRRLHALPDSIVVHDAWGVLSDGEIGALQSTHRVQVSGRGDLHSEQTHSTETDSFPVPSFDSSTTATSSS

SEQ ID NO: 22007 - protein, 460 aa, Idiomarina baltica OS145
MTNPQHTFRVAKFGGTSVANYSAICAAVANVKSQNQPILVVVSACAGVTDRLVMLANESDNVESILSEIVHRHTEIADELSRLNRAGAVEKQLALDDLHDRLRQHVARRPTPHDASFVAWRDQLLSFGEYCSSLLFSWAWEAKTEQPSAVLEAKTWLFTDSRYGRARPQLKAMIEKAPQWLKTLEPGRLYVTQGFIGKNERGQTTTLGRGGSDYSAALLAVVVQAQELQIWTDVAGVYSTDPRLCSDAFAIAEMSFDEAAEMATFGAKVLHPASLLPAIEYQIPVFVGHAAYPARGGTRLVKNSTHKPDVRAVAVRKQQTLMTVHSIDMFHASGFLAQLFSIFAKYDISVDLITTSEVSIALTLDEGGSQANHAVSVPAAAIAEIELFAKVELEYNLTLIALIGNQIGRQSQLSQWVFDAVAPTPVRLICQGASEFNLCFLIPERDTVDVVTRLHERIKR

SEQ ID NO: 22008 - protein, 774 aa, Erythrobacter sp. SD-21
MADANAATASDEKTVRLQVAAARQEESGQGIVRMPRSAFQALGVTEGDPVEIVGKRATVAIAMSAYDEDQTIEVIRLDGLQRGNAEVGSGEHVVVKAAESRPATRVVFAPANRDMRLQGPSQALKRNFAGKPLLAGDLVATTGQQPVRNMPPEVRRMFNAPAYALTQIRLSVVSTTPKGIVHIDENTEVELRAEFEPPRDARAVVNYDDVGGIDDTIQALREMVELPLRYPELFTRLGVDPPKGVLLHGPPGTGKTRLAQAVANESDAEFFTINGPEIMGSGYGESEKALREVFEQATKASPAIIFIDEIDSIAPKRDRVPGEAEKRLVAQLLTLMDGLEARSNLVVIAATNRPEAIDEALRRPGRFDREIVVGVPDEKGRREILGIHTRGMPLGDKVDLTELAKATYGFVGADIAALAREAAIDAVRRIMPKIDLDERTIPPEVLDELYVGREDFLSALKRIQPSAMREVMVQVPNVGWDNIGGVGDAIDKLKEGIELPMKNADAFHRLGIRPAKGFLLYGPPGTGKTLLAKAVAKEAEANFISMKSSDLLSKWYGESEQQIAKMFKRARAVAPCVIFIDEIDSLVPARGSGQGEPQVTGRVVNTILAEMDGLEELQSVVVIGATNRPTLVDPALLRPGRFDELVYVGTPDKPGREQILGIHTASMPLGDDVSLAAIAGKTERFTGADLEDVVRRAGLNALKRAGDDVQNVAAGDFDEALKDSRATVTSKMESEYKKMRGELKKRAAEVQPIGFIHEGMLEPTRDRKHGSTES

SEQ ID NO: 22009 - protein, 531 aa, Xanthomonas campestris pv. vesicatoria str. 85-10
MSEHSLRRDVGPFALMLTGLGSIIGSGWLFGAWRAAGLAGPGAIWAWVLGAAIITTIALSYAELGAMFPESGGMVRYSHYSHGSLVGFIAGWANWIAIVSVIPVEAEASVQYMASWPWAWAQGLYVQAPGGAGELSVPGLLISAVLVLVYFFLNFWSVKLFARSNTLITVFKLVVPAATGVALIASGFHSENFSVGIHGDSHVLDLAAVLTAVATAGIVFSFNGFQSPVNLAGEARNPGRSIPFAVLGSIALATVVYVILQVAYIGAVPPDLLAKAGWHGIDFRSPFAELAIIVNLHWLAMLLYIDAFVSPSGTGITYTATTARMVYGMEKNGTMPAVLGKLHPVWGVPRMAMFFNLAVSFVFLFFFRGWGTLAAVISVATIISYLTGPISAMALRRHAPELHRPLRIAALPVLAGVAFVMATELLYWARWPLTGEIILLMVVALPVYCYYQAKQGWPDLRRNLKGAAWMICYLPTIALVSWAGSTDFGGHGYLSYGTDLVVVAVVGAVFYVWGVRSGWRTPSVEKAVAQA

SEQ ID NO: 22010 - protein, 289 aa, Zea mays
TTFRQVLGQHAKRINLMSKVENQEGVVNFDEILRETDAFMVARGDLGMEIPVEKIFLAQKMMIYKCNIAGKPVVTATQMLESMIKSPRPTRAEATDVANAVLDGTDCVMLSGESAAGAYPEVAVKIMARICIEAESSLDHEAVFKAMIRSAPLPMSPLESLASSAVRTANKAKAALIVVLTRGGTTAKLVAKYRPRVPILSVVVPVLTTDSFDWTISSEGPARHSLIYRGLIPLLAEGSAKATDSESTEVILEAALKSAVQKQLCKPGDAIVALHRIGVASVIKICIVK

SEQ ID NO: 22011 - protein, 642 aa, Bacillus halodurans C-125
MIVLQCVNITKSFGAETILSNIKLEVKTGDRVALVGRNGAGKSTLLKIIADKLSYDSGDLIIPKGVEIGYLEQHTGLESDLTIWDEMLSVFEPLQQMERRLRKMEEQMANPALLNNASSYEKLLEEYDSLQVEFKDRGGYQYEADIRNVLAGLQFADFPYHETKIATLSGGQKTRLALGKLLLTKPDLLILDEPTNHLDIDTLSWLEQYLSAYPGAILIVSHDRYFLDKLVTQVYEISRTKSTKYVGNYSHYLDEKALRYEQELKEFEKQQKEVAKLEDFIQRNIARASTTKRAQSRRKALERMTKLDRPNSDEKSASFFFDIERQSGNDVLRVRDLTFSYDGDPLFSRLDLDLNRGESVALIGPNGAGKSTLLKLLTKKLQADQGTIEYGSHVKIGYYDQEQANLHSNKQVLYELWDDYPLLPERDIRTVLGNFLFSGEDVLKVVSDLSGGEKARLALAKLMMEKANLLIMDEPTNHLDLDSKEVLENALIDYPGTLLFVSHDRYFLNRMATRIIELDGGQPSVFLGDYDYYLEKKQEIKERERLDESPSHAAAASSKKGSFEQDKEQKKRERQRQRRIEQIEASIEELEKQLSTHEEALCNPEVFTDHEKALSHQQTIDEAKKAVDALMEEWELLHAEEG

SEQ ID NO: 22012 - protein, 257 aa, Crocosphaera watsonii WH 8501
MEWLEISGSSVLVPRYPIAIIHFLGGAFVGTAPNFTYRWLLEELAKEGYAIIATPFVNTFDHLAIARNVLNRFEGILDRLQTNNSLGQGYLPIYGIGHSMGCKLHLLIGSLFSVERAGNVLISFNNYPVKKAIPFLEQLDIENYLNLEFTPSTDETKLIIEKDYLVRRNLLVKFTDDNIDETKILEPILDDKYPNLIALQTLSGNHLTPLSQDIKWEAGEIFTPLDAVGQWVKQAFSRDLYRLKNEILRWLNPGRIV

SEQ ID NO: 22013 - protein, 198 aa, Sulfolobus tokodaii
MTNIPEIPYKAVVNIENIVATVTLDQNLDLYAMERSVPNVEYDPDQFPGLIFRLEAPKVTSLIFKSGKMVVTGAKSTDELIKAVKRIIKTLKRYGMNLTGKPKIQIQNIVASANLHVIVNLDKAAFLLENNMYEPEQFPGLIYRMEDPRVVLLIFSSGKMVITGAKREEEVHKAVKKIFDKLVELDCVKPFEEEELEF

SEQ ID NO: 22014 - protein, 487 aa, Oryza sativa Japonica Group
MGRRDEESIIFSSLENGVRKRESEYFSRRTGACDWAALRSSRPNHTESTKMIGPLDRCVIAISARTSQGLQAHNACLTKRVGPHMSVAVREHNPHPVLFAPFPPFVLRPPRSLPRVREPDGFSVWSGPPYPTGSAPPVRLPKTACSATYFSSDGSRLLATVASASATVYDCRTLSVVRSFELPGLLAAALSPAGTFLQTFQKSSSPQEKNVTVWHVDTATALYQHYQKNMSKATWPMVQFSADESVACRMMTNEIQFFDPKDFTKGFVYKLRMPGIAAMQLASAPGSHVAGFVPEAKAFWDYSEKKLVGKTKAECSVTSEWSPDGRHFMTATTAPRLQIDNGIKIFDHNGSLQFKKMFEKLYQADWKPEAPEKFSDIADLTISLGSIKIEETKKQGSLHFLIFHVISAQGSKSAQPSSKAPANIAAKPTAYRPPHSKNSADVQDKLFGGLASTGGEMSKNALRNKKRREKQKEKKAAEGSGASADDN

SEQ ID NO: 22015 - protein, 295 aa, Aspergillus oryzae
MFSLARLGTVAGLFLLAQAAPASLRRDVSSSLLNNLDLFAQYSAAAYCDENLNSTGTKLTCSVGNCPLVEAASTQSLDEFNESSSYGNPAGYLAADETNKLLVLSFRGSADLANWVANLNFGLEDASDLCSGCEVHSGFWKAWSEIADTITSKVESALSDHSDYSLVLTGHSYGAALAALAATALRNSGHSVELYNYGQPRLGNEALATYITDQNKGGNYRVTHTNDIVPKLPPTLLGYHHFSPEYYISSADEATVTTTDVTEVTGIDATGGNDGTDGTSIDAHRWYFIYISECS

SEQ ID NO: 22016 - protein, 462 aa, Chlamydophila abortus S26/3
MSTDFDCVVIGAGPGGYVAAITAAQQGLKTALIEEQQAGGTCLNRGCIPSKALLVGAGIVSQIKHANQFGIHIDGYSIDYPAMVQRKNTVINGIRQGLEGLIRSNKITVLHGRGSLISSTEVRVKGQDTSVTKSQYIIIATGSESRPFPGVPFSSRILCSTGILNLTELPKKLAIIGGGVIGCEFASLFHTLGVEITIIEVAEQILSVNNADISKTMLDKFSRQGIRIITKASIHALEDLGDRVRITVNEQTEEYDYVLVAIGRQFNTTDIGLDNAGVIRDNRGIIPVDETMRTNVANIFAIGDITGKWLLAHVASHQGIVAGKNAASHNEIMDYSAVPAVIFTLPEVAMVGLSLEAAQQQGIPVKLTKFPFKAIGKAVAMAEADGFAAIISHETTQQILGAYVVGPHAASLIAEMTLAVRNELTLPCIYETIHAHPTLAEVWAESALLATNHPLHLPPPKL

SEQ ID NO: 22017 - protein, 319 aa, Burkholderia xenovorans LB400
MLARVTRLFPLWAVLVSIAAYFSPASFSGIAPHVTTLLTIIMLAMGVTLSVADFQRVFTRPAPVIAGIVLHYLVMPLAAWVIARALRMPPDLTAGMVLVGSVASGTASNVMIYLARGDVALSVTISALSTLVGVFATPLLTRLYVDASIAVDVHGMLMSILQIVALPIVVGLIVNHLFGKVVRKIEPVLPLISMIAIVLIIGAVVGGTQKSIASVGLVVMLGVVLHNGIGLLGGYWGGRLLGFDEAVCRTLAIEVGMQNSGLAATLGKLYFTPIAALPGALFSVWHNLSGSLLAGYWAGRPAKGSTHVDSEQVLNAERG

SEQ ID NO: 22018 - protein, 466 aa, Francisella tularensis subsp. holarctica
MGSKAENLVVFHLVGSPGDGAVGKKRQVHHTLGDGVFGNFFDLSASAACVSAVITPENARREMNRVIAEAFKYRKPAYISVSLDSGNRPVTDITPDDIDCSYLKSDSHQLELATNLVLEHLSKAKKVVAIPAIKLDRFGVTEKAINLIEKLNIPFSIMPHDKSVISETHPNYVGFYAGLLSDTNTAEIVEGADLIINLGDALWSDFNTAGFTNNLDLNKVLNLGPLFVEDNKTYLADVYLSELLDALLEKVESINYRPNYSRMKIQDTTITKEKLTLRALYTQVLKFLENTDSLVVETGSSSLNMPKLPLPEGVKYFNQTLWGSIGWATPAALGVALANPDSRTILITGEGSHQLTLNELGVMGRYKINPIILCINNDGYMIERALELDPNPSYDDIAQLNYTKLPEAFGCNDWLAIRVKTSEELAEALKKAREHQSGVYIEVITGKYDYGNAFDFFNNHLKEMYS

SEQ ID NO: 22019 - protein, 295 aa, Pseudomonas fluorescens PfO-1
MIAAYSATSQARVNAALETLFNAPLPELARLYEAMRYSVMNGGKRVRPLLAYAACEALGGKAEQANGAACAVELIHAYSLVHDDLPAMDDDDLRRGQPTTHKKFDEACAILAGDGLQSLAFSALLDPRLSDLSADIRLQQVTALAHAAGPAGMVGGQAIDLGSVGLKLDQKALEQMHRHKTGALIEVSVKLGALASGCAEKDELKSLQTYAQAIGLAFQVQDDILDVESDTETLGKRQGADIARDKPTYPALLGLDAAKAYALELRDQALHALRPFDAAAEPLRDLARYIVDRRN

SEQ ID NO: 22020 - protein, 632 aa, Pseudomonas fluorescens PfO-1
MPTTFHEIPRKRPTTPLLDRANTPDGLRRLGEAELETLADELRLELLYTVGQTGGHFGAGLGVIELTIALHYVFDTPDDRLVWDVGHQAYPHKILTGRRERMETLRQKDGIAAFPRRSESEYDTFGVGHSSTSISAALGMAIAARLQNSDRKAIAVIGDGALTAGMAFEALNHAPEVDANMLVILNDNDMSISRNVGGLSNYLAKILSSRTYASMREGSKKVLSRLPGAWEIARRTEEYAKGMLVPGTLFEELGWNYIGPIDGHDLPTLIATLRNMRDLKGPQFLHIVTKKGKGFAPAEVDPIGYHAITKLEPLDAPAAAPKKAGGPKYSGVFGEWLCDMAAADPRLVGITPAMKEGSDLVAFSERFPLRYFDVAIAEQHAVTLAAGMACEGAKPVVAIYSTFLQRGYDQLVHDVAVQNLDVLFAIDRAGLVGEDGPTHAGSFDLSFLRCIPGMVIMTPSDENELRKMLTTGHLYNGPAAVRYPRGTGPNATIEKDLEPIEIGKGVVRRQGSKVALLVFGVQMAEALKVAETLDATVVDMRFVKPMDEALVREIANSHDLLVTIEENAIMGGAGGAVSEFLARENILKSVLHLGLPDVYVEHAKPAQMLAECGLDEVGIEAAVRERLELLNR

SEQ ID NO: 22021 - protein, 469 aa, Thermotoga maritima MSB8
MKSHIGLIGLAVMGQNLALNIARKGYKVSVYNRTAQRTEEFVKNRVTNEEIEPHYDIESFVKSLERPRKIILMVKAGKPVDDTISQLLPHLEPGDLIIDGGNSHYMDTERRFKELSEKGILFLGMGVSGGEYGALHGPSLMPGGSREAYNLVEEILLEIAAKTEDGPCCTYVGERSAGHFVKMVHNGIEYAIMQAIAEVYHIMRDVLSLSSEEMSSIFEEWNRGELSSFLVEITYKILRKKDEETGKPMVDVILDKAEQKGTGKWTSQAALDLGIPTPSINLAVVERVISHFKDIRTRLSKLYNKRRSATQGSEEFLRDLRNSLFFAMFMAFSQGMWLIAEASKEFGYGVSLSEVLRIWKGGCIIRAKLIDTLRRYISNENAYLLENEEVMNLLKGKIDSLKNILKASIENEIPVPVLSSSYNYFMSLTEERLPANLIQAQRDFFGAHTFERVDREGVFHINWEEGEIG

SEQ ID NO: 22022 - protein, 576 aa, Oryza sativa Japonica Group
MAHHVAPLLLLLTLAAVAAAASEEAAAADTEAAAAVEAGLLVRREAQLARLEELTESLAKSVQALESALARSVEPDPPPPAAAAASPGDRRAPQGVAVTKRRPLLPPVTALLAYLSPRRTDCFLFAGHADGSIAAHRLIESSPHGDDWLTLAAASSRLLVRGLDAAPVLHLEAHHAGRARYVLSCDSGGRIRVFTENGTLYGTAIASSTPLAFVKQRLLFLTEAGAASLDLRSMSVRETPCEGLAEALNGSLPKAYSFDPSERFKAYGFTDAGDLVHVLLLGDIASLKCRVRAIKKAEIDNPVAIQTIKGYLLVASQDKILVYNTSTQYYGRVGAPRLLFATSIKDIKSVFAGSGGVMPASPAGKPLVAADREKLVILGLGDGYIAIYRSNFPVYKPESNAVVWSGPALLFLLFLIGIWQVYVKKKDSLGWTPEETFNTSVTAPTGSILNHSTSDRAFADSSTRTGERGYVDGTTRASDRSYVDATTRATDRAYAEATRGVDLRGGALRGAPRRYVSPTRYTGAAGIPYRPVSTEPVLRTTPELKYRGPGMEPPGFPKKRDTLFSSNQTVVDDHVD

SEQ ID NO: 22023 - protein, 420 aa, Staphylococcus aureus subsp. aureus MW2
MKLTVVGLGYIGLPTSIMFAKHGVDVLGVDINQQTIDKLQSGQISIEEPGLQEIYEEVLSSGKLKVSTTPEASDVFIIAVPTPNNDDQYRSCDISLVMRALDSILPFLKKGNTIIVESTIAPKTMDDFVKPVIENLGFTIGEDIYLVHCPERVLPGKILEELVHNNRIIGGVTKACIEAGKRVYRTFVQGEMIETDARTAEMSKLMENTYRDVNIALANELTKICNNLNINVLDVIEMANKHPRVNIHQPGPGVGGHCLAVDPYFIIAKDPENAKLIQTGREINNSMPAYVVDTTKQIIKALSGNKVTVFGLTYKGDVDDIRESPAFDIYELLNQEPDIEVCAYDPHVELDFVEHDMSHAVKDASLVLILSDHSEFKNLSDSHFDKMKHKVIFDTKNVVKSSFEDVSYYNYGNIFNFIDK

SEQ ID NO: 22024 - protein, 255 aa, Thermotoga maritima MSB8
MKEVFDLRGRVALVTGGSRGLGFGIAQGLAEAGCSVVVASRNLEEASEAAQKLTEKYGVETMAFRCDVSNYEEVKKLLEAVKEKFGKLDTVVNAAGINRRHPAEEFPLDEFRQVIEVNLFGTYYVCREAFSLLRESDNPSIINIGSLTVEEVTMPNISAYAASKGGVASLTKALAKEWGRYGIRVNVIAPGWYRTKMTEAVFSDPEKLDYMLKRIPLGRTGVPEDLKGVAVFLASEEAKYVTGQIIFVDGGWTAN

SEQ ID NO: 22025 - protein, 397 aa, Trifolium pratense
MASASASLFKSSLVLDKSEWVKGQTLRQPMSVVRCSPAAPSSLTIRAGAYTDELVKTAKTIASPGRGILAMDESNATCGKRLASIGLENTEVNRQAWRTLLVTVPSLGEYISGAILFEETLYQSTVDGRKIVDVLVEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHNIDRTFEVAQKVWAEVFYYLAENNVQFEGILLKPSMVTPGAESKDRASPATVADYTLKLLQRRIPPAVPGIMFLSGGQSEVEATLNLNEMNKSPNPWHVSFSYARALQNTALKTWGGRIENVKAAQEALLHRAKSNSLAQLGKYAGDGESEEAKKELFVKGYVY

SEQ ID NO: 22026 - protein, 397 aa, Shewanella sp. ANA-3
MIFSQVVLAPADPILGLTDTFKADPRQDKVNLGVGIYKDEAGQTPVLQSVKKAEALLLEQEKTKNYLGIEGVQTYNRVVQELLFGEGSTLVTSGRAATAQAPGGTGALRIAAEFLLRNTPSRTVWVSNPTWANHQNIFETAGLTVKEYGYYNASAHDIDFDGMMTDLANAQAGDIVLLHGCCHNPTGIDLTLAQWELVANLCADKQLVPLFDFAYQGFGAGIEEDAAGLRLVAAKVPELLVANSFSKNFGLYNERIGAVTVVAQNADEAVRAFSQVKRTIRANYSNPPAHGALIVSTILSDAALKALWVQELTEMRERIAQMRTLFVQSLKDEGVTQDFSFISRQNGMFSFSGLNKEQVARLKDEFGIYIVGSGRISVAGMTKTNMPVICKAIAQVL

SEQ ID NO: 22027 - protein, 566 aa, Pseudomonas putida GB-1
MLRNPSRRTFVKGLGAASTLAGLGLWRPLAQAAEGRDLAGQHFELFIGQTPVNITGRPRTALTINNSLPGPLLRWREGDTVTLRVRNRLAQDTSIHWHGIILPANMDGVPGLSFAGIEPGGDYRYQFTLRQSGTYWYHSHSGLQEQAGVYGAIVIEPREPEAHRYQRDHVLLFSDWSDQAPEQLMATLKKQSDAYNYHKRTVGDFIDDVADKGWSPTVAERTAWARMRMSPTDLADISAATYTYLLNGQPPEGNFTCLFQPGETVRLRLINASAMTYFDFRIPGLKLTVIAADGLPVTPVSVDELRIAVAETYDVLVTVGDQPAYTLFAQSMDRTGFARGTLARAAGLQAPVPAPDPRPVLSMDDMGHGGMGAMASMDHSNMAGMDHAAMSAMQQHPASETDNPLVDMQTMAPRANLADPGIGLRNNGRRVLTYADLRSPYPDPDGRTPSRDIELHLTGHMERFAWSFDGIKFSDAEPLRLTYGERVRITLVNDTMMTHPIHLHGMWSDLEDEHGQFLVRKHTLDIPPGSRRSYRVTADALGRWAYHCHLLYHMETGMFREVRVDE

SEQ ID NO: 22028 - protein, 211 aa, Pisum sativum
PDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLESRTQIFKIHTRTMNCERDIRFELLARLCPTP

SEQ ID NO: 22029 - protein, 540 aa, Bacillus subtilis subsp. subtilis str. 168
MIAVNNVSLRFADRKLFEDVNIKFTPGNCYGLIGANGAGKSTFLKVLSGEIEPQTGDVHMSPGERLAVLKQNHFEYEEYEVLKVVIMGHKRLYEVMQEKDAIYMKPDFSDEDGIRAAELEGEFAELNGWEAESEAAILLKGLGISEDLHTKKMADLGGSEKVKVLLAQALFGKPDVLLLDEPTNHLDLQAIQWLEEFLINFENTVIVVSHDRHFLNKVCTHIADLDFNKIQIYVGNYDFWYESSQLALKLSQEANKKKEEQIKQLQEFVARFSANASKSKQATSRKKLLEKITLDDIKPSSRRYPYVNFTPEREIGNDVLRVEGLTKTIDGVKVLDNVSFIMNREDKIAFTGRNELAVTTLFKIISGEMEADSGTFKWGVTTSQAYFPKDNSEYFEGSDLNLVDWLRQYSPHDQSESFLRGFLGRMLFSGEEVHKKANVLSGGEKVRCMLSKAMLSGANILILDEPTNHLDLESITALNNGLISFKGAMLFTSHDHQFVQTIANRIIEITPNGIVDKQMSYDEFLENADVQKKLTELYAE

SEQ ID NO: 22030 - protein, 413 aa, Staphylococcus epidermidis ATCC 12228
MAEHSFDVKAVIKDFPILEQKVNNKRLAYLDSTATSQTPVQVLNVLDDYYKRYNSNVHRGVHTLGSLATDGYENARETVRRFINAKYFEEIIFTRGTTASINIVAHSYGDANISEGDEIVVTEMEHHANIVPWQQLAKRKNATLKFIPMTKDGELQLDDIKATINDKTKIVAIAHVSNVLGTINDVKTIAKIAHEHGAVISVDGAQSAPHMALDMQDIDADFYSFSGHKMLGPTGIGVLYGKRELLQNMEPVEFGGDMIDFVSKYDSTWADLPTKFEAGTPLIAQAIGLAEAIHYIENLGFNAIHQHEKELTEYAYEQMLTIDGLEIYGPPKDRRAGVITFNLADIHPHDVATAVDTEGVAVRAGHHCAQPLMKWLGVSSTARASFYVYNTKEDVDQLVQALKQTKEFFSYEF

SEQ ID NO: 22031 - protein, 311 aa, Salmonella enterica subsp. enterica serovar Typhi str. CT18
MALPIIIDCDPGHDDAIALVLALASPELEVKAITSSAGNQTPEKTLRNVLRMLTLLKRPDIPVAGGAVKPLMRELIIADNVHGESGLDGPALPEPSFAPQSGTAVELMAKTLRESAQPVTIVSTGPQTNVALLLNSHPELHTKIARIVIMGGAMALGNWTPAAEFNIYVDPEAAEIVFQSGIPVVMAGLDVTHKAQIHAADIERFRDIGNPISTIVAELLDFFFEYHKDEKWGFVGAPLHDPCTIAWLLKPEIFTTVERWVGVETQGKYTQGMTVVDYYFLTGNKPNATVMVDVDRQGFVDLLAERLQYYA

SEQ ID NO: 22032 - protein, 220 aa, Pseudomonas fluorescens PfO-1
MPPSESRTFQIRSTPVPVVFVAASKLPTPFAQFTMHGFLDEATGREHVVLSLGEIADGAPVLGRLHSECLTGDALFSQRCDCGSQLEGALKAIAREGRGVLLYLRQEGRGIGLLNKIRAYELQDGGADTVEANERLGFAADQRDYAMCLPMLEHLGVKSLRLMTNNPRKVKALTDMGIVVAERVPLHTGHNPHNKLYLATKASKLDHMMGNEHQGEVDRA

SEQ ID NO: 22033 - protein, 227 aa, Arabidopsis thaliana
MKSLASPPCLRLIPTAHRQLNSRQSSSACYIHGGSSVNKSNNLSFSSSTSGFASPLAVEKELRSSFVQTAAVRHVTGSLIRGEGLRFAIVVARFNEVVTKLLLEGAIETFKKYSVREEDIEVIWVPGSFEIGVVAQNLGKSGKFHAVLCIGAVIRGDTTHYDAVANSAASGVLSASINSGVPCIFGVLTCEDMDQALNRSGGKAGNKGAETALTALEMASLFEHHLK

SEQ ID NO: 22034 - protein, 698 aa, Francisella tularensis subsp. holarctica
MKKSIFILPTSKHTGLRLLASSMVYALQQKGLKVGSFHPIYDMQMSIKNIQEYLLNNRVKDYVEIVLDKFYQKSQEFDFIIISGLFRQGNNAHKLYPINAIIDELNIEIVKALSSEVIITSYHGNKPLIDINDELDYAMRSLPKQINIIGTIITKLNAPYDDDGRVSFSLTDEDISSEQQQQVTVNMLRELPVFAQKGLNLIGVVEWQQEKTSPRILDIKNILKLNLISRVSLEARVDRVMMCSRGVDNFINDLTPNSLVITSADRSDILVTVCLAAKNGMKIAGILLTAEEYLNDKVKELCVETAEKVGLAILTTRNKSVKTILRIADIDLMGIPLDDKERIQRVKEIICNSLDRDKIINAITADVLGHQVMSPPAFRYHLLKMATKAKKRIILPESYEPRTLQAAKNSHEQGLAECVLIGDRDKIHKVAEMNGFSLPKDIQVVNIDDEAEIKYLNTLMNLRKHKGLSESMARDALKNPIVVATVMLYLGEVDGLVSGAEHTTADVLRPALQLIKIKPNSSLVSSVFFMCMPDQVIVFGDCAVNQDPSAEQLVDIAIQSAESAKKFGIEPRVAMISYSTGTSGSGVQVEKVRTATELLKQKAPELLVDGPLQYDAAMIESVAKSKAPDSPVAGRATVLIFPDLNTGNTVYKAVQRSANVLSIGPVLQGINKPVNDLSRGATVDDITYTIAITAIQAI

SEQ ID NO: 22035 - protein, 158 aa, Pseudomonas fluorescens PfO-1
MTLKTIEGTFIAPKGRYALVVGRFNSFVVESLVSGAVDALVRHGVSESDITIIRAPGAFEIPLVAQKVAQKGEFAAIIALGAVIRGGTPHFEYVAGECTKGLAQVSMEFGVPVAFGVLTVDSIEQAIERSGTKAGNKGAEAALSALEMVSLLAQLEAK

SEQ ID NO: 22036 - protein, 363 aa, Pseudomonas fluorescens PfO-1
MALNSIEELVEDIRQGKMVILMDDEDRENEGDLIMAAECCKAEHINFMAKYARGLICMPMSRERCETLKLPLMAPRNGSGFGTKFTVSIEAAEGVTTGISAADRARTVQAAAAKDAKAEDIVSPGHIFPLMAQAGGTLARAGHTEAACDLARMAGFEPSGVICEVMNDDGTMSRRAELEAFAAEHDIKIGTIADLIHYRMIHERTVQRIAEQPLDSELGQFNLVTYRDSVEGDVHMALTLGTVCAEEPTLVRVHNMDPLRDLLMVKQPGRWSLRAAMAAVAEAGSGVVLLLGHPLDGDVLLAHIRETGDQAAVKKPTTYSIVGAGSQILRDLGVRKMRLMSAPMKFNAISGFDLEVVEYVPSE

SEQ ID NO: 22037 - protein, 700 aa, Ustilago maydis 521
MYASSVRRSANFTLANGAQIPKLGFGTWKMSKEQATPAVAHAIKTGYRHIDCAWAYRNEDAVAAGIKKAGVPRSQLWLTSKLWNSFHHPEHVEKALDASLKDLGTDYLDLYLMHWPVAFLNSKGSMVPSIRSTGGHPVESEDLSRDFMATYRVMEEMVKKGKVRNIGVSNFNIRRTSEVVDEASIKPVVNQVEVNLGVHNEELRNYAHAHGVTLQAYSPFGSNQNVAKSLEDPVVVDVAQRNNITPAQVLLAWTLGRDIIPISKSVTPERIEENFRVLDIQLAEEEIKHLTNEALSRPIERTVDPTEGWGVADEIFEDGVDQTREMELKGGSYVPPPAHESPAEHRLEPRNDPETPARMLHTAAHPLASSSRSTLVSRRRTAVQAKSSSSFFRGFATTSRVAAVAEVAPPSASEAPAVSESALLRTTSKSALATPGLKFLDGEQRIERETKKMNMYTVRRMSTSTTTQASVRASARVTATSSAVKPTTRKYPAKKSFLYEKYLRLLSDSQMVLVLQHNNLSVAELAQVRSDIAAINLAEGQTSKASLTVVRAGLIKAVTRQLSEKNAAMKSLQPALSGPIALLTCEHLTPAYLSALLNVVDRALGHVPPRAPAVGAKFPETAVANPRLVPLAAVLEGKRLLHVPQTRDVGRIGGLDQLRSQIVGLLSAPAQQLAHVLTHASGQQLAMTLEARKRDLEAKQ

SEQ ID NO: 22038 - protein, 506 aa, Caulobacter crescentus CB15
MTKPEFIESLSRPPFKARYDNFIGGQWVAPADGRYFDNSSPIHGRKICEIARSQAIDIERALDAAHAAKAGWARTSAADRSRILLRIADRMEENLAALATAETWDNGKPIRETLAADIPLAIDHFRYFAGCLRSQEGSISEIDHDTIAYHFHEPLGVVGQIIPWNFPLLMACWKLAPALAAGNCVVLKPAEQTPASIMVWAEMIGDLLPAGVLNIVNGFGLEAGKPLASSPRIAKIAFTGETSTGRLIMQYAAQNLIPVTLELGGKSPNIFFDDVAREDDDYLDKALEGFTMFALNQGEVCTCPSRALVQESIYEKFMERALKRVNAVVQGSPLDPATMIGAQASEEQLNKILGYMDIGRNEGAKLLAGGQRKILPGQLADGYYVEPTVFEGHNKMRIFQEEIFGPVLAVTTFKTEEEALEIANDTAFGLGAGVWSRDANRCYRFGRGIEAGRVWTNCYHAYPAHAAFGGYKQSGVGRETHKMMLDHYQQTKNMLVSYSPKALGFF

SEQ ID NO: 22039 - protein, 946 aa, Mycobacterium avium subsp. paratuberculosis K-10
MVDGAPTADPSEESTRSGDLPDRLRVHSLARTLGTTSKRVLDALSELDGRVRSAHSTVDREDAVRVRDLLAAQPSAEPEPAAEDAASGGPDAGIAGEPESRLLLETPDATERPHYMPLFVAPQPLESSDDDGDADETADSDDSDGDDDEQADRPSSRRRRRGRRGRGRGRGEQGGSDGPGDGDDDEPQNRGKKGGQSDGDDDSDGQDAEDADDSDTGDDGSADGGNRRRRRRRRRKSGSGDDNEDGPSPDDPPNTVVHERPPRNGKNGGDDGNGSSSSEIKGIDGSTRLEAKRQRRRDGRDAGRRRPPVLTEAEFLARREAVERVMVVRDRIRTEPPHQGSRYTQIAVLEDGIVVEHFVTSAASASLVGNIYLGIVQNVLPSMEAAFVDIGRGRNGVLYAGEVNWEAAGLGGSDRKIEQALKPGDYVVVQVSKDPVGHKGARLTTQVSLAGRYLVYVPGASSTGISRKLPDTERQRLKEILREVVPSDAGVIIRTASEGVKEDDIRGDVTRLQERWKQIEAKAIEIKEKAAGAAVALYEEPDVLVKVIRDLFNEDFAGLIVSGDDAWNTINEYVNSVAPDLVSKVTKYEPATGPDGTPGPDVFAVHRIDEQLAKAMDRKVWLPSGGTLVIDRTEAMTVIDVNTGKFTGSGGNLEQTVTKNNLEAAEEIVRQLRLRDIGGIVVIDFIDMVLESNRDLVLRRLTEALARDRTRHQVSEVTSLGLVQLTRKRLGTGLVEAFSTSCPNCGGRGILLHADPVDSAPSNGRKSESGGRRGRRKKSKAEEPVVAKVPVHSPGEHPMFKAMAAGSSTQAASDEDESAAEEAGDELERKKAARAEELEAAEDTEDLEDTEDDDEDSDDSDDEDLDDEDIDDEEDLGDDDEDLELDDDDLDTEDSDDSDDSDDSEDSDDSEDQRDPAAERPGVSALGRPRRRRAAGRPAGPPIHAD

SEQ ID NO: 22040 - protein, 136 aa, Mycobacterium avium subsp. paratuberculosis K-10
MTERTLVLIKPDGVQRQLVGEIIGRIERKGLTLVALELRHVSQDLAAQHYAEHEGKPFFASLLEFITSGPVVAAIVEGPRAIAAFRQLAGGTDPVEKAIPGTIRGDFGLETQFNLVHGSDSVESAKREIGLWFPDA

SEQ ID NO: 22041 - protein, 278 aa, Triticum aestivum
  misc_feature (66)..(66): Xaa can be any naturally occurring amino acid
  misc_feature (91)..(91): Xaa can be any naturally occurring amino acid
  misc_feature (97)..(97): Xaa can be any naturally occurring amino acid
  misc_feature (118)..(118): Xaa can be any naturally occurring amino acid
  misc_feature (247)..(247): Xaa can be any naturally occurring amino acid
  misc_feature (258)..(258): Xaa can be any naturally occurring amino acid
MHPTRPELSHMVDLQAAALVISSGRPGRWAGFTLNIIDTPGLIEGGYINEQAVVFIGGFLLEKTYXDSLLYVDSLGYNIGMDTLDGPGIKXAITNSXGRAIWRRTLVVLTQPQLSPPXDGIDYYNDFLARRSESLLRYIRSGAGIGKREYADFPLPIALAENSGRCKTNENGAKILPDGTPWIPNLMKEITIVVSNGSQSIHVDQKLIDGPNPNNRWKKYIPLIPCRAVLFCVVKGIRGAIHSDISXNGKLDDWEHRXRDLVGTGNPGDQKVAASRNP

SEQ ID NO: 22042 - protein, 214 aa, Triticum aestivum
  misc_feature (151)..(151): Xaa can be any naturally occurring amino acid
MDITINSLTYKGSIPDAINQSRREKKLFVIYISGQDETSSSLEQSTLVDEHVAAVISRCCIFLQLKQGDVDALQFSAIYPQKSVPSISVVGLSGAMLWNHEGYISPEELKESIDKAWAALQLQETAATLLAASLASRMSEPANTASTTMPXEDGSSTSENHSNSSGQSSESSAVRGFANSTALVAQPPSSTSNAELLKTSKIPKSESAPCNING

SEQ ID NO: 22043 - protein, 249 aa, Arabidopsis thaliana
MKKIELGHHSEAAKPDCIKALIVEFITTFLFVFAGVGSAMATDSLVGNTLVGLFAVAVAHAFVVAVMISAGHISGGHLNPAVTLGLLLGGHISVFRAFLYWIDQLLASSAACFLLSYLTGGMGTPVHTLASGVSYTQGIIWEIILTFSLLFTVYATIVDPKKGSLDGFGPLLTGFVVGANILAGGAFSGASMNPARSFGPALVSGNWTDHWVYWVGPLIGGGLAGFIYENVLIDRPHVPVADDEQPLLN

SEQ ID NO: 22044 - protein, 134 aa, Staphylococcus aureus
HETDEEINKKAHAIFKHGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGA

SEQ ID NO: 22045 - protein, 531 aa, Shewanella sp. ANA-3
MIKDFILPDIGEGVVECELVEWLVQEGDTIAEDQPIADVMTDKALVQIPAPFAGVVTKLYYTKGDIAKVHAPLYAVQIESDEAAPVAASQPEAHTATQTPASQSSAAGTSVEEFLLPDIGEGIVECELVEWLVQEGDTVVEDQPIADVMTDKALVQIPAIKAGKIVKLHYRKGQLAKVHAPLFAIEVEGGVSAPVSHAQEASATAVNTAAPVACAAVSSEPARQGKALASPAVRRMARALDIDLSRVPGSGKHGRVYKEDITRFQAQGGAVPAAAPVAAAPTVAQSTVSTAVASAARGDIVEPIRGVKAVMAKMMVESVSTIPHFTYCEEFDLTDLVALRESMKAKYSSDEVKLTMMPFFMKAMSLALTQFPVLNSQVNADCTEITYKARHNIGMAVDSKVGLLVPNVKDVQDKSILEVAAEITRLTNAARSGRVAPADLKEGTISISNIGALGGTVATPIINKPEVAIVALGKLQTLPRFNAKGEVEARQIMQVSWSGDHRVIDGGTIARFCNLWKQYLEQPQDMLLAMR

SEQ ID NO: 22046 - protein, 173 aa, Pyrococcus furiosus DSM 3638
MPVYEINGIKPKIHPTAYVDENAVIIGDVVLEEKTSVWPSAVLRGDIERIYVGKYSNIQDNVSIHTSHGYPTEIGEYVTIGHNAVVHGAKIGNYVIIGMGAIILDGAKIGNHVIIGAGALVPPNKEIPDYSLVIGVPGKVVRQLSEEEIEWTKKNAEVYVELAEKHMKGRKKI

SEQ ID NO: 22047 - protein, 134 aa, Staphylococcus aureus
HETDEEINKKAHAIFKHGMTPIICVGETDEERESGKANDVVGEQVKKAVAGLSEDQLKSVVIAYEPIWAIGTGKSSTSEDTNEMCAFVRQTIADLSSKEVSEATRIQYGGSVKPNNIKEYMAQTDIDGALVGGA

SEQ ID NO: 22048 - protein, 351 aa, Thermus thermophilus HB8
MRPPLIERYRNLLPVSEKTPVISLLEGSTPLIPLKGPEEARKKGIRLYAKYEGLNPTGSFKDRGMTLAVSKAVEGGAQAVACASTGNTAASAAAYAARAGILAIVVLPAGYVALGKVAQSLVHGARIVQVEGNFDDALRLTQKLTEAFPVALVNSVNPHRLEGQKTLAFEVVDELGDAPHYHALPVGNAGNITAHWMGYKAYHALGKAKRLPRMLGFQAAGAAPLVLGRPVERPETLATAIRIGNPASWQGAVRAKEESGGVIEAVTDEEILFAYRYLAREEGIFCEPASAAAMAGVFKLLREGRLEPESTVVLTLTGHGLKDPATAERVAELPPPVPARLEAVAAAAGLL

SEQ ID NO: 22049 - protein, 470 aa, Photobacterium sp. SKA34
MSQNVYQFIDVERIDPPKKPLNIRKIEFVEIYEPFTKQQAGAQADRCLDCGNPYCEWKCPVHNYIPQWLKLANEGRIIEAVELSHQTNTLPEVCGRVCPQDRLCEGSCTLNEDFGAVTIGNVEKYITDKAFEMGWKPDMSGVEWTDKKVAIIGAGPAGLSCADILVRNGVKPVVFDRYPEIGGLLTFGIPSFKLEKDVMVNRRKIFTEMGVEFQLNTEIGKDVTMESLLSDYDAVFLGVGTYKNMRAGLENEEATGVYDALPFLISNTYKVMELESPSTFLDMKDQRVVVLGGGDTAMDCVRTSIRQGAKNVVCAYRRDEANMPGSKREVKNAREEGVNFMFNLQPLGIEVDNSGKVTGVKVVKTALGEPDNAGRRRPEPVAGSEHVLGADAVIMAFGFQPHAMPWLTPYDVELDQWGRIKTSFDAHCAYQTTNPKIFAGGDAVRGSDLVVTAIDEGRKAADGILDYLNV

SEQ ID NO: 22050 - protein, 420 aa, Pyrococcus furiosus DSM 3638
MVEQDPYEIVIKQLERAAQYMEISEEALEFLKRPQRIVEVTIPVEMDDGSVKVFTGFRVQHNWARGPTKGGIRWHPEETLSTVKALAAWMTWKTAVMDLPYGGGKGGIIVDPKKLSDREKERLARGYIRAIYDVISPYEDIPAPDVYTNPQIMAWMMDEYETISRRKTPAFGIITGKPLSIGGSLGRIEATARGASYTIREAAKVLGWDTLKGKTIAIQGYGNAGYYLAKIMSEDFGMKVVAVSDSKGGIYNPDGLNADEVLKWKNEHGSVKDFPGATNITNEELLELEVDVLAPAAIEEVITKKNADNIKAKIVAEVANGPVTPEADEILFEKGILQIPDFLCNAGGVTVSYFEWVQNITGYYWTIEEVRERLDKKMTKAFYDVYNIAKEKNIHMRDAAYVVAVQRVYQAMLDRGWVKH

SEQ ID NO: 22051 - protein, 125 aa, Glycine max
ACSMISSPSVTTVNRACAGMFAPFTGLNSIAGFPIMNTNTDITSIASNGGRVQCMQVWPPVCKKKCETLSYLPDLDDAQSAYEVQHHLMNGWITCLECQLEHCFVYRVHYMSPVYYDGLYWTIWN

SEQ ID NO: 22052 - protein, 427 aa, Pyrococcus furiosus DSM 3638
MEAATWILFTLGVSLILAKIGDSLVERFELPGVLGELLVGIILGNLVYFGVISSEYLPITAGSSEVIDFMAKLGVVFLLFLGALDTDLNLIKRTGITAVVSTILGVFVPLILGYLGLRWLGYDNKEAFAGGVLLTATSIGLTVRVMMDLGVLRSEVGAASLSASVIDDFLGIALIIFAVGSGSLLGLGIKIIIFFLITGVVGWYFIDHYLKFAERLGVEKGVLGFVLGMMLIFSALAEGWFAAAIEGAFMMGLILSKTAEGKRLLEEVRSIGYGFLIPIFFVHTGAMLNFKVFENLEAIKLAVVLSVIAIVGKVAGRGFGAWITAWGRGKDFLFTRENFRMSFQMGIGSIPRTEVALVALMVAIHGGAISPDDAPKFIAATLIFITISVLITPPLLKWAFREEILAQKKLLLENRKEKIESKKRGTR

SEQ ID NO: 22053 - protein, 189 aa, Glycine max
  misc_feature (21)..(21): Xaa can be any naturally occurring amino acid
  misc_feature (66)..(66): Xaa can be any naturally occurring amino acid
  misc_feature (96)..(96): Xaa can be any naturally occurring amino acid
  misc_feature (107)..(107): Xaa can be any naturally occurring amino acid
  misc_feature (117)..(117): Xaa can be any naturally occurring amino acid
  misc_feature (120)..(120): Xaa can be any naturally occurring amino acid
  misc_feature (185)..(185): Xaa can be any naturally occurring amino acid
MGRNLFIRGDWKCYGTTEEEXKLVLLKMNLRNLDKHVLVICGEHCLSDTSLSKKALLPDIHVSAHXLKSQQSGAYTVEVFAETLVPLPITWIIIGXHSQQRPFLNEXNEFVGDKGAXALXQGREAIACIAETLKQREAGTTTAGDPDQTHAIATKIIYCDNVILIYDPDGSIRTGKAATNAPAQXVHAD

SEQ ID NO: 22054 - protein, 157 aa, Pyrococcus horikoshii
MSETERTLVIIKPDAVVRGLIGEIISRFEKKGLKIVGMKMIWIDRELAEKHYEEHREKPFFKALIDYITKTPVVVMVLEGRYAVEVVRKMAGATDPKDAAPGTIRGDFGLEVSDAICNVIHASDSKESAEREISLFFKPEELFEYPRAADWFYKKGI

SEQ ID NO: 22055 - protein, 139 aa, Oryza sativa Indica Group
LVLYSVGIYTDDELKAMVERMESSKLRTVDLTDNDLAKDHLRYFIGGRSEVTDELVYRFIFPERPGALMKFLDAFSPCWNISLFHYRAQGETGANVLVGIQVPPEEFDEFKSRADNLGYEYMSELNNEIYRLLLRDPKI

SEQ ID NO: 22056 - protein, 445 aa, Cryptococcus neoformans var. neoformans JEC21
MSFQSVRASQIFDSRGNPTVEVVVETLQGRFVAGVPSGASTGSHEAVELRDKGDAYGGKGVSKAVKAVNEVLGPALIQSGIKASEQAKIDQLLIQLDGTDNKSKYGANAILGISMAAARAGAAEKGLELFEHLADLTFPQRDKAKPYVLPVPCTNQLNGGVHAGNQLAPQEFMVLPTGATSFEEAMRIVTECYHSLKSVITEKFGLAGTGIGDEGGFAPPVDSIDQALDLLVEASAKAGHSNNVHFAIDPASSEFFKDGVYDLDFKSTDQLETHRCLSPDQMASLYNDLISKYPLILLEDPFAEDDWDSWTKFMEKINGRIEVVGDDLLCTQVSRVKMAKKASACDGLLLKINQCGTISEAIEAAQTAYSYGWSVFVSHRSGETIDDFIGDIVVGLQTGHIKSGAPCRGERLAKYNRLLQIERLLKERGHPVRYAGVDFRRAATW

SEQ ID NO: 22057 - protein, 277 aa, Triticum aestivum
  misc_feature (27)..(27): Xaa can be any naturally occurring amino acid
  misc_feature (40)..(40): Xaa can be any naturally occurring amino acid
  misc_feature (58)..(58): Xaa can be any naturally occurring amino acid
  misc_feature (67)..(67): Xaa can be any naturally occurring amino acid
  misc_feature (80)..(80): Xaa can be any naturally occurring amino acid
  misc_feature (110)..(110): Xaa can be any naturally occurring amino acid
  misc_feature (134)..(134): Xaa can be any naturally occurring amino acid
  misc_feature (254)..(254): Xaa can be any naturally occurring amino acid
GRISKLFFWPKRRNFFCLQKPKEIPWXSPGAENIFRSTRXFTDKDKAAAHIKGGAKKXVIISAPSKXAPMFVCGVNEKGXQSEIDNVSHPSGTTNCLAPLGKVINDRFGXIVEGLMTTVHAMTATQKTVDGPSXSKDWRGGRAASFNIIPSSTGAAKAVAKVLPELNGKLTGMAFRVPTVDVSVVDLTVRLAKPATYDQIKAAIKEESEGNLKGILGYVDEDLVSTDFQGDNRSSIFDAKAGIALNDNFVKLVXWYDNEWGYSTRVVDLIRHMHSSK

SEQ ID NO: 22058 - protein, 306 aa, Francisella tularensis subsp. holarctica
MLSFQKLLRGDQIIKDDLFKLFHQADIYKNKLANSEPIKDLEGKILASLFFEPSTRTRFSFESAMNRLGGKVISLENGSSSSTQKGETLDDTGRIIDQYADIIVMRHPKPHSVEEFSKYVNSPVINAGDGENEHPTQSLVDLYTIYFEKGSLDNLKVGFLGDLKYGRTVHSLTNILAKYNASFKFISSKELQIPKKLKDFIIKNGNSFIELDKVSADVLEDLDVLYVTRVQRERFPDEESYLKNKDLCYLDRKHISPRSNFIILHPLPRVDEMDRSIDELECAKYFEQIKYSIPIRMALLALLVIS

SEQ ID NO: 22059 - protein, 517 aa, Zea mays
MSGGSSESSPLSGQNSLSSLSISKDNELSSESGCLSIVVLGASGDLAKKKTFPALFHLFQQGFLQSGEVHIFGYARSNLSDDGLRERIRGYLKGASDEHLSQFLQLVKYVSGSYDRVEGFELLNKAISEYETSKNNDSGSYRRLFYLALPPSVYPSVCKMIRSYCMSPSSHTGWTRVIVEKPFGKDLNTAEELSAELGQLFQEEQLYRIDHYLGKELVQNLLVLRFANRLFLPLWNRDNIANVQIVFKEDFGTEGRGGYFDQYGIIRDIIQNHLLQVFCLVAMEKPVSLKPEHIRDEKVKVLQSVEPIKHEEVVIGQYDGYKDDPTVPDDSNTPTFASVVLRVHNERWEGVPFILKAGKALNSRKAEIRVQFKDAPGDIFRCKKQGRNEFVIRLQPSEAMYMKLTVKKPGLEMATEQSELDLSYGMRYNGVKIPEAYERLILDTIRGDQQHFVRRDELRAAWEIFTPLLHDIDGGKLRSVPYKPGTRGPQEADELSRRMGYVQTHGYVWVPPTLSKV

SEQ ID NO: 22060 - protein, 488 aa, Photobacterium sp. SKA34
MGKPTGFLEFGRELPNKMDPSVRIQDNKEFVLNDEFGDKINEQSSRCMDCGVPFCHNACPIGNIIPEFNDAVYRDSWEEAWNILSSTNNFPEFTGRVCPAPCESGCVLGINQDPITICNIEKTIVETAYREGYAKPKTPRSRTGKTIAIIGSGPAGLSAAEQLNSAGHTVTVFERDEKVGGLLRFGIPDFKLGMDIIDRKINLMAEAGVKFEVNAHIGVDINAKQLRQDFDVVLLTGGSTVPRNLPIPGRELHGVHFAMEFLGQNNRRANNMDLKTEEIHAQGKHVVVIGGGDTGSDCVGTSNRHGAASITQVEIMPVPPEKRPANQPWPSYPMIMKTSTSHEEGCDRYWNILTKEFISDDNGNVKGLRVADIVWQEAKPSERPGFDEVEGSERVIACDLAFLAMGFLHPEPTGVLAQLDIALDERGNVATEDFATNQAGVFAAGDMRTGQSLVVRCINEGRESARAVDAYLMGNTNLEAKADSLMLS

SEQ ID NO: 22061 - protein, 66 aa, Triticum aestivum
RGRGRGGHHVELGAREKALLEEDVALKRFKSYKNSVKRVSKIGNVLTLVVFAACSYEVVALATSTQ

SEQ ID NO: 22062 - protein, 211 aa, Mycobacterium avium subsp. paratuberculosis K-10
MNPQIQPQARYILPSFIEHSSFGIKESNPYNKLFEERIIFLGVQVDDASANDIMAQLLVLESLDPDRDITMYINSPGGGFTSLMAIYDTMQYVRADIQTVCLGQAASAAAVLLAAGTPGKRMALPNARVLIHQPSLQGVIQGQFSDLEIQAAEIERMRTLMETTLARHTGKDAATIRKDTDRDKILTAEEAKDYGIIDTVLEYRKLSAQTA

SEQ ID NO: 22063 - protein, 369 aa, Zea mays
MSSPWSPLSIEEDEEIQELGADEQQVGEQLRQGDGQQQELTAEARAQETVKKRARSVSSSSTNPSNSRKSEGKIKVEESAPGAATGVILSLRESLQDCKQSLASCQVELEAAKSEIEKWHSAFQSIPAVPSGTIPDPVSVVSYLSTLKSSEESLKEQLEKAKKREAAFIVTFAKREQEIAELKSAVRDLKTQLRPPSMQTRRLLLDPAIHEEFTRLKNLVEEKEKKIKELQDNVAAVNFTPSSKLGKMLMAKCRTLQEENEEIGTMASEGKIHELGMKIAVLKSQNNELRNQFDVLYKHMDGVTNDVERSNELVSILQEELEAKDLELTRLKEVLAQKGATQDAPVETSDDAGNGQEADSDTLQVKAES

SEQ ID NO: 22064 - protein, 639 aa, Clostridium difficile 630
MNLMTLENISKSYSEKKLLENISLGINEGEKIGLIGVNGTGKSTLLKIIAGVEESETGNITKTNGIRIEYLPQNPTYNENSTVLEQVFNGTSEELKLLGEYQEILEKLNSNFTEELNKKLLSVHEKIDALNLWDLESEAKSVLTKLGINDFNQKIAELSGGQRKRVSLASALITPCEFLILDEPTNHLDNDTIDWLEEYLNSRKGSLLMITHDRYFLDRVTNRIIELDKGRLFSYDGNYSIFLEKKMERLSLEASIEDKRQNLIRTELAWVRRGAQARSTKQKARLQRFDELINRDSFKPDENLDISVASSRLGNKIIEIHNIYKSFEENTVIDNLEYTLTRTDRIGIIGKNGMGKSTLINILNGEIEPDSGYISIGETVKIGCFSQDDSHMNIDMRAIDYVKEASDYIETSDGTRITASQMCERFLFNGTMQYTLIGKLSGGERRRLHLLKILMTAPNVLLLDEPTNDLDIETLKILEEYLDEFKGVVVTVSHDRYFLDRICNKIFAYEGNGKIHIYTGNYSDYLIYREIQGIEFEESKKESVKKDDSTTLKKEKPKNDKKLKFSYNEQREFENIDSDIEKLESKIATLDESTAKFSTDFTKLQEILDEKSKLEKELEYKYERWEYLNNLADEIANNK

SEQ ID NO: 22065 - protein, 134 aa, Staphylococcus aureus
HETDEEINKKAHAIFKHGMTPIICVGETDEERESGKANDVVGEQVKKAVAGLSENQLKSVVIAYEPIWAIGTGKSSTSEDANEMCAFVRQTIADLSSKEVSEATRIQYGGSVKPNNIKEYMAQTDIDGALVGGA

SEQ ID NO: 22066 - protein, 199 aa, Mycobacterium avium subsp. paratuberculosis K-10
MSDMRSPSQGLNLTDSVYERLLSERIIFLGSEVNDDVANRLCAQILLLAAEDPTKDISLYINSPGGSISAGMAIYDTMVLAPCDIATYAMGMAASMGEFLLAAGTKGKRYALPHARILMHQPLGGVTGSAADIAIQAEQFHVIKKEMFRLNAEFTGQSIERIEADSDRDRWFTAQEALEYGFVDHIITRAATITNGEAQ

SEQ ID NO: 22067 - protein, 394 aa, Staphylococcus aureus subsp. aureus MW2
MNSIIELTDYYSSNNYAPLKLVISKGKGVKVWDTDGKQYIDCISGFSVANQGHCHPTIVKAMTEQASKLSIISRVLYSDNLGKWEEKICHLAKKDKVLPLNSGTEAVEAAIKIARKWGSEVKGITDGQVEIIAMNNNFHGRTLGSLSLSNHDAYKAGFHPLLQGTTTVDFGDIEQLTQAISPNTAAIILEPIQGEGGVNIPPKGYIQAVRQLCDKHQILLIADEIQVGLGRTGKWFAMEWEQVVPDIYILGKALGGGLYPVSAVLANNDVMRVLTPGTHGSTFGGNPLAIAISTAALDVLKDEQLVERSERLGSFLLKALLQLKHPSIKEIRGRGLFIGIELNTDAAPFVDQLIQRGILCKDTHRTIIRLSPPLVIDKEEIHQIVAAFQDVFKN

SEQ ID NO: 22068 - protein, 310 aa, Nicotiana benthamiana
MKVLVVTRSGKELIKGGLELTDSATVTDLQEAIHKRTRKYYPSRQRLTLPVQPGSKERPTVLHYKKSLNEYTNGSTSELTVVFKDLGPQVKYSTLFFWEYLGPLVLYPIIYYFPVYKFFGYKEERVIHPVQTYAMYYWCFHYFKRIMETFFVHRFSHATSPLSNVFRNCAYYWSFGAFIAYYVNHPLYTPVSDLQMKIGFGFGLVCQVANFYCHLLLRNLRSPSGNGGYQIPYGFLFNIVTCANYTTEIYQWLGFNIATQTVAGYVFMVVAASIMTNWALGKHRRLRKLFDGKEGRPKYPRRWVILPPFL

SEQ ID NO: 22069 - protein, 134 aa, Staphylococcus aureus
HETDEEINKKAHAIFKHGMTPIICVGETDEERESGKANDVVGEQVKKAVAGLSVDQLKSVVIAYEPIWAIGTGKSSTSEDANEMCAFVRQTIADLSSKEVSEATRIQYGGSVKPNNIKEYMAQTDIDGALVGGA

SEQ ID NO: 22070 - protein, 134 aa, Staphylococcus aureus
HETDEEINKKAHAIFKHGMTPIICVGETDEERESGKANDVVGEQVKKAVAGLSEDQLKSVIIAYEPIWAIGTGKSSTSEDANEMCAFVRQTIADLSSKEVSEVTRIQYGGSVKPNNIKEYMAQTDIDGALVGGA

SEQ ID NO: 22071 - protein, 404 aa, Shewanella sp. ANA-3
MRPIIKSNKLDTVCYDIRGPVHKEARRLEDEGHRILKLNIGNPAPFGFEAPEEIVRDVILNLPSAQGYCESKGLFSARKAIVQHYQAQGIKGVDIEDVYIGNGVSELIMMAMQGLLNTDDEVLLPSPDYPLWTAAANLAGGKAVHYRCDEEADWFPDLDDIKSKISSRTRGIVLINPNNPTGAVYSKELLLQVIELCREHNLILFADEIYDKILYDEAKHIPAASLSDDILTVTFNGLSKAYRAAGFRVGWMMLSGNLKAAKSYIEGLEMLSSMRLCANVPNQHAIQTALGGYQSINELILPSGRLTVQRDTCYELLNQIPGVSVKKPKGALYAFPKLDMKKFNLRDDERLVLDLLRDKKILLVHGSAFNWPEPDHLRVVFLPYKEDLTKALTEFGNFLETYKQ

SEQ ID NO: 22072 - protein, 372 aa, Cuphea lanceolata
MAPSELNCTHQNQHSSGYDGPRSRVTVVGSGNWGSVAAKLIATNTLKLPSFHDEVRMWVFEETLPSGEKLTDVINQTNENVKYLPGIKLGRNVVADPDLENAVKDANMLVFVTPHQFMEGICKRLEGKIQEGAQALSLIKGMEVKMEGPCMISSLISDLLGINCCVLMGANIANEIAVEKFSEATVGFRENRDIAEKWVQLFSTPYFMVSAVEDVEGVELCGTLKNIVAIAAGFVDGLEMGNNTKAAIMRIGLREMKAFSKLLFPSVKDTTFFESCGVADLITTCLGGRNRKVAEAFAKNGGKRSFDDLEAEMLRGQKLQGVSTAKEVYEVLGHRGWLELFPLFSTVHEISTGRLPPSAIVEYSEQKTIFSW

SEQ ID NO: 22073 - protein, 392 aa, Ganoderma sp. kk-02
MSLIRPYCDGLRGPLVVYDPHDPLAHMYDVDDDSTVITLTEWYWTASHLGTRFPAGLANSRDNGLGRTTATSNAELAVVNVIKANGTYRFRLVSMACDPSFNFSIDGHDLTVIEADGVETQPVTVNSINIFAAQRYSFVLTANQTIDNYWIRANPSLGVMGFDAGINSAILRYDGAAPVEPVTSPQSTQILLNETDRPPSLRPEEDAWKPEKGGVDLPLNMAFGFDGTDFFINNATFVPPTVPVLLQILSGTQAAQDLLPAGSVYTLPKNASIEITFPANANAAGSPHPFHLHGHTFAVIRSAGSTAYNYDNPVWRDTVSTGFATNNDNVTIRFQTDNAGPWFLHCHIDFHLNAGFAVVLAEDVPDIARANPVPQAWKNLCPTYDALSPNDQ

SEQ ID NO: 22074 - protein, 442 aa, Bacillus subtilis subsp. subtilis str. 168
MAFEFKLPDIGEGIHEGEIVKWFVKPNDEVDEDDVLAEVQNDKAVVEIPSPVKGKVLELKVEEGTVATVGQTIITFDAPGYEDLQFKGSDESDDAKTEAQVQSTAEAGQDVAKEEQAQEPAKATGAGQQDQAEVDPNKRVIAMPSVRKYAREKGVDIRKVTGSGNNGRVVKEDIDSFVNGGAQEAAPQETAAPQETAAKPAAAPAPEGEFPETREKMSGIRKAIAKAMVNSKHTAPHVTLMDEVDVTNLVAHRKQFKQVAADQGIKLTYLPYVVKALTSALKKFPVLNTSIDDKTDEVIQKHYFNIGIAADTEKGLLVPVVKNADRKSVFEISDEINGLATKAREGKLAPAEMKGASCTITNIGSAGGQWFTPVINHPEVAILGIGRIAEKAIVRDGEIVAAPVLALSLSFDHRMIDGATAQNALNHIKRLLNDPQLILMEA

SEQ ID NO: 22075 - protein, 502 aa, Lactococcus lactis subsp. lactis Il1403
MNKRVKIVSTLGPAVEIRGGKKFGESGYWGESLDVEASAKNIAALIEEGANVFRFNFSHGDHPEQGARMATVHRAEEIAGHKVGFLLDTKGPEMRTELFADGADAISVVTGDKFRVATKQGLKSTPELIALNVAGGLDIFDDVEIGQTILIDDGKLGLSLTGKDAATREFEVEAQNDGVIGKQKGVNIPNTKIPFPALAERDDADIRFGLSQPGGINFIAISFVRTANDVKEVRRICEETGNPHVQLLAKIENQQGIENLDEIIEAADGIMIARGDMGIEVPFEMVPVYQKLIISKVNKAGKIVVTATNMLESMTYNPRATRSEISDVFNAVIDGTDATMLSGESANGKYPRESVRTMATVNKNAQTMLKEYGRLHPERYDKSTVTEVVAASVKNAAEAMDIKLIVALTESGNTARLISKHRPNADILAITFDEKVERGLMINWGVIPTMTEKPSSTDDMFEVAEKVALASGLVESGDNIIIVAGVPVGTGRTNTMRIRTVK

SEQ ID NO: 22076 - protein, 453 aa, Bacillus halodurans C-125
MPTNTMPTGPKGNPVLGNTIEFGKDPLQFITRCSQEYGEIVRLRFERERDTFLLNDPKHIQYVFMNKGGEFSKGYQQDPIMGLVFGNGLLTSEGSFWLRQRRLSQPAFHPKRIADYADTMVGYCERMLNTWMDNDTRDINDEMMQLTMAIATKTLFDLDLHKGDTQEASRSLDTVMTAFNEQMTNVFRHVLHLIGLGKLVPPVSRELREAVESLDKMIYSIIEERRKHPGDRGDLLSMLISTYDEDDGSYMTDRQLRDEIITLFLAGHETTANTLSWAFYLLSQHPHVEEKLYQEVSQVLGNRPATLEDMPKLSYAEHVIKETLRVQPTVWLISRRAEKDVTLGDYHISAGSEIMISQWGMHRNPRYFNDPLTFLPERWDNNDNKPSKYVYFPFGGGPRVCIGERFALMEATLIMATIVREFRMELVDELPIKMEPSITLRPKHGVTMKLRKR

SEQ ID NO: 22077 - protein, 470 aa, Bacillus subtilis subsp. subtilis str. 168
MVVGDFPIETDTLVIGAGPGGYVAAIRAAQLGQKVTVVEKATLGGVCLNVGCIPSKALINAGHRYENAKHSDDMGITAENVTVDFTKVQEWKASVVNKLTGGVAGLLKGNKVDVVKGEAYFVDSNSVRVMDENSAQTYTFKNAIIATGSRPIELPNFKYSERVLNSTGALALKEIPKKLVVIGGGYIGTELGTAYANFGTELVILEGGDEILPGFEKQMSSLVTRRLKKKGNVEIHTNAMAKGVEERPDGVTVTFEVKGEEKTVDADYVLITVGRRPNTDELGLEQVGIEMTDRGIVKTDKQCRTNVPNIYAIGDIIEGPPLAHKASYEGKIAAEAIAGEPAEIDYLGIPAVVFSEPELASVGYTEAQAKEEGLDIVAAKFPFAANGRALSLNETDGFMKLITRKEDGLVIGAQIAGASASDMISELSLAIEGGMTAEDIAMTIHAHPTLGEITMEAAEVAIGSPIHIVK

SEQ ID NO: 22078 - protein, 625 aa, Haemophilus influenzae R2866
MTNNMNNYPLLSLINSPEDLRLLNKDQLPQLCQELRAYLLESVSQTSGHLASGLGTVELTVALHYVYKTPFDQLIWDVGHQAYPHKILTGRREQMSTIRQKDGIHPFPWREESEFDVLSVGHSSTSISAGLGIAVAAERENAGRKTVCVIGDGAITAGMAFEALNHAGALHTDMLVILNDNEMSISENVGALNNHLARIFSGSLYSTLRDGSKKILDKVPPIKNFMKKTEEHMKGVMFSPESTLFEELGFNYIGPVDGHNIDELVATLTNMRNLKGPQFLHIKTKKGKGYAPAEKDPIGFHGVPKFDPISGELPKNNSKPTYSKIFGDWLCEMAEKDAKIIGITPAMREGSGMVEFSQRFPKQYFDVAIAEQHAVTFATGLAIGGYKPVVAIYSTFLQRAYDQLIHDVAIQNLPVLFAIDRAGIVGADGATHQGAFDISFIRCIPNMIIMTPSDENECRQMLYTGYQCGKPAAVRYPRGNAVGVKLTPLEMLPIGKSRLIRKGQKIAILNFGTLLPSALELSEKLNATVVDMRFVKPIDIEMINVLAQTHDYLVTLEENAIQGGAGSAVAEVLNSSGKSTALLQLGLPDYFIPQATQQEALADLGLDTKGIEEKILNFIAKQGNL

SEQ ID NO: 22079 - protein, 542 aa, Salinibacter ruber DSM 13855
MVEFELLRSLGIMLLAALGVVLVARTARVPNIVAYIGAGLLLGPALGVLTVTHTIELIAEFGIILLLFLVGLELSLDKIKAVGTTAFVAGGVQMGGTALGGGLLAGLVGVPVVEAVVVAVAIMFSSTVVVVKMLEKQSDLDAPYGQIAVGVLLVQDLVVVMVLTFVAGLAGPGELAWADVARGLGQAFVGMVLLGGLIAAAARYVLPPAIQWISRMTEGLFIWSLFWCFLVVLGAEALHLSPELGAFLAGIALAQLPQCHELRQRVHPLMNFFIIVFFVSLGLQMELGAALARWPLALALAAFVMVVKPLLFFGVLPRLGHGEETSFRTGLSLAQISEFSLIFGALALSSGLIDEALLSVITLVGLVTFALSSFLLLYSDRLYAAVKPYRPLAWLGARQEAPAPPPDGLQGHVIVVGLNTLGRCLVDRLTAAGETVVAVDTDPEKLARRSVSTVHGNAVHETTREAADWEDAKLVVSSLSIEGTNNLLAYHAQRAGVPCSIHAFDRTSENSLRTFGVDHLIRSKHEGARRLLDELKSRAVLS

SEQ ID NO: 22080 - protein, 394 aa, Sulfitobacter sp. EE-36
MFETLQAQPADKILALMQMYKDDPRETKIDLGVGVYKDATGLTPVMRAVKAAEHQLWEAQTSKAYTGLAGDPAFGDAMVQMVLGDAVPRAQVAAAATPGGTGAIRQAFELIQMARPQARVFVSNPTWPNHLSILKYLGMEVAPYRYFDDETRGVDFDGMIADLKTAQKGDVVLLHGCCHNPTGANLNAAEWDAVIKVLQDTGATPMIDIAYQGFGDGLDADAAATRKVAAAVPECLIAASCSKNFGIYRERTGILMALSADTSAQKLNQGTLAFLNRQNFSFPPDHGARIVTTILNDDALRSDWMAELEDIRNTMLGLRSQLAGELQRLSGSDRFGFLAEHRGMFSRLGTSSDMVDKLREDHGIYMVGDSRMNIAGLNAETVPILAKAIIEVGI

SEQ ID NO: 22081 - protein, 557 aa, Neurospora crassa
MATMTDPGSTEVRPPPVFPTVNNYEQDEKKVAIPQVSPSEYSEQTQRPWVAGLRTWFGLRPNRHSPPPVYQPRPPPSSESASIGSKIWKFFKFLGPGAVISVAYVDPDNYQTAISAGAEFQYKLLFMVLVSNLIAIYIQSLCVKLGTVTGMDLAQMNRRWLPRWLDLSIYVVAEASIIATDLGQVIGTAIALNILIPKLPLPAACVISVVETLLVLLFYTDTGELRRVRIFEAFVSILVVVVFVTICIALSMVDHSTSTTREILRGYVPSREIFVDTGLYASCAILGGTLMPHALYVGTSLSRARLYDYDSKHDLPSPSPSFSPRQQSPSSSSETIGYRPSLRAIKSCLGYSIAELTFTLFTVAIFVNSALLVIAGSAFYSENPSEEGEEISEDLYALYSLFRDSIAPAAGIMFAISLLFSGISAGIVSTMSGQIIMEGALDIRLNPFLRRLITRCVAIIPALVIALAVGKDGLSKALVACNYLLAIALIPITFPIVWYTCCKKYMQVPADDDDTGTVDMKNSVVTAGVAWLLWLLVVVMDVATVVLVGLGITKDEG

SEQ ID NO: 22082 - protein, 187 aa, Zea mays
SARAPTRAEVADVSEAVRQRADALMLSGESAMGRYPDKALSVLRSVSLRIEKWWREEKRHEALELRSVSSSFSDKISEEICNSAAKMANGLGVDAVFVFTKTGHMASLLSRCRPDCPVFAFTTSTSVRRRLNLQWGLIPFRLAFSDDMESNLNRTFSLLKARGMIQSGDLVIALSDMLQSIQVMNVP

SEQ ID NO: 22083 - protein, 321 aa, Festuca rubra
MNSTSPRMILPVCSSPSTKTLNWLLSTPVKGARANRIRVQRGLPDPACVIIPHRTFALSQLPVHEFYGHGDAILDLSWSKNGDLLSASMDKTVRLWQVGRDSCLKVFSHTNYVTCVQFNPTNGNYFITGCIDGLVRIWDVRKCLVVDWANSKEIVTAVCYRPDGKGAVAGTITGNCRYYDASENRLELESQVSLNGRKKSLHKRIVGFQYCPSDPKKLMVTSGDAQVRILDGAHVISNYKGLQSSSQVARSFTPDGDHIVSASDDSRIYMWNYANQLAPLTSRVKSVWSSERFFSNDVSIAIPWNASQARNSISLSCNIPS

SEQ ID NO: 22084 - protein, 423 aa, Coprinopsis cinerea okayama7#130
MFAMLRGARPLARAVSAGQRRHLSIHEYQSMKLLNSYGIPTPKSVAAHTPEEAYQVAKNFGTDKLVIKAQVLAGGRGKGHFDTGLQGGVHMVDSAEQAKDFASKMIGSKLITKQTGAGGRICNAVMLAERRQPEHEYYVAVLNDRTTQGVVLVASAQGGMNIEEVAAKDPSAIITTPIDFEKGLSKPEAIAIAQKLGFKDEQTQSEAADIFINLYRIFKEKDATQIEINPMALTKDGAVLCMDAKFGFDDNAEFRQQEVFSLRDISQEEPSEVEAQKANLNFIKLDGSIGCLVNGAGLAMATMDVLALHGGNPANFLDVGGGATPETVKKAFEILLADPKVKSIFINIFGGIMRCDYIAEGVIKATKELGLNIPLVVRLKGTKEAEAKQMIKDSGLTIIPFDSLDEAAEKAVQLALYHRHFRL

SEQ ID NO: 22085 - protein, 424 aa, Chlamydophila abortus S26/3
MLEVVISDIQAREILDSRGYPTLYVKVITNTGTFGEACVPSGASTGIKEALELRDQDTSRYQGKGVLQALKNVKEVLLPVLQGVSIFDQILIDSIMVEADGTPNKEKLGANAILGVSLAAAKAAAATLGRSFYRYVGGCFAHILPCPMMNLINGGMHANNGLQFQEFMIRPIGAHSLQEAVRMGADVFHTLKNLLNDKHLATGVGDEGGFAPQLKSNSEALDLLVLAIEKAGFQPGEEISLALDCAASSFYDTKTETYAGKNSQEQVGILADLCDRYPIDSIEDGLAEEDFDGWELLTAELGENIQIVGDDLFVTNPELIAEGISKGLANAVLIKPNQIGTLTETSEAIQLAHSQGYTTILSHRSGETEDTTIADLAVAFNTGQIKTGSLSRSERIAKYNRLMAIEEELGSEGLFKDSNPFSGE

SEQ ID NO: 22086 - protein, 188 aa, Escherichia coli CFT073
MHDLPARKGSSARNIMLKSAPLRGHTRTRRKKMNIIEANVATPDARVAITIARFNNFINDSLLEGAIDALKRIGQVKDENITVVWVPGAYELPLAAGALAKTGKYDAVIALGTVIRGGTAHFEYVAGGASNGLAHVAQDSEIPVAFGVLTTESIEQAIERAGTKAGNKGAEAALTALEMINVLKAIKA

SEQ ID NO: 22087 - protein, 546 aa, Staphylococcus aureus subsp. aureus MW2
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEHAGKYVHHSLGEGTFDDYRKMFAHITVAQGYITPENATTEIPRLINTAIAERRPVHLHLPIDVAISEIEIPTPFEVTAAKDTDASTYIELLTSKLHQSKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLPSLLKQLSNISYTNNATFPAYHRPTSPDYTVGTEPLTQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQDTFNAINGHPDVMHFVEVKMSVEDAPKKLIDIAKAFSQQNK

SEQ ID NO: 22088 - protein, 134 aa, Staphylococcus aureus
HETDKEINKKAHAIFKHGMTPIICVGETDEERESGKANDVVGEQVKKAVAGLSENQLKSVVIAYEPIWAIGTGKSSTSEDANEMCAFVRQTIADLSSKEVSEATRIQYGGSVKPNNIKEYMAQTDIDGALVGGA

SEQ ID NO: 22089 - protein, 429 aa, Photobacterium sp. SKA34
MKLYNLKEHQEQVSFGQAVRQGLGRNQGLFFPSELPQFSDIDALLEMDFVTRSSKILSAFIGDELSEETVSQMIDSAFQFPAPINKVKDGVYALELFHGPTLAFKDFGGRFMAQSLAAVTSDSESDITILTATSGDTGAAVAHAFYGMDNIKVVILYPKGKISPLQEKLFCTLGKNITTVAVNGTFDDCQALVKQAFDDAELRKEVGLNSANSINISRLMAQICYYFEAVAQLPKAEREQLVISVPSGNFGNLTAGLLAKSLGLPVKRFIAATNENDTVPRYLQTGEWSPKVTVPTISNAMDVSQPNNWPRIEELCQLKGWGLSELGHGAVTDEQTAETLKQMDAEGYLCEPHGAIAYRILNEQLKDGETGLFLCTAHPAKFKEVVDEILDKDIPLPAPLAKHNAMELLSLERDNDFEAVKAVLRSVQS

SEQ ID NO: 22090 - protein, 320 aa, Trichodesmium erythraeum IMS101
MGLGILIDGKWISEREQEDAQGRFIRPQTTFRHQITADGSSGFKAEAGRYHLYISWACPWAHRTAIMRKLKGLEDAIGLSVVGAVIDQNSWEFTDEPGSIGDTLNHHSYLWQLYLQADSTYSGRVTVPVLWDKTEGKIVNNESREIIRMFDTQFSGIAKNDVNLCPDDLYNQIEETIDKIYQPINNGVYRAGFAGSQLAYDEGVKDLFAALDHWENVLSKQRYLCGDRLTEADICMFTTLVRFDPVYYVHFKCNLRHIWEYPNLGNYLKDIYQYPGVKETCNFDHIKRHYYMSHPKVNPTKIVPTGPEIDLDSPHNRASI

SEQ ID NO: 22091 - protein, 324 aa, Rhodopirellula baltica SH 1
MATDFRLKEQLPELTEQIVSTYTSDDSINHLGHCPLPSYTAVVDILLDLKDILYPGYKRHTNLHAGNIRYHVGGLIDSLHDQLTTQIARALRHEHRVLQNHKDCETDIDFEAKGQAMAIELLKRVVKLRHMLATDVQAAHDGDPACQTTDEVVFCYPGFEAITVYRIAHELVQLNVPFIPRMMTEWAHKETGIDIHPGATIGEYFFIDHGTGVVIGETCHIGKHVKLYQGVTLGALSFPTDADGQLIRGQKRHPTIEDEVVVYANATILGGRTVIGRESVIGSSVWITRSVSPGTTVVLEKPQLKVRGSDEPADELRPEVNYQI

SEQ ID NO: 22092 - protein, 122 aa, Thermotoga maritima MSB8
MSKKVLLVDDSAVLRKIVSFNLKKEGYEVIEAENGQIALEKLSEFTPDLIVLDIMMPVMDGFTVLKKLQEKEEWKRIPVIVLTAKGGEEDESLALSLGARKVMRKPFSPSQFIEEVKHLLNE

SEQ ID NO: 22093 - protein, 481 aa, Caulobacter crescentus CB15
MAERMLKFTTVARKTPEKRAAAERSGDFHEIYADFIDAKATEQASRCSQCGVPFCQTHCPLHNNIPDWLRMTAEGRLEEAYALSQATNSMPEVCGRICPQDRLCEGNCVIEQSGHGTVTIGSVERYLTDKAWEMGWVKPLAAGPARGQSVGIVGAGPAGLAAAEKLREAGYDVTVYDRHDRAGGLLIYGIPGFKLEKDVVERRTQRLADGGVVFKLGFEVGKDATLEDLRAQHDAVLIAVGVYAARDLTVPGGGSKGVVPALDYLITSNRLSLGDSVPAYDSGELNAEGKDVVVVGGGDTAMDCVRTAIRQGAKSVTCLYRRDKANMPGSMREVANAEEEGVTFEWLAAPRALSGEAEAVTGVRAIRMRLGAPDASGRQSPEEIPGGDFDRPAQLVVKALGFEPENLPEQWSAPDLKVTRWGTVKADVRNQMTNLDGVFAAGDIVRGASLVVWAIKDGRDAADAIHRYLLAKASSTLIAAE

SEQ ID NO: 22094 - protein, 134 aa, Staphylococcus aureus
HETDEEINKKAHAIFKYGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGA

SEQ ID NO: 22095 - protein, 463 aa, Glycine max
MASSVLSAASHSVSPSCSLSTTHKGKPMIRDNTLGFHRGPNSFSSSRSRGRISMAVAVNVSRFEGIPMAPPDPILGVSEAFKVDNSDVKLNLGVGAYRTEELQPYVLNVVKKAENLMLERGDNKEYLPIEGSAAFNKATAELLLGADNPAIKQQRVATVQGLSGTGSLRLGAALIERYFPGAKVLISAPTWGNHKNIFNDASVPWSEYRYYDPKTVGLDFEGMIEDIKSAPEGSFILLHGCAHNPTGIDPTPEQWEKIADVIQEKNHIPFFDVAYQGFASGSLDEDAASVRLFVARGMEVLVAQSYSKNLGLYAERIGAINVVSSSPESAARVKSQLKRIARPMYSNPPVHGARIVADVVGNPVLFNEWKAEMEMMAGRIKNVRQQLYDSITSKDKSGKDWSFILKQIGMFSFTGLNTNQSDNMTNKWHVYMTKDGRISLAGLSLAKCEYLADAIIDSYHNVS

SEQ ID NO: 22096 - protein, 279 aa, Triticum aestivum
  misc_feature (179)..(179): Xaa can be any naturally occurring amino acid
LYRTSLYKKAGWYRSGIPGIPPTRLSVPLLPLPWTTSRRAWGWPNPTRRRTARWPTGEASDDGRAVEVSGGVSEDTLPAVLRGFVDGVWPPGDSGDPLLRRLRAATCEAAQRLRDASRNSARDLLAWTKQGSGLRAILVISVGTITMISLTGLLIFMSFLLVATANAIIVSVLMSLGAXLGGFLALVFCLVGLQCMSEAESIGHISSIPATGYLCQLVGIQEWPPGWESDSFWKDLGLAPKGKKPWDPFPRPLKFGQGTNLLSWSDPLFPVSPRKGGGE

SEQ ID NO: 22097 - protein, 463 aa, Ostreococcus tauri
MPQPRLARVTAQRDAMDRTAVADVTPSGAFARKESTFRNSFDVHGPHPPERDRYVLVVSLACPWACRALSVLHLKGLENVFKVVVTHPVWARTRPEDANDAHCGWVFVKPGESIANPAGVGHFVADGRCSSSAPEDAKFVRDLYELCGAPKEQRFTVPLIWDTKARTIVNNESSEIIREMNTNFNAFSSSPERAALDLYPEALRERIDDINGWVYHRVNNGVYKCGFAVTQEAYDQAVKDLFEALDDINSILSESRYLCGDVFTEADVRLWQTLIRFDEVYVVYFKTNKKFIHQYEHISGYVRELWQMPELRAATNMDHIKTHYFASHPSLNAHAIIPIGPDVNLDAPHGLVTPSKRLTTSRLAARAHIATRYERKVVVLFKATGDAPILRRNVVKIRASAKFEEILAHLTKSTRCERAFAYLGAAFAPRYDATIGALCDGYGERNDEGGKLVVFYSTTPAWG

SEQ ID NO: 22098 - protein, 490 aa, Shewanella sp. ANA-3
MGKTTSGAKACDFVLFGTKGDLARRKLLPSLYQLDKAELLDKNTKVIGVAKDEFSQDEFRELVILALKTFVKEALCEETVQRFLSRCHYVGTNFTESAGYSAFHELLKPEERVMVSYFATPPAIFGDICRCLHEQNLIHSDSRVVLEKPIGSDLASSRVINDQVSAYFKENQVYRIDHYLGKETVQNLIALRFANSLFASKWDNRTIDHVQITVAEEVGIEGRWGYFDKAGQMRDMIQNHLLQVLTLVAMDPPVNLDADSIRDEKVKVLKSLRPINADNVYENTVRGQYSAGFLKGSPVPGYLEEEGANLQSHTETFVALRVDIDNWRWAGVPFYLRSGKRMPFKSSEIVVYFKNPPHNLYRSSYRNLPPNKLTIRLQPHEGVEIQMMNKVPGLEQKQRLQTTKLDLSFSDTFKNERIADAYERLLLEAMLGNQALFVRRDEVEQAWTWVDGIIQSWEQSNEKPKPYPAGTWGPVASVALITKDGRSWDE

SEQ ID NO: 22099 - protein, 479 aa, Shewanella sp. ANA-3
MFRRTKIVTTLGPATDRDDNLRRIIAAGANVVRLNFSHGSPEDHLKRATQAREIAKELGVHVAILGDLQGPKIRVSTFKDNKKVQLNLGQAYILDAELGKGEGDENQVGIDYKQLPDDVNVGDILMLDDGRVQLRVERVEGRKVHTTVTVAGPLSNNKGINKQGGGLSAAALTEKDKADILTAAMIQVDYLAVSFPRSGADLEYARSLAQQAGSNALIVAKVERAEAVASEEAMDDVILASDVVMVARGDLGVEIGDAALVAVQKKLIARSRQLNKIVITATQMMESMISSPMPTRAEVMDVANAVLDGTDAVMLSAETAAGDFPEETVKAMANVCIGAESHPSVKVSKHRLDARFTSVEETIALSTMYAANHLEGVKAIIALTESGATPKLMSRISSSLPILGLSRHETTLAKMALYRGVLPIYFDSTIYPADELAQKALESLTAAGYLQSGDLVLMTKGDAMETIGGTNTCKVLIVA

SEQ ID NO: 22100 - protein, 341 aa, Lactococcus lactis subsp. lactis Il1403
MNPQKIAVLGPGSWGTALSQVLNDNGHEVRIWGNNPEQMAEINEKHTNTRYFKDVVLDEKIKAFDRLDLALEDVDAILFVVPTKVTRLVAKQVAEVLKHKVHILHASKGLEQGTHERISTILEEEIPAQLRGEIVVVSGPSHAEETIVRDITLISAASKDHDEAKYAQAIFSNDYFRLYTNTDVIGVETAGALKNIIAVGAGALHGLGFGDNAKAAIITRGLAEITRLGVAMGAEPLTYSGLSGVGDLIVTGTSIHSRNWRAGDALGRGEKLADIEKNMGMVIEGVSTTKAAFELAQQLGIDMPITETIYKVLYENLDAKTGILDIMRRETRAENEFINNK

SEQ ID NO: 22101 - protein, 265 aa, Bacillus subtilis subsp. subtilis str. 168
MTNWTEIDEIAKKWIREAGARITQSMHESLTIETKSNPNDLVTNIDKETEKFFIDRIQETFPGHRILGEEGQGDKIHSLEGVVWIIDPIDGTMNFVHQQRNFAISIGIFENGEGKIGLIYDVVHDELYHAFSGRGAYMNETKLAPLKETVIEEAILAINATWVTENRRIDQSVLAPLVKRVRGTRSYGSAALELANVAAGRIDAYITMRLAPWDYAAGCVLLNEVGGTYTTIEGEPFTFLENHSVLAGNPSIHKTIFEEYLHARK

SEQ ID NO: 22102 - protein, 313 aa, Lactococcus lactis subsp. lactis Il1403
MKQNIIPTKARKVRKAVIPAAGLGTRFLPATKAIAKEMLPIVDKPTIQFIVEEALKSGIEDILIVTGKAKRPIEDHFDSNIELEQNLLEKGKTELLKLVEETTDINLHFIRQSHPKGLGHAVLQAKAFVGNEPFVVMLGDDLMNITGNETPLTKDLINDYEKTHASTIAVMKVPHDDVDKYGVIDPNGEVSKGLYNVERFVEKPNVDEAPSDLAIIGRYLLTPEIFDVLETQVPGAGNEIQLTDAIERLNKTQRVFAHEFTGKRYDVGDKLGFVETTIEYGLEHPQIGANLKNYIIEKAKELSQDDSKNITKK

SEQ ID NO: 22103 - protein, 353 aa, Haemophilus influenzae R2866
MKLSKTFLFITALCCAAPTLAIQNSTSSSGEQKMAMENTQNIREIYLAGGCFWGMEAYMERIHGVKDAISGYANGNTEKTSYQMIGLTDHAETVKVTYDANQISLDKLLKYYFKVIDPTSVNKQGNDRGRQYRTGIYYQDGADKAVIEQALAQLQTKYKKPVQVEVQPLKNYIVAEEYHQDYLKKNPNGYCHIDITKADEPVIDEKDYPKPSDAELKAKLTPLQYSVTQNKHTERSFSNEYWDNFQPGIYVDVTTGEPVFSSNDKFESGCGWPSFTKPIIKDVVHYETDNSFNMQRTEVLSRAGNAHLGHVFDDGPKDKGGLRYCINSASIKFIPLAEMEKAGYGYLIQSIKK

SEQ ID NO: 22104 - protein, 394 aa, Zea mays
  misc_feature (296)..(296): Xaa can be any naturally occurring amino acid
MMASTAPAASTAVAFGAAATPRGPASASAALCARVPAAAGGMRRSGVAVRCDAGADAQVRAVAKAASVAALEQFKISADRYMKERSSIAVIGLSVHTAPVEMREKLAGAEELWPRAIQELTSLNHIEEAAVLSTCNRMEIYVVALSWNRGIREVVDWMSKKSGIPASELREHLFMLRDSDATRHLFEVSAGLDSLVLGEGQILAQVKQVVRSGQNSGGLGKNIDRMFKDAITAGKRVRSETNISSGAVSVSSAAVELALMKLRKSEALSARMLLIGAGKMGKLVIKHLIAKGCKKXVVVVNRSAQRVDAIREEIKAIEIVYRPLSEMYEAAAEADVVFTSTASETPLFTKEHADALPTVSDAMGGVRLFVDISVPRNVSACVSEIGSARVYNVD

SEQ ID NO: 22105 - protein, 436 aa, Pseudomonas putida GB-1
MLKVNAFQPEQAAALDAAERRLIERRQRLLGPAYQLFYDNPLHLVRGAGTWLYDTAGRAYLDLYNNVASVGHSHPRVVEALAGQAAALNTHTRYLHEGVLDYAEKLLATMPAQLGNVMFTCTGSEANDLALRIARDYTGGTGVIVTRYAYHGMTAAIAELSPSVGDYVPLGRDIRVVDAPLHLPHAPHQVGQQFAAQVRAALADMQRHGIRPAALLVDTLFTSDGVFADPAGFLVEAVEAVRAAGGLFIADEVQPGFGRTGTHMWGFQRHGLVPDLVTMGKPMGNGHPLAGLTVRPEILERFGRNASYFNTFGGNPVSAAVGLAVLQVIEDEGLQENARQVGGQLKEGLEGLAREHACLGQVRGAGLFIGADVVAPSGAADGATARRIVNLLREEGMLIGVSGADNNALKIRPQLCFSAQNVEQFLSALQRVLHQL

SEQ ID NO: 22106 - protein, 442 aa, Arabidopsis thaliana
MAAILSVDFQNCFIFIVLCLFSLFCYSLFFKKPKHPRGCDLPPSPPSLPIIGHLHLLFSPLTHKSLQKLSSKYGHLLHLRIFNVPVILVSSASVAYEIFRAHDVNVSSRGVAAIDESLLFGSSGIITAPYGDYWKFMKKLIATKLLRPQSLESSRGIRGEELTRFYNSLLDKARMTESVEISTEAMKLVNNTLCRMSMGRSFSEENGEAEKIRGLVGESYALTKKMFLASLLRKPLKKLRISLFEKEIMGVSDRLDELLERILVEHEEKLHEEHQGTDMMDVLLAASGDENAEYNITRNHIKSFFVEIFIGATDTSVQTTQWTMAEILNHPNVLERLRKDIDSVVGKTRLIHETDLPNLPYLQAVVKEGLRLHPPGPLLVRTFQERCKIKGFYIPEKTTLVINAYAVMRDPDSWEDPDEFKPERFLRAPPMGGSLDKFIEFS

SEQ ID NO: 22107 - protein, 352 aa, Oenococcus oeni PSU-1
MGVALGPGILGWIEPNQFIKTFSEFGVVLLMFLAGLGSDLKGLKKFFKPSITIAFSGTIFPLIMTYFVARAFRFNFSQAAFLGVIFSATSVSITVEILREMNLLASNEGITILGSSVADDIISVFVLSLLISFTGSQSNENAMNIVYKILGLVAYFVFAFVVIHWLINYIMFYTKKLFSPMSETVVSIVLCFSMASLSELCGLSDVIGAFFAGLAISTTDSKSEIVKNINPIGYAVFIPFFFVSIGLNVSFEGFTNDFLLILSLTVIGILSKIIGAGFASKFCGFDYPHSYLIGSGMVARGEMALIVAQIGFSANLLTAGRYTAVIMAIILVTLSAPFLVKHAAGRLTKQAS

SEQ ID NO: 22108 - protein, 97 aa, Cyanidioschyzon merolae strain 10D
MYKIQLVNQKEGIDVTIQCAGDQYILDAAEEQGVDLPYSCRAGACSTCAGKLVKGSVDQSDQSFLDEDQISKGFILTCVAYPTSDCVIQTHQEEALY

SEQ ID NO: 22109 - protein, 439 aa, Salmonella enterica subsp. enterica serovar Typhi str. CT18
MSKPKSNKMGVVQLTILTMVNMMGSGIIMLPTKLSEVGTISIISWLVTAVGSMALAWAFAKCGMFSRKSGGMGGYAEYAFGKSGNFMANYTYGVSLLIANVAIAISAVGYGTELFGAALTPLQIGLATIAVLWVCTIANFGGARITGQISSVTVWGVIIPVVGLCIIGWFWFSPSMYVASWNPHHVPFFSAVGSSIAMTLWAFLGLESACANADVVENPEKNVPIAVLGGTLGAAVIYIVSTNVIAGIVPNMDLANSTAPFGLAFAQMFTPAVGKVIMALMVMSCCGSLLGWQFTIAQVFKSSADEGYFPKVFSRVTKVDAPVQGVLIIVIIQTGLSLMTISPSLNSQFNVLVNLAVVTNIIPYILSMAALVIIQKMANVPSSKAKVANFVAFVGAMYSFYALYSSGEEAMLYGSIVTFLGWTLYGLVSPRFELKNKHG

SEQ ID NO: 22110 - protein, 455 aa, Prochlorococcus marinus str. MIT 9215
MYSLLAELSAHDLEVAETLIGVIRFLLIFLAARALAEVLVRLSLPTIVGELLAGVVIGASGFHLLIPPSAGTELNEGLVNVISSLASIPPEAVPDVYFESFPSLQAVATLGLYALLFLTGLESELEELVAVGAQAFTVAMAGVILPFAFGTLGLMFIFQVDLIPAVFAGASMTATSIGITASVFGELGYLKTREGQIVIGAAVLDDILGIVILAVVVALAAGGSLEIAPIVKLVAAAVVFVIAAIALSRTAAPGFDWLLDRLKAPGAVVVASFVILVLCCFVATAIGLEAALGAFAAGLILSSSKNNHAIQQSVLPLVSLFATIFFVLVGAGMDLSVINPLDPTSRSALVVAGFLLVVAIIGKIAAGWVFSSDKPTNRLVVGLGMMPRGEVGLIFLGLGTSAKLLTPSLEAAILLMVIGTTFLAPVLLRIVLKDKPPNDGNKISDDVAADPVGLL

SEQ ID NO: 22111 - protein, 134 aa, Staphylococcus aureus
HETDEEINKKAHAIFKHGMTPIICVGETDEERESGKANDVVGEQVKKAVAGLSEEQLKSVVIAYEPIWAIGTGKSSTSEDANEMCAFVRQTIAGLSSKEVSEATRIQYGGSVKPNNIKEYMAQTDIDGALVGGA

SEQ ID NO: 22112 - protein, 196 aa, Chlamydophila abortus S26/3
MGSLFIGKTAPDFSVQAVVDGEVKNISLQDYRGKYVILFFYPKDFTYVCPTELHAFQDSLEEFENRGAQVIGCSVDDLDTHQRWLKTDKKAGGVKGITYPLISDTTHELSKLYNVLDSQSGLSFRGSFLIDKDGIIRHMVVNDLPLGRSIDEELRVLDALIFFENHGLVCPANWQQGQRAMAPNEEGLKEYFGTID

SEQ ID NO: 22113 - protein, 709 aa, Ostreococcus tauri
  misc_feature (709)..(709): Xaa can be any naturally occurring amino acid
MVDDGYDGTLDDSDVVRRAMGFLTDDEREGASDGEADADGFAFARDGRGGVDRSAVAGWATEGGRVNASVQFRLLCPVARIGRVIGKEGRVIKALRAETGARVKVAPTTRGADERVVLVASGEELMMDDGDGSDVPVTTAERALFRIFDTVASESGGALDGTRDGTSSESGSGVPESSSTGGERSMNGGRAVPICRLLVPRAQVGSLIGKGGAVISAIRASSGATVRLMPATMLPTCASRGDELLQITAPVRDTDGNDVDLALASVKSALRMVAKNLREYPTKMATSESFRSPLEAFMLGIKPGANADGDGGNGAGIAGGSSGGHMSTRMNLNGVYVPGGTEIMFRLLCPVSKTGSVIGRNGEVIQQIRSETGAKVKVCEQINNAEERIICVSSNDDGLAPMLAAQVALFRVYRCIVDSSGSDVPLPFRLLVQTSQIGCLIGKGGSIIRQIRNETGATVRVLPSDALPACANADDELLEIGQWPADACALGIRIVSGRLRGNMRHKAAERLNVESNVYSASMTPTMAVQDTPTLQQSELMMYGMTAYETEPVDTALASLSLSAPPVEIPGVTTVNSVHMTISSQHIGSVLGRGGCNISIARQVSGARIKLYPGASGRNGARRAQDSERLLEISGTSEQVSSAQTIIERFIASSGAMIPEFASLGIAGNSGAQVSGVPSAKAARETTRRCSSSRDRLFNHFNTHHPNERX

SEQ ID NO: 22114 - protein, 134 aa, Staphylococcus aureus
HETDEEINKKAHAIFKHGMTPIICVGETDEERESGKANDVVGEQVKKAVAGLSEDQLKSVIIAYEPIWAIGTGKSSTSEDANEMCAFVRQTIADLSSKEVSEATRIQYGGSVKPNNIKEYMAQTDIDGALVGGA

SEQ ID NO: 22115 - protein, 246 aa, Brassica napus
MPRRSDENEDKEDPVAIRDGSDEDEDEANEDLSLKILEKALSRRELDDSKDTSLSDLGGSGVVSTLMMVNGRDSKSHKKKTKRTILEDAHEIPIVLKDQDENIPKGEDEKSAEPTSSNMVLKKLLRGARYFDPPDAGWETCYSCGEPGHVTINCPTPIKRKKPCFICGSLEHGAKQCTKGHDCYICIKGGHRARDCPDKYKSGSKSAVCLRCGDFGHDMILCKYDYSRDDLKDIQCYVCKSLWHLC

SEQ ID NO: 22116 - protein, 340 aa, Selaginella lepidophylla
MGSEAKIKIGINGFGRIGRLVARVVLERDDVELVAVNDPFISTEYMAYMFKYDSVHGKWKKADVEVKDHETLIFGGKPVGCFACKDPSEIPWGKFGAEFVVESTGVFTDRDKASAHLKAGAKKVVISAPSSNAPMFVMGVNENDYKPDIDIVSNASCTTNCLAPLSKVINDRFAIIEGLMTTVHSLTATQKTVDGPSSKDWRGGRGAGFNIIPSSTGAAKAVGKVLPALNGKLTGMAFRVPTADVSVVDLTVRLEKPASYEEIKKAVKEESEGKLKGIMGYTEDAVVSSDFIGDSRSSIFDAAAGIALNDSFVKLVSWYDNEWGYSNRVVDLIVHMAKTK

SEQ ID NO: 22117 - protein, 436 aa, Caulobacter crescentus CB15
MAAIYPVILCGGSGTRLWPASRSDHPKQFLKLVSDRSSFQETVLRVKDIPGVAEVVVVTGEAMVGFVSEQTAEIGAWATILVEPEARDSAPAVAAAAAYVEAQDPAGVVLMLAADHHIAQPEIFQQAALTATKAAEQGYIVTFGVQPTVPATGFGYIRPGAPLLDGSVREVAAFVEKPDQATAERYLLEGYLWNSGNFAFQAATLLGEFETFEPSVAAAAKACVAGLQLEAGIGRLDREAFAQAKKISLDYAIMERTQKAAVAPAAFAWSDLGAWDAIWEASTRDGDGNAQTGDVDLHGSSNVLVRSTGPYVGVIGVNDIVVVAEPDAVLVCHRKDSQAVKTLVDGLKAKGRSIASRKSASPNGTETLVSTDGFDVELRRVPAGETLMLPVSTLQVLEGVIEMDGDVYAAGAIIALDDSVQARAIGAATLLVTKPR

SEQ ID NO: 22118 - protein, 408 aa, Streptomyces avermitilis MA-4680
MSAATPPTERRVSARVGAISESATLAVDAKAKALKAAGRPVIGFGAGEPDFPTPDYIVQAAIEACSNPKYHRYTPAGGLPELKAAIAAKTLRDSGYEVDASQVLVTNGGKQAIYEAFAAILDPGDEVIVPAPYWTTYPESIRLAGGVPVDVVADETTGYRVSVEQLEAARTENTKVLLFVSPSNPTGAVYTREQIEEIGRWAAEKGLWVLTDEIYEHLVYGDAEFHSLPVVVPELADKCIVVNGVAKTYAMTGWRVGWVIGPKDVIKAATNLQSHATSNVSNVAQVAALAAVSGDLTAVAEMREAFDRRRKTIVRMLNEIGGVLCPEPEGAFYAYPSVKALLGKEIRGKRPQDTVELAALILEEAEVAVVPGEAFGTPGYLRLSYALGDEDLVEGVSRIQKLLSEAKD

SEQ ID NO: 22119 - protein, 138 aa, Zea mays
  misc_feature (11)..(11): Xaa can be any naturally occurring amino acid
MATVLSSPRSXAFSFSLRAAPAPTTVAMTRGGGASSRLRAQATYNVKLITPEGEVELQVPDDVYILDYAEEEGIDLPYSCRAGSCSSCAGKVVSGSLDQSDQSFLDDSQVADGWVLTCVAYPTSDVVIETHKEDDLIS

SEQ ID NO: 22120 - protein, 271 aa, Zea mays
MAAMTAYKYQAQALMRDYLLADPLVPYTSVLIGIVLCKMAYDFTRILSSFYFKGYTLLTKIQRIEWNNRGMSSAHAIFITAVSLYLVMSTDLFSDRVKGPITFRYSIISTSALGVSVGYFITDLAMIFWLYPSLGGMEYVLHHTVSLVAIAYTMLSGEGQFYTYMVLISETTTPEINLRWFLGWFLDTAGLKKSSAYLVNGILMFVAWLVARIFLFMYVFYHIYLHYGQIMQMHAFGYYLTFVVPSVLFVMNTMWFMKILKGVMKTLAKWP

SEQ ID NO: 22121 - protein, 490 aa, Saccharophagus degradans 2-40
MLEHLKFDNSFDKLGSDFATRVNPRPLVNPKLVCVDSKTCELLGISKDSVSSENGVNMFSGNRVPPQFAPLAMVYAGHQFGGYSSQLGDGRGLLLGELNTHSGKYDLHLKGAGKTPYSRFGDGYAVLRSCIREYLAGIAMRGLGIPTSHALCVVRGDNAVTRETIEPAATLTRVARSHIRFGSFEYFYYTQQHTQLEQLADYAVEQYIPEYVDKDGRFNALLHYTTEQTAKLIAAWQAVGFCHGVMNTDNMSIIGETLDYGPYGFMEAYNPTHICNHSDTYGRYAYDQQPSIGLWNLNALAAALSPLIDRDQARASLESYEGILTKEYNSRMTKKLGFLSAKQGDAKLINTMFIQLEQLQLDYTLFFRLLALAKADDLQSSFIQPLLGCDNIAKGEQLAAWAAEYLTRRQLEDVPQATITADMNHHNPIYCLRNYFAQQAIDEAYQQGTYSTLEKLAAVLAAPFTSHPNASEFETPPPSELANIAVSCSS

SEQ ID NO: 22122 - protein, 452 aa, Pseudomonas putida GB-1
MSEQNSQTQAWQALSRDHHLAPFSDVKQLAEKGPRIITSAKGVYLWDSEGNKILDGMAGLWCVAVGYGRDELAEVASQQMKQLPYYNLFFQTAHPPALELAKAIADVAPQGMNHVFFTGSGSEGNDTVLRMVRHYWALKGKKNKNVIIGRINGYHGSTVAGAALGGMSGMHQQGGVIPDIVHIPQPYWFGEGGDMTEADFGVWAAEQLEKKILEVGVDNVAAFIAEPIQGAGGVIIPPQTYWPKVKEILARYDILFVADEVICGFGRTGEWFGTDYYDLKPDLMTIAKGLTSGYIPMGGVIVRDEVAKVISEGGDFNHGFTYSGHPVAAAVGLENLRILRDEQIIQQVHDKTAPYLQQRLRELADHPLVGEVRGLGMLGAIELVKDKATRARYEGKGVGMICRQHCFDNGLIMRAVGDTMIIAPPLVISVEEIDELVQKARKCLDLTYEAVR

SEQ ID NO: 22123 - protein, 309 aa, Bacillus subtilis subsp. subtilis str. 168
MVCQHNDELEALVKKAKKVTDKGEVASYIPALAKADKHDLSVAIYYSNNVCLSAGDVEKTFTLQSISKVLSLALVLMEYGKDKVFSYVGQEPTGDPFNSIIKLETVNPSKPLNPMINAGALVVTSLIRGRTVKERLDYLLSFIRRLTNNQEITYCREVAESEYSTSMINRAMCYYMKQYGIFEDDVEAVMDLYTKQCAIEMNSLDLAKIGSVFALNGRHPETGEQVISKDVARICKTFMVTCGMYNASGEFAIKVGIPAKSGVSGGIMGISPYDFGIGIFGPALDEKGNSIAGVKLLEIMSEMYRLSIF

SEQ ID NO: 22124 - protein, 215 aa, Oryza sativa
  misc_feature (158)..(158): Xaa can be any naturally occurring amino acid
  misc_feature (169)..(169): Xaa can be any naturally occurring amino acid
MASSGFSWTLPDHPKLPKGKTVALVVLDGWGEANADKYNCIHVAQTPVMDSLKNGAPERWRLVKAHGTAVGLPSEDDMGNSEVGHNALGAGRIFAQGAKLVDLALASGKIYDGEGFNYIKECFDKGTLHLIGLLSDGGVHSRLDQVQLLLKGASERGXAKRIRVHLLTXDGREWFGLGSRVGFVEDLKVIFSASDTGVMPKLVRWWRCCSLAVLN

SEQ ID NO: 22125 - protein, 197 aa, Staphylococcus epidermidis ATCC 12228
MTNYPQLNKEIQDNEIKVVMHTNKGDMTFKLFPDIAPKTVENFVTHSKNGYYDGVTFHRVINDFMVQGGDPTATGMGGESIYGSAFEDEFSLEAFNLYGALSMANAGPNTNGSQFFIVQMKEVPENMLSQLADGGWPQPIVEAYGEKGGTPWLDQKHTVFGQLIEGESTLEDIANTKVGAQDKPVYDVVIESIDVEE

SEQ ID NO: 22126 - protein, 377 aa, Pseudomonas putida GB-1
MSTLYSSIDPEGLVEYSVVYTDRSLNHMSQAFQGVMKNISKTLKQVYGAQAVAVVPGSGTFGMEAVARQFATGQQCLVIRNGWFSYRWSQILDTGNIPAATTVLKARPVDTGRQAAYAPPPLEQVLAAIEAHKPQIVFAPHVETSSGIILPDDYLRAVGDAVHAVGGLFVLDCIASGTIWVDMHKCAVDLLISAPQKGWSASPCCALVMFSALALERIEHTQSSSFACDLKKWLQIMQAYEQGGHAYHATMPSDSLARFNDVVNEMQAYGFDKVRAEQQALGDRVRALLTGKGIKSVAASGFQAPGVVVSYTDDADIKSGRKFADHGLQIAAGVPLQCDEPADFQTFRIGLFGLEKLHNIERTVSTLEQALDEVMRG

SEQ ID NO: 22127 - protein, 406 aa, Sulfitobacter sp. EE-36
MYDLNAIRSDFPILSREVNGKPLVYLDNGASAQKPQVVIDAISRSYSHEYSNVHRGLHYLSNLATDQYESVRGTVARFLNAGNEDHIVFTSGTTEGINLVAYGWAMPNLQAGDEIILSVMEHHANIVPWHFLRERQGVVIKWVDVDASGALDPQAVIDAITPKTKLIAVTQVSNVLGTVVDVKAITAGAHAKGVPVLVDGSQAAVHMPVDVQDIGCDFYAITGHKLYGPSGSGAIYINPDRMAEMRPFLGGGDMIREVTKDGVTYNDAPMKFEAGTPGIVQTIGMGVALDYMMNIGMQNIAAHEASLRDYAVSRLSGLNWVQVQGTTPDKAAIFSFTLDGAAHAHDISTILDKKGVAVRAGQHCCGPLMQHLGQTATCRASFGMYNTNAEIDTLIEALELAHDLFA

SEQ ID NO: 22128 - protein, 185 aa, Solanum demissum
MKAVSIEAGEGSKAKRVHGVNRGISVFDLVLRIVALVGTLASAVAMGTADQALSFSTQIVNFEAQYDDIDAFKFFVVSNSITCVYLALSIPISIFHIIRSRAGKSRVLLIVLDAIMLVFLTSGASAAAAIVYLAHNGNTSTNWFSICQQYTDFCQRSAGSLIGSFGAMALMVLLIILSSIALSRR

SEQ ID NO: 22129 - protein, 166 aa, Oryza sativa Indica Group
AQQRSLKEYLKSYPNAKYIDDAKPWSEKCDVAFPCASQNEIDQAEALAIINSGCRVLIECSNMPCTAQAVDILRTAKVVVAPAKATAAGGVAVGELELNPEFSLMQWSVEDFENKIQDAVKQTYDRSIKAAQDYGIMKENPESLVHGANICAFLNIAQAMTDQGCV

SEQ ID NO: 22130 - protein, 561 aa, Oryza sativa Japonica Group
MQLSCSGHDTILDHPVLGSCKVTAIYYRYRVINAILLVESSSNCPLQKLASTNVSTAVYEPQKKDGATIVGCSKDSIATNQDGIVGPRSCLNLSSHGSQLWYLVPPRTYMSALPPDCTVVAKGIPIPYNYDRNGPNENQYLDISNLKEKANKVINFGETAFTWHLNKITNACQGCEWNGHHCGFSSQRGQAFCQHQGSQVILIAATSSAATLVVLLLMVGTTIYLSLKTRYNEEIHLKVEMFLKTYGTSKPTRYSFSEVKKITRRFREKIGHGGYGNVYKGELPNGVPVAVKMLENSRGDGQEFINEVATIGRIHHANVLRLLGFCSEGTRRTLIYEFMPNDSLEKYIFSQGPNVSREFLVPDKMLDISLGIARGMEYLHQGCNQRILHFDIKPQNILLDYSFNPKISDFGLAKLCARDQSIVTLTAARGTMGYIAPELYSRNFGVISYKSDVYSFGMLVLEMVSGRRNLDPGIDNQHEVYFLEWIYEKVFTGQNLLIGTEMTQDEKYKVRKLAIVALWCIQWNPKNRPSTTQVVNMLTGRLQDLQMPPKPFVSSASESIP

SEQ ID NO: 22131 - protein, 210 aa, Triticum aestivum
SRNDQQLRDASKANETTLCDPEKTRDGMAIVPCGLIAWSTFNDTYTFQHNTNNLSIDKTDISWKSDRDHKFGSDVFPKNFQKGPLIGGKTLNESIPLSEQEDLIVWMRTAALPTFRKLYGRIRVDLKENDTITVTLDNNYNTYSFDGKKSLVLSTSTWLGGKNDFLGLAYLTVGGLCFFLAFAFTLLYLIKPRKLGDNNYLSWNRNSAGH

SEQ ID NO: 22132 - protein, 872 aa, Chlamydophila abortus S26/3
MKKSLIVVESPAKIKTLQKLLGKGFIFASSLGHVVDLPAKEFGIDIEQDFEPDYQILPDKQEVISQIRKLASSCDIVYLSPDPDREGEAIAWHIANQLPKHTRIQRISFNAITKGAVNEALKHPREIDMALVNAQQARRLLDRIVGYKISPILSRKLQQRSGISAGRVQSVALKLVVDREKAIEAFVPTEYWNIRVFLQDPKTSTTFWAHLYSAEGKKWEKELPKGKTEDEILLIQSEAQAQHYVALLEDAAYRVTRVEVKEKRRNAAPPFITSTLQQEASRHFRFSSSKTMSVAQTLYEGVELDNEDATGLITYMRTDSVRIDPEALSNVRDYIHNTFGQEYLPKSPNVYTTKKMTQDAHEAIRPTDIHLSPDKLEGKLSDDQLKLYSLIWKRFVASQMNPAIYDTLAMTISTNVKIDLRASGSLLKFKGFLAVYEEKLDDDTTEEENLSLPQLHAQDVLDKEKVSAEQAFTKPLPRFTEASLVKELEKSGIGRPSTYATIMNKIQSREYTIKENQRLRPTELGKIISQFLETNFPRIMDIGFTALMEDELELIADNKKSWKLLLKEFWDQFLPVVTAAEKEAVIPRVLTDITCSACHKGKLVKIWAKNRYFYGCSEYPECDFKTSEEELAFNKDDYAVDTPWNSPCPVCGGDMKVRHGRFGTFLGCLNYPQCRGTISIHKKGEEVEKEETLPCPAVGCSGKILKKRSRYNKTFYSCSEYPDCSVIGNTIDAVITKYTGTPKTPYEKKTTGKKKATTKSSSKTTKTTTKKKKSEGKTPKTPKAGALLTPSPQLALMIGPEPLGRGEATKKVWQYIKDHNLQSPENKKMLLPDDKFAAIIGPEPVDMFQLPKLLNQHLFKSDVSPGSSSASS

SEQ ID NO: 22133 - protein, 321 aa, Coccidioides immitis RS
MFRTAATKSLTAGIPSIGARAFSTSPATQAAAEVHKVAVIGAGQMGLGIALVAAQKAGVPVTLVDNSQASLDKGLKFADKLLEKDVAKERITKDAAVKIRSMLTPTTKLEDVSDVDFVIEAVPEIPDLKASIFSKLAQVAPKHAILATNTSSISITKIAAATTTDPKDLSNSSRVISTHFMNPVPVQKGVEIITGLQTSQDTIDTALEFVKRMGKIPARSTDSPGFLANRILMPYINEAISCLENGIGTREDIDSIMKYGTNVPMGPLTLADFIGIDTCLAIMNVLHQETGDSKYRPAGLLKKMVDAGWLGKKTGKGFYDY

SEQ ID NO: 22134 - protein, 83 aa, Microcystis aeruginosa PCC 7806
MSAEIFDRVKKVVVEQLEVEDPGTVTPEASFANDLKADSLDVVELVMALEEEFDIEIPDEAAEQIDTVGKAADYISGKVEATA

SEQ ID NO: 22135 - protein, 328 aa, Caulobacter crescentus CB15
MDDASSLYDAARFKRAGRGKIYDSIIDTIGDTPLVRLPRLSAELNPKAEVLAKLEFFNPIASVKDRIGVSMIESLEAQGVLKPGATIIEPTSGNTGIALAFVAAAKGYKLTLVMPESMSIERRKMLLLLGAKLELTPAEKGMRGAVTRAQELIEATPGAVMPQQFENSANPLIHRVSTAEEIWNDTAGAVDAVVSGVGTGGTITGVGQALKARKPSLKMVAVEPEASPVLSGGAPGPHKIQGIGAGFVPGVLDRGVIDDIVQVSNDDAFAMARRAAATEGLPVGISSGAALTAAFDLALRDAYKGKTIVVIIPSFAERYLSTALFDGL

SEQ ID NO: 22136 - protein, 748 aa, Photobacterium sp. SKA34
MLTQLREIVDKVVSAQTLIEALDQLVMSTCQAMKTDCCSVYIANHERQLYTLMATQGLHKSQRRVSLRFNQGLVGLVGRKAELVNVADARLHPHFKHLPGIGEESFRSFFGTPIIHQRQVLGVLVVQQREKREFNESEESFLVTLAAQLSGILAHAKAQGMWFEQGNKLHLTGSAASAGVAVAKAWWDDTQPLLEHVAPTSCLDVNVEQERLTIAIEAASTEFRRLRKRFDSELQKETLAIFDLFSHLLNDPMLRKDLKARIACGDQAEWAVRQVVESYSARFANMKDQYLKERAQDIRELGQRLLFFLRDEEVDELQWDEPVVLLTRELTAAMLATVPLGKLAAVVAQEGAANSHAAILSRALGIPAIMGVDFVPHMVHNNLVVVDGYRGDFLVNPNRHVLIEYRRLLREEHELAKTVEGDLDKEAYTKDNQRIMVHLNAGLSADTNIAVNKGVDGVGLYRTEVPFLLQRSFPSEDEQINQYRSILQTYPEQTVVMRTLDIGGDKPLPYLTIEEDNPFLGWRGIRFTLDHPEIFLIQVRAMLRASIGLNNMDILLPMISGIAELDEAKILIERAYQEVAGQYDGELRKPRLGIMIEVPSMLYQLHALADKVDFISVGSNDLTQYLLAVDRNNSRVASVYDALHPAVLNALKHIIDSAKRYQLPVCVCGELSGDPIGAILLVGMGYRSLSMNTRNVAKIKYILRHVSALDMAQLADDVLAVHLSCEVRDRTTLFVEQHGLGGFIRAGK

SEQ ID NO: 22137 - protein, 388 aa, Oryza sativa Japonica Group
MELFARAQVVRLKSHHDKFLYADEDEVHVTQDRNGAATNARWTVERVPHSPGVVRLRSRYGRYLSASNEPFLLGMTGRKVLQAPPPGGRATDSSLEWEPVKDGFQAKLKTRYGHYLRANGGLPPWRNSVTHDVPHRTATQDWVLWDVEIVQVLTPGHDRAPTSAAPPSPAHAPELKKPPPPPEAHHRPTKSYTGHPPPPPLEKDAPPQPPRPQEVHHRPTKSYTGNPPQPLEKDASPQPPPPKPAPSRLESSLSFSAPLHKVEGRAIYYHIADDKGDVDEDDETRSFTFNGSNLEELTHKLQEETGLHDIIICTRSPITGKLAPLRLQLPPNNAAMHIVLVQESSKDGAYTKSSATSLLIESYRTEDGGIILLAANIVQFRSWVFLKQ

SEQ ID NO: 22138 - protein, 155 aa, Brassica napus
  misc_feature (15)..(15): Xaa can be any naturally occurring amino acid
  misc_feature (19)..(19): Xaa can be any naturally occurring amino acid
  misc_feature (37)..(37): Xaa can be any naturally occurring amino acid
  misc_feature (63)..(63): Xaa can be any naturally occurring amino acid
  misc_feature (67)..(67): Xaa can be any naturally occurring amino acid
  misc_feature (69)..(70): Xaa can be any naturally occurring amino acid
  misc_feature (75)..(75): Xaa can be any naturally occurring amino acid
  misc_feature (98)..(98): Xaa can be any naturally occurring amino acid
  misc_feature (110)..(110): Xaa can be any naturally occurring amino acid
  misc_feature (118)..(118): Xaa can be any naturally occurring amino acid
  misc_feature (129)..(130): Xaa can be any naturally occurring amino acid
MGNDTSIIMDASKYXQKLXKKVERFKGDTTSGQSSSXPTDPTIPMVTVETLEKAFMINVFAGXNHPXMXXSVLEXFEDIGLNVLDARVSCTDSFSLHXTGVENEDGEGMXSEAVTQAXTDAITSWSESXXLQSHHLLSILFIIFYLCKNIITQFL

SEQ ID NO: 22139 - protein, 461 aa, Triticum aestivum
MATTASPSTTTTPRSFLSSPSFSLRASKSNHLRTTRRLPVNVRCASSSPAADTSYTTKVSRNANIAKLQAGYLFPEIARRRAAHLLKHPDAKIISLGIGDTTEPIPEVITNAMAERAHALSTVDGYSGYGAEQGEKKLRAAIAATYYADLGIDETDIFVSDGAKCDISRLQVLFGSKVKIAVQDPSYPAYVDSSVIMGQTDLYQQDVQKYGNIEYMRCSPENGFFPDLSKVPRTDIIFFCSPNNPTGAAASRDQLTQLVKFAKDNGSIIVYDSAYAMYISDDSPKSIFEIPGAKEVALETASFSKYAGFTGVRLGWTVVPKELLFSDGHPVAKDFNRIVCTSFNGASTISQAGGLGCLSPEGLKAMQDVVGFYKENTKIIVDTFESLGFNVYGAKNAPYVWVHFPDRNSWDVFAEILEKANVVTTPGSGFGPGGEGFVRVSAFGHRENIIEAARRLKQLYK

SEQ ID NO: 22140 - protein, 465 aa, Saccharophagus degradans 2-40
MIESQYDLVVIGSGPAGQKAAIQAAKAGKSVALIEQTRELGGSCVHRGTIPSKTLKENALRVKNMRSNAELSHFQLREDVELATLIDRLNEVLAEHDSYMRRQLERNEITLIHGRAKFLSPNQLEVTKLQQEAECISAANIIIASGSHPRQPPNIHIDHEYIFDSDSILSMMYLPKSLTVLGGGVIASEYASIFQALGVKVTMIDRYPRPLGFLDDDLTDVFIQAFEQMGGTWVGNTVVEECHWNNVDSVETVCADGNIYKSEKLLCAAGRLANVKDLHIEQAGLALNDAGLISVDGQLRTSVPHIFAAGDVIGPPSLASASMEQGRRASCNALDISVGKMHSMIPTGIYSIPELSSVGLSETQARKTHGDVLVGKAKFDEIARGQISGVQNGMLKIVCDAQGEKVLGVMIVGEGATELVHVGQMALLHEADVDLFVDCIFNFPTLAEAYRVAALQIIGQRNAKR

SEQ ID NO: 22141 - protein, 450 aa, Vibrio campbellii AND4
MSSSLSHELLNERLSDALASLDSIPVARVTGRLIKVNGLMLQAVGCRFKLEQRCLVETAEGDMIEAQVVGFDHTVAYLMPIRRLGGLFAGAKVIPLDSDSTVRLSSQWLGRVVNGLGEPFDDGAPLKGGDRVSLEPKPINPLKRRPVDTPLDVGVRAINGLLTVGKGQRIGLMAGSGVGKSVLMGMITQNTEADVIVVGLIGERGREVREFVERNFTPEARRKAIIIAAPADESPLMRLRATLLCHRVAEYFRDQGKDVLLLMDSLTRYAMAQREIALSLGEPPASRGYPPSVFSVLPQLLERAGNSENPDGSLTAIYTVLAEGDDQQDPVVDSARAILDGHVVLSRQLAEQGHYPAIDINASISRCMSACTHEAHSTIANNFRQLYSNYLQVKELLPLGGYQPGQDPELDQSVSMYPHLRAYLQQSASEAVDYPTSLTALAQMFQSEAQ

SEQ ID NO: 22142 - protein, 182 aa, Photorhabdus luminescens subsp. laumondii TTO1
MQLNIPTWLTLFRIALIPFFVLAFYLPFTWAPMVCAIIFIVAAATDWFDGFLARLWKQTTRFGAFLDPVADKIMVAAALVLVSEHYHTWWITLPAATMIAREIIISSLREWMAELGKRSSVAVSWMGKVKTTAQMAALIALLWRPNFEFELGGFILLYVATVMTFWSMFQYINAAWSDLREA

SEQ ID NO: 22143 - protein, 764 aa, Arabidopsis thaliana
MEQLKVLPLLFLSWVMFLQSTHQLPNSQTQVLYQLRKHLEFPKALESWGNYYGDLCQIPATAHMSITCQGNSITELKVMGDKLFKPFGMFDGSSLPNHTLSEAFIIDSFVTTLTRLTSLRVLSLVSLGIYGEFPGKIHRLNSLEYLDLSSNFLFGSVPPDISRLVMLQSLMLDGNYFNGSVPDTLDSLTNLTVLSLKNNRFKGPFPSSICRIGRLTNLALSHNEISGKLPDLSKLSHLHMLDLRENHLDSELPVMPIRLVTVLLSKNSFSGEIPRRFGGLSQLQHLDLSFNHLTGTPSRFLFSLPNISYLDLASNKLSGKLPLNLTCGGKLGFVDLSNNRLIGTPPRCLAGASGERVVKLGGNCLSIIGSHDQHQEFLCEEAETEGKQFQGRKVGILIAVIGGAVLVLVFFVLVILLLLCTNRCSSCCSREKSVPQTRLKVVTDNSHTSLSSEVLASARLISQTAKLGAQGVPSCRSFSFEDLKEATDDFDSSRFLGEGSLGKLYRGTLENGSSIAIRCLVLSRKFSSQSIRGHLDWMAKLNHPHLLGFLGHCTQTSGEHDPVATILYLVYEYMPNGSYRTHLSESFSEKILTWPDRLAILIEIAKAVHFLHTGVMPGSFNNQLKTNNILLDEHKIAKLSDYGVSAIIEENEKKKAKREDDVYNFGFILLESLIGPVPTTKGEAFLLNEMTSFGSQDGRQKIVSPTVLTTSSQESLSIAISIANKCVLLEPSARPSFEDVLWNLQYAAQMQSAADAERKSDTSS

SEQ ID NO: 22144 - protein, 930 aa, Oryza sativa Japonica Group
MERSLLPWLLLLLCFADGVFQSRAQPDSKGFISIDCGIQPNTSYVHNTTKISYVADDDFTDGGSNYNVSPEYIKPQLSQRYYNLRAFPDGARNCYTARSLAPGIKYLIRASFLYGNYDGLNKLPVFHLYIGVNFWTMVNITSLGLGGSRYEEAIVVVPDDFVQVCLINTGTGTPFISSLELRPLDKRLYPQVNATLGLLQLNRLNFGPTDNSLVRYPDDPHDRFWGNWDSYTSSLWKEISTASRVDNLDGDIFDAPTAVMQTAVTPRNASGNIYFFWEPWPQPNDPTPPYTVIFHFSELEILTNNASRQFYINLNGEPLIDTAYEPTYLTARYLYGLEPLERTSRYNITINATANSTLPPLINAAEIFSIISTAVIGTDSQDASSMMAIKDKYQVKKNWMGDPCMPKTFAWDKLTCSYPNSSGARIISLNLSSSGLSADISSAFGNLKALQYLDLSNNSLTGSIPDVLSQLPSLRVLDLTGNQLSGSIPSGILKRIQDGSLNVRYGNNPNLCINGNSCKAAKKKSKLAIYTVIPAVLVVLIASVTTLFCLLRRKKQGPMNNSLEQQNEMSTSTSHVLINSGYGDNVSLRLENRRFTYKELEKITNKFKRVLGRGGFGYVYHGFLEDGTEVAVKLRSESSSQGAKEFLIEAQILTRIHHKNLVSMISYCKDGIYMALVYEYMPEGTLEEHIVGENKKGKILNMEREAQYRIGICTRDVKATNILLNTRLEAKIADFGLSKASSYDNITHVSTNALVGTLGYVDPEYQMTMQATTKSDVYSFGVVLLELVTGKPAILHEPNPISVIHWTRQRLARGNIEDVVDTCMPSDYDVNGVWKAMDIAFTCTAQASTQRLTMTEVVMQLQECLELEDARCAIGDAHNEFYPDPRSDHNLSYNTYVSDRSNDVSQNSGVSMMEHNFGRVPTMASGPAAR

SEQ ID NO: 22145 - protein, 513 aa, Bacillus halodurans C-125
MEQLSEEMIVVLDFGGQYNQLITRRIRDLGVYSELHPNTITAEQLKEMKPKGIIFSGGPNSAYAEGAPKCDPAIFDLGVPILGICYGMQLMTQHFGGKVDAAEHREYGKATITVENQSKLFQGLPVEQTVWMSHGDLIVAPPEGFVVDAQNPSCPVAAMSDEARNYYGVQFQPEVRHSQFGDDMLKNFAFAVCGCEGNWSMENFIELEMEKIREQVGDKQVLCALSGGVDSSVVAVLIHKAIGDQLTCMFIDHGLLRKGEADSVMKTFSEGFNMNVIKIDAKDRFLSKLEGVSDPEQKRKIIGNEFIYVFEEEASKLKDMDFLAQGTLYTDIIESGTATAQTIKSHHNVGGLPEDMRFELIEPLNTLFKDEVRKLGTELGIPDEVVWRQPFPGPGLGIRVLGEITEEKLEIVRESDAILREEIKKAGLDREIWQYFTALPNMRSVGVMGDARTYDYTVGIRAVTSIDGMTSDWARIPWDVLEIISTRIVNEVKHVNRVVYDITSKPPATIEWE

SEQ ID NO: 22146 - protein, 396 aa, Staphylococcus epidermidis ATCC 12228
MTQSEKIINLTNHYGAHNYVPLPIVISEAEGVWVKDPEGNTYMDMLSAYSAVNQGHRHPRIIQALKDQADKVTLVSRAFHSDNLGQWHEKICKLAGKDKALPMNTGAEAVETALKAARRWAYDVKGIEPNKAEIIAFNGNFHGRTMAPVSLSSEAEYQRGYGPLLEGFRKVEFGDVNQLKAAINKNTAAILVEPIQGEAGINVPPEGYLKTIRELCDEHQILFIADEIQAGLGRSGKLFATDWDHVKPDVYILGKALGGGVFPISVVLADNEVLDVFTPGSHGSTFGGNPLASAVSIAAIDVIIDEDLPGRSLELGEYFKSELKKIEHPSIKEVRGRGLFIGIELHESARPYCEALKEQGLLCKETHDTVIRFAPPLVITKEELDMALEKIKSVFA

SEQ ID NO: 22147 - protein, 414 aa, Staphylococcus epidermidis ATCC 12228
MTENNNLVTSTQGIIKEALHKLGFDDGMYDLIKEPIRFLQVRIPVRMDDGTVKTFTGYRAQHNDAVGPTKGGVRFHPEVDEEEVKALSMWMTLKCGIVNLPYGGGKGGIVCDPRQMSIHEVERLSRGYVRAISQFVGPNKDIPAPDVFTNSQIMAWMMDEYSALDKFNSPGFITGKPIVLGGSQGRDRSTALGVVIAIEQAAKRRGMDIKDAKIVIQGFGNAGSFLAKFLYDLGAKVVGISDAYGALHDPNGLDIDYLLDRRDSFGTVTNLFEDTISNKELFELDCDILVPAAISNQITEDNAHDIKASIVVEAANGPTTPEATRILTERDILLVPDVLASAGGVTVSYFEWVQNNQGYYWTEEEVNDKLREKLVTAFDTIYELSQNRKIDMRLAAYIVGIKRTAEAARYRGWA

SEQ ID NO: 22148 - protein, 327 aa, Brucella melitensis 16M
MGLLVDGKWHDVWYDTGSTQGRFERSKAQFRNWVTQDGSAGPTGEGGFKAEPGRYHLYVSYACPWAHRTLIFRALKKLEKIISVSVVDFLMAEEGWTFYGTTGSTGDALYGAKRLYEIYTRADPAYSGRVTVPVLWDKQRETIVSNESAEIIRMLNHAFNEFGDATRDFYPAALRNQIDTLNDFIYPNINNGVYCAGFATTQEAYEEAFQQVFAALDALEQKLSQQRYLAGSSLTEADWRLFTTLVRFDPVYVGHFKCNLRRLADYPNLWNYTRDLYQTPGVAETVNMEHIKGHYYRSHKTINPTGIVPAGPEIEYTAAHDRGRFTG

SEQ ID NO: 22149 - protein, 572 aa, Bacillus halodurans C-125
MGNERLKAPEGPPSDVERIKEESNYLRGTLKESMLEPISAGISDDDNRLMKHHGSYLQDDRDLRNERQKQKLEPAYQFMLRVRMPGGVATPEQWLVMDELAQKYGNGTMKLTTRETFQLHGILKWNMKKTIQAIHSALLDTIAACGDVNRNVMCTSNPYQSEIHQEVYEWSKKLSDDLLPRTRAYHEIWLDEEKVAGTPEAEEVEPMYGPLYLPRKFKIGIAVPPSNDIDVFSQDLGFIAIVEDDKLVGFNVAIGGGMGMTHGDKATYPQLAKVIGFCKPEQIYDVAEKIITIQRDYGNRSVRKNARFKYTVDRLGLETVKNELENRLGWSLDEAKPYHFDHNGDRYGWVKGVKGRWHFTLFVEGGRVTDYADYKLMTGLREIAKIHTGDIRLTSNQNLIIANVTSQKKKKINELIEQYGLTDGKHYTALRRSSIACVALPTCGLAMAEAERYLPKLIDKIDEIIEENGLKNEEITIRMTGCPNGCARHALGEIGFIGKAPGKYNMYLGAAFDGSRLSKMYRENIGEEEILKELREILPRYAKERKEGEHFGDFVIRAGIIKETTDGTNFHD

SEQ ID NO: 22150 - protein, 228 aa, Thermoplasma acidophilum
MMESKTFRSIWKIWKEKPRITDACSQRDPDQGSWNSNYGPDQENNFIDISVQRRMIYEFEGRIPEIDPSAYVSESATVIGKVKIGKEVWIGPGAVLRGDYGEIEVGDYSAIEDNCVIHARPGEKTTIGQHVTIGHLSVIHTGRIRDWAVIGMGSTVSDFAVVGVWAAIGEGAVVKNRQEIPDEAVAVGVPAKVIGKIDDDYKKLWTDYKHNYNTFSSRYKTNLKPINR

SEQ ID NO: 22151 - protein, 507 aa, Bacillus halodurans C-125
MSLVEIFRFRNERIKILHLTWIAFFISFFTWFNMAPLATTMMESMDWLTREHIAALAIINVALTIPARLIIGMLLDRFGPRIVYSSLLVLMAIPAFMFAFGDTWTQLMISRLLLSSIGASFVVGIRMVAEWFPPKDVGFAEGIYGGWGNFGSAVAAMVLPWFAITMFGGPEGWRYAMAFTGVVCLIYGVIYYLFVRDTPEGKTFVRAKRTGAMEVSSWKDLIWLIVWTIPLHAALGVLAWRLEGMGFLSETILYTIYLVLAVALVYQVYTILKVNVPLLKKGIPEDDRYSFKNVAALNSTYFANFGAELAIISMLPMFFQLTFSLTPAQAGLIASSFAFINLFARPLGGILSDRMGSRRNIMLVYMAGITIGLVGMGFMDSNWPLVVAILITVFTSVFIQGAEGATFAVIPMIKKRMTGQVAGMAGAYGNVGATIYLTLYTFVTPQQFFFILAGGALASFVICYFWLEEPENSFASEYALSSVDEQVVQEAEVSEAEESVVVQKKVL

SEQ ID NO: 22152 - protein, 557 aa, Nicotiana tabacum
ATSLSTPKLSTTLSSPTLHSLLYKHKFSLLSLSNPIKPLHFNFLTHSRSTPSSLSCTRRRFTAPRAESSNGADAPRHYDFDLFTIGAGSGGVRASRFASNFGASVAVCELPFSTISSDSTGGVGGTCVLRGCVPKKLLVYASKYSHEFEESCGFGWNYDVEPRFDWSTLIANKNAELQRLTGIYKNILKNAGVTLIEGRGKVVDPHTVDVDGKLYSAKNILISVGGRPFIPDIPGSEYAIDSDAALDLPTKPNKIAIVGGGYIALEFAGIFNGLKSEVHVFIRQKKVLRGFDEEIRDFVGEQMSLRGIEFHTEESPQAIVKSADGSLSLKTSRGTVEGFSHIMFATGRRPNTKNLGLETVGVKMTKNGAIEVDEYSRTSVPSIWAVGDVTDRINLTPVALMEGGALAKTIFAHEPTKPDYRNVPAAVFSQPPIGQVGLMEEQAIKEFGDVDVYTANFRPLKATISGLPDRVFMKLIVCAKTSKVLGLHMCGDDAPEIVQGFAIAVKAGLTKADFDATVGIHPTSAEEFVTMRTPTRKVRSSPSEGKAEHDIKAAAGV

SEQ ID NO: 22153 - protein, 361 aa, Zea mays
  misc_feature (152)..(152): Xaa can be any naturally occurring amino acid
MEEHVPRGGGGGRPPIPAAAARKPALARHSSFVRSPANNTKPATERAFEGMDTEFIPIVRSGGWADIGSRHTMEDVFICFDNFMQDFGIESFEEGPSAFYGIFDGHGGKHAADFVCSNLPRFIVEDEDFPREIVKAMSSAFLQADASFADAXCSLNCSLSSGTTALAALVVGRSLLVANAGDCRAVLCRRGKAIEMSRDHKPSCNREKIRIEALGGYVDDGYLNGQLNVARAIGDWHMEGMKACGGLGPLTAEPEVMTMDLTDEDEFLIMGCDGIWDVFLSQNAVDFARRKLQEHNDPAACCKELVDEAIKRKSGDNLSVVVVCFNSRPPPVLTTPRPRVQRSISAEGLRELQSFLDSLAD

SEQ ID NO: 22154 - protein, 150 aa, Bacillus subtilis subsp. subtilis str. 168
MTKIKDLMTADLQYCTVLDNVYEAAVKMKDANVGAIPVVDEDGETLVGIVTDRDLVLRGIAIKKPNSQKITDAMTEKPVSVEEDASVDEVLHLMASHQLRRIPVTKNKKLTGIVTLGDLSLSEQTNERAGSALSDISEGIIEKKAFFINT

SEQ ID NO: 22155 - protein, 233 aa, Crocosphaera watsonii WH 8501
MKQPKVIFLDAVGTLFGVKGSVGEVYRYLAAEVGVECDASLLEKVFYQQFKKAPPLAFQGVDIMMVPDLEYQWWYRVAYDTYTEANVIDQFSDFDGFFRQLYDYFATPHPWFLYTDVFPALQHWQKQGITLGIISNFDSRIYEVLDIFGLTNFFQTITISSTTGKAKPDSHIFIKALEKHNCKPEETWHIGDSRKEDYDGAKSVGINPFLLERNEEVSRSDYTIIDSMERLTL

SEQ ID NO: 22156 - protein, 166 aa, Pseudomonas fluorescens PfO-1
MSNNDQKRDEGYIEKLVQVNRVAKTVKGGRIFTFTALTVVGDGKGRVGFGRGKSREVPAAIQKAMEAARRNMIQVDLNGTTLQYAMKSAHGASKVYMQPASEGTGIIAGGAMRAVLEVAGVQNVLAKCYGSTNPVNVVHATFKGLKAMQSPESIAAKRGLRVEEIK

SEQ ID NO: 22157 - protein, 186 aa, Oenococcus oeni PSU-1
MNLPNKLTTFRIFLIPIFILILSLPLKWSSTFGHSTGWIVAAIIFAIASITDLLDGRIARSRHLVTNFGKFADPLADKLLVMTALIFLTRYGVVAAWITSIIVIRELAITGLRTLIVENSGTVFAAQMPGKIKTFTQMFAIIFLYCSNFGISFPIGQILIYLAVIFTIYSGIDYFVKNRSVFSDGM

SEQ ID NO: 22158 - protein, 344 aa, Ralstonia metallidurans CH34
MLLYGITGMIWKSNDRSEIEHQYMPAQPLDSQVAQLLDLIARAKRPAIHTMDPVDAKIAYEKSAPILDLSPAPVHGVEDFQVTARDGHAIPVRLYSPREASWADPLPLLVYFHGGGFTVGSVNSHDSLCRMFCNGAECLVLSVDYRLGPEWKFPVAANDAFDVLHWVFEEAARIGADATRIALGGDSAGGTLAAACAVEARDHGLAPVLQMLIYPGTCARQDTPSHRALAEGYLLTAEMIQWFFSQYLDVDASRDDWRFAPLDGGGEGADVRGCCPAWIAVAGYDPLHDEGVAYAAKLEAAGVVASLTDYPSMIHDFFKLGRFIGAVAGAHADATAALRRAFGI

SEQ ID NO: 22159 - protein, 481 aa, Zea mays
MPEPGGRCLGDLGGQRQVLKGWPDLWLVGDKPGLRALSTAAMAAAPQPPPLEADQTLALPDVLLLRVLACLPEPQLTGAASLVCRRWTRLAGRLRRRLAVRDWAFVAHRLPYRFPDLADLDLFPASIAAPTTAVPHGAAASPLLTCGVVSLTLDTSADPPLGACRFIDDDALDRGLAAVAASFPNLSRLSATAASESGGLMAIAVGCPTLQELELHRCTDLALRPVSAFAHLQILRIVAASPALYGTAEGGGVTDIGLTILAHGCKRLVKLELQGCEGSYDGIAAVGRCCAMLEELTIADHRMDGGWLAALAFCGNLKTLRLQSCSRIDDDPGPAEHLGACLTLESLQLHRCQLRDRSALHALFLVCEGAREIQFQNCWGLEDDMFALAGLCRRVKILLLEGCSLLTTRGLESVITSWGDLQSLEVVTCNKIKDEEITPTLAELFSNLKELKWRPDNKSLLAASLVGTGMGKKGRVFFKRV

SEQ ID NO: 22160 - protein, 350 aa, Arabidopsis thaliana
MISDSITNASATSAPTARDFGKKKRTNRSAKLKQSKLGLRREQWLSQVAMINKGDKEEMESNRRIGSEKPDQRDLPRPVENLDEDNNGTHRHESFIESLSNSPNSILSGMNSIPNFSSSSSSGSGGSCSGNITEEEDADDDGCLDDWEAIADALAADDEKHEKENPPESCQEHEDIKQSALIGGADVVLRDAKADSQRRKQKSNQAWRPDDKLRPQGLPNLEKQRSFPVMNLHFSSVTVVPSSCPICYEDLDLTDSNFLPCPCGFRLCLFCHKTICDGDGRCPGCRKPYERNTIKFEASVQGGGLTIRLARSSSMFCRVVCEYIRWYTNFKYIKVAISLFLIACENLAYL

SEQ ID NO: 22161 - protein, 415 aa, Rhodopirellula baltica SH 1
MSPLIAADKIEAARKRIAKVVRHTPLMRNARLSALYDAEILLKREDLQEVRSYKIRGAYNRMSQLSDAQRAAGVVCASAGNHAQGFAYACHAMGIQGRVFMPAVTPKQKVDKVKLFGQEHVEVILIGDTFDDAAAEAHRAAEEGLTYIPPFDDPAIIEGQGTVGAEILEDHSEPIDMVLVAVGGGGLISGLGSIFKQLSPKTKIIGIEPTGAPAMHDSLRAGEVITLEKIDNFVDGAAVRRVGDLNFKIAQHVIDEMILVPEGKVCSVMLQLYNDEGLVVEPAGALSIAALDQLASEICGKTVVCVVGGSNNDITRTEEIRDRAMLYEGLQHYFIIKFPQRAGALREFLNNVLGPTDDITHFEYTRKHNRETGPALVGLQVAHRDDYQGLLDRMAASNIEYQVVNEQRMLFELLV

SEQ ID NO: 22162 - protein, 400 aa, Caulobacter crescentus CB15
MTLDLAAIQAAAGRLQGQIERTPCRHSKTLSKITGAEVWVKFENLQFTAAYKERGALNKLMLLSETEKQRGVIAASAGNHAQGLAYHGARLGVPVTIVMPKTTPFVKVQHTRDFGATVVIEGETYDDANAHARKLRDEQGLTFVHPFDDYDIMAGQGTIALEMLEDAPDLEILPVPIGGGGLISGVATAAKALKPDIRIIGCEPAMYPSFTAKMRGVAAHCGGQTIAEGVAVKQVGELTYGVVRPLLDDVLLLEEPYLEQAVSLYCNVEKTIAEGAGAASLAALLAYPERFRGKKCGLILCGGNIDTRLLASVLTRELVRAQRLASLRIIGDDRPGLLSTVASVIGAMGANIIEVNHNRLALDVPAKGAEFDITIETRDAQHTQEVMEALRESGYPPRVV

SEQ ID NO: 22163 - protein, 194 aa, Staphylococcus xylosus
MNLIPTVIETTNRGERAYDIYSRLLKDRIIMLGSQIDDNVANSIVSQLLFLQAQDAEKDIYLYINSPGGSVTAGFAIYDTIQHIKPDVQTICIGMAASMGSFLLAAGAKGKRFALPNAEVMIHQPLGGAQGQATEIEIAANHILKTRAKLNQILAERTGQSIEKIEKDTDRDNFLSAEEAKEYGLVDQVMVPES

SEQ ID NO: 22164 - protein, 236 aa, Ostreococcus tauri
MNDGSVEDGDLEMFDSLAAKVRDWERETGDQGDGVANDASALVKCGAGGDASEPPKMKWYERTSDGFVEREFSMETGESERIVVDALANISLEEEDASHSATSVKSLESAAEATRALRDRLRTTLGYLSAVRNGDAAIDFDVLRSIVSVMNDLRASSSDSVRDTFVDEYEDVLLVNYLASLTKAVDNLNELVDKYHFAHGDHGGVQHAERGGERSGRFHARDREARAQERAMLSLF

SEQ ID NO: 22165 - protein, 291 aa, Caulobacter crescentus CB15
MKPVRKAVLPVAGLGTRVLPGTKTTPKELLNVVDRPILSYIVEEGRKAGIEHFVFVTGRSKGAIEDYFDHQIELEAQLEAKGKIEILEQLRAELPKPGEMSFVRQMAPLGLGHAVWCARDIIGDEPFAVMLPDVIVDAERACLGQLIDLYNKVGGGNVIGVEEVPESETHKYGVVAPGKVDGRMATMTGMVEKPAKGTAPSNWAIAGRYILQPEIFALLAAQEKGAGNEIQLTDSMAKLMQDQAFHAYVYEGVTHDCGDKIGLLRANVALALKRADLGAAARAAVEAALKA

SEQ ID NO: 22166 - protein, 320 aa, Debaryomyces hansenii CBS767
MSTNSIKLLASDVHRGLAELVAKRLGMKLTPSELKRDSTGEVQFSIGESVRDEDIFIICQIGSGEVNDRVIELLIMINACKTASARRISVILPNFPYARQDRKDKSRAPITAKLMADMLTTSGCNHVITMDLHASQIQGFFDVPVDNLYAEPSVVRYIKETINYKDAIMISPDAGGAKRAAGLADRLDLNFALIHKERARANEVSKMVLVGDVTDKISIIVDDMADTCGTLAKAAEVLLDNGAKEVIAIVTHGILSGNAIKNINNSKLTKVICTNTVPFEEKLLLCPKLDTIDVSAVLAEAIRRLHNGESISYLFKNAPL

SEQ ID NO: 22167 - protein, 379 aa, Photobacterium sp. SKA34
MSKSALLVLEDGTVFRGVSIGADGSAVGEVVFNTSMTGYQEILTDPSYSQQIVTLTYPHIGNTGTNTEDEESTAIHAQGLVIRDLPLIASNFRSEQSLSDYLKSQNIVGIADIDTRKLTRILREKGAQNGCIVAGNNIDEGFALEQAKAFPGLKGMDLAKEVTTSETYSWKQGSWTLENGLPEAQEDKELPYHVVAYDFGAKRNILRMLVDRGCRLTVVPAQTSAEDVLALNPDGVFLSNGPGDPEPCTYAIEATKTFLDKNIPIFGICLGHQILALASGAKTVKMKFGHHGANHPVKDLDRDVVMITSQNHGFAADEATLPENLRATHKSLFDGSLQGIHRTDKPAFSFQGHPEASPGPHDAAPLFDHFIELIKKHSA

SEQ ID NO: 22168 - protein, 343 aa, Vibrio campbellii AND4
MKIKALSKLKPEEGIWMTEVDKPEVGHNDILIKIKKTAICGTDVHIYNWDEWSQKTIPVPMVVGHEYVGEVVAIGQEVRGFEIGDRVSGEGHITCGHCRNCRGGRTHLCRNTIGVGVNREGAFAEYLVIPAFNAFKIPEGISDDLASIFDPFGNAVHTALSFDLVGEDVLITGAGPIGIMAAAVAKHVGARHVVITDVNEYRLGLAREMGVTRAVNVAEEKLEDVMAELGMTEGFDVGLEMSGNPSAFNTMLTTMNHGGCIALLGIPPSDMGIDWNQVIFKGLVIKGIYGREMFETWYKMASLIQSGLDLTPIITHHFKVEDFQKGFDAMRSGLSGKVILDWE

SEQ ID NO: 22169 - protein, 473 aa, Aspergillus fumigatus
MANSFPLRVLPTIDPSAGHTFITPSKRIHESEDVSEFLISKAYVDIMTFLLQLNRAMIPVKLADGTVQSWPINTDAVEFSAPVRQLQQLLTKLEELLAEAPPDTGPRRFGNISFRRWYELVESRASELLGECLPSELLQAKSSDPNSVTAEAELKAYFLGSWGSPQRLDYGTGHELSFLAFLAGIWKLNGFPKTTPGVEERAIVLGVIQPYLELVRTIIKRYTLEPAGSHGVWGLDDHSFIPYILGSAQLAPAISETDPTPEEGSLPGAPSPNGVTKAHIVERERLTNMYFSAIGFIYDVKKGPFWEHSPMLYDISGIQAGWGKINKGMIKMYNAEVLSKFPVVQHFPFGSLFSWDRDPNAVPPPTSAHMSTTQSQSRGPAVPSAGQTPPSGTRAPWATATQAAPPAGAGTAAPWAAKRDGCTPGKPPTSLPDTSRLPPGPMAPTRAPWAASSTGQAPGGDPTHVPTKAPWAK

SEQ ID NO: 22170 - protein, 478 aa, Aspergillus oryzae
MAADGLPVRVLPTLDPSEGHTFLEPSKRINEGDDVSEFLCSKAYVDIMTFLLQLNRSMFPAKLPDGRVQTWPLNTEAVGFSAPVRQLQQLLSKIEDLLDATPLMPGEWRYANGAFQVWHDKVKKATPSLLAECLPAEILHAPSSDPNGPTAEVELTEYFLGSWGSRERMDYGTGHELSFLTFLGAIWKLNGFPKNEPGVEERTIVLGVIEPYLELIRAVIKKYKLEPAGSHGVWGLDDHSFIPYIFGSAQLGPAISNSDLVPETGSLPDAVDPDGVTKANVVEKERKVNMYFSAIGFINDVKKGPFWEHSQMLYNISGVQAGWAKINKGMIKMYNAEVLSKFPVVQHFRFGSLFSWNRDPSAIPPPSRIHTSSGPETRPRQVPPSARQDPGPGTKAPWATASQSTPPPSTGTAAPWATSRAGREPPTTSRIPSALPDTSRLPPGPMAPTRAPWASSQPAGPAPTGDPNDITTKAPWAK

SEQ ID NO: 22171 - protein, 422 aa, Aspergillus oryzae
MASEVSASQGVPKPKIDLSKKLSELRSNRKSQPALPSRPSREPAPVTPPLSNPPDLSSHQYARPVCRILSNHDHQLFLSSSSYSLILAFIFGLSDSVRGRATTDSKDRPVSPNVSKILAVVESIRTLLDQHPSIDQGGSRFGNPAFRDLFDDVAAQSAKWHREILGIQDSTAIEEASAYLIHSLGSRDRLDYGSGHELNFMMWLLCLRQMQLYSTADFEMIVFRVYVTYMHLMRDVQSAYYLEPAGSHGVWGLDDYHFLPFLFGAAQLVEHPYITPLAIHNNVILDEEGDRYIYLDQVRWVDSVKTVKGLRWHSPMLDDISGAKNWSKIESGMKKMFVKEVLGKLPIMQHFLFGSLIPAAPGMGEADDVQTDGHDHTHSHDHAHAQHTDHFGDCCGIKVPSTVAAGAEARKRGTGLRPIPFD

SEQ ID NO: 22172 - protein, 420 aa, Emericella nidulans [sequence omitted]

SEQ ID NO: 22173 - protein, 101 aa, Arabidopsis thaliana
  misc_feature (14)..(15): Xaa can be any naturally occurring amino acid
  misc_feature (30)..(31): Xaa can be any naturally occurring amino acid
  misc_feature (42)..(42): Xaa can be any naturally occurring amino acid
  misc_feature (54)..(55): Xaa can be any naturally occurring amino acid
  misc_feature (84)..(84): Xaa can be any naturally occurring amino acid
RNNNNVFSMLSSAXXVTFFFQASMVTPFTXXNSSSSFPFTLXTNKDITSISFYXXRFNYINLFPPIVKNKFLTLSYLPDLNDFXLANEFYYLFLNKWIPFF

SEQ ID NO: 22174 - protein, 278 aa, Arabidopsis thaliana
MSTTSLQTIGAIKSYHHQAQHLVKNYLLADPFIPYTSVLTGIFLCKVVYDLCHFISNSHSKTYIILTKIQRIEWNNRGISTVHAIFISAMSLYFVFWSDLFSDRWHNDLVVFRSSRLSSLGLGISIGYFLADLGMIFWKYPSLGGIEYIVHHSLSGVAVAYSLFSGEGQLYTYMVLISEITTPEINLRWYLDTAGMKKSLAYVVNGVFIFLAWLVARILLFIYMFYHVYLHYNQVMRMHIFGYVLVFGVPAALGVMNLIWFGKIVRGVKKTLAKRCEC

SEQ ID NO: 22175 - protein, 422 aa, Pseudomonas putida GB-1
MSLKNDALEYHAQPRPGKLSVELSKPTATARDLSLAYSPGVAEPVREIARDAELAYRYTGKGNLVAVISDGTAILGLGDLGPLASKPVMEGKGVLFKRFAGIDVFDIEVESESPQAFIDTVRRISITFGGINLEDIKAPECFEIERTLIEQCDIPVFHDDQHGTAIVTAAGMINALEIAGKKLEDAKIVCLGAGAAAISCMKLLISMGAGASSILMVDRSGVIHAGRDDLNQYKVQFAHATDKRTLADALDGADVFVGLSGPNLLSPEGLKSMAANPIVFACSNPDPEISPELAHATRSDVIMATGRSDYPNQVNNVLGFPFIFRGALDVRAKRINEEMKIAAAIALKDLAKLPVPKEVCEAYGVEGLEFGREYIIPKPLDARLISAVSDAVARAAIESGVATLPYPTHYPLSSVSEVFGGN

SEQ ID NO: 22176 - protein, 258 aa, Brassica napus
  misc_feature (39)..(39): Xaa can be any naturally occurring amino acid
  misc_feature (221)..(221): Xaa can be any naturally occurring amino acid
MAIRSVKVGNLSSGATEHDIKEFFSFSGEVESIDIQGNXEHSAYVTFKDPQGAETAVLLSGASIADQSVTIEMAPNYTPPAAPHAETQSGGGGAAESVVQKAEDVVSSMLAKGFILGKDAVGKAKAFDEKLGFTSTATAGVASIDQKIGLSQKFTAGTSLVNDKIKEVDQSFQVSERTKSAFATAEQTVSSAGTAVMKNRYVLTGVSWAAGAFSRLAKAAXGEVSQKPKGKVEAEQPSQPSESQQQPPEGYAPILSSE

SEQ ID NO: 22177 - protein, 219 aa, Nicotiana plumbaginifolia
MESNNVVLLDFSGSSFGMRLRIALALKGIKYEAKEENLSDKSPLLLEMNPVHKKIPILIHNGKPICESLNILEYIDEVWHEKCPLLPSDPYQRSQARFWANYIDNKIYSTGRRVWSGKGEDQEEAKKEFIEIFKTLEGELGNKTYFGGDNLGFVDVALVPFTSWFYSYETCANFSIEAECRKLVVWQNCMENERVSKSLPHPHKIYDFVLELKHKLGLA

SEQ ID NO: 22178 - protein, 636 aa, Crocosphaera watsonii WH 8501
MNLSDITHPNQLHGLSIRQLEDVTRQIREKHLQTIAASGGHLGPGLGVVELTVALYQTLDLDRDKVIWDVGHQAYPHKMLTGRYHDFHTLRQKDGIAGYLKRCESKFDHFGAGHASTSISAGLGMALARDAKGEDYKVVSIIGDGALTGGMALEAINHAGHLPHTNLMVVLNDNEMSISPNVGAISRYLNKVRLSDPVQFLSDNLEEQFKHLPFFGESLTPDMERVKEGMKRLAMPKVGAVIEELGFKYFGPIDGHNLEELISTFKQAHKTPGPVFVHVATVKGKGYELAEKDQVGYHAQSPFNLATGKAIPSNKPKPPSYSKVFAHTLTTLAQNNPKIIGITAAMATGTGLDKLQAKLPKQYIDVGIAEQHAVTLAAGLACEGIRPVTAIYSTFLQRAYDQVLHDVCIQNLPVFLCLDRAGIVGADGPTHQGLYDIAYLRCIPNLTIMAPKDEAELQRMVVTGINYTDGPIAMRYPRGNGVGVPLMEEGWEPIPVGKGEILRSGDDVLLVAYGTMVHQSLQVAELLKEHGIEATVINARFVKPLDTELILPLAQRIGKVVTLEEGCLMGGFGSAVAEALMDNDVVVPIKRFGVPDKLVDHAKPDQSKADLGLTSPQIAEQIRQLFFKVAQPSVVA

SEQ ID NO: 22179 - protein, 380 aa, Sulfitobacter sp. EE-36
MRISTRSQVDPFIVMDVMQAAAAAEAEGRHIIHMEVGQPGTGAPKGASTALTAAMEQGALGYTVALGLSALRQRIARMYGEWYNVDLDPNRVVITSGSSGGFILTFTSLFDTGDRVGIGAPGYPSYRQILKALDLAPVDLPTSLDNRLQPVPADFAGMDLQGLLVASPGNPTGTMLDHAAMSALIDATKAQGASFISDEIYHGIEYEKKAVTALEITDDVYVINSFSKYFSMTGWRVGWMVVPEDHVRVVERIAQNMFICAPHASQVAALAAMDCIDELEANMDVYRANRAMMITGLREAGFTRFAPPDGAFYVYADVSELTDDSRALARDILDKAGVAVTPGLDFDPVRGHHWLRFSYARSTQDIVEGLGRLKTYMAAR

SEQ ID NO: 22180 - protein, 402 aa, Salmonella enterica subsp. enterica serovar Typhi str. CT18
MSSVDILVPDLPESVADATVATWHKKPGDAVVRDEVLVEIETDKVVLEVPASADGILDAVLEEEGTTVTSRQILGRLREGNSAGKETSAKSEEKASTPAQRQQASLEEQNNDALSPAIRRLLAEHNLEASAIKGTGVGGRLTREDVEKHLAKGESKAPAVEPAAQPALGARGEKRVPMTRLRKRVAERLLEAKNSTAMLTTFNEVNMKPIMDLRKQYGEVFEKRHGIRLGFMSFYVKAVVEALKRYPEVNASIDGDDVVYHNYFDVSMAVSTPRGLVTPVLRDVDTLGMADIEKKIKELAVKGRDGKLTVEDLTGGNFTITNGGVFGSLMSTPIINPPQSAILGMHAIKDRPMAVDGKVEILPMMYLALSYDHRLIDGRESVGFLVTIKELLEDPTRLLLDV

SEQ ID NO: 22181 - protein, 388 aa, Salmonella enterica subsp. enterica serovar Typhi str. CT18
MNLHEYQAKQLFARYGLPAPVGYACTTPREAEEAASKIGAGPWVVKCQVHAGGRGKAGGVKVVKSKEEIRAFAENWLGKRLVTYQTDANGQPVNQILVEAATDIGKELYLGAVVDRSSRRVVFMASTEGGVEIEKVAEETPHLIHKVALDPLTGPMPYQGRELAFKLGLEGKLVQQFTKIFMGLATIFLERDLALIEINPLVITKQGDLICLDGKLGADGNALFRQPDLREMRDQSQEDPREAQAAQWELNYVALDGNIGCMVNGAGLAMGTMDIVKLHGGEPANFLDVGGGATKERVTEAFKIILSDDNVKAVLVNIFGGIVRCDLIADGIIGAVEEVGVNVPVVVRLEGNNAELGAKKLADSGLNIIAAKSLTDAAQQVVAAVEGK

SEQ ID NO: 22182 - protein, 174 aa, Oryza sativa Indica Group
MALEQTFIMIKPDGVQRGLIGEVIGRFEKKGFYLKAMKLINVEKSFAEKHYADLSSKPFFGGLVEYIVSGPVVAMVWEGKQVVSTGRKLVGATNPLAAEPGTIRGDFAVDIGMSSTEATRSRTPGRRLLCGSLRASPSGGATSTHGSMRSKMPCHYEPGELASEDLPCYLAAIL

SEQ ID NO: 22183 - protein, 189 aa, Staphylococcus xylosus
MSLINKEVLPFTANAYDPQKDEFLEVSEEILKGSWSVVCFYPADFSFVCPTELEDLQGQYDKLQELGVNVYSVSTDTHFVHKAWHDHSEAINKIQYTMIGDPSQTITRNFDVLDEDLGLAQRGTFIVDPDGIVQAAEVNADGIGRDASTLVHKIKAAQYVRQHPGEVCPAKWEEGSETLQPGLDLVGKI

SEQ ID NO: 22184 - protein, 601 aa, Microcystis aeruginosa PCC 7806
MAVIVQKYGGTSVGSVERIQSVAQRVKNTVIAGNTVVVVVSAMGKTTDGLVNLAKQIAAEPSRREMDMLLSTGEQVTIALMSMALEEIGQPAISLTGAQVGIVTESEHSRARILEIKTDRLSRHLSEGKVVVVAGFQGVSDSDQLEITTLGRGGSDTSAVALAAALKADFCEIYTDVPGILTTDPRLVPEARLLDEITCDEMLELASLGAKVLHPRAVEIAKNFGVPLVVRSSWTDEPGTWVTSPAPKPRTLQGLELTKAVDAVEFEGNQAKIALLRVPDRPGIAARLFGEIAHQQVDVDLIIQSIHEGDSNDIAFTVMGNALKKAQSVAEAIAPVLRSHPTNTEEAEVIIESGAAKIAITGAGMIGRPGIAAQIFSTLAAAAINIEMISTSEVKVSCVIDEADGEKAIKVLCDAFQVEYSAKVANREIPKNLVPVRGVALDNNQAQMAIRNVPDRPGMAARIFSVLAAKNVSVDMIIQSQRCRIVDGIPRRDIAFTLPQADANSAQKILLELSESLGLQEVVVNNDVAKVSIVGSGMEGQPGVAARFFEALAKEKINILMIATSDIKISCVVNQEDGVRSLQVVHAAFGLAGQGKIEVPA

SEQ ID NO: 22185 - protein, 293 aa, Chlamydophila abortus S26/3
MVVMDIFEAYRVMIETGIENSLDEFGPKGFSIRAPVEYALTSGGKRIRPMLVCMMAKGLGMGRDVLDSALAIEFIHTSTLIADDLPCMDDDDERRGRPTVHKAFDEASALLASYALIPAAYSRIRLNAKKLKSLGVDSKEVDCAYDIISDITDKNFGVHGVLGGQYEDMFFTNHGPEHVQSIINKKTGALFEIACVSGWLFGGGTPQCVPQVLEFSQTFGLLFQIKDDILDIHQDDQDVGLNYALLFGLDAAKDLLNSSKDKCLTLIHHLKHYRLKDTSELERLVEYMGTRDY

SEQ ID NO: 22186 - protein, 121 aa, Clostridium difficile 630
MDKILLSNLGFYGYHGVLKEENFLGQKFFVDMELYIDSREAGLSDDINKSVSYAEVYNVVKDITENKQFNLLEALAENIAEEVLNKFILINGVMVRVRKPEAPVNGIYDYFGVEIRRARDE

SEQ ID NO: 22187 - protein, 693 aa, Ralstonia metallidurans CH34
MTAQYQVQDGVAVITLDNPPVNGLGHSTRLGIVEGLTRALDDAAVKAVVITGAGKAFSGGADIREFNTPKATQEPTLHSVIRALEASTKPIVAAIHSVAMGGGLELALGCNYRVAAKGAQIALPEVKLGLLPGAGGTQRLPRLIGLEHALNMIVSGTAIPSEKFAGSKLFDEIVDGDVLPAAVKFAQSVAAAPGPYPKVRDLKVRHENAEGFLAFARNTVAAVAKNFPAPLKCVDAVAASLKPFEAGLKDERDGFMYLVGTPESRALRHAFFGERAASKIPDVPEGTPVRKIERVAVIGAGTMGGGITMNFLNAGIPVTMLEMKQEALERGVATIRRNYENSAKKGKLTQEKVEQRMGLLTTTMSYDDIKNADLVIEAVFEEMGVKETVFKKLDEVMKDGAILASNTSTLDVNKIASFTRRPQDVVGMHFFSPANVMKLLEVVRGEKTGKDVLATVMQIGKKIKKTAVVSGVCDGFIGNRMIEQYSRQAGYLLDEGALPEQVDKAIEKFGFAMGPFRMGDLAGNDIGWAIRKRRAVDKPDIQYSKTADKLCEMGRFGQKTGAGWYDYKAGDRKPYPNKQVNDMIVEHSKELGITRRKISDEEIVERLVFALVNEGAKILEEGIASKASDIDMVYLTGYGFPLFRGGPMLYADQVGLYNVAQSMKRYAKGYHGEAWVVAPLLQKLADEGKGFNG

SEQ ID NO: 22188 - protein, 493 aa, Ralstonia metallidurans CH34
MSHPHPHQHPVVEHDDLHRKLKARHLTMIALGGAIGTGLFVASGASIAQSGPGGALLAYCLIGLMVYCLMTSLGELAVHMPVAGSFVTYSALYVDEGFGFALGWNYWFSLAVTIAVELTAAQLVMQYWFPEVPGIYWSAGFLALMFALNAFSVKGFGEAEYWFAMIKVVTVVVFLCVGVLMILGILKGGPQSGWHNFTTGEAPFVGGLPGLFAVAMIAGFSFQGTETVGVAAGEAADPGRTIPRAIRQTFWRILLFYVVAILIIGVLIPYTDPNLLRNDVTDVGVSPFALVFQHAGLAFAAALMNAVVLTALLSAGTSSMYVSTRILYGLAVSQRAPRALAKLTPNGVPFNALLVTTGIGALCFFSSLFGDKAVYLWLLNTSAMTGFFAWLGIAVSHYRFRKGLLYQGYKVSDLAYRSPLYPFGPIFAGVLCLVIVGGQNYQAFTDIPGRWQEIVSTYIGVPVFLALWLGYRIVRGTRMIDYEDMPFELVKKD

SEQ ID NO: 22189 - protein, 471 aa, Oryza sativa Japonica Group
MDKKQGFFSALREEVARGLSPARARRRSQAAAAAEVAAALRYAGGGGGGEMLAPLMEGPDPESGDGGRSSSSAAAARREGWGRWVRGQLSRAPSTAGAAVVAAGGGGGAARRNDLRLLLGVMGAPLAPVHVAAGEPLPHLSIKDTPIETSSAQYILQQYLAASGGQKLLSSVRNSYAMGKVRMVATEFETGGRVVRNRMAARATESGRFVLWQMAPEMWYIELAVGGSKVHAGCNGKLVWRHTPWLGAHSAKGPVRPLRRALQGLDPLTAASMFAGARCIGERKVNGEDCFILKLCADPETLRARSEGLAEIIRHVLFGYFSQKTGLLVHLEDSHLTRIQSTTGGDAVYWETTINSFIEDYRPVEGIMVAHAGRSAVTLFRFGEVAMSHTKTRMEEAWSIEEVAFNVPGLSIDCFIPPTDIKSGSISETVELPHGEKSKVGLLQCHSAKVAALEKADDNVAWSGALQRDFK

SEQ ID NO: 22190 - protein, 389 aa, Rhodopirellula baltica SH 1
MMSSPAKAAKLALEDGTVYTGTSLGAEGETTGEVVFNTSMTGYQEILTDPSYRGQLVTMTYPEMGNYGINSIDLENRGTSLAGFIIRNESRMHSNYRSEGSLSDYLNSQGVVGIAGIDTRALVRRIRSEGAMRGVLSTTDLDDASLVAKAKASPGLVGRDLVQEVMPTQLEKWTNELDDWTIREIREAAKDASIGDDSRPHVVCMDFGMKWNIPRHLRSRGNRVTIVPGNASADDILKMDPDGVFLSNGPGDPEPLTYAHKAIGELLGQVPVFGICLGHQLLSVACGAKTFKLKFGHRGANQPVLDLETGKVEITSQNHGFAVDDQGLPDCLEVTHRNLNDDTIAGVRHKDTGAFAVQYHPEAAAGPHDSHYLFSRFQEQLNEKCGVTA

SEQ ID NO: 22191 - protein, 152 aa, Oryza sativa
  misc_feature (69)..(69): Xaa can be any naturally occurring amino acid
  misc_feature (115)..(115): Xaa can be any naturally occurring amino acid
ARGSLSLSLSLSIYLSLSLDGDYALYWWADLDNLTNLQPRYGCDDPTYPYYLKFQKWQALCGRDASIAXMIPGQGTPLTMEQSPKGDRTCLMVFDCRGCEPIDFAFGNGWKAESXEFADYDEKGECPVGVGKLRSEFRVVKKQESRGKTEYV

SEQ ID NO: 22192 - protein, 163 aa, Saccharophagus degradans 2-40
MRRIISLLMENEPGALSRVVGLFSQRGYNIESLTVAPTEDNTLSRLTLTTMGDDHKIEQITKHLNRLIDVVKLVDLTEGAHIERELMLVKVRATGAQRAEVKRCVDIFRGQIVDVTASVYTIQITGASEKLDSFFQAVGEASIVEVVRSGVSGIARGEKVLSL

SEQ ID NO: 22193 - protein, 324 aa, Physcomitrella patens subsp. patens
MAGVHTVRVSNVSLKANEHDIQDFFSFSGEIEHIRLLSDGELSQIAFVTFKEAQALETALLLSGATVVDKAVTIAPADESERLATSVDNVSLDSTSTDKPSDASAPKPVTKSAQEAFQSMLEKGYILGNNTMSKAKAFDEKHQLTANASQLAENAKANASQLAENAKANASQLAANAKANVVNIDNKIGISQKLSAGTAAINQQVKAVDEKYHVSEKTRTALQATEQKLNAAGSAIAKNKYILTGTTWVVGAYAKVAKTAEEVGQKTLERVATLSGDQKGASSPSNASEGFGPPPPYPGSDESTLKSTSPPTDDQPQPKPSVTQ

SEQ ID NO: 22194 - protein, 588 aa, Saccharophagus degradans 2-40
MKYDGHQRIKQVEKLSGGDMLIRALADEGVEYLFGYPGGAALHIYDAVFRQKRVQHILVRHEQAATHAADGYARSTGKVGTVLVTSGPGATNAITGIATAYMDSIPMVVISGQVASDKIGEDAFQETDMVGVSRPIVKHSFLVKHAKDIPEIVKKAFYIASTGRPGPVVIDIPKDITNPVDKFEYSYPDKVKIRSYTPAAKGHTGQIKKAVQLLLGARRPIIYAGGGVVQGNASNQLTEIAKLLNFPVTNTLMGLGAFPGTDKQFLGMLGMHGTVEANTAMHHADVIFAVGARFDDRVTNTPSKFCPSAKIIHIDIDPASISKTVTADVPIVGPVEGVLDEMLELVKATKERPDTSAIASWWKQIDEWRDRYSIIDTPRYDTGGMIKPQEVVRMVHEVTGGDAYVCSDVGQHQMFSAQYYQFDKPRRWINSGGLGTMGFGLPAAMGVQIAHRDANVVCVTGEGSIQMCIQELSTCTQYHLPVKIICINNQALGMVRQWQDMQYESRYSESLYEDSLPDFVKLMEAYGHVGMKVTKREELKSKLEECFAMKDKTVFMDIYVDPNEHVYPMQVAPNGSMRDMWLSKSERT

SEQ ID NO: 22195 - protein, 186 aa, Brucella melitensis 16M
MKGLKMESGFKVTLKDAIRTIPDYPKPGVQFRDVTTLMGNAQAFRRAVDELVYPYAGNRIDKVAGIEARGFILGGAIAHQLSAGFVPIRKKGKLPRDTVRIAYSLEYGVDEMEMHRDAIEKGERVVLVDDLIATGGTAEAAAKLLLQMGAEIVAACFIIDLPDLGGRKKLEALGLPVRTLVAFEGD

SEQ ID NO: 22196 - protein, 413 aa, Coccidioides immitis RS
MLPSLLHFLPRFGRWKPLSFSNLNFPRIPLAQKIEEETIPGYVAARYYPVRIGEVFNERYQVVGKLGYGATSTVWLARDMNRRNYVTLKIFITSTSMGQQLDGELNMYKRLERGSKSHPGRKAVRMLLDSFDVNGPTDKHRCLVHPPLWESVLTFLRRNPIHRLPVPVMATVLKYLLLALDYLHSECKIIHGDIKSDNIMLGIADDSVFTHFEESELQTPCPRKELDDGRIIYESRQLTMPKNFAPPVLCDFGSAMPGDVDEHLEDIQPNFYRAPEVILEIPWSYSVDIWNAGCVAWDMFEGEFLFTGHDPELQTYRSRAHLAEMIGLLGPPPPNLLAQGRLTSKFFSEEGEFCAGIPLQDPVPLEERETALKEQQEDREKFLCLMRKMVQWEPGKRSSAKELMQDEWIRAHS

SEQ ID NO: 22197 - protein, 123 aa, Oryza sativa
  misc_feature (46)..(46): Xaa can be any naturally occurring amino acid
  misc_feature (70)..(70): Xaa can be any naturally occurring amino acid
  misc_feature (102)..(102): Xaa can be any naturally occurring amino acid
MATKRLVVTLREANLTGKKEPVRSDLNVPLERRTIRSPITPRIRSXVPTGKFLLERGAKVMLASHLGRAXDVTPYYRLKPIVPRWSELLGVDAVMANDCIGXEVEKLIAVLPEGGVLLLENVR

SEQ ID NO: 22198 - protein, 121 aa, Saccharomyces cerevisiae
AMANIAQRPKRGPHDAAIQNILTELQNHAAAWPFLQPVNKEEVPDYYDFIKEPMDLSTMEIKLESNKYQKMEDFIYDARLVFNNCRMYNGENTSYYKYANRLEKFFNNKVKEIPEYSHLID

SEQ ID NO: 22199 - protein, 300 aa, Escherichia coli
AMDFPQQLEACVKQANQALSRFIAPLPFQNTPVVETMQYGALLGGKRLRPFLVYATGHMFGVSTNTLDAPAAAVECIHAYSLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 22200 - protein, 1169 aa, Suaeda japonica
MAASRIEVPFPFMLAEDVTSPSSSNSTVSAVLEEESNPTDAVIFFGASLILGIACRHFLRGTRVPYTVALLVIGIGLGSLEYGTKHGVGRFGDGIRIWENIDPELLLAVFLPALLFESSFSMEIHQIKRCIAQMVLLAGPGVLLSTCILGAALKLTFPYGWNWKTSLLLGGLLSATDPVAVVALLKELGASKKLSTIIEGESLMNDGTAIVVYQLFYQMVLGRSFTWVAIVKFLLQVALGAVGMGIVFGAASVLWLGFIFNDTVIEISLTLAVSYVAYFTAQEGADVSGVLTVMTLGMFYAAAARTAFKGESQQSLHHFWEMVAYIANTLIFILSGAVIAQGVLSSDNIFENHGIAWGYLFLLYAYVLVGRAIVVGVLFPFLRYFGYGLEWREALILIWAGLRGAVALSLSLSVKRSSGDPALLSTQTGTLFVFFTGGIVFLTLIVNGSTTQFLLSSLGMNKLSKAKRRILDFTKYEMEKKALDAFGDLGEDEELGPADWATVKRYIKSLNTLDEERIHPHEASGTENDGYLDPMNLKDMRVRLLNGVQAAYWAMLDEGRITQNTANVLMQSVDEALDKVDYEPLCDWKGLKSSVQFPNYYRFLQGSIYPKKLVTFFTVERLESACSICAAFLRAHRIVRGQLHDFIGDSEVSFAIINESEAEGEEARKFLEDVRITFPQVLRVVKTRQATFAVLQHLIHYIESLEKAGILEEKEMVHLHDAVQTDLKRLLRNPPTVKLPKVGDLICTHPFLGALPEGLRNRLVGSTKEEVKVRGMTLYKEGGKPNGIWLISNGVVKWASKSSKNKHVLHPTFTHGSTLGLYEVLIGKPYFCDMITDSVAVCFFIEAEKIQAVLGSDPAVEHFFWKESVIVLAKVLLPRFFENKSMQDMRMLTAERSTLNTYLRGETIEVPPHSIGFLLEGFIKSHSLVEELITSPAPLFPAQGNSSFLNQNHNGSGYNKSTSFSHQGASYYVETRARVLLIDMSQSQPESTLQRRKSSFLLPEQSARNLTNREHSGLLSWPENQYRSHQQLPTGQEIEESENLSAKAMQLSIYGSMVPSRGESFKEAPMRGQSFKGDNLGNPSHVRSYPQVPFSDQEQRSLTSVKSEGSTAVRKRLAEEGIKQELLPPAHSSRHPSHARDDSSSESGGDEDVIVRIDSPSKLSFRQAP

SEQ ID NO: 22201 - protein, 186 aa, Sulfitobacter sp. EE-36
MSALKIKKGSNSHSAYNLRPNFSDVIERHTLAVLVENEPGVLARVIGLFSGRGYNIDSLTVAEVDHTGHLSRITIVTSGTPQVIEQIKAQLGRIVPVHDVHDLTVEGPVVERELAMFKVNGTGDKRVEALRLADIFRANVVDSTLETFVFEITGAPEKIDAFAELMRPLGLVSVARTGVAALSRGD

SEQ ID NO: 22202 - protein, 244 aa, Prochlorococcus marinus str. MIT 9215
MLKTFKSDIEIIKERDPAARGIIEIFLCYPGFQSIVMHRFTHKLWKLKIPLIPRLLSHTNRLLTGIEIHPGAKIGKRVFIDHGMGVVIGETAEIGNNCLLYQGVTLGGTGKSHGKRHPTLMENVVVGAGAKVLGSITVGSNTRIGAGSVVVRNVEGNSTVVGVPGRVVHQSGVKVNPLAHSALPDAEANVIKNLMDRIDFLENEILKLQKTLQCLVNSESIDISKLGDAQNLKDKEIIEFLGED

SEQ ID NO: 22203 - protein, 332 aa, Oenococcus oeni PSU-1
MNVLVTGGAGYIGSHTVDRLLAHGDRVSVVDNLWTGHRQAVPDQAKFYEADVRDKTALKKIFDENDFDAVVHFAALTQVGESMKKPLFYFDNNTFGVISLLEAMRDHNVKKIVFSSSAATYGVPKHNPITEDEIQKPINPYGLTKLQMEQIMAWSDQAYGIKGVALRYFNVAGAKADGSIGEDHNPETHMIPNILMVAQGKKDKMVIFGDDYNTPDGTNVRDYVHVVDLADAHVLALEYLQRENKSNRFNLGTEMGMSNKQLISAAKKVTGIDFKVEIGPRRAGDPDALVASPKKAKEVLGWDPKLSNVEDEIKSAWNWMTKHPNGYDDKEQ

SEQ ID NO: 22204 - protein, 128 aa, Populus trichocarpa
MTVEAVNPKAYPLADAQLAITILDLVQQAANYKQLKKGANEATKTLNRGISEFVVMAADTEPLEILLHLPLLAEDKNVPYVFVSSKQALGRACGVTRPVIACSVTTNEGSQLKTQIQQLKDAIEKLLI

SEQ ID NO: 22205 - protein, 158 aa, Prochlorococcus marinus str. MIT 9215
MTIFEGSFTNASTLKVGIVIARFNDLITNKILSGCLDCLKKHGLDTSELSNQVDIVWVPGSFELPIAAKTLMKKKSYDVVIALGAVIRGETSHYDVVISEASKGISQVSNENNVPIIFGVLTTDTLQQALERAGIKNNLGWNYALQAIEMGSLIKNLN

SEQ ID NO: 22206 - protein, 284 aa, Ricinus communis
AIAQIGWIAGPAVMFLFSLVTYYTSTLLSACYRSGDPVNGKRNYTYMDAVRTNLGGAKVKLCGFVQYLNLFGVAIGYTIASSISMMAIKRSNCFHKSGGKNPCHINANPYMIAFGIAEIIFSQIPDFDQLWWLSILAAVMSFTYSTIGLGLGIAQVVENGKAMGSVTGISIGANVTPTQKIWRSFQALGDIAFAYSYSIILIEIQDTVRSPPSESKTMKKATLISVAVTTLFYMLCGCFGYAAFGDMSPGNLLTGFGFYNPYWLLDIANVAIVVHLVGAYQVFA

SEQ ID NO: 22207 - protein, 492 aa, Arabidopsis thaliana
MISLSGLTSSVESDLDMQQAMLTNKDEKVLKALERTRQLDIPDEKTMPVLMKLLEEAGGNWSYIKLDNYTALVDAIYSVEDENKQSEGSSNGNRGKNLKVIDSPATLKKTYETRSASSGSSIQVVQKQPQLSNGDRKRKYKSRIADITKGSESVKIPLVDDVGSEAVPKFTYIPHNIVYQSAYLHVSLARISDEDCCANCKGNCLSADFPCTCARETSGEYAYTKEGLLKEKFLDTCLKMKKEPDSFPKVYCKDCPLERDHDKGTYGKCDGHLIRKFIKECWRKCGCDMQCGNRVVQRGIRCQLQVYFTQEGKGWGLRTLQDLPKGTFICEYIGEILTNTELYDRNVRSSSERHTYPVTLDADWGSEKDLKDEEALCLDATICGNVARFINHRCEDANMIDIPIEIETPDRHYYHIAFFTLRDVKAMDELTWDYMIDFNDKSHPVKAFRCCCGSESCRDRKIKGSQGKSIERRKIVSAKKQQGSKEVSKKRK

SEQ ID NO: 22208 - protein, 306 aa, Vibrio angustum S14
MSKLVVLGSVNADHVLQVPSFPRPGETLHGRNYQVIPGGKGANQAVAAARLNADIGFIACVGDDAFGMLMHDNFVKDGIDVSGVKTEVGTPTGIAMIQVSDCGENSICLSAEANNKLTEQAIESDLDTIRQAEYLLMQLETPMCGIEKAAKVAKSANTTVILNPAPARELSDELLACVDVITPNETEAEVLTGVTVTDNQSAQQAADILHGKGIKTVMITLGAKGVWLSQNGSGDIISGFRVEATDTTAAGDTFNGALVTGLLEDLALESAIKFAHAAAAISVTRFGAQTSIPTREEVDLFLAQHA

SEQ ID NO: 22209 - protein, 383 aa, Zea mays
EFSGLRSSASLPMRRNATSDDFMSAVSFRTHAVGTSGGPRRAPTEAKLKVAINGFGRIGRNFLRCWHGRGDASPLDVIAINDTGGVKQASHLLKYDSTLGIFDADVKPVGDNAISVDGKVIKVVSDRNPSNLPWGELGIDLVIEGTGVFVDREGAGKHIQAGAKKVLITAPGKGDIPTYVVGVNADQYNPDEPIISNASCTTNCLAPFVKVLDQKFGIIKGTMTTTHSYTGDQRLLDASHRDLRRARAAALNIVPTSTGAAKAVSLVLPNLKGKLNGIALRVPTPNVSVVDLVVQVSKKTLAEEVNQAFRDAAANELTGILEVCDVPLVSVDFRCSDVSSTIDASLTMVMGDDMVKVISWYDNEWGYSQRVVDLADICANQWK

SEQ ID NO: 22210 - protein, 388 aa, Rhodopirellula baltica SH 1
MAVAKTAGSWRFDSHLSFPILSGNSMEAGIVGLPNVGKSTLFNALTSSVAAQSANYPFCTIEPNEGIVSVPDSRLNRITDFIKPKKVIPSALKLVDIAGIVKGAAEGEGLGNKFLSHIRQVDAIMQVVRCFEDPDVIHVSGQVNPIADIDTIETELVLADMQTLENALGKAQRTARSGDKEAKLRVAAIEKCNAHLENEQPLRTLELPEAEQVAISSYGLMTAKPILYIANVDENDLNGEHELVDKVREHAAKTGASVACVCAKLESEIAELDEEDRAEMLADVGLEEPSLNIIAREAYRTLGLQSFFTAGETEVRAWPVRIGATAPQAAGVIHSDFERGFIRAEIYQLPELEEYKTEKDIRQAGKLRVEGKSYVMQDGDICHFLFNV

SEQ ID NO: 22211 - protein, 348 aa, Vibrio campbellii AND4
MKAYVFDGKSTAKLVEREKPEIIKQSDVVVRIEKTTICGTDLHILRNNVATFKPGTTMGHEGVGIVESCGDRVTKFKPGDRVIVSCITSCGSCKMCQVSKFGQCLDGGWLLGNEINGCQAEYVRVPYGDTSLHLVPDDIDTDCLVLLSDIFPTGYEVGVLDGQVQPGCSVAVIGCGPVGLAALMTSKFFSPSEIYAIDNNPHRLEVAKELGATHAINNSEGTAVQQILDMTNDVGVDVVIEAIGIPAGWDMSQKLVCPGGNIAVLGVHGKPATINLEDMWKRNFTMTAGMVHTHTIPMLIKQIRAGYLKPKDLISHQFKLSEAKEAYSTFTHASDHKSLKVIISNDCS

SEQ ID NO: 22212 - protein, 521 aa, Debaryomyces hansenii CBS767
MFKNSIAKQARSNVAYAKSFIRMSSNLPLQVSIKLPNGTTYEQPTGMFINNEYVYPKQKKTFDVISPSTEEHITDVYEALEEDIDTAVEAASAAFKSSWSTGDPSVRANALLKLADLVDANADTLAHIEALDNGKSLMCSRGDVALTAMYFRSCAGWADKILGTVPETGSTHFNYTRREPIGVCGQIIPWNFPLLMLAWKVGPATATGNTIVLKTAESTPLSGLFLTGLIKEAGFPPGVVNILTGFGKNAGNAIASHPKIKKVAFTGSTATGRHIMKSAAESNLKKVTLELGGKSPNIVFNDADVQKSAQSLITGIFYNTGEVCCAGSRIYVQEEIYDNVLEELKNASSKIKIGNPFEEDTFMGAQASSQQLDKILKYIETGKNEGAKLISGGERVQGKGYFIKPTIFGDVTEDMQIVKEEIFGPVVTITKFKTIDEVVDLANDSEYGLAAGIHTENINTAIGVANRLQAGTVWVNTYNDFHPMVPFGGYGQSGFGREMGAEALDNYTQVKAVRIGLTEKH

SEQ ID NO: 22213 - protein, 363 aa, Photorhabdus luminescens subsp. laumondii TTO1
MGFKCGIVGLPNVGKSTLFNALTKAGIEAANFPFCTIEPNTGVVPMPDPRLEQLAEIVKPQRILPTTMEFVDIAGLVKGASKGEGLGNQFLTNIRETEAIGHVVRCFVNDNIIHVSGQVDPAADIEIINTELALSDLDTCERAIHRVQKKAKGGDKEAKAELAALEKCLPHLEQAGMLRALDLSTEEKAAIRYLSFLTLKPTMYIANVNEEGFENNPHLDAVRAIAEKEGSVVVPVCAAVEADIAELEDDEREEFMAELGLEEPGLNRVIRAGYQLLNLQTYFTAGVKEVRAWTIPVGATAPQAAGKIHTDFEKGFIRAQTIPFEDFITYKGEQGAKEAGKMRSEGKDYIVKDGDVMNFLFNV

SEQ ID NO: 22214 - protein, 239 aa, Vibrio campbellii AND4
MSKSLVALGLTLVFASSVNAANWGYKGDHGPENWGEFASECAKGQNQSPIDIQSVTEAKLDKLNFDYEGKVISLLNNGHTLQTKLEGKNTLMVDGTEFTLKQFHFHTPSENHVNGKEYPLEAHFVHADKAGHLAVVAVFFKLGGENPELAKLLANIPKKDQVVAIKVPFDADSLLPNNKDYYRFDGSLTTPPCSEGVRWLVIKETQTISPEQVTAFTKAMGHNNRPIQPLNSRMIRTLQ

SEQ ID NO: 22215 - protein, 220 aa, Triticum aestivum
MDSEHWISRLAAAKRFYAAQLGHAGADRAGMDELDMDGDENAGRPDFACPYCYEDHDVASLIAHLEEDHPFEPHAAPCPICSEKVSKDMLNHITMQHGYLFKNRRRLRRFAVPGSQSLSLLSRDLREAHLQVLLGGGGHRSSNNNAANISADPLLSSFGLSFPTLDAEETSKLSTPAQSDVPVLKEAAARPWRSSMDSSLTREERGASQRESGMLARPML

SEQ ID NO: 22216 - protein, 278 aa, Streptomyces avermitilis MA-4680
MVQIKTPEQIAKMREAGLVVAAVHAATSEAAVPGATTKDLDEVARKVLAEHGAKSNFLGYGGFPATICTSVNEVVVHGIPDDKTVLKDGDVISIDAGAIIDGWHGDAAYTAFVGSGHAPELVELSRVAEESMWAGIAAMKQGNRLVDVSRAIETYIRRQPKPGGGKYGIVEDYGGHGIGTEMHMDPHLLNYVERRRGKGPKLVPGFCLAIEPMVSLGTPKTEVLEDDWTVITTDGTWSSHWEHSVALTEEGPLVLTAPDGGKAKLAEYGITAAPDPLA

SEQ ID NO: 22217 - protein, 367 aa, Brucella melitensis 16M
MGFKCGIVGLPNVGKSTLFNALTKTAAAQAANYPFCTIEPNTGEVAVPDPRQNEIARIAGSKEIIPTRINFVDIAGLVRGASKGEGLGNQFLANIREVDAIVHVLRCFEDDDITHVEGRIDPVSDAQTVETELMLSDLESIERRIVQIRKRATGKDKEALAILPVMEKALELLQNGQPVRLMLKDISPEDLLTLKGLNLLTSKPVLYVCNVAEGDATNGNAFSAAVDKMAEEQGAQTVIISAAIEAEVAQLPDEEAGEYLESMGLEEPGLDRLIRAGYKLLDLITYFTAGPKETRAWTIKRGTKAPAAAGVIHTDFERGFIRAQTIAYEDYVKYNGELGAKEAGKARDEGKEYIVHDGDVMLFRFNT

SEQ ID NO: 22218 - protein, 328 aa, Brucella melitensis 16M
MRQNQTANRYRIGVRGKRMKLFAGNSNRVLAESVAQYLNIPLGKASVRRFADQEIFVEIQENVRGEDVFVLQSTSYPANDHLMELLIMIDAFRRSSARRITAVLPYFGYARQDRKPGPRTPISAKLVANLITEAGASRVLTLDLHAGQIQGFFDIPTDNLYAVPVIARDVKANYATGNCMVVSPDVGGVVRARSLAKRIDAQLAIVDKRRERPGESEVMNVIGDVSGKDCLLFDDIVDSGGTLCNAAEALLNKGANSVTAYITHGVLSGGAVARIASSKLKELVITDSIQPTTAINDAPNIRVLSISDLIGEAIARTAAEESVSSLFD

SEQ ID NO: 22219 - protein, 87 aa, Arabidopsis thaliana
ANEDGYHQDAFLAASMLSSAAEVTSPGGATMIAQFTGLTQCPGFPVTRKTTTDLTFIPSNGGRVRCMKVWPPIAKKKLETLYYRRDL

SEQ ID NO: 22220 - protein, 302 aa, Triticum aestivum
  misc_feature (68)..(68): Xaa can be any naturally occurring amino acid
  misc_feature (96)..(96): Xaa can be any naturally occurring amino acid
  misc_feature (108)..(108): Xaa can be any naturally occurring amino acid
  misc_feature (152)..(152): Xaa can be any naturally occurring amino acid
  misc_feature (156)..(156): Xaa can be any naturally occurring amino acid
  misc_feature (158)..(158): Xaa can be any naturally occurring amino acid
  misc_feature (164)..(164): Xaa can be any naturally occurring amino acid
LGALSAPLVPSVPLSVGSVEETCTQEHQGWQPLLAIFKGGKSFPGLQVDKGTIEPGWNQRGRPPPPGXYDLAKRCAKYSEAGAASAKCVQVLKIGXPEPFQFSMDQTXQVLPRYASFCQEDGLVSHGEPEILVDGLHAIDRCAYVTEIVLAXCSKXSXDQHVSXEGTLLKPNMVTPGSTPRKVAPEVIAEYTARTLQRTVPAAVPAIVFLSGGQSEEEATLNLNAMNKLQTKKPWNLSFSFGRALQQSTLKEEEAAQAPGLIILKSQRLSLIKCMPCKETGCLNSALPLQLRMYMLNQVYAL

SEQ ID NO: 22221 - protein, 63 aa, Triticum aestivum
  misc_feature (45)..(45): Xaa can be any naturally occurring amino acid
PNYLFEIVGLFGVAMIAQTVYALAYATGAAAYLAGRSCATRRWYXSKFDEFPARIKALVPYVL

SEQ ID NO: 22222 - protein, 594 aa, Oenococcus oeni PSU-1
MYKALYRQYRPRTFSDLVGQTVIAQTLENALKSNKVGHAYLFAGPRGTGKTSVAKIFAREIEGIPEDTDRESFSDIIEIDAASNNGVDEIRNLRDAANYAPIEYQFKIYIIDEVHMLSTGAFNALLKTIEEPPAQVKFILATTEPQKIPATILSRVQRFDFHRIDVDQIVKRLEFVLDDQKIAYDPAALKIVANASDGGLRDALSILDQAVAITKTGRVELDDVFKITGTSPIDQQIGFLQHALEKQTAKAFKDIHKLLLDGKDPIRFAEDLLVLLKNLMLIKIAPELVSENAFNQIENLSKEFSNSVFEQAIDDVSDNLMKMKQTTRPELYLEILAVKIASRLKKVDQKAIQAQTPSPAKTEMSSSAVLVNSNASSAESMASDFDNHPQAQVDIAEKNEKSNQMPESTEKPASQNEEPLESPSLAKTDDDSAWQVMEAAVKSELQAVKDAWPDIVADFDESVAMLAENSEPVAASQKGLIISFNHPELAEAAARTPHFVAKLSESLLDLLGVKYQLVFISEADWVTLRKNYILKLRGAKIEDKSTQETQLPNSTQSETSKAKATPAESSENRDVVDKAKKLFGDIVKVKDENK

SEQ ID NO: 22223 - protein, 586 aa, Prochlorococcus marinus str. MIT 9215
MALLVKKFGGTSVGDIKKIKNIARNICKSKEAGNEIVVVVSAMGQATDDLNCLAESISKNPNRRELDMLLSTGEQVTIALLSIALNEFGIPAISMTGSQVGIITESIHGKARILDIKTERIQNYINQGFVVVVAGFQGTTLSHTGSMEITTLGRGGSDTSAVALSTALGAETCEIYTDVPGVLTTDPRIVPSAKLLDEISCEEMLELASVGASVLHPRAVEIARNYGIKLCVKSSQSESSGTLLESQIQPLPLKRGSLELTKTVNSLEVLENQAVFSLSNIPDRPGIAAQIFEKLSEASINVDLIIQATNDGNNNDITFTVSDLEVKKTAEQCELITSQLGGEYNLKTKMTKLSIQGAGIMGRPSVSADLFDTLSQANINVRLIATSEIKVSCVIEINNIPKAIRFVAEKFKLSDTQIFINPINKKQNQPEVRGIALDKNQVQVSFRKLPDRPGVAASICLALAENNLLFDTIVQSERISSLKTKDISLTMNKQDREKANLVFEALTKKLPGSYIEDGPAIAKVSTVGAGMAFKVGTAGKIFRALANQNINIEMIATSEIRTSCIVLEKDCDNAVSAIHNHFELEK

SEQ ID NO: 22224 - protein, 408 aa, Sulfitobacter sp. EE-36
MTTPLSPPASTDPSDLPVVRLLPKANARAIRHGFPWVYANEMVTDRRTKALAPGSLALLEDSARQVMGVVAVNPASKIFCRMLDQNAQAVVNQNWFEAHINRAVQLRDQMYDAPYYRLIHAEADGLPGVVIDRFGDTAVIQANAAWADVHIDALTAALVEQTGVRHVLKNASGRTRSLEGLDDVSGVLQGEAPSAPVQVPMNGAIYMADLTGGQKTGLFYDQRPNHAFAANLTKGKRVLDVFAHVGGFSLAALAHGASSAVAVDGSAPALELAQQGAEAMGVTDRFATRQGDAFDILTALRAEGEEFDVVICDPPAFAPGKPALEAGLRAYERVARLAAQLVAENGVLGLCSCSHAADLTQFRTASVRGIGRAGRRAALLHTGFAGPDHPQLPQLAETGYLKSLFFRL

SEQ ID NO: 22225 - protein, 250 aa, Salmonella enterica subsp. enterica serovar Typhi str. CT18
MAVTKLVLVRHGESQWNKENRFTGWYDVDLSEKGVSEAKAAGKLLKEEGFSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNDTILPRMKSGERVIIAAHGNSLRALVKYLDNMSEDEILELNIPTGVPLVYEFDENFKPIKHYYLGNADEIAAKAAAVANQGKAK

SEQ ID NO: 22226 - protein, 710 aa, Nostoc punctiforme PCC 73102
MKLLIVENDQDTAAALTTSLVAQQFTVDTASDSRSALELAEATEYDLIVLDVMLPDENGIRLCRQLRTQNQQEPILLLTGKVDPADRIAGFEAGADDYITKPYELSELLARIRALLRRGSTVLTKVLCWGQLQLDPNNCEVMCQGKGLHLTPKEYKLLELFLRHPRQIFDRRTLLDRICSIDECPGEEAVTTQIRGLRRKLQMAGLNSDPIETLYGLGYRLKSVPEEREQGSEQGHGDTETRGQGDTGNIFDRLSALPFGVTSRHKSLPSGFGSDAPNVANAALTDSTGKGATPVLGSPQVENAASKTPTSSPQSGSVQGAGSPHLPISASSSSYLLNANRYDAEAEAVAAIQQMWQDSQERLQGQLGKLEEAIAHLSTNTLTLDLRQFAHTVAHRLIGSLGAFGMPQAAELARQIERTLKTPTAAVQSEEAVQLKSLLGQLRQVIQLLPTFATTSPTLVLKSSDRVVLLIDDDTDLIERMQANASNWSIHLETVTDLTLARQRLQYLTPDAIILDLIFPNTTESGLTLLAQLKHQFPTIPVLVLTGLGDLTKRVEVTRLGANAFLQKPATPTEVFQAVSQLLHRIDTINARLLIVDDDPALLSMLEAQLQLWGFQVTTLADSSQFWQYLEATTPDLLLLDVAMPGFSGIELCQVVKSDPRWSRLPVLLLSAHADADTLYRALAAGADDYILKPIVEADLIQRILNFNSW

SEQ ID NO: 22227 - protein, 502 aa, Glycine max
MATTRIEAEKKPKTKIVCTLGPASRSVPMIEKLLRAGMNVARFNFSHGSHEYHQETLDNLRAAMENTGILCAVMLDTKGPEIRTGFLKDGKPIQLIQGNEITISTDYDLKGDEKTICMSYKKLPEDVRPGMVILCADGTISFTVLSCDKQAGLVQCRCENSATLGERKNVNLPGVIVDLPTLTDKDKEDILAWGVPNKIDMIALSFVRKGSDLVEVRKVLGKHAKNIMLMSKVENQEGVANFDEILANSDAFMTARGDLGMEIPIEKIFLAQKVMIYKCNIQGKPVVTATQMLESMIKSPRPTRAEATDVANAVLDGTDCVMLSGETAAGAYPDLAVQTMAKICIEAESTLDYGDVFKRIMEHSPVPMSPLESLASSAVRTANSARAALILVLTRGGSTAKLVAKYRPGMPILSVVVPELKTDSFDWACSDEAPARHSLIFRGLVPVLSAASARASHAETTEEAIEFAMQHAKSKGLCHNGDSVVALHRVGTASIIKILTVK

SEQ ID NO: 22228 - protein, 551 aa, Rhodopseudomonas palustris CGA009
MSSTLRSRSESEPAGNAMSLHSKIDPGSADFARNADAMRALVAELNDKLAAVAAGGGEAARAKHTARGKLLPRERVDLLLDPGTAFLELSPLAANGLYGGDVHSASIVTGIGRVMGRECMIVANDATVKGGTYYPMTVKKHLRAQDIARQNNLPCIYMVDSGGAFLPQQDEVFPDERHFGRIFFNQANMSAAGIPQIAVVMGSCTAGGAYVPAMSDESIIVRNQGTIFLGGPPLVKAATGEVVSAEELGGADVHSRQSGVTDHYAQNDAHAIGIARKIVSTLKPAQRPPLNMREPREPLYPAEQLYGIVPAESRKPFDVRDIIARIVDGSEFDEFKKLYGQTLVCGFAHIWGFPVGIIANNGILFSESSLKGAHFIELCCQRGIPLVFLQNITGFMVGKKYEAGGIARDGAKLVTAVATANVPKFTVVIGGSYGAGNYGMCGRAYSPRFLWMWPNARISVMGGEQAAMVLSQLRRDNIEAKGGSWSTEEEEVFRSPIRAQYETQGSPYYATARLWDDGVIDPADTRLVLGLGLSASSNASIEPTKFGLFRM

SEQ ID NO: 22229 - protein, 215 aa, Populus trichocarpa
MVLGLGTGSTAKHAVDRIADLLHQGKLKNIIGIPTSKKTHQQAVSLGIPLSDLDSHPIVDLAIDGADEVDSNLNLVKGRGGSLLREKMIESACKKFIVIVDESKLVPHVGASGAMPVEVVPFCWKFTQDKLQSLFDYAGCVAKLRSNNGGEDGEIFVTDNGNYIVDLFFKKDVGDLKIASDAILRLAGVVEHGMFLDMATTVIVAGELGITIKNK

SEQ ID NO: 22230 - protein, 382 aa, Salmonella enterica subsp. enterica serovar Typhi str. CT18
MNLKEKTRALFAEIFGYPATHTIQAPGRVNLIGEHTDYNDGFVLPCAIDYQTVISCAPRDDRTVRVIAADYDNQVDEFSLDAPIVTHDSQQWSNYVRGVVKHLQQRNNAFGGVDMVISGNVPQGAGLSSSASLEVAVGTVFQQLYHLPLDGAQIALNGQEAENQFVGCNCGIMDQLISALGKKDHALLIDCRTLGAKAVSMPKGVAVVIINSNFKRTLVGSEYNTRREQCETGARFFQQPALRDVSLEAFNAVASELDPVVAKRVRHVLSENARTVEAASALEKGDLQRMGQLMAESHASMRDDFEITVPQIDTLVDIVKATIGDQGGVRMTGGGFGGCVVALIPEDLVPAVQQAVAQQYEAKTGIKETFYVCKPSQGAGQC

SEQ ID NO: 22231 - protein, 457 aa, Populus trichocarpa
MASPPDTSKTIKLERYNSYLRRLHSTKVLNASSKLLFRATLLIALVLILFFTLNYPPLSDNIPNHAHLHHHNFLSTAFFTSSAGGGAAWEKQVRHSSTPKRRNGLSVLVTGAAGFVGSHCSLALKKRGDGVLGLDNFNSYYDPTLKRARQKLLLRHEVFIVEGDLNDASLLRKLFDVVPFTHILHLAAQAGVRYAMQNPQSYVSSNIAGFVNLLEVAKAANPQPAIVWASSSSVYGLNTQVPFSELDRTDQPASLYAATKKAGEEIAHTYNHIYGLSLTGLRFFTVYGPWGRPDMAYFFFTKDILQGKPIDVYQTQDDKQVARDFTYIDDVVKGCLGALDTAEKSTGSGGKKKGPAQLRVYNLGNTSPVPVANLVSILEGLLSTKAKKHVIKMPRNGDVPYTHANVTLAFKDFGYKPSTDLATGLRKFVKWYVNYYGIQTRVKKGSAINSEHPEESA

SEQ ID NO: 22232 - protein, 245 aa, Zea mays
DQRGGDGWRRAGGVLPRTMSEGTHLLVPILQKPFIFDIRTRPHSFSSTSGTKDLQMVSLTLRVLSRPDVEHLPDIFTSLGLEYDEKVLPSIGNEVLKAVVAQFNADQLLTERPHVSALVRESLTKRAREFNIVLDDVAITHLAYGQEFAQAVEKKQVAQQEAERSRFLVARAEQERRAAIVRAEGESESARLISEATTTAGNGLIELRRIEAAKEIASVLSRTPNVSYIPAGDNGQMLLGLNAAR

SEQ ID NO: 22233 - protein, 493 aa, Silicibacter sp. TM1040
MTKFTDLNLNPKVLKAIEEAGYESPTPIQAGAIPAALEGRDVLGIAQTGTGKTASFTLPMITRLARGRARARMPRSLVLCPTRELAAQVAENFDTYAKHVKLTKALLIGGVSFKEQDAAIDRGVDVLIATPGRLLDHFERGKLLLTGIEIMVVDEADRMLDMGFIPDIERIFSLTPFTRQTLFFSATMAPEIERITNTFLSGPERVEIARQATTSENIEQAVVMFKASRKDREGSEKRRVLRELINQEGEAVQNAIIFCNRKTDVDIVAKSLKKYGYDAAPIHGDLDQSQRTKTLDGFRDGTLKILVASDVAARGLDVPSVSHVFNFDVPGHAEDYVHRIGRTGRAGRDGKAITLCSPRDEKALDAVEGLVQKEITRLENPVKPTPRKTATKDEDAGDKPKPARRSRSKAASAKTDATPTPEAANDAAPQVEAPQQQPQEPKETRAEQPSAGAKSGKSRGRGRRDDRRDDKVVGMGDHMPSFIALSFDERRAS

SEQ ID NO: 22234 - protein, 315 aa, Photorhabdus luminescens subsp. laumondii TTO1
MPDMKLFAGNAIPELAQRVANRLYTNLGDAAVGRFSDGEVSVQVNENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQKELENPIVVSPDIGGVVRARAIAKLLNDTDMAIIDKRRPRANVSQVMHIIGDVAGRDCVLVDDMIDTGGTLCKAAEALKERGAKRVFAYATHPIFSGNAVDNIKNSVIDEVVVCDTIPLSAEIKALNKVRTLTLSGMLAEAIRRISNEESISAMFEH

SEQ ID NO: 22235 - protein, 119 aa, Glycine max
  misc_feature (83)..(83): Xaa can be any naturally occurring amino acid
MPEEEVLELKFRLYDGSDIGPFRYSPASTIAMLKDRIFADWPRDKKIIPKAANDIKLISAGKILENNKTVGQCRVPFGELPKXGVITMHVVVQPSLLKTKTEKKVDEVPRKHKCACSIL

SEQ ID NO: 22236 - protein, 420 aa, Photorhabdus luminescens subsp. laumondii TTO1
MTLLALGINHKTAPVSLRERVTFSPDTIGEALDNLLQHPLVKGGVVLSTCNRTELYLSVEQQDNLYEQLIGWLCEYHQLNPRELKSSIYWHCDNEAVSHLMRVASGLDSLVLGEPQILGQVKKAFAESQHSHSLSSELERLFQKSFSVAKRIRTETEIGSNAVSVAFAACTLARQIFESLSELNILLVGAGETIELAARHLREHRVHHMMIANRTKEKAQVLADEVQAEVITLPEIDIRLAEADIVISSTASPLPIIGKGMVERALKLRRNQPMLLVDIAVPRDIEPDVEKLNNVYLYSVDDLQAIIQQNLAQRKAAAVQAECIVQQESRYFMDWLRSQSAVNSIREYRNQAEQMRAEMAAKALTAINQGADVEQAINQLTHQLMNRLIHAPTKSLQQAASNGDLERLNLLRDSLGLEHN

SEQ ID NO: 22237 - protein, 322 aa, Nocardioides sp. JS614
MNLPDLPRLPLVLAPTPLVPAPRLSEILGLDVWFKRDDLTGRGLGGNKVRPLEYLLGDAKTKGCDALVTGAGPQSNWAMLAALTAHGAGIAPHLVFYGDPQHPTGNLLLAQLAGADIHYTGELDRGSVDPALFKAADELTDAGHLPYVVPRGGATPIGCLGYVRATAELLAQLAETGLSPASIWLATGSGGTQAGLVAGAQWSGWEIDVIGITTSRSPEEAASRVRDLASATLDLIGVGDTSIAAPQVRGGYLGEGYGKASPAGAAAAQLVAQTEGVFLDPAFGAKAMAALIDAARDGTVEGPVVFLVTGGAPTLFTPGAQL

SEQ ID NO: 22238 - protein, 629 aa, Oryza sativa Japonica Group
MSHSSDEDSEISDSEIDEYADKFYARLVAGEFKVKDGQSYSCPFCSGKKKKDFNINNLIQHASGVGAASNRQAKDKATHRALAKHLKNGLTKSSGQQSQTAVVEPQPLPNRDEKFVWPWMGVLVNVPTEWKDGRQIGRSGNHLKEQLSRFCPLKIIPLWNFRGHSGNAIVEFGKDWHGFRNALAFEDYFGKEGYGRRDWKEKQNQGSNLFGWVARAEDHTSPGLIGDHLRKNGDLKTINDLENEGARKTDKLVANLANQIEVKNRHLQELEVTYNERTTSLEKMMGQREQLLQKYNEEIRKMQQLAQRHSQKIIDENQKLRSELESKMSELNTRSKELDEIAAKSDYDRRIIDQEKQKNAIKSSHLKLATLEQERADENVLKLVREHKREKEAAVKKILKLEQQVDAKQKLELDIQQLKGKLEVMKHMPGDEDSALKNKIDELSEELQEKMDELDAMESLNQTLVIKERKSNTEMQDARKELENGLLDLLDGQSHIGIKRMGELDLEAFSKACRKMSSEEDAEITAAILCSKWQAEIKNPDWHPFRFVLVDGQEKEIIEDDAKLQELKEEHGEDIYRLVRDALCEINEYNPSGRFPVGELWNFKDKRKATLKETVQFVLRQWRANRRKR

SEQ ID NO: 22239 - protein, 180 aa, Triticum aestivum
DMVIAEYYYDHFHLDLRAAGTIAACFGMANIVARPMGGYLSDLGARYFGMRARLWNIWILQTAGGAFCIWLGRASALPASVTAMVLFSICAQAACGAVFGVAPFVSRRSLGIISGLTGAGGNVGAGLTQLLFFTSSQYSTGRGLEYMGIMIMACTLPVTLVHFPQWGSILPHPAAITSEF

SEQ ID NO: 22240 - protein, 116 aa, Brassica oleracea var. alboglabra
IPAGEVIACHTVEDWNNKLKAAKESNKLIVIDFTAVWCPPCRFIAPIFVELAKKHLDVVFFKVDVDELATVAQEFDVQAMPTFVYMKGEEKLDKVVGAAKEEIEAKLLKHSQVAAA

SEQ ID NO: 22241 - protein, 116 aa, Oryza sativa Japonica Group
MAVPRSVPVRVAHELQQAGHRYLDVRTEGEFAGGHPVGAVNIPYMYKTGSGLTKNTHFLEKVSTTFGKEDEIIVGCQSGKRSLMAASELCSAGFTAVTDIAGGFSAWKENELPTNK

SEQ ID NO: 22242 - protein, 252 aa, Escherichia coli
MNQTLLSSFGTPFERVENALAALREGRGVMVLDDEDRENEGDMIFPAETMTVEQMALTIRHGSGIVCLCITEDRRKQLDLPMMVENNTSAYGTGFTVTIEAAEGVTTGVSAADRITTVRSDSDGAKPSDLNRPGHVFPLRAQAGGVLTRGGHTEATIDLMTLAGFKPAGVLCELTNDDGTMARAPECIEFANKHNMALVTIEDLVAYRQHMSVKPAENRCLIYCLNQETEVVAGFGFYFSLLCKMLIPLLFL

SEQ ID NO: 22243 - protein, 288 aa, Xanthomonas oryzae pv. oryzae KACC10331
MSDSAFTGALTMQKPAVTVMVKAARLAGNVLLRGINKLDALNVVQKGRMDYASEVDADAEKVIIKELKRGYPEYAVFGEEGGVQGGKSGRYTWVIDPLDGTSNYLRGFPHYCVSIALVENGEPIDAVIFDPLRNELFTASRGVGAVLNDRRIRIAERKDLEGAMVHTGFPPRERARASAQLKCVDALLVQAEDVRRTGSAALDLAYVACGRADAYFEAGVKAWDIAAGVLLVREAGGRVCDYKGATPPRMDNMGPQTQQIVAGNIKISDALQKVIVNTGYAREFDATF

SEQ ID NO: 22244 - protein, 586 aa, Prochlorococcus marinus str. MIT 9215
MSNIHKPFHQKYRPNNLDELVGQKFISITLKEALLTQKIAPAYLFNGPRGTGKTSSARIFAKSLNCLAFDKPTINPCCKCDLCRQITDGNALDIIEIDAASNTGVENIREIIERARFAPTQARWKVYVIDECHMLSTAASNALLKTIEEPPSRVIFILATTNPERVLNTIQSRCQKFDFRRISPGDIFQHLSEIAEKESIEYEVQALKMIAKRSNGGMRDAQSLLEQLNLLQEGITINNIQNLLGEVSEIELTNLIQSLVENNPESLIITCNKLYDAGNEPNQIIIGLLNITRDLLLYTTNNKYSDLYYTSDEFQDELDKISKTINKSTIINWHNNLRNIEYQIKTSDNPRLWFEIHLTGLLNNQEVNSFDNKKEGKNNENEEKHKSIKNIVINNENISNQMQKPIINNKISPEELIVKKEDKLEKFDVIEKESIDNIYDNNQNDPCSNNLKDKWELILSKLELPSTRMLLSQQAELESFDSDKVTIALSPNWENMIKSRKVIIENTVKKIFGDQIILNFSTKHLTKRNPTQTPEITQSEVKNLNPIKKIEPKTNMSKKISNQENYDDGSKNLANFFNGEIIDIDE

SEQ ID NO: 22245 - protein, 432 aa, Nostoc punctiforme PCC 73102
MVDIYIIDLFVIGLLLLMVTLGSGWITRLPLSFAIIYLIVGISLGPYAFGLIQLRRDEVFNAELLEKITELVVIISVFSCGLRIVRPLRLGVWDITVRLILFLMPISIFALAVVGKLFLGMNWGEAILLGAILAPTDPVLASEVQLTDINDQDELRFGLTSEGGLNDALAFPFVYFGLHALKDDNWGNWFKQWVAVDLIWAITVGIIMGIVVAKSIVWIEKKIQKRRPADKLMEDFIAISTILITYSLTEMVNGYGFLAVFVAGLVVQRSYRNPEKPLAQLEFIEQVEKLLEVGTILLLGSILLLKPILNYAMQSLLVIILLFLIIRPVGVWISTIGKRPLDSRRRTFHAETRWLFGWFGIRGVGSLYYLAYAFGNGLKGEPAEQIAWITYTTIVASVIIHGISATPLMKWYERNFANRRKTTPPDTIDEFE

SEQ ID NO: 22246 - protein, 224 aa, Frankia sp. CcI3
MTGRPPAASGIMLGGGAPRARHVLPNIVERTSRGEYSMDPYSKLLKERIVFLGVQIDDVSANDVMAQLLFLESEDPDRDISIYINSPGGSFTSLTAIYDTMQFVRPDISTICMGQAASAAAVLLAAGTPGKRFALENSRILIHQPSAQGEGQSSDIEIQAREILRVRALQETMLARHTGRTETEIRRDTERDKIFSADEAEEYGLIDEVIMSRKAARLLSARSA

SEQ ID NO: 22247 - protein, 238 aa, Frankia sp. CcI3
MIESFSRLTQAGPGSPRRATVQAAASGLGSADDQVFSRLLENRIVFLGSVVEDAVANAISAKLLLLAAEDPAADIYLYINSPGGSVSAGMAIYDTMQYVGNDVATVALGLAGSMGQFLLCAGTAGKRYALPHARIMMHQPHGGIGGTAADISIQAEQMLYTKRTLQERIAFHTGQTVEQIETDSDRDRWFTAEEAKEYGLVDHVVVRADQVPSVVSGAGMGLRRAGRTGFGPGGGSGR

SEQ ID NO: 22248 - protein, 363 aa, Populus trichocarpa
MVIAGPPEYMGKRRWFILAIFVCLLAFSCGRELMAEHKHADNHLTAYNHSLATILVEYASAVYMSDLTQLFTWTCPRCSGLTAGFDIIELLVDVEHCLQSFVGVAKDLNAIVIAFRGTQEHSIQNWIEDLYWKQLDINYPGMPDAMVHHGFYSAYHNTTIRPGILNAVERAKKYYGDLNIIVTGHSMGGAMAAFCGLDLVVNTEDKNVQVMTFGQPRVGNAAFASYYSQLVPNTIRVTNDHDIVPHLPPYYRYFPQKTYHHFPREVWLHNIGVGSLVYEVEKVCDGSGEDPDCSRSVAGNSIADHLVYFGVELMCETWRSCGIVMDSLAKEYGKMDVKGNIVFSRDSSILRMKTETNIGGDRM

SEQ ID NO: 22249 - protein, 358 aa, Populus trichocarpa
MSCFKSKYADELIKNAAYIGTPGKGILAADESTGTIGKRLSSINVENVEENRRALRELLFCAPGALQYLSGVILFEETLYQKTASGKPFVDVLKEGGVLPGIKVDKGTVELAGTNGETTTQGLDGLGQRCAKYYEAGARFAKWRAVLNIGANEPSELAIHENAYGLARYAVICQENGLVPIVEPEILVDGSHDIEKCAAVTERVLAACYKALNDHHAILEGTLLKPNMVTPGSEAPKVAHEVIAEYTVRALQRTVPPAVPAIVFLSGGQSEEEATLNLNAMNKLNTKKPWTLSFSFGRALQQSTLKAWAGKPENVGKARAALLARCKANSEATLGTYKGDATLGEGASESLHVKDYKY

SEQ ID NO: 22250 - protein, 271 aa, Staphylococcus xylosus
MTVYEYAKGLILEAGINVRKIMKEDIKVETKSNPNDLVTNVDKATEKYLFDNITETYPNHLVIGEEGHGHHLKDETGVVWVIDPIDGTLNFVHQKENFAISIGIYNNGKPYAGFVYDVMNDVLYHAKSGEGAYENGTLLPEIENTPLKTSIIGINPNWLTKPRLGEVFKPIVEEARSARAYGSAALEIIHVATGKLGGYVTPRLQPWDFAGGLIVLNEVGGLGTNLMGDTLSIYEPNSIVMANAQLHSELIEHHFQKNNEIIELLQHRLKK

SEQ ID NO: 22251 - protein, 572 aa, Physcomitrella patens subsp. patens
MAMAMPLPVSHRPWRAPPTLLQHRYGNAPAPRKPPKHAAVSFHSLYLRLQLGRISDHGTCGLSGGVFRVRCASKSAMRVLQEVDAASVTDAAKLLVRRSRGLSRVTQLEVLEELVLRGQCELVIPVYEAVRKETKYKWDANLHARIVAMVAKDEQLLANSSQLLEPRETLNLKQRAQLECALIECYIIQGLMNQAHESFLRICELPLAKSRSLGYRALVRGYSAAEKPVEAEKMLLEWKLTGYLPSVDDYKALLLGYGKLEMLSDMERITNDLQMIGMKLDTAGFNIMITAYCYAGRLERMVEIFQQMDEAGVRPSLVSWNALTKACRALAGVGLEVSGAMASPQTLFSRLYDEDASSEELSIVQLLLARGLPPECVVFSPDVWQLDLHNMSLGTASIMLPLWLDSLRDRFQLNHKPPLEVKLITGWGKHSKADVKAPVRKMIVAELEVLKSPFKPDSENRGALITRASEIASCDDWSAYLLIYVNQKPRLALLQSSLVRLMKVTMSDLFLHGASDAVSNLCLNAVFVVISCNRTAMRRKADDWEGCGFSRRCRTKLLKSLENVGHAVPPTW

SEQ ID NO: 22252 - protein, 188 aa, Oryza sativa Japonica Group
MAIAGDDSNHGVDDARIARIAAAITVFPGFPKPGISFQDVTGIFHKPEVFRDAIGLFVERYKGKGVTLVAGIEARGFFFAPTIALEVGAKFVPLRKPRKLPGEVISEEYSLEYGTDKIEMQIGAVEPNDRAIIVDDLIATGGTLCAAVKLLERAGAEVVECACVVELQELKGREKLGKIPVFVLVETN

SEQ ID NO: 22253 - protein, 566 aa, Photorhabdus luminescens subsp. laumondii TTO1
MNGIRPFSAVIDACWKESYSFARLTKDIIAGITVGIIAIPLAMALAIGSGVAPQYGLYTAAIAGIVIAITGGSRYSVSGPTAAFVVILYPVSQQFGLSGLLIATLMSGIILLVMGLARFGKLIEYIPLPVTLGFTSGIAITIATMQVKDFFGLQLEHMPENYINKVVALFQALPTLYVSDTLIGLTTLAVLIYWPKLRLKLPGHLPALIAGTAVMGIMNLFDQHVATIGSEFSYILNDGTQGQGIPPILPQFVLPWHLPDMGAHQVDISWSTVSALLPAAFSMAMLGAIESLLCAVVLDGMTGKKHHSNSELIGQGLGNIAAPFFGGITATAAIARSAANIRAGATSPVSAIVHSLLVLLTLLALAPMLSYLPLAAMSALLLMVAWNMSEIHKVIDLIRRAPRDDIIVLVLCMSLTVLFDMVIAITIGIVLASLLFMRRIANMTRISQLPQTNVDKALLVVRINGPLFFAAAERIFTELKEESASYQTILMQWDAVPVLDAGGLHAFQRFIDEVGKDKYIAVCDIPFQPLKTLARARIQLIENHLSFHATLPRAMEELNFNSKTVN

SEQ ID NO: 22254 - protein, 467 aa, Xanthomonas campestris pv. campestris str. ATCC 33913
MSDVLPIILSGGSGTRLWPLSRESYPKQFLPLVGEHSMLQATWLRSAPVAAHAPIVVANEEHRFMAAEQLQQLGVKPSAILLEPKGRNTAPAIAVAALEATRNGGDPLLLVLPSDHVIRDEAAFQAAVTVAAAAAEQGKLVTFGIKPTAPETGYGYIKAGVGTGATAVERFVEKPDLATAQGYLASGEYYWNSGMFLFRASRYLEELRKFQPAIADACQKAWEGGKRDADFTRLDKDAFASSPSDSIDYAVMEKTADAVVVPLDAGWNDVGSWSSLLDVSEQDGQGNAHHGDVIQLDCKNTYAYGSRLIAMVGLENVVVVETDDAVLVGHRDRIQEVKEVVSQIKSAGRSEATWHRKVYRPWGAYDSIDMGQRFQVKRITVKPGATLSLQMHHHRAEHWIVVSGTAEVTRGEEVLLLTENQSTYIPLGVTHRLKNPGKLPLELIEVQSGSYLGEDDIVRFEDTYGRT

SEQ ID NO: 22255 - protein, 558 aa, Ashbya gossypii ATCC 10895
MIKESFSRTATGGFSGRALRLAVTITAVTGFSLFGYDQGLLSGLINGEQFNHEFPATLEQGDNDRHATVVQGAVTSCYELGCFFGSLYVMVDGERRGRKPLIIMGSLLTILGTVVSVAAFREHWGLGQFVIGRVVTGLGTGLNTSTIPVWQSEMSKPKNRGLLVNLEGSVIAVGTMIAYWIDFGLSYVDSSVQWRFPVAMQIVFAVLLLVGIVQLPESPRWLMAHGRTAESKYVLGKLDNLDPSDDSVLAEAAAIEDAVNRFKHEKRSLKDALTGGRGQNLQRTLVACSTQFFQQFTGCNAAIYYSTVLFHKTINLEYRLSLILGGVFSTVYTLATIPSFFLIETVGRRKLFLIGALGQGFSFTITFACLINDTKNNAKGAAVGLFLFIIFFGMTILSLPWIYPPEISSMKVRSITNAMSTCTNWLCNFAVVMFTPIFIHEAGWGCYLFFAVMNFLYVPIIFFFYPETAGRSLEEIDIIYAKSFVDGTQAWRVAANLPKLSLKEVEEYGIQLGLYNNEHDFKDEMKVITEAEGQVPRSSISDSNMESSSTGNGIMKKP

SEQ ID NO: 22256 - protein, 400 aa, Magnetospirillum magnetotacticum MS-1
MSQTIRAAFPALSRPGFHYLDNAAMAQIPGLVSEAIASLNRVARSNVRRGLHEAALRADEAYDSARATVGRFLNAPAEEVVFTGGCTLALNMAAWGLGRKLGPGDEVALSRLEHHSACLPWMSLAEDRGFAIRWLPVTHEGRLDLDHLGAIVTPCCKVVAVTHASNVTGAVSDLPRLAEAAHGVGARLVVDGAQMVPHGRVDPRSLGADLYAFSGHKAYGPTGIGVLWGRAEVLQSMTPMVVGGGMVDAVGDDDVTWADPPHRFEAGTPPVAQAVGLAAALDWMMSLDGQEIHQQEAALTWHLLDGLGSMAGVKIVGPRGLEARVPVVSFTVEGCHPHDLAHLLAERGVAVRGGAHCARPLMAALGLEEGTLRASLAPYSDRSDVEALLVGLAEAVKVLR

SEQ ID NO: 22257 - protein, 204 aa, Zea mays
VITQDMAYAAVQAYPDEYKPDWGRMSFLVDILRPTPGEGPSWYHLLKKASGGCNDLMYSGHMLVAVLTAMAWTEAYGGWISVAIWLLVLHSAQREVRERHHYSVDCVAAIYVGVLLWRMTGFIWSARDLARARRLAKLEEVQSRLVHAAKDSDIDEIRGLLKEVELSGQERQGFSQRAILAFAAGTIIFTLSCVLIAFTATSDG

SEQ ID NO: 22258 - protein, 179 aa, Fusobacterium nucleatum subsp. nucleatum ATCC 25586
MDNDVKLGRFISLILRHKPETINLKLDKNGWANTKELIEKISKSGREIDFEILERIVNENNKKRYSFNEDKTKIRAVQGHSIEVNLELKEVVPPAILYHGTAFKTLESIKKEGIKKMSRQHVHLSADIETAKNVATRHSGKYIILEIDTEAMLKENYKFYLSENKVWLTDFVPSKFIKF

SEQ ID NO: 22259 - protein, 258 aa, Oryza sativa Japonica Group
MDLHGIRGKVALNPVLKLPQGELVVFTDQFEPGIGRRTSAGLQHLLQELLRLKMQGITKALRFHGKQLKLTVLQHMNKGIFSWATLISRIQTESPTVIIPHIGLENIRVREILNAKGEAKAGAVYWCCTSHFVHEAIKHMTAHNVGALVVLKSGDEKQLAGIVTERDFARKILLPGRPSEETRVGDIMTEEDKLITVSSNTNILQAMELMTERHIRHVPVFDEKVVGMITIGDVVKTIVDQQHQEVKQLKKYIRGDYY

SEQ ID NO: 22260 - protein, 1146 aa, Thellungiella halophila
MATVIEAVMPYRLLEDETGSPEGESSPVDAVLFVGMSLVLGIASGHLLRGTRVPYTVALLVIGIALGSLEYGTHHNLGKLGHGIRIWNEINPELLLAVFLPALLFESAFSMEVHQIKRCLGQMVLLAGPGVLISTFCLASLVKLTFPYDWDWKTSLLLGGLLSATDPVAVVALLKELGASKKLSTVIEGESLMNDGTAIVVFQLFLKMVMGHSSGWSSIITFLIRVALGAVGIGIAFGIASVLWLKFIFNDTVIEITLTIAVSYFAYYTAQEWAGASGVLTVMTLGMFYAAFARTAFKGDSQRSLHHFWEMVAYIANTLIFILSGVVIAEGILDSDKIAYQGSSWGYLFLLYLYIQLSRCVVVGVLYSFLCRVGYGLDWKEAIILVWSGLRGAVALSLSLSVKQSSGNSFLSTETGTMFIFFTGGIVFLTLIVNGSTTQFALRLLRMDGLPASKIRILDYTKYEMLNKALQAFEDLGDDEELGPADWPTVESYISSLKDSEGEQVHPHSGSKPGNLDHTSLKDIRIRFLNGVQAAYWEMLDEGRISESTANILMRSVDEALDHISTEPLCDWRGLKSHVKFPGYYNFLHSKIIPGKLVIYFAVDRLESACYISAAFLRAHTIARQQLYDFLGESNIGSTVIKESETEGEEAKEFLEKVRSSLPQVLRVVKTKQVTYSVLSHLLDYIQNLEKIGLLEEKEIAHLHDAVQTGLKKLLRNPPIVKLPKLSDLITSHPLSGALPSAICEPLKHSKKETMKLRGVTLYKEGSKPTGVWLIFDGIVKWKSKGLSNNHSLHPTFSHGSTLGLYEVLTGKPYMCDVITDSVVLCFFINSERILSYVQSDSTIEDFLWKESALVLLKLLRPQTFEKVPMHELRALVSAESSKQTTYVSGESIEIDHNSVGLLLEGFIKAVGIQEELLIASPAALLHSNENQSFRNSSEASGILRVSFSRQAARYSVETRARVIIFNHGAFGAHRTLQRKPSTLASPRATSSDHQLKRSASKEHRGLMRWPENIYKAGQEEEMNGKTLNLSERAMQLSIFGSTENLYKRSVSFGGLNNNKAQDNLSYKKLPSTSAQGLFSAKSEGSMATTKQVESRKFVSQLPPLAASAEGSSRRETMAEESSDDEGEGIIVRIDSPSTIVFRNDL

SEQ ID NO: 22261 - protein, 186 aa, Xanthomonas oryzae pv. oryzae KACC10331
MTDCSRCAGTNASGPNHWSERIRDIVDFPKPGIVFKDITPLLSDGPDFASALDEMAQPWRTTPLDAVLGIEALGFILGAALARELRTGFVPVRKPGKLPGRTLIREYALEYGTDRIEMHEGALPRGARVLIVDDVLATGGTLRAALGLAAQLELEIVGAAVLVELLALQGRQKWADDVPLLATLSF

SEQ ID NO: 22262 - protein, 1151 aa, Mesembryanthemum crystallinum
MAALTDFQLPLRLAEEVAANATSAAAAVAAESETNPTDAVIFVGVSLVLGIACRHFLRGTKVPYTVALLIIGIGLGSLEYGTKHGLGRFGDGIRLWEHIDPELLLAVFLPALLFESSFSMEVHQIKRCIIQMLILAGPGVLISTFCLGSALKLSFPYDWNWKTSLLLGGLLSATDPVAVVALLKELGASKKLSTIIEGESLMNDGTAIVVYQLFFQMVLGRSFNVAQIIKFLVQVSLGAVGIGLAFGVVSVLWLGFIFNDTIIEISLTLAVSYVAYFAAQEAADVSGVLTVMTLGMFYAAAARTAFKGESQESLHHFWEMVAYIANTLIFILSGAVIAEGVLNSGHIFENNGISWGYLVLLYVYVLASRAVVVTVLFPFLRYFGYGLEWKEAVILTWSGLRGAVALSLSLSVKRSSGDASLLSAQTGTLFVFFTGGIVFLTLIVNGSTTQFVLHFLGMDRLSAAKRRILEFTKFEMEKRALEAFGDLGEDEELGPADWPTVKRYIKSLNSGGEQIHPHDNSTSGGDLDPMSLTDIRVRLLNGVQAAYWVMLDEGRISQSTANILMQSVDEALDSVTHEPLNDWNGLKRNVHFPNYYRFLQGSSMWPRKLVTFFTVERLESGCYICAAFLRAHRIARRQLYDFIGESEIATAVINESETEGEEARKFLEDVRITFPEVLRVVKTRQVTHSVLKHLIDYIHSLEKAGLLEEKEIHHLHDAVQTDLKRVLRNPPLVKLPKAKDLVSTHPLLGALPATARDVLVNSTKEVVKVRGLTLYKEGSRPNGIWLISNGVVKWGSKSRVIKHAFHPTFTHGSTLGLYEVLIGKPYLCDMITDSVVVCFFVEAEKILSVLGSDFEMENFLWKESVIGLAKILLPQIFEKMSMHDLRLLIERSTMNTYLSGENVEVPPHAIGFLLEGFIKCHSLHEELITSPAALWPAQGNSSFLSQDGTGYKSTSFYSQGCSYYVETRARVIVFDINSFQHDKTLMRRKSSLLLHDQSTISLTSRDHGGLVSWPENARPEREGEDEEEIDEHEQNMSARARQLSIYGSMLKEKDPLLKTVSFHESVLNKPSSHSLSYPTVPDAQGRSLTTVKSEGSHTIRKRLEGDLPDIPSVPHSRRPSQLPESSDESGGEEDVIVRIDSPSRLSFRHAP

SEQ ID NO: 22263 - protein, 226 aa, Triticum aestivum
MSRSTTEDWDEERDVRPNALVVVLGDVGRSPRMCNHALSLTTELNYNVFLLGYNDTTPHPAIALNPNIRIVPVRPPPDLPRFVPDPVALVFKLLWTNFFLFTAMLFRVPFLVHLILLQNPPGLPTMFICWIISHLKRANWIIDWHNYTYKMLQHKWNLEMDLSKKSRTAATEAQQEVAKKRQTREEREAALREKKRAARAEKKPAWNLRKFFVEMVYRYEGFFGRR

SEQ ID NO: 22264 - protein, 557 aa, Xanthomonas oryzae pv. oryzae KACC10331
MCRTSPLGASQPSEDTVRKRHRMRRDPCQVHRRWPRLARMTQLHFDNRLRQQLPGYQEEGARRREVRAAWSAVMPTPVAAPYLIAHSAEMAHVLGLDASEVASAAFAQVFGGNALYPGMQPWAVNYGGHQFGHWAGQLGDGRAISLGEAIGIDGGRYELQLKGAGPTPYSRGADGRAVLRSSIREFLCSESMHHLGVPTTRALSLVGTGDAVVRDMFYDGRPQREPGAIVCRVAPSFIRFGNFELPSARGDNALLRQWVDFTIARDFPELVGTAEALYADWFAQVCQRTAVMVAHWMRVGFVHGVMNTDNMSILGLTIDYGPYGWVDDYDPDWTPNTTDAQGRRYRFGTQPQVAYWNLGRLAQAMAPLFADQAPLQQGLNRFRDTYLACDRRDTAAKLGLAECRDEDLELIDALRALMRDAEMDMTLTFRGLIDLSPVHPDPAQLHDAFYDDHKRVASASQLQEWLQRYAARLQQDALSPDERRALMRLANPRYVLRNYLAQQAIDQAEQGDPSGVQELLEVMRRPYDDQSGRAAFAARRPEWARDRAGCSMLSCSS

SEQ ID NO: 22265 - protein, 308 aa, Sulfitobacter sp. EE-36
MILCCGEALIDMVAAPSLDGPDGFVPHSGGAVFNTAIALGRLGARAGMLTGMSRDMFGDQLADALKASAVDTTHIIRSDRPSTLAFVKLEDGQASYSFFDENSAGRMIRPEDMPALPSDITALFFGGISLASDPSASAYAALLERQGGPRAVMIDPNIRPLFITDAEGYRRRMAAMIRQADIVKVSDEDLNWLNPAPLTQAEKISAMLDTGPSVVIVTQGAAGAIATLADGTSITVPSVKTNVVDTIGAGDTFNAGFLAKLSELDLLTPEALGTLDPDVLRDAMTYGARVAAITVSRAGANPPWANEL

SEQ ID NO: 22266 - protein, 301 aa, Staphylococcus aureus
MTNLPMNKLIDEVNNELSVAINKSVMDTQLEESMLYSLNAGGKRIRPVLLLLTLDSLNTEYELGMKSAIALEMIHTYSLIHDDLPAMDNDDYRRGKLTNHKVYGEWTAILAGDALLTKAFELISSDDRLTDEVKIKVLQRLSIASGHVGMVGGQMLDMQSEGQPIDLETLEMIHKTKTGALLTFAVMSAADIANVDDTTKEHLESYSYHLGMMFQIKDDLLDCYGDEAKLGKKVGSDLENNKSTYVSLLGKDGAEDKLTYHRDAAVDELTQIDEQFNTKHLLEIVDLFYSRDHKGHHHHHH

SEQ ID NO: 22267 - protein, 888 aa, Oryza sativa Indica Group
MNICAAILLFYILQFVHGQPDSQGSTQWKATADSQCSHVSFRGFISIDCGIPEKSSYQDPTSSIIYVSDYGFISTGANHNISSAYIKPSLAQRNYNVRFFPDGTRNCYTLRSLQEGNKYFVRAVFYYANYDSLNKLPVFDLYLGANYWHEVKFSNADAVNWMDIIVVAPADYLQVCLVNKGTGTPFISGLDLRPLKSTLYPEANTTQSLVLINSNRFNMGPTDNSITRYPLDPHDRLWSTYDTIPDWTEISATSVVQNYLTDVYDVPSAVMQSAATVNSSRINFTWDPSDPSVNISSKYFFVLYFSELQSVPSNGLRQFDIIVNNNTWNTQPYTPPFLFADSLSGTVQGLASYSVSLVATKNATLPPILNAMEMYLVKPLTEFATDPRDARAMMEVQQNYDVKKNWMGDPCAPKAFAWEGLNCSYPPADSSKITSLNLSSSGLAGSIATYFGDLKSLQYLDLSSNDLSGPIPYNLLQKSQNGSLSLRVGYNAKLCGNDTECGSGQKKIKGSLLSAIIITIVATVALIVVLFLLLRRMLKAKDKRRAAGPTYESALLENREFSYRELKHITNNFSQQVGKGGFGAVFLGYLENGNPVAVKVRSESSSQGGKEFLAEAQHLTRIHHKNLVSLIGYCKDKNHLALVYEYMPEGNLQDHLRATTNKPLTWEQRLHIALDAAQGLEYLHVACKPALIHRDVKSRNILLTTNLGAKIADFGLTKFYQVTELPCHILPILFRYYRNYHISEKSDVYSFGVVLLELITGRPPVIPIDESVSIHIGEFVHQSLDHGSIESIVDARMGGGGGYDINSVWKVADLALHCKREVSRERPTMTEVVAQLKESLELESHGDRKHLVTGDDDVSVSNLGEETALEVEEQSGEISRVSPGPAVR

SEQ ID NO: 22268 - protein, 288 aa, Oryza sativa Japonica Group
MAGSFITGALMLILGYAYPAYDCYKTVELNKPEIEKLRFWCQYWILLAVLTVFDRVGDNFVSWLPMYSEAKLAFVVFLWYPKTLGTAYVYESFFKPWIAKYEADIDHNLLELRTRACDMAVLYFQKVSNYGQTRLYEILQYVASQSQTQTSRPQAREQQQRPPPAQTRQVNPAPQPVPAPSVPPLPPQPTQAPSAPPRNQTQDTTPVPVPPPGAESLAQPQAHAGPPQANASDGPQNTEAMQIDPSGPSTSNARQSSIPDEDTLIQEAIRMTRGRLRRRTAGSGPPPS

SEQ ID NO: 22269 - protein, 217 aa, Oryza sativa Indica Group
RDVARVLSGYNDIIMARVFAHQDILDLAKYAAVPVINGLTDYNHPCQIMADALTMLEHIGRIENTKVVYVGDGNNIVHSWLRLAALFPLHFVCACPKGFEPDAKTVEIARSAGSKIEITDDPMEAVKGADVVYTDVWASMGQKEEAEYRKKVFQGFTVDEAMMEMAGPNAFLMHCLPAERGIEVTDGAIEAPNSIVFPQAENRMHAQNAIMLHVLGA

SEQ ID NO: 22270 - protein, 128 aa, Brassica napus
MEIDPVTNGNTDTVMTEPSTAIAPSRPVSSSRSSQLTESIKLEHQLLRVPFEHYKKTIRANHRSLEKEVSSVVSSVGDLADNDWSKDVAVSRLTSLVSRLQGLKRKLEEGSTVENLQAQRCRARIDQL

SEQ ID NO: 22271 - protein, 379 aa, Vibrio angustum S14
MSKSALLVLEDGTVFRGVSIGADGSAVGEVVFNTSMTGYQEILTDPSYSQQIVTLTYPHIGNTGTNTEDEESTAIHAQGLVIRDLPLIASNFRSEQSLSDYLKSQNIVGIADIDTRKLTRILREKGAQNGCIIAGNNIDEGFALEQAKAFPGLKGMDLAKEVTTSETYSWKQGSWTLENGLPEAKEDKELPYHVVAYDFGAKRNILRMLVDRGCRLTVVPAQTSAEDVLALNPDGVFLSNGPGDPEPCTYAIEATKTFLDKNIPIFGICLGHQILALASGAKTVKMKFGHHGANHPVKDLDRDVVMITSQNHGFAADETTLPENLRATHKSLFDGSLQGIHRTDKPAFSFQGHPEASPGPHDAAPLFDHFIELIKKHSA

SEQ ID NO: 22272 - protein, 76 aa, Populus trichocarpa
MESDMVMHYGGCHCRRVRWRVQAPSSVVALNCNCSICSMRASIQFIVPSEKFELLGDSKEFLTTYTFGTHTAKHTF

SEQ ID NO: 22273 - protein, 572 aa, Ehrlichia ruminantium str. Gardel
MFVRVLNTLLILICCFTISCSNKAKYQFSRKYSPVYNPGGESFESNQEFSRAYSVYKERRDALVGDGNQQNVSKKKYGKLDNKHINRYDPIEDDGLSEGKDLQLMVDSNGINLADVAGARFVQSIDDDYENDNVIKKHNDVQDKSVKLSKKNVKHVSSKSVSKKLDVKEKLLDDHVPVEEKYEIVEEDKAKVSTEDKSKSDVNKLPAIKEDKAKVSIESKSSELDKSKVHVKEDKSKSLPEDTSKSDVNKLPAIKEDKAKVSTESKSSELDKSKVHVKEDKSKSLPEDKSKSDVSKLPAIKEDKAKVSTIDGKSSELDKSKVHIKEDKSKSLPEDTSKLDTSKLPAITGDKAKLSTESKSSELDKNKVHIKEDKSKSLPEDKSKSDVNKLPAIKEDKAKVSTIDGKSSELDKNKVHVKEDKSKSLPEDKSKLDTSKLPVVEGNDHSNTDESKLHLLLDFSKDNDKEKDLSNHQPLKGDNNSKTINDHKDSKQDTTHKVTHFLPELSEQNITKDVEKNNSKGPGDNNNLPLSDNVNKKYDNRNQQKSVKQNNRKDVKAKEEYDEDYSITYYYE

SEQ ID NO: 22274 - protein, 267 aa, Clostridium difficile 630
MKKIGFIGAGNMASAMIGGIVNSKLVEPNMVIASAYSQGTLDRIDANFGINTTKDSKEVTRTSDIVIVAVKPDIYDDILEEIKDFIDDNKIIVTIAAGKSIKDIESIIGEDKKIVRTMPNTPALVNEAMSSLSINKNINKEDLEAVTEVFNSFGNTEVVPEYLIEAVIGASGSAPAYVFLFIEAIADAAVIAGMPRPQAYKFASQAVMGSAKMVLETGKHPGELKDMVCSPGGTTIEAVKVLEEEGFRASVIKAICACIEKSKKMSE

SEQ ID NO: 22275 - protein, 152 aa, Zea mays
  misc_feature (7)..(7): Xaa can be any naturally occurring amino acid
  misc_feature (17)..(17): Xaa can be any naturally occurring amino acid
  misc_feature (36)..(36): Xaa can be any naturally occurring amino acid
FAVYKSXKLPTLKGDFXNTMLWSSPVFFFILFLFGXAWHFFAKKKESLTAWGPDDPFTPTGAQNSSAKEPTFTEPSRRNDDLMDLRRRYAGGSYRSVGANDPSSRAPVDGNYRTTAQDHNNYRGGGSGLDSNGFGNRRDHLFGNNKVLDNES

SEQ ID NO: 22276 - protein, 138 aa, Shorea falciferoides
EKNIPVLLGLLSVWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 22277 - protein, 422 aa, Methanosarcina barkeri str. Fusaro
MKRESELKKELNLLEVTLVGIGDILGAGIYVLMGKAAGLAGNMVWFSFLFAGATATLSAFSYMELASMFPKAGAEYGFVRRAFGERIGLFIGLLVIYFVAITSSAVALGFGRYFSNLFGNGYLTGTLGLFILLSLIMVYGIKESARLAIFISFIEVSGLLIVIYTGLPYLGTVNYFETPDLAGIFKASTLIFFAFLGFEDIVRLSQETKEAEKTTPKALLIAIFFTVFLYMCVAITAVSMLDFRVLGLSGAPLADVVAISLGNKAFVLMSWIALFSTMNTVLVVMLGGSRIVYGMADSGALPRFLSRVHPGYRTPWVAILGVSFLSALFVLFRDVAIVANISNFMIFIIFFMVNLSLIKLRYTDPGRNRPFKVPLNIGRFPLLPFLGALSTVFLFFQLSLEVITYGLVFIGIGILIVLFRTR

SEQ ID NO: 22278 - protein, 282 aa, Glycine max
MGGGGAMRTVAKFATAGIRGVPSVRRASSQTAAASEVSPLQAAAWDDVDDWEVADGGEGTPRVVLGGVPSFQEATSATTELKHAIDKIYLSSNSSECDGCSLSGHVSVMSPSHSELENKSRVTEAILNPSESNRALQAFQLLSECPEAQSVVASIACDPNIWNAIVQNPALQDFFQSQQTADFEVEETHDQRLGNLPYSDSVYAFIDSLNVLQNVKFTVSEMLSRVPNYLQNMFGFLSGQTSSAVIDARGNTKANFIDPITMGGTFMGLAVLVVMVIMLKRA

SEQ ID NO: 22279 - protein, 600 aa, Cyanidium caldarium
MWIPLFITGFWNTNTSSSHLWKTKYTKGWTTPLYFSKVDKSFFAPRLASIQAVQGDLDNIAPQWNDSSLETTLPITTNERPAIPRQHFSHLGDTLDPSLMDSVKKRKQRAKEEPLCIVVIGASGDLAKKKTFPALFSLYYHDLLPKDFLIVGYARRQMTQEEFRNSIMESLTCRVIDGPQCQRKMDEFLPKCHYMSGMYDRTEDFVRLDQFLNNFEQSFPNTRVDRLYYLAVPSQVFENVVHHVHESGRTQRGWNRIVMEKPFGKDITSYLQLRNSLRNCISEDEIYRIDHYLGKELVQNLMVLRFANYLFEPLWNRDHIASIQIVFKENFGVEGRAGYFDEYGIIRDIMQNHLLQVMALLGMEQPVTLHAEDIRDEKVKFLRSIRPLKASDFVLGQYRDRQNPQRSYLSEPGVMNDSHTPTFAACVFQVDNRRWSGVPFLMKAGKALDERKAEIRIQFQSVPGGLFSQVVSSHLPHNELVIIVQPDEAIYMRILSKAPGFTSRLEEARLNLFYRTAWEDSKDIPDAYERLILDVIHGEKSLFIRDDELEVAWNIFTPSLKEMEMAQDSWKPILYDYGGRGPIESDYLAAKYAVQWSEGD

SEQ ID NO: 22280 - protein, 322 aa, Nocardioides sp. JS614
MNLPDLPRLHLVLAPTPLVHAPRLSEAVGVEVWFKRDDLTGRGLGGNKVRTLEYLLGDAVAKGCDALVTGAGPQSNWAMLAALSARTAGFSPHLVFYGDPPEASGNLLLTQVTCTDIRYTGELDRCSVDSMLGKVADELVAAGRFPYVVPRGGATPLGCLGYLRAAVELVRQLPEVGVDPATLWVPTGSGGTQAGLLAGAHWLGWDVAVVGVATSRTPEEAQVRVGELASATLELLDADDTARAAPHVLGGFLGDGYGEVSPAGTAAAELVARTEGIFLDPVFGAKAMAALLAEVRHGTVRGPVIFLVTGGAPTLFMKGTEL

SEQ ID NO: 22281 - protein, 569 aa, Oryza sativa Japonica Group
MAMQVGESVAPLSPQMIGNAFVQQYYNVLHSSPGQVCKFYHDSSTLGRPDSNGTMTSVTTLTAINDEFLSTDFSSCLIKLENVDAQLSLNGGVHILVTGSIGHNGTMRHRFSQSFFLAPQESGGYFVLNDMLRYDSLQETLLTETNDSPQERLLTEINDSLPNHVDDNTHSVTFTSEPETSGNVNETADLELPSAENVNDNVENLPANDSSPEENVLVEACTEVVSSCAENIPAAAPAPAPRASTQKDVTKQSYASVVKVTKEGTPTPPVAKPKPKPKPKPTAKVTDNVEKAVSSPVKPTNAADTTSPNDKNVLVEQGYSVYVKHLPYECTTKDVEEKFRKFGAIRPGGIQVRHRQPDGFCFGFVEFESRQSMLAAIEASPVSIGSKASIVEEKRTTTRVVNGVTHIENNGNARGGRFQQDNRGGGYRGDNFRGREAGFVNNGNYRDGDNMRNGFRNQNEYSGRGRGPQGNGYHQNGNGGGYHQNGNGYHQNGDGYHQNGNRYNQNGNRYHQNGDEYYQNGNGNGHRQNGSGYYHQNGNGYRQDRIFHNGNGNGRPARFNGPRQTPVQA

SEQ ID NO: 22282 - protein, 181 aa, Arabidopsis thaliana
  misc_feature (96)..(96): Xaa can be any naturally occurring amino acid
MASSMLSSAGVVTSPGQATMVAPFTGLKSSASFPVTRKGNKDITSITRNGGRVSCMKVWSPIGKKKVETLYYLPDLTDVQLGKEVDYLLRNEWIPXVGFEWEHGFVYREHGNTPGYYDGRCWTMWKLPLFGCTESAPELNEVEECKNEYPERFIRIIGFRQNPCSAAAIVSLAEKPPSIHG

SEQ ID NO: 22283 - protein, 439 aa, Silicibacter sp. TM1040
MDLSALKTIRIAACDLNGQMRGKRLPAGMAAKLGEGSARMPFSVLNVDIWGRDIEDSPLVFETGDADGILLPTKRGAVPMPWLATPSALVPMKMVHEDGRPFLGDPRQVLAHVLDRYAEKGWQVAAATELEFILVDDAGTEPLPPIDPLTGRALDQQSVLSIAELDAYDDFFTDLYDGAEAMGIPAQDAISEAGLGQFEINLTHQDAMRAADDTWLFKALVKGVARKHGFAATFMAKPYAEESGNGMHVHFSVVDKDGVNIFDNGGPEGTPALHAAVAGCINAMRDSSLVFAPHGNSYDRLVPGAHAPTSAAWAYENRTAAIRIPGGSPKARRIEHRVSGGDINPYLMLATVLGAALIGMEDGATPPPPSEGNIYDIDGLPQLAGSWAEAIDLFENSPLIARILPPMAIRNLVMTKRQELKGFAERPPESHWLSWLEAV

SEQ ID NO: 22284 - protein, 450 aa, Ashbya gossypii ATCC 10895
MGCSVSTQTLEDENDPFIQDRRANDAIEQNLHQEKQRGKNEVKLLLLGAGESGKSTVLKQLKLLHHGGFTHEERLQYSQVIWADAIQSMKILIIQARKMGISLDCDDPEKNRPLFECKRAVLQAKALDCIDPDMAGGPEFLNDYVLKYSERSENKRRVQSTGKAEAFTPESGAPSSGIDMQELSLGLNEQSGHMGPSGLFVRAQPAAQPLPKRTSNVQVAAAIRKLWDNDRGIRQCFARSNEFQLEDSAAYYFDNIEKFARPDYVCTDEDILRGRIKTTGITETRFNIGASKFNVLDAGGQRSERRKWIHCFQSITAVLFVLAVSEYDQMLFEDERVNRMQEAIMLFDTLLNSKWFYNTPFILFLNKVDLFEDKVKRSPIRQHFPDYPGRVGDAETGLKYFERIFLSLNRSKKPIYVHRTCATDTQSMKFVLSAVTDLIVQQNLKKSGIL

SEQ ID NO: 22285 - protein, 590 aa, Dunaliella bioculata
MLGGRQLGMDKLSRKLSGAQPVANYSRRPISRPFRAAPVPRVAQNSQDAVTQNGSGTSEAPTSWQNPALKKAIPTVVSLSDEAAAMAADDWSQSSLSVVVVGASGDLAKKKIFPALFALFYEGLLPPDFQLFGYARSKMTDEEFRDLIGNTLTCRIDARSRCEDSQAAFLSRCFYCPGQYDAPEGYANLDKKCKEQEALTGKMVANRMFFLSIPPNVFVQAAGGAADNCSSPTGWTRVIVEKPFGRDSASSAELGRGLARHLTEDQIYRIDHYLGKELIENLTVLRFSNLVFEPLWSRQYIRNVQVIFSEDFGTEGRGGYFDRYGIIRDVMQNHLLQIVALFAMEPPVSLDGEAIRNEKVKVLQSMSQVALEDVTLGQYRGRSGAGRSGGADLPGYLDDATVPKGSLCPTFAAIALHINNARWDGVPFLLKAGKALHTRGAEIRVQFRHVPGNIFKHKVGPNIDMTTNELVIRIQPRESIYLKINNKVPGLGMRLDTTKLDLVYNDAYSKELPDAYERLLLDVVNGDKRLFIRDDELEQAWNIFTPVLHEIERRKVAPELYPYGSRGPVGAHYLAAKYNVRWGDLTEDEI

SEQ ID NO: 22286 - protein, 154 aa, Brassica napus
MIARRIWRSHRFLRPFSSSSVCAPPLLAPYHSQWFASPTSRPFLVPSLSLMKWCEGGGGGSRSWFSNEAMSIDSDARGGFIDVPLAQTGEGIAECELLKWFVKEGDPVEEFQPLCEVQSDKATIEITSRFKGKVALISHAPGDIINVGETLVKL

SEQ ID NO: 22287 - protein, 421 aa, Brucella melitensis 16M
MRKTGPRPVTVNRACHLWRSIMAFLADALSRVKPSATIAVSQKARELKAKGKDVIVLGAGEPDFDTPENIKQAAIAAINRGETKYTPVSGIPQLRQAIVSKFKRENGLDYKPEQTIVGTGGKQILFNAFMATLNPGDEVIIAAPYWVSYPEMVAINGGTPVFVDTKIEDNFKLTAADLEKAITPKTKWLIFNSPSNPTGAAYTQAELKSLTDVLVRHPHVWILTDDMYEHLVYGDFVFTTPAQVEPSLYDRTLTMNGVSKAYAMTGWRIGYAAGPIELIKAMDMIQGQQTSGACSIAQWAAVEALNGTQDFIPANKKIFQARRDLVVSMLNQATGLQCPTPEGAFYVYPSCAGLIGKKTEAGKVIETDKDFVTELLETEGVAVVHGSAFGLGPNFRISYATSDELLEKACIRIQRFCASLR

SEQ ID NO: 22288 - protein, 390 aa, Physcomitrella patens subsp. patens
MESRINDSKRKRVVVVGGSIAGLCCAHSLLRSEWLEVLVFERARSVTAAGAGLGVGPRACDALRSWGLGDALESSSLPLSMEENRALDSKRNDPVVIKDETYDHRAVHWSDLHRLIHDALPAGIVRWSHEVVSFAELREANGEPRVRVKVSKLGGAENESNVEEIDADFMVSADGSMSQTREKFIPNESRRYSGYCAWRGVLETSSEHAQEVAETVKKAYPDLGKCLYFDIAEGTHAGLYELLKKRLNWLWYINQPEPQLKGKSVTLKADEKAIKELHEQAQRTWPPELAKLMQSTASPFINAIFDREPLGQFVWGRVVLVGEAAHPTTPHGLRSTNMSIDDAFVLGNAIAKWGPDQIEVALDEYQGERVPAATREVLFSRHLGKLKQGL

SEQ ID NO: 22289 - protein, 415 aa, Chlamydomonas reinhardtii
MAATMLRSSTQSGIAAKAGRKEAVSVRAVAQPQRQAGAASVFSSSSSGAAARRGVVAQATAVATPAAKPAAKTSQYELFTLTTWLLKEEMKGTIDGELATVISSVSLACKQIASLVNRAGISNLTGVAGNQNVQGEDQKKLDVVSNEVFKNCLASCGRTGVIASEEEDQPVAVEETYSGNYIVVFDPLDGSSNIDAGISVGSIFGIYEPSEECPIDAMDDPQKMMEQCVMNVCQPGSRLKCAGYCLYSSSTIMVLTIGNGVFGFTLDPLVGEFVLTHPNVQIPEVGKIYSFNEGNYGLWDDSVKAYMDSLKDPKKWDGKPYSARYIGSLVGDFHRTLLYGGIYGYPGDAKNKNGKLRLLYECAPMSFIAEQAGGLGSTGQERVLDVNPEKVHQRVPLFIGSKKEVEYLESFTKKH

SEQ ID NO: 22290 - protein, 216 aa, Brassica napus
  misc_feature (90)..(90): Xaa can be any naturally occurring amino acid
  misc_feature (96)..(96): Xaa can be any naturally occurring amino acid
  misc_feature (148)..(148): Xaa can be any naturally occurring amino acid
  misc_feature (152)..(154): Xaa can be any naturally occurring amino acid
  misc_feature (160)..(165): Xaa can be any naturally occurring amino acid
  misc_feature (167)..(168): Xaa can be any naturally occurring amino acid
  misc_feature (170)..(173): Xaa can be any naturally occurring amino acid
  misc_feature (175)..(175): Xaa can be any naturally occurring amino acid
  misc_feature (177)..(177): Xaa can be any naturally occurring amino acid
  misc_feature (181)..(182): Xaa can be any naturally occurring amino acid
  misc_feature (184)..(184): Xaa can be any naturally occurring amino acid
  misc_feature (186)..(186): Xaa can be any naturally occurring amino acid
  misc_feature (188)..(188): Xaa can be any naturally occurring amino acid
  misc_feature (192)..(192): Xaa can be any naturally occurring amino acid
  misc_feature (194)..(203): Xaa can be any naturally occurring amino acid
  misc_feature (205)..(206): Xaa can be any naturally occurring amino acid
  misc_feature (209)..(212): Xaa can be any naturally occurring amino acid
MKTNDFSSSTSPSDRRIGALFRHLTAGTDADRVSSVFASPTSGGAGGSVFAHLVQAPEDAILGVTIAYNKDPSPIKLNLGVGAYRTEEGXKPLVLXVVRKAEQQLINDRSRIKEYLPIGGLVEFNKLSAKLILGADSPAIRENRVTTXGGVXXXTGSLKXXXXXXFXXGXXXXKXNXKFPXXNXGXNXPKIXPXXXXXXXXXXTXXYDXXXXGGKG

SEQ ID NO: 22291 - protein, 345 aa, Rhodopseudomonas palustris CGA009
MSIKNDVVDAIGNTPLIKLKRASEATSCTILGKAEFMNPGQSVKDRAALFIIQDAVKRGTLRPGGVVVEGTAGNTGIGLALAANALGFRTVIVIPNTQSQEKKDMLRLCGAELIEVPAVPYANPNNYVKLSGRLAAQLAETEPNGAIWANQFDNVANRQAHIETTAPEIWNQTDGKVDGFVAAVGSGGTLAGVSIGLKQFNPKVRAVLADPLGSALYNYYKNGALKSEGSSITEGIGQGRVTANLEGAQIDDAYQIPDDEAVPLIYDLLEHEGLCLGGSSGINVAGAIRLAKDLGPGHTIVTILCDYGSRYQSKLFNPDFMRSKNLPVPDWMETKSTIQVPFEPV

SEQ ID NO: 22292 - protein, 299 aa, Methanosarcina acetivorans C2A
MELKRENVLIEALPYMQEFYDSIMVIKVGGNAMVSTQIMEDIIKDIVLLRYVGIKPVIVHGGGPEITEKMERMGKKAEFFQGLRITDDETMEIARMVLVGNINTKIVSLIGIFGGKGVGFTGYDGRMILGHKQAVKRVLVDGVETEVDIGWVGESEVINPEILHIMLEKSYIPVISPIAVDAKGNALNINADTVAGDIAAALKAKKLILMTDVSGLLRNIKDPSSRISRVNLDQIDSLIEEGIISGGMIPKIKGAAVAVKSGVERAHVINGSVSHSMLLELFTDGGVGTMLYGPDHPPV

SEQ ID NO: 22293 - protein, 421 aa, Ehrlichia ruminantium str. Gardel
MANVKINNISARQILDSRGYPTIEVQITLSNNVFAKASIPSGASVGKFEAVELRDHDTNYYHGYGVTKAVNLINSEIGQKIIKLETLDQEKIDNALIEIDGTNNKSRVGANSILAISLAVAKAAASTLNIPLYQYLGGITAKILPTPLINIINGGMHADNNLDFHEFMIIPHGANSFEDAIRMSSEVFHTLKKILKQKQYNTNVGDEGGFAPNIKDNTEVFDIIIDAIEKSGYKVYKDFSLGLDVAASTFYKNEKYKFSDYQFSTHELVEYYKNIVTQYPIISLEDPIAEEDTLGWKMITKELGDKIQIVGDDLFVTNCKLIKNGIDNNMANAVLIKPNQIGTLTETLNAIRLAQKNNYKVILSHRSGETNDTTISHIAVAVNCGQIKTGSLSRSERLAKYNELLYIEKLLNTSAIYQGML

SEQ ID NO: 22294 - protein, 211 aa, Methanosarcina mazei Go1
MGASRMTEIIDISLDITEDTVVMPENPEFDKERLASIGKEGYELYKICMSNHIGTHIDAPAHFVSEGALINQLDLDTLMGKALVVEIKDEHKISVDELKRVNLKDNIRLLFKTRNSELIAENKLTKDFVYIEEQAAGHLVKNGVKLIGLDYFTIDRIEDQDKPAHKEFAGNGVVVIEGVNLLNVEPGEYELVALPIKINADGAPARVILRR

SEQ ID NO: 22295 - protein, 138 aa, Shorea havilandii
EKNIPVLLGLLSIWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEVVSNHDELMSNFVAQPDALAFGKTPEELHK

SEQ ID NO: 22296 - protein, 268 aa, Methanosarcina barkeri str. Fusaro
MNSTNSGFLKLSREAFKAASDSICDLAGTDAAGSFVCMGADGTPTTRIDLAAEDAIVEVLKEDGRSMRIISEELGERILGDSPEFSVVLDPLDGTYNSSVGIPFYSVSLAVSSHDLSDLRFGYVSNLALREEYYAEAGKGAYLNGKKIKSSVNSELNKLCVSVYGYRQNIERTRKIYSNVRRVRLFGSVALELCYVASGRLDAFVDVRNALRVTDVAAGQLILAEAGGLVTDGYGNSLRLPDNVTTRVEMVASNGHVHDKLLKLLFGG

SEQ ID NO: 22297 - protein, 495 aa, Frankia sp. EAN1pec
MPGGGSDDVTRRPAVPRPLMTGGLPAVRRIGVVGTGYLGATHAVCMAELGYEVVGLDTDADKVRRLGAGEVPFFEPGLEELLRKNLEAGRLSFTCDPAEVAGWADVHFICVGTPQRAGDGAADMTYVDAAVETLIRAGLRPDALVVGKSTVPAGSAERLARRLAAGTGGTGPGGARTGEAAPGGTGTGRARTAQPAPGGVELAWNPEFLREGFAVDDTLRPDRLVFGVRPGGRGEAVLRAVYAPVIEAGTPVIVTDYATAELVKVAANAFLATKISFINAMSEVCDAAGGDVTSLARALSHDARIGGRFLRPGIGFGGGCLPKDIRAFHARAAELGAGPALGFLAEVDRINLRARERTVALITRALGGRAEGRRITVLGAAFKPNSDDIRDSPALEISAELHRAGARVVVYDPAAMANARRRFPELEYAPSAHEAATGADALAVLTEWTEFRDLDPDALTPRVAGRVVVDGRHALDGPAWRRAGWAYYALGRPPA

SEQ ID NO: 22298 - protein, 413 aa, Ashbya gossypii ATCC 10895
MSLLHHLVTLPSRPITRDAYLPQLQNLLRSGIPATYTLEQLAAYEKGDEEGPGDEDTNTTPLHIMARSLPEAGQLSEAESEVVLEIMDTLFQYGAGWNFLDYEQKHAGDLLLEKGYGPGDALYERLVEAGVAAELLLRKVNGGEIEFLDGSDTEMGDKGGSARDVPASADSAPADSAGHSSSEPTAVDADATAAHQDTYLQTELEYIPGALVTKHNRDGVMMDWETDIMRVAAASIVKNREPAECQVLNIGFGMGIIDGFLQEQRPTRHYICEAHPDVLARMRREGWYERPDVVILEGRWQDTLSRLLDDGTVFFDGIYYDTFSEHYTDMLELYDLVVGLIKPCGIFSFFNGLGADRQVCYDVYRRIVELDMATYGMTCEYTTIDLRQLPTWDNVRRSYFNCDHYYHPEISFQ

SEQ ID NO: 22299 - protein, 529 aa, Ashbya gossypii ATCC 10895
MSESLLQTVVAYVELVLHHFMALSWTQQLSIVIVAPFIYSLVWQTLYSFRKDRVPLVPFMVPWVGSALAYGRAPYEFFGKCQQKYGDVFAFMLLGRVMTVYLGTKGHEFILNAKLAEVSAEEAYTKLTTPVFGEGVVYDCPNHRLMEQKKFCKNALSTEAFRRYVPMVMDEVRKYLRTSKHFMMNERSSGVVNVMETQPEMTIFTASRSLLGAEMHSMLDADFAYLYADLDKGFTPLNFVFRDLPLDNYRRRDNAQRTISSTYMKVIERRRKNNDVQDRDLIDALMTSAQYKDGVKMTDQQIANLLIGVLMGGQHTSAATSAWVLLHLAERPDIQEELYEEQMRVLDGGAKELTYELLQEMPLLNQVIKETLRMHHPLHSLFRKVTRDMPVPNTSYVIPKDHYVLASPGFCHLSEEYFPNAKEFNPHRWDNDAASSVSTGEKVDYGFGAISKGVSSPYLPFGGGRHRCIGEGFAYMQLGTIFSVVVRSMKWHFPADMKGVPNPDFTSMVTLPSEPCRIAWERRVPDQII

SEQ ID NO: 22300 - protein, 419 aa, Oryza sativa Japonica Group
MENMRSENFNQGVSMEGVKHAPEMANTNRRALRDIKNIIGAPHQHMAVSKRGLLDKPAAKNQAGHRPMTRKFAATLANQPSSAPLAPIGSERQKRTADSAFHGPADMECTKITSDDLPLPMMSEMDEVMGSELKEIEMEDIEEAAPDIDSCDANNSLAVVEYVDEIYSFYRRSEGLSCVSPNYMLSQNDINEKMRGILIDWLIEVHYKLELLDETLFLTVNIIDRFLARENVVRKKLQLVGVTAMLLACKYEEVSVPVVEDLILICDRAYTRTDILEMERMIVNTLQFDMSVPTPYCFMRRFLKAAQSDKKLELMSFFIIELSLVEYEMLKFQPSMLAAAAIYTAQCTINGFKSWNKCCELHTKYSEEQLMECSKMMVELHQKAGHGKLTGVHRKYSTFRYGCAAKSEPAVFLLKSVAL

SEQ ID NO: 22301 - protein, 211 aa, Mycoplasma genitalium G37
MNDQKTTNTGLLTSTLKTKPKHNLKPSSEAIKKAVSKKEGHYKNKRFQKHNFNNKSEFEERIVKLKRISKTTKGGRNMRFSVLVVVGNKKGKVGYGIAKALEVPLAIKKAIKKAHNSIHTVEIHKGSIYHEVIGRKGASKVLLKPAPLGTGIIAGGAIRAIVELAGFSDIYTKNLGRNTPINMIHATMDGILKQLSPKKVALLRNKPISDL

SEQ ID NO: 22302 - protein, 189 aa, Zea mays
  misc_feature (2)..(3): Xaa can be any naturally occurring amino acid
  misc_feature (6)..(6): Xaa can be any naturally occurring amino acid
  misc_feature (11)..(11): Xaa can be any naturally occurring amino acid
  misc_feature (14)..(15): Xaa can be any naturally occurring amino acid
  misc_feature (17)..(18): Xaa can be any naturally occurring amino acid
  misc_feature (28)..(28): Xaa can be any naturally occurring amino acid
  misc_feature (42)..(42): Xaa can be any naturally occurring amino acid
  misc_feature (44)..(44): Xaa can be any naturally occurring amino acid
  misc_feature (46)..(46): Xaa can be any naturally occurring amino acid
  misc_feature (50)..(51): Xaa can be any naturally occurring amino acid
  misc_feature (53)..(53): Xaa can be any naturally occurring amino acid
  misc_feature (57)..(58): Xaa can be any naturally occurring amino acid
  misc_feature (70)..(70): Xaa can be any naturally occurring amino acid
  misc_feature (78)..(78): Xaa can be any naturally occurring amino acid
  misc_feature (98)..(98): Xaa can be any naturally occurring amino acid
  misc_feature (108)..(108): Xaa can be any naturally occurring amino acid
  misc_feature (113)..(113): Xaa can be any naturally occurring amino acid
  misc_feature (125)..(125): Xaa can be any naturally occurring amino acid
  misc_feature (134)..(134): Xaa can be any naturally occurring amino acid
FXXSIXDPFFXSAXXDXXAVSTFSLLKXVSTSPFGSDPEIPXRXRXWAKXXAXLGVXXGKPAKRVSRVSXQKSQTTLXRADAATFRQMVQQVTGAKYXGSPHGFFAPXVKRSXHRLASRLPPFWXLLMDPLRFXTLDTSSFLSNHHQETLVTELGSVSAPGSSTGVGGGSAVELDSYPSFPTLESWKVM

SEQ ID NO: 22303 - protein, 317 aa, Triticum aestivum
  misc_feature (267)..(267): Xaa can be any naturally occurring amino acid
  misc_feature (285)..(285): Xaa can be any naturally occurring amino acid
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAITATQKTVDGPSSKDWRGGRGRKPFNIIPSSTGAAKGWWERVLPELNGQLTGMPFRVPHWGCVSWLISLVRTEKAALYDDLKKAXIRAASEGKIQGGSLGYVXEELGSHRILPGNSGSSLFDAQGWNLLLNNNFR

SEQ ID NO: 22304 - protein, 248 aa, Mycoplasma genitalium G37
MIYLKSANEVAGIKKACAIFKAVKAYFTIEKLLGKKLVTIDRLIKQFIEQKQAKCAFHGYLGFPGFNCLSLNQTVIHGVADQTVFKDSDKLTLDIGIDYHGYLCDAAFTLLGNKADPKAVKLLNDVEQAFSKVIEPELFVNNPIGNLSNAIQTYFENKGYFLVKEFGGHGCGIKIHEDPLILNWGEKNQGVRLQEGMVICIEPMVMTDSSEITMAANNWNVLTLKSKFNCHVEQMYHITNNGFECLTN

SEQ ID NO: 22305 - protein, 352 aa, Chlamydomonas reinhardtii
MRWSKVFNTRKLAGSPLEAAKKIVVFGGGSFGTAMGCALARQKPDLEVVLLVRDPYLCKDINLLHENTRYLKGFKMPPNVRATTHAPEAIVGAQYAVHAVPVQSSRAFLQGIKEYLPSSVPIICVSKGLEVGSGQMMSELIPSALERKQPAVFLSGPSFAKEVMQNRPTGVVAACKDAKLARTVQALFASPTMRVNTTTDVVGVEICGALKNVLAIAAGIVEGMDLGHNALAALIAQGCSEIRWLAEKLGAKPTTMSGLSGLGDIMLTCYGDLSRNRSVGMRLGRGERLEDIIASSSQVAEGVATAGVVVGLARKYRVSLPVLTAVAQVLDNNLTAREAVFHIMNLPQIEEA

SEQ ID NO: 22306 - protein, 109 aa, Zea mays
  misc_feature (95)..(95): Xaa can be any naturally occurring amino acid
DKIVEIYLLSLPVKEHHILVTFLPLLRDYVMNITPVHNHTLSCQLTLFKAFVVVCYRDCHVGLDVKCSKEVATAILVAIILSKLSVVPVMKCYCXNNICQPYTVPCKVT

SEQ ID NO: 22307 - protein, 585 aa, Triticum aestivum
MTTYRVCCFLRRFRPASNEPSEAIGDVFEAYAGADGSGSALGEEALRRFLREVQGEAGDDDVEAAAREVLAFAAEHRLLKKGGGLTVEGFHRWLCSDANAALHPRRGVHHDMGLPLSHYFIYTGHNSYLTGNQLSSGCSEAPIAKALRDGVRVIELDLWPNAAKDDVEVLHGRTWTSPVDLMKCLETVKEHAFVSSPYPVILTLEDHLTPHLQAKVAKMIKETFGDLLHLSESEAMPVFPSPEDLRGKIIISTKPPKEYLETKSSKEEAQNGSAEESVWGDEIPDNKAQVATARQVSEKDTERYVEEDEEMEKKVQQGVNGEYKSLISISLTRRKHDMDQDLKVDPEKVSRMSLGEAAYEKATITHGSEIIKFTQRNLLRIFPKTTRITSSNYNPLMGWRYGAQMVAANMQGHGRKLWLTQGMFRANGGCGYVKKPDFLMNTDKMFDPRSKLPVKTRLKVTVYMGDGWRFDFRKTHFDKCSPPDFYARVGIAGVVADTMMKETKVIMDNWIPTWDHEFEFPLSVPELALLRVEVHESDNHQKDDFAGQTCLPVWELRSGIRSVRLYARDGEVLRSVKLLMRFEFS

SEQ ID NO: 22308 - protein, 490 aa, Physcomitrella patens subsp. patens
MESGENNFADGGGSIDLKKPLLSEGSSKPKHSHDRRHFLRSRKDVVLPNPAHAICSTLIVALGPLSLGFALGFTSPTQAAIIRDLNLTIAQFSTFGSILSVGCMLGAIVSGRLADYFGRKPALSVAVIPVLAGWSLIVFTFSRTCMVIYSEALMFSFRYGHFSFQVPMYIGEISPKHLRGTLGTMNQLAITIGVTLSYIVGMYFHWRTLALLGGIPGVLLVVGLLFIPESPRWLAKADRKEELQVCLQWLRGKEFNVSDEIQDIQAATEASNALPSVKWSDLKQRKLIQTLIVGVGLMVLQQFSGINAVMLYSSFIFTTAGVQNPGVATVALGILQVVMTLAAAGLIDKAGRRLLLMVSAGGMALSSFLVGFSFYLRMSLELATFIGYLALVSLLVYIAAFSLGVGAIPWIIMSEIFPAHVKGTAGSVATLVNWFCSSAVTLIFNSMLLWSSTGSFWIFAAECVGTMVFVALYVPETRGRTLEQIEASFK

SEQ ID NO: 22309 - protein, 155 aa, Methanosarcina mazei Go1
MAVWKGKKVVFHTTMGDITIELFEDMPITAGNFAKLVDQGFYDGVIFHRIIDKFMIQGGDPTGTGTGGPGYEIPDEFTKHNRNDKGTISMANAGPNTGGSQFFINLVNNNYLDKMHPVFGKVVEGMDVVDAMGKVKTDRQDRPKTEVKIIKAELV

SEQ ID NO: 22310 - protein, 138 aa, Shorea lumutensis
EKNIPVLLGLLSIWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEAVSNHDELMSNFFAQPDALAFGKTPEELHK

SEQ ID NO: 22311 - protein, 289 aa, Zea mays
  misc_feature (32)..(32): Xaa can be any naturally occurring amino acid
VPHHRLQSPNVPSPPLRRRHRCRAHPLRAASXAGDPNDERCLTHLHQSLSNPSGGLNWTKAAISAPCDGFFSHLQGVTCNNGRVYKLALPELSLGGTVPPELSNCTNLQSLDLSANALSGAIPTELSALLNLAVLNLSANALSGAIPRELASCAYLNVIDLHGNQLSGPIPDELGLLVRLSAFDVSHNRLSGPIPVLLANRTGAGTAAVGTARFNASSFVGNKGLYGYPLPPMRTRGLSVLAIAGIGLGSGLLSLVLSFSAVCLWLRATDRTATISGEEGKISQLMPDY

SEQ ID NO: 22312 - protein, 520 aa, Glycine max
  misc_feature (178)..(178): Xaa can be any naturally occurring amino acid
MASSSLFQSLPFSLQTSKPYAPPKPAVHFVVRAQSPLTQNNNSSSKHRRPADENIRDEARRINAPHDHHLFSAKYVPFNADSSSSSSTESYSLDEIVYRSQSGGLLDVQHDMDALKRFDGEYWRNLFDSRVGKTTWPYGSGVWSKKEWVLPEIHDDDIVSAFEGNSNLFWAERFGKQXFLGMNDLWVKHCGISHTGSFKDLGMTVLVSQVNRLRKMNRPVVGVGCASTGDTSAALSAYCASAAIPSIVFLPANKISLAQLVQPIANGAFVLSIDTDFDGCMQLIREVTAELPIYLANSLNSLRLEGQKTAAIEILQQFDWQVPDWVIVPGGNLGNIYAFYKGFKMCQELGLVDKIPRLVCAQAANADPLYLYFKSGWKEFKPVKSSTTFASAIQIGDPVSIDRAVHALKSCDGIVEEATEEELMDATAQADSTGMFICPHTGVALTALFKLRNSGVIKATDRTVVVSTAHGLKFTQSKIDYHSKDIKDMACRYANPPMQVKADFGSVMDVLKTYLQSKAH

SEQ ID NO: 22313 - protein, 428 aa, Methanosarcina mazei Go1
MSYIGLQQDSGEYKIQKIHAREILDSRGNPTVEVDVFTPKGFGRASVPSGASTGTNEALELRDADPNRYGGKGVLTAVKNVNTIIQKELLGLDVRNQREIDELMIELDETENKSNLGANAILGVSMAVAKAAADSLNIPLYRYFGGSNAFTLPVPTMNVLNGGKHAGNELAIQEFMIQPKGAETFYEALQIGAEIYQTLGKFLENKYGRSSTNVGYEGGYAPKMGESTEALDALVHAIEEAGYTESEVTIGLDAAATEFYEEEFYNIDGKKLAAPELLDYYVELVNSYPILSIEDPFYEEAFEDFEALTNELWDTIIVGDDLFVTNIERLSKGVDMGAANALLLKVNQIGSISEAFDAASMASRNGYTVIVSHRSAETEDTTISDLAVAIGAEMIKTGAPARGERTAKYNQLLRIEEDLGEVAHYVQL

SEQ ID NO: 22314 - protein, 563 aa, Arabidopsis thaliana
MRPKKRAGRRVFKETRHPVYRGIRRRNGDKWVCEVREPTHQRRIWLGTYPTADMAARAHDVAVLALRGRSACLNFADSAWRLPVPESNDPDVIRRVAAEAAEMFRPVDLESGITVLPCAGDDVDLGFGSGSGSGSGSEERNSSSYGFGDYEEVSTTMMRLAEGPLMSPPRSYMEDMTPTNVYTEEEIFYVRGIYVSFKIVDVSQALEVSLMLIIRSNSSHTSPDTGRVRYTRFEAKWQQFLICSSGFFFGYLVNGICEEYVYNRLKFSYGWYFTFAQGLVYIALIYMYGFRTKQMVNPWKTYVKLSGVLMGSHGLTKGSLAYLNYPAQIMFKSTKVLPVMVMGAFIPGLRRKYPVHEYISAMLLVIGLILFTLADAHTSPNFSIIGVMMISGALIMDAFLGNLQEAIFTMNPETTQMEMLFCSTVVGLPFLLAPMILTGELFTAWNSCAQHPYVYGVLVFEAMATFIGQVSVLSLIALFGAATTAMITTARKAVTLLLSYLIFTKPLTEQHGTGLLLIFMGIILKMVPDPNPNPKSSGSGQTPGKLERVKFEKEDDEESRPLV

SEQ ID NO: 22315 - protein, 333 aa, Debaryomyces hansenii CBS767
MAKGKNKTSEERANKAKTSNGHKSKQHHIRKGRQENGSQSQEDGEKFPVKLAMWDFDHCDPKRCSGKKLERLGLIKNLRVGQKFSGIVVSPNGKGVVCPDDREIVETFGSAVVECSWARLEEVPFNKIGGKHERLLPYLVAANPVNYGKPWRLNCVEAVAACFAIVGHTDWAELLLSNFSWGLTFLKINKELIDVYSKCTDSDSVESAQKEWLVKIENEAKERKELALKEDVWMMGNVNRENVDDTKEDDDEDDDDDDDEEEEEDDDDDDDEEDVEYDNLGNIILKKEVKVDSLGNLIDGDEDESSDELNEDESEEEIEEELYDKLGNLIIKS

SEQ ID NO: 22316 - protein, 873 aa, Ashbya gossypii ATCC 10895
MRTPRLPMKGNIAEVVLYRCSKTIKVNNYSNPRPVALDGRMMETTNTQKPLQWQTTPGEGSLEVHSPEQDRQRSISLSKFIPRSLKRNNSMNGSVESHVDAGDAEVDQEGQRASNGRQLGPGGEKRPEAGQLRGTGALPVILKENNKFASRLRSMFKASRELSQQEPNDVQQVSPEGKAEGTARHTPDGGMRVRSPSTPTFTVSRDPQPPTGQAAGTHEAIDIAPGRLQSPLMPSSHSAGGGITSKARGNRSNTVRGLNPYFAYQGLPPHAEPAHDGSQRSYDNSTFLTTPNTAQTSQTTLSYTNCSSNASAASLNDIEENEEVCSFQHTKKSPDILLQAIGCPVTPLTASESREETPLKSPVLRRVASQPTSLNKQEGQTRNNQQATDAGASLMAHQTLPVPVSCRSSSSSNMCAEASATARLEGGSPEHLELPPKRSQRLRAKSFGNKFREAVVGPQSFEKIRLLGQGDVGKVYLVREKKSDRLYALKIFGKAEMIKRKKIKRILAEQEILATSNHPFIVTLYHSFQTEDYLYLCMEYCMGGEFFRALQTRKTKCISEDDARFYASEVTAALEYLHLMGFIYRDLKPENILLHQSGHVMLSDFDLSVQAKGTRNPQVKGNAQSSLVDTKVCSDGFRTNSFVGTEEYIAPEVIRGNGHTASVDWWTLGILTYEMLFGFTPFKGDNTNQTFSNILKNDVYFPNNNDISRTCKDLIKKLLVKKESKRLGSKFGASEIKKHPFFKTVQWALLRNQEPPLIPVLTEDGYDFAKLSHKKDVKKAEKFGPSGDSTHKFKVAASIDSVEEQERIMFEEKVEHDDAVSDDDPFHDFNSMSLMKQDNNSLIYGDNNSYGKITYAPNQNRSRSNSHRSFFKR

SEQ ID NO: 22317 - protein, 92 aa, Zea mays
  misc_feature (13)..(13): Xaa can be any naturally occurring amino acid
VIKADDVVGPEVXKLVSALPNGNVVLLENVRFYKEEEKNDPEFAKKLASLADLYVNDAFGTAHRAHASTEGVTKFLKPSVAGFLLQKELDYL

SEQ ID NO: 22318 - protein, 551 aa, Frankia sp. EAN1pec
MRRSPHQSSTWTTDRRTLRGMALPASPQEPTPEPHSTAGRLARLQAVTDEAVHAGSQRAVDAQHAKGKMTARERIEAFLDPGSFVETDAFARHRSHDFAMDRNRPYGDGVVTGYGTVDGRQVCVFSQDFTVFGGSLGEVFGEKIVKIMDLALRTGVPVVGINDSGGARIQEGVVSLGLYGEIFYRNVMASGVVPQLSLIMGPCAGGAVYSPAITDFTLMVDQTSHMFITGPDVIKEVTGEDVGMEELGGATTHNSRSGVAHFQAADEADCLELARALLSYLPSNNMDEVPAYTEVADVEAEVDPELDTFIPDSPNTPYDMHHVIERILDEEDFLEVHAQFAQNMIVGFGRIDGRSVGVVANQPMQFAGTLDIDASEKAARFVRTCDAFNIPVLTFVDVPGFLPGTSQEWNGIIRRGAKLIYAYAEATVPKVTVITRKAYGGAYDVMGSKHLRADINLAWPTAEIAVMGARGAVNIIYRRELAGSEAPEQRRSELIQDYTDHFATPYIAAERGYLDAVIPPSVTRREVIRALRLLRTKRATLPPKKHGNIPL

SEQ ID NO: 22319 - protein, 389 aa, Ashbya gossypii ATCC 10895
MLSSAENTDRAYSAGSASLSAAQKSKKPPNTAFRQQRLKAWQPILSPQSILPLLILLSGAFAPIGIALIISANNVQNLVIDYSQCGKHATSEYTPIPENLVSYHFRTSMSEQPKWRLHSKNECELEFEIPNDISSSVYIYYKLTNFYQNHRKYVQSFDLDQLKGKAVAPDKLSDTCHPLSTKDGKAVYPCGLIANSMFNDTFTPVLRGVNGVPDYELSNRNIAWHTDRNRYKKTSYNPADIVPPPAWHDRFPDGYNDTNLPDISTWEEFQVWMRTAGLPRFYKLALKNERKHLLHGTYRIRIGLNYPVEIFGGTKSFVLTTNSIIGARNMSLGVAYLVVAGIALLFGIVFLAKLIIQPRKLGDHTYLNFEPHREPSTGVPLAPQLREML

SEQ ID NO: 22320 - protein, 425 aa, Magnetospirillum magnetotacticum MS-1
MTAIIDIHGREILDSRGNPTVEVDVVLETGVIGRAAVPSGASTGVHEACELRDGDKKRYLGKGVQKACDSVNGEIYDALSGMDVEDQILIDKTMIDLDGTPNKSRLGANAILGVSLAAAKAAAEESGLPLYRYVGGAFASILPVPMMNIINGGAHADNPIDIQEFMIMPVGASSCSEAIRMGAEVFHALKKTLKDAGHNTNVGDEGGFAPNLKSAEMALDFIMKSIETAGYKPGDDIMLALDCASSEFFKEGKYVMAGAKKTYDQKGLVKFYAKLVGSYPIISIEDGCAEDDLVGWELLTDALGAKVQLVGDDLFVTNPERLSMGIDKGLANSILVKVNQIGTLSETLEAVDMAHKAGYTAVMSHRSGETEDSTIADLAVATNCGQIKTGSLSRSDRIAKYNQLIRIEELLGSAARYAGQTIMKR

SEQ ID NO: 22321 - protein, 150 aa, Triticum aestivum
  misc_feature (63)..(63): Xaa can be any naturally occurring amino acid
  misc_feature (70)..(70): Xaa can be any naturally occurring amino acid
  misc_feature (74)..(74): Xaa can be any naturally occurring amino acid
  misc_feature (128)..(128): Xaa can be any naturally occurring amino acid
  misc_feature (139)..(139): Xaa can be any naturally occurring amino acid
MAEQTFIMIKPDGVQRGLIGEVISRFEKKGFYLKGLKLQNVEKSFAEQHYSDLSSKPSSAGLXVEYIVSXPVVXMAGKGKSVVATGTQVHLGATNPWALTRHIRGDFAVRHRQDSSMGTNQFRCQEGXAWWVPEGFKWXTTTQRFMRLVQ

SEQ ID NO: 22322 - protein, 514 aa, Escherichia coli
MADSQPLSGAPEGAEYLRAVLRAPVYEAAQVTPLQKMEKLSSRLDNVILVKREDRQPVHSFKLRGAYAMMAGLTEEQKAHGVITASAGNHAQGVAFSSARLGVKALIVMPTATADIKVDRLRGFGGEVLLHGANFDEAKRKAIELSQQQGFTWVPPFDHPMVIAGQGTLALELLQQDAHLDRVFVPVGGGGLAACVAVLIKQLMPQIKVIAVEAEDSACLKAALDAGHPVDLPRVGLFAEGVAVKRIGDETFRLCQEYLDDIITVDSDAICAAMKDLFEDVRAVAEPSGALALAGMKKYIALHNIRGERLAHILSGANVNFHGLRYVSERCELVEQREALLAVTIPEEKGSFLKFCQLLGGRSVTEFNYRFADAKNACIFVGVRLSRGLEERKEILQMLNDGGYSVVDLSDDEMAKLHVRYMVGGRPSHPLQERLYSFEFPESPGALLRFLNTLGTYWNISLFHYRSHGTDYGRVLAAFELGDHEPDFETRLNELGYDCHDETNNPAFRFFLAG

SEQ ID NO: 22323 - protein, 179 aa, Glycine max
  misc_feature (56)..(56): Xaa can be any naturally occurring amino acid
  misc_feature (111)..(111): Xaa can be any naturally occurring amino acid
  misc_feature (165)..(165): Xaa can be any naturally occurring amino acid
YKVIKDILSQNGFWWNPNTEMIECDSDEIWKNYVAAHPDAKGFHGKQIEIYDELKXVCGNYQAPSHWAKMKSGTQLMDMKNCDNESASFVSPNSEDMSGTDGTESYTATPXTRPDARWFSRASCTSYALQEALMTVASSIRHLVDAMEQSKCSFDACELLQAVMXIDGLEEGNNVAFEF

SEQ ID NO: 22324 - protein, 512 aa, Vitis vinifera
MIIIILISMNSGGEVGVQIQQGRGLPDFLQSVNLKYVKLGYHYLITHLLTLCLIPLMALIIVEASQKNPDDIHQLWLHLQYNLVSIIICSAFLVFGSTVYIMTRPRSIYLVDYACYRPPSHLQVRYHQFMEHSRLTGDFDESALEFQRKILERSGLGEETYVPEAMHYIPPQPSMAAAREEAEQVMFGSLDKLFANTNVKPKDIGILVVNCSLFNPTPSLSAMIVNKYKLRGNIRSFNLGGMGCSAGVIAVDLAKDMLQVHRNTYAVVVSTENITQNWYFGNKKSMLIPNCLFRVGGAAVLLSNKSGDRRRAKYKLVHLVRTHRGADDKAFRCVYQEQDDAGKTGVSLSKDLMAIAGGALKTNITTLGPLVLPISEQLLFFATLVAKKLFNAKVKPYIPDFKLAFEHFCIHAGGRAVIDELEKNLQLLPSHVEASRMTLHRFGNTSSSSIWYELSYIEAKGRMRKGNRVWQIAFGSGFKCNSAVWQALRNVNPSPNGPWEDCINKYPVEVVA

SEQ ID NO: 22325 - protein, 93 aa, Vitis vinifera
MEAQNNQHETQPASAAKAPVVTSCRKKKSDDATFLQDVKDHIDEFIHASMDEHKTCFTKTIKKMFGMSKVVAERNSNSEGVESSLPLQTTIAN

SEQ ID NO: 22326 - protein, 302 aa, Salmonella enterica subsp. enterica serovar Paratyphi A str.
MAALNSKVKKAVIPVAGLGTRMLPATKAIPKEMLPLVDKPLIQYVVNECIAAGITEIVLVTHSSKNSIENHFDTSFELEAMLEKRVKRQLLEEVQSICPPHVTIMQVRQGLAKGLGHAVLCAHPVVGNEPVAVILPDVILDEYESDLSQDNLAEMIRRFDETGNSQIMVEPVEDVTAYGVVDCKGVELAPGESVPIVGVVEKPKADVAPSNLAIVGRYVLSADIWALLAKTPPGAGDEIQLTDAIDMLIEKETVEAYHMKGKSHDCGNKLGYMQAFVEYGIRHNSLGAEFKAWLEEEMGIKK

SEQ ID NO: 22327 - protein, 277 aa, Geobacter sulfurreducens PCA
MPKGIALALGLNAVDPKHYGGWAGKLNACEADAEDMAAIAAERGFAVTTLMTKAATRAKVIDAIGKAAKALGKGDIFMLSYSGHGGQVPDTSNDEPDGVDETWCLFDGELIDDELYALLGKFAAGVRVLVFSDSCHSGTVVKMAYYNGTTAARSAGPDEGEIRYRAMPQSVAMRTYRANREFYDTIQQKTKKVDLADVKASILLISGCQDNQLSQDGAFNGAFTGQLLRVWKNGLYKGSYRSFHKAIVRRMPPDQTPNFFTAGTPDPAFLKQRPFTV

SEQ ID NO: 22328 - protein, 188 aa, Streptococcus pyogenes MGAS315
MILLIDNYDSFTYNLAQYLSEFDETIVLYNQDPNLYDMAKKADALVLSPGPGWPKEANQMPKLIQDFYQTKPILGVCLGHQAIAETLGGTLRLAKRVMHGRQSTIETQGPASLFGSLPQEITVMRYHSIVVDQLPKGFSVTARDCDDQEIMAFEHHTLPLFGLQFHPESIGTPDGMTMIANFIAAIPR

SEQ ID NO: 22329 - protein, 341 aa, Bordetella bronchiseptica RB50
MTTRYEDLRATLPRAPEKWLVTGCAGFIGSNLLETLLGLDQAVVGLDNFATGHQHNLDEVRAAVTPEQWARFTFIEGDIRDLAACQRAVQGVDRVLHQAALGSVPRSLKDPITTNEVNIGGFLNMLVAARDAQVQAFVYAASSSTYGDHPDLPKVEDRIGNPLSPYAVTKYVNELYADVFARSYGFSSVGLRYFNVFGKRQDPDGAYAAVIPKWTAAMIKGEDVVINGDGQTSRDFCFVENAVQANLLAAMAAPEGANQVYNVAYNARTTLTELFEHLRRALAGQGVSYEKAPVYAEFRAGDVRHSQADIGKAGKLLGYEPAYDILRGLEAAMPWYKQFLR

SEQ ID NO: 22330 - protein, 429 aa, Bordetella bronchiseptica RB50
MPKKFSNPADVHLAVVGLGYVGLPLAVEFGKKRPVIGFDINERRIAALKAGHDHTLEVEDDELAQAGQLSYTAEREELGKANVFIVTVPTPIDEYKQPDLTPLVKASETIGAVLKRGDIVIYESTVYPGATEEDCVPVLERVSGLKFNQDFYAGYSPERINPGDKAHRVNTIKKVTSGSTPEVAELVDQLYNEIITAGTHKASSIRVAEAAKVIENTQRDVNIALINELALIFNKMGIDTEAVLQAAGTKWNFLPFRPGLVGGHCIGVDPYYLTHKAQAIGYHPEIILAGRRLNDSMGGYVVSQLVKAMAKRRIHVEGARVLLMGLTFKENCPDLRNTRVVDIVRELGEYHVDVDVYDPWVDPAEAEHEYGITPVAKPAAGAYDAVILAVSHHQFVEMGAEAIRKFGKAEHILYDLKYVLPPEQADLRL

SEQ ID NO: 22331 - protein, 398 aa, Rhodopseudomonas palustris CGA009
MTNSPRTAAIIVAAGRGLRAGAGGPKQYRSLAGRPVIARAMEPFCTHPGVMAVQPVTNPDDTEMFNAAVAGLNFRPAVGGGATRQASVRAGLEALAELKPDIVLIHDAARCFVTPELISRAITAAGATGAALPVVPVTDTIKQVDSSGAVDATPDRASLRIAQTPQAFRFDVILDAHRRAASGGRDDFTDDAAIAEWAGLTVSTFEGDANNMKMTTPEDFAREESRLMAALGDIRTGTGYDVHAFGEGDHVWLCGLKVPHTRGFLAHSDGDVGLHALVDAILGALADGDIGSHFPPTDPQWKGAASDKFLKYAIDRVTARGGRVANLEVTMICERPKIGPLRDAMRQRIAEITGVPVSRVAVKATTSEKLGFTGREEGIAATASATIRLPWGADGLAG

SEQ ID NO: 22332 - protein, 297 aa, Oceanobacter sp. RED65
MDYPTIADFVGNTPLVKLQRLGRQSSNTILLKLEGNNPAGSVKDRPALSMITEAEARGDIQPGDNLIESTSGNTGIALAMAAAMKGYNMTLIMPDNLSMERRWAMEAYGAELILVTKDEGMEGARDLALKMQEEGKGKVLDQFGNQDNPLAHYKGTGPEIWRDTKGTITHFVSSMGTTGTIMGTSRYLKEQNPNIQIVGLQPKEGAAIPGIRRWPEAYLPKIFDATRVDQVLDIGQEEAEVTMRELAMKEGIFCGVSSGGSVAAALKLDEELENAVIVCIICDRGDRYLSTGVFSTE

SEQ ID NO: 22333 - protein, 167 aa, Klebsiella oxytoca
KHFSTTAPEKNLPVLLALIGIWYNNFFGAETEAILPYDQYMHRFAAYFQQGNMESNGKYVDRNGNAVDYQTGPIIWGEPGTNGQHAFYQLIHQGTKMVPCDFIAPAITQNPLSDHHPKLLSNFFAQTEALAFGKSREVVEQEYRDQGKDPAALEHVVPFKVFEGNRP

SEQ ID NO: 22334 - protein, 138 aa, Shorea seminis
EKNIPVLLGLLSIWNVSFLGYPARAILPYSQALEKFAPHIQQVSMESNGKGVSIDGMPLPYEAGEIDFGEPGTNGQHSFYQLIHQGRVIPCDFIGSAKSQQPIHLKGEVVSNHDELMSNFFAQPDALAFGKTPEELHK

SEQ ID NO: 22335 - protein, 458 aa, Methanosarcina mazei Go1
MLELYRTHVRGKMRKLEKTITLRRGLGLAICMLIGTGILALPGLALDAGSAHEAILGWFLIALIAVPLIQICARLGLKFPSTAGLAGYAEEAVGPWGGYAVSYLVGGSFFFGLPAVALIGSEYMKQLFSLTETGVALFAVLLVTLMFISNLAGMKAVSMINYAALAVLFLLTGLLIVFNLDFLGSGLELAGEVFRGSEKIDLNNVWKVSALLFWAFIGWENLSFSLGEIKEPEKNVPLLYWLSFALVTSIYIVLALISTGASASGVPLEGAAGLSGLVLFTPGGSHLIWLMVIVIAANACSWNFTASRLLYAGGRTGAFPDVFGKLSGKNIPVSSLVGLYVLSILLILGTYVFKIPVSAMMLLVNQNFVFLYAFIIIAYWKTETGWQKWVFSVLALLSLSFLVSGFTWKIIYPVFLIGLGYWRFLGRKNSEKTISSRKEHVIREETQEIPCLTRHQEQ

SEQ ID NO: 22336 - protein, 445 aa, Yersinia pestis CO92
MKLPDIARLTPRLQQQLTRPSAPPEGLRYRGPIVEIGPTLLRASLPNVAQGELCRIEPQGMLAEVVSIEQEMALLSPFASSDGLRCGQWVTPLGHMHRVQVGADLAGRILDGLGAPIDGGPPLTGQWRELDCPPPSPLTRQPVEQMLTTGIRAIDGILSCGEGQRIGIFAAAGVGKSTLLSMLCADSAADVMVLALIGERGREVREFLEQVLTPEARARTVVVVATSDRPALERLKGLSTATTVAEYFRERGLKVLLLADSLTRYARAAREIGLAAGEPPAAGSFPPSVFANLPRLLERTGNSDRGSITAFYTVLVEGDDMNEPVADEVRSLLDGHIVLSRRLAGAGHYPAIDIAASVSRIMPQIVSAGQLAMAQKLRRMLACYQEIELLVQIGEYQAGEDLQADEALQRYPAICAFLQQDHSLTRDPDTAHLDTTLEHLAQVVG

SEQ ID NO: 22337 - protein, 238 aa, Oryza sativa Japonica Group
MFIRMRAASTTSSSEPCRRLSPPSSKRPAGRTKFHETRHPVFRGVRRRGRAGRWVCEVRVPGRRGCRLWLGTFDAADAAARAHDAAMLALRGRAAACLNFADSAWLLAVPPPATLRCAADVQRAVARALEDFEQRESSSSVFPLAIDVVAEDAMSATSEPSAASDDDAVTSSSSTTDADEEASPFELDVVSDMGWSLYYASLAEGLLMEPPASGASSDDDDDAIVDSSDIADVSLWSY

SEQ ID NO: 22338 - protein, 223 aa, Leifsonia xyli subsp. xyli str. CTCB07
MLGGSAHGGPVFGGVQAPGARYILPSFEERTAYGYKRQDPYAKLFEDRIIFLGVQVDDASADDIMAQLLVLESQDPDRDIVMYINSPGGSFTAMTAIYDTMQYVRPQIQTVVLGQAASAAAVLTAAGAPGKRLALPNARILIHQPAVGEAGHGQASDILIQSNEINRMRAWLEETLVKHSSRTLEQVNKDIERDNILSATEALKYGLIDQVLTSRKTLPALVK

SEQ ID NO: 22339 - protein, 446 aa, Oryza sativa
  misc_feature (181)..(181): Xaa can be any naturally occurring amino acid
MAATIQSVKARQIFDSRGNPTVEVDICCSDGTFARAAVPSGASTGVYEALELRDGGSDYLGKGVLKAVDNVNSIIGPALIGKDPTEQTVIDNFMVQQLDGTKNEWGWCKQKLGANAILAVSLALCKAGAIIKKIPLYQHIANLAGNKQLVLPVPAFNVINGGSHAGNKLAMQEFMILPTGXASSFKEAMKMGVEVYHNLKSVIKKKYGQDATNVGDEGGFAPNIQENKEGLELLKTAIEKAGYTGKVVIGMDVAASEFYTEDQTYDLNFKEENNDGSQKISGDSLKNVYKSFVSEYPIVSIEDPFDQDDWVHYAKMTEEIGDQVQIVGDDLLVTNPTRVAKAIKDKACNALLLKVNQIGSVTESIEAVKMSKRAGWGVMTSHRSGETEDTFIADLAVGLSTGQIKTGAPCRSERLAKYNQLLRIEEELGAAAVYAGAKFRAPVEPY

SEQ ID NO: 22340 - protein, 466 aa, Aspergillus oryzae
MSSKSRWADEDPEAEAINAQRKREKEEKRRAKAEKQRQLEQQAEEAARQREAANNDTEAPPKKRRRLSNDPDTTADVQVGSAKPQENTSNILQFPTQEWGPSRHVDNFERLNHIEEGSYGWVSRAKDITTGEIVALKKLKMDNSPDGFPVTGLREIQTLLEARHPNIVLLREIVIGNKMDDVFLVMDFLEHDLKTLLDDMREPFLPSEIKTLLSQVLSGLDFLHSQWIMHRDLKTSNLLMNNRGEIKIADFGMARYYGDPPPKLTQLVVTLWYRSPELLLGAEKYGTEIDMWSIGCIFGELLTKEPLLQGKNEVDQVSKIFALTGPPTPQTWPGFRSLPNAKSLRLPQTSAPSGNPPLLPRSKFPFLTNAGLQLLSSLLALNPSSRPTTQECLSHPYFREDPRPKPKEMFPTFPSKAGMEKRRRRQTPEAPKRGQEAPRLDFASVFGGQSSGDGGETGAGFTLRLG

SEQ ID NO: 22341 - protein, 85 aa, Brassica napus
  misc_feature (66)..(66): Xaa can be any naturally occurring amino acid
  misc_feature (68)..(69): Xaa can be any naturally occurring amino acid
LLYVEGCSLLTTSGLESVILQWHELEHLKVVSCKNVKDSEISPLMSALFSDLVELQWRPDTRSHLXSXXAGAGIGGKGAKFFKKT

SEQ ID NO: 22342 - protein, 103 aa, Debaryomyces hansenii CBS767
MVAAITSKQEFTDALSHDGLVVVDFFATWCGPCKMIAPLLDKFSAEYNQAKFIKVDVDEFGEIAQEYEVSSMPTVIFFKGGEVVNKVIGANPGALKQVISANA

SEQ ID NO: 22343 - protein, 320 aa, Ashbya gossypii ATCC 10895
MSEEVPPPPPAEYQAPESYGNEPYGGHREQEGEYSTTRLHVKPFPPDVEEHELDEIFSPYGALKEVKLMSGFAFVEFEKPESAEQAIKDVNGKMFADMPLTVSYSRMPMPRFRIKIRNLPEGIAWQELKDLARENNLETTFLSVDTSNFDGTGALEFSSEEILEEALEKLNNYEFRGNVLAVERDDNPPPINRRLGMRGGFRGRGGFRGRGYPPRGGYGFPPRGGYGSRGGYARGSYGAPRGSYGGPRGGYGAPRGSYGGPRGGYGPPRGTYGGPRGGYGGPRGGYGSYGAPRGGGYGARDTYAPRGDSYSTRERSPVRE

SEQ ID NO: 22344 - protein, 414 aa, Zea mays
  misc_feature (325)..(325): Xaa can be any naturally occurring amino acid
  misc_feature (341)..(341): Xaa can be any naturally occurring amino acid
  misc_feature (346)..(346): Xaa can be any naturally occurring amino acid
  misc_feature (364)..(364): Xaa can be any naturally occurring amino acid
  misc_feature (381)..(381): Xaa can be any naturally occurring amino acid
MRWPGDSDAAASREAQSRTRGELKGAGTVAGDLGHRELHDRGILSWERGNHGWSRRGAGRWRPERRAEGRVKLKEPGRSAPSSPQREFGCARVMARRRDGVQTSAPDGVCVGERNGQGRHPVRSGQILLCTPLEERERFFLLSGYLTSSPWSSQVDAFTAEPFKGNPAAVCLLEDAAKAADERWMQSVAAEFNISETAFLLREKSSAAGAVPLFQLRWFTPVAEVELCGHATLASAHFLFTSVLAEHEKLVEFSTKSGILTAKKVPAPQSTGVSGEGKLFIELDFPTIDLVDCHPSELPAIPDTLNGASIVSVHKSTTAGDLIVXELSSGKEVADIIPNIXEIEKXSSKGIIVTRPRPCWIGLXFLRDFVWPKFECNEDSXLGERKMGFKNLIGGRNWGKNKWIAFTASPRKWI

SEQ ID NO: 22345 - protein, 188 aa, Amphibacillus xylanus
MSLIGTEVQPFRAQAFQSGKDFFEVTEADLKGKWSIVVFYPADFSFVCPTELEDVQKEYAELKKLGVEVYSVSTDTHFVHKAWHENSPAVGSIEYIMIGDPSQTISRQFDVLNEETGLADRGTFIIDPDGVIQAIEINADGIGRDASTLINKVKAAQYVRENPGEVCPAKWEEGGETLKPSLDIVGKI

SEQ ID NO: 22346 - protein, 526 aa, Vitis vinifera
MIMRALEIRRNVTVEIFKEAMRKGKFGITYSNNLVSRLPDFIDYVMIEAASMKQLPEFSHSTFNTRAKTVIHDSNVVPLIRWLKHNSLSYPRIGKLICMSMGNLETIRGLVEWLKTIHVRGEFLGFVIMKAGGDILERSIEELDDIVRYLENNGVRRDWMGNVMSRCPQLLSYSIEEVKTRVGFYLDMGMNEKDFGTMVFDYPKALGYFTLEEMNEKVSYLKEFGLNNEDVGRLLAFKPQLMGCSIEERWKPFVKYLYYLGVCREGMRRMLIIKPMVFCVDLEKTIVPKVRFFQDIGIRDDAIGNMLVKFPPLLTYSLYKKIRPVVIFLITKAGVSRKDIAKVIALGPELLGCSIVHKLEVNVKYFLSLGIPLQILGEMIADFPMLLRYNIDVLRPKYRYLRRTMVRPLKDLIEFPRFFSYSLDDRIIPRHKALVENRVNFKLRYMLAISDEEFARRVEAAVERRSRFESGLMSSTLSDSQTTNDSLENRTLVDFCGREVAFSECQTSENQVSSSKNEDAQSFSSE

SEQ ID NO: 22347 - protein, 348 aa, Nocardioides sp. JS614
MSRVAINGLGRIGRAALKLLLEFDDLDVVAVNDLADIENLAYLIRYDTVYGRYHREVACEADALIIDGREIRVLAEADPANLPWRDLNVDLVLECTGVFRHEDDLRRHIQAGASFVVLSAPTTSEAVPTVVHGVNAAHGDARVISCASCTTNCITPIVEVARRRLAAERAVMTTVHAYTATQHLVDGPSKTFRQGRAGAVNLVPASTGAARATISAVPQLAGRFDGIAIRVPIPVGSIADIVFVAGRSTTADEVNEVFRHEALTSRYQGILGVSEDPLVSADIIGDSRAAVLDTALTRVVDGTLVKVMAWYDNEWGFTNQMIREVRAMLGLRPSPTRPGARPVTGSHA

SEQ ID NO: 22348 - protein, 518 aa, Lotus japonicus
MLVEIALALLALALFLQFRPTPTAKSKALRHLPNPPSPKPRLPFVGHLHLLDQPLLHNSLIKLGEKYGPLYTLYFGSMPTVVASTPELFKLFLQTHEATSFSTRFQTSAIRRLTYDNSVAMVPFAPYWKFIRKVIMNDLLNATTVNKLRPLRSQEIRKVLKAMAQSAESQKPLNVTEELLKWTNSTISRMMLGEAEHVKDIVREVLKIFGEYSLTDFIWPLKKLRVGQYEKRIDEIFNKFDPVIEKVIKKRQEIIKRRKERNGELEEGEQSVVFLDTLLEYAADENMEIKITKEQIKGLVVDFFSAGTDSTAVATDWALAELINNPRVLKKAREEVDSVVGKDRLVDESDIQNLPYIRAIVKETFRMHPPLPVVKRKCVQECELNGYVIPEGALVLFNVWAVQRDPKYWKTPLEFRPERFLEEADIDLKGQHFELLPFGSGRRMCPGVNLATAGMATLLSSVIQCFELQVVGPKGQILKGSDAKANMEERAGLTVPRANSLMCVPLARSKVAAELLSS

SEQ ID NO: 22349 - protein, 134 aa, Pisum sativum
AMGLAPHTDPGGMTILLPDDFVSGLQVRKGNDWITVKPVPNAFIINIGDQIQVMSNAIYKSVEHRVIVNPTQDRVSLAMFYNPKSDLIIQPAKELVTKERPALYPPMTYDEYRLYIRMKGPCGKAQVESLASQI

SEQ ID NO: 22350 - protein, 393 aa, Prochlorococcus marinus str. MIT 9211
MSKSHLISERTQELQLSLTLEISARAKLLKKEGKDICSLSAGEPDFDTPNYIVNAAIEALRNGITRYGPAAGDPELREAIAQKLTTSNNVPSKAENILITNGGKQAIFNLFQIILNPGDEVLIPSPYWLSYPEIAKLAGAIPVPLHTSPKDGFKLSSEKLEEKITNRTKLLILNSPCNPTGRVIQKEELISIAEVLRRNKQLLVMTDEIYEYLISENESHHSLAAIAPDLRERIFIVNGFAKAWAMTGWRIGYLAGPKEFIKTAIALQSQSTSNVCSFAQRGALAALLGPKESIKTMSRSYNERREILTKGLNSINGISLIPQKGAFYAFPELAPSLPNSLSFCKLALEKVGLAIIPGIAFGEDRCVRLSCAVSEDTIKEGIARLEKLITQLI

SEQ ID NO: 22351 - protein, 243 aa, Arabidopsis thaliana
MQTIIISPLVSHRLCLARAVPCNRLLNNHHRAPPSIRLSNHRSTTSLRLFSSAAASRDSEMATEDVQDPRIAKIASSIRVIPDFPKPGIMFQDITTLLLDTEAFKDTIALFVDRYKDKGISVVAGVEARGFIFGPPIALAIGAKFVPMRKPKKLPGKVISEEYSLEYGTDTIEMHVGAVEPGERAIIIDDLIATGGTLAAAIRLLERVGVKIVECACVIELPELKGKEKLGETSLFVLVKSAA

SEQ ID NO: 22352 - protein, 135 aa, Triticum aestivum
RRRRRATRLVQTRERAGRPRAEFGTRGTFILVYTVFSATDPKRTARDSFIPVRVPLPIGFAVFVVHLATIPITGTGINPARSLGAAVVHAAWKDHWIFWVGPLIGATVAALYHKLVLRGEAVKALGSFRSTSATV

SEQ ID NO: 22353 - protein, 312 aa, Vitis vinifera
MEKSYEPANGNGFTDNGHRTMRYSPYQPCIKVSLSWLDIRVFYVRVSKCEIDDSTPEYLTLNHIPLNRDTLLEVNGVRSSIYSDGVSTLLRRDRLDKKSEEATFVSTDSVRMTGSVKFEVFDKDVLVLYGVLEMSNSNGCTGKSKNIGQRWSMTCELDIVPGTSFLKGKQYMGGPESASPAIEVYIAGCFSATPIILTKTLQLTLRKKQIRKGMLDSIPEYDATECQKDETAGLSLQISEHPNYKPENEDYNSLYSGTEYLEGEDGELSWFTAGVRVGVGIGLSICLGIGIGVGLLVRTYQGTTNNFRRRLL

SEQ ID NO: 22354 - protein, 499 aa, Lotus japonicus
MDIISFLYYSLFYVALFAIIKLFLGSRKFKNLPPGPTSLPIIGNLHHLKRPLHRTFRALSEKYGDVFSLWFGNRLVVVVSSFADVQECFTKNDVVLANRPRFLSGKYIFYNYTTLGSTSYGEHWRNLRRITSLDVLSNHRINSFSPIRRDETTRLIRKLAEDSAKNFSEVELTSRFFDMTFNNIMRMISGKRYYGEDCDMTELQEASEFRDMVTELLQLSGANNKADFMPILRLVDFEGLEKRVKGISSKTDRFLRGLLQEHRDKKQRTANTMIDHLLTLQESQPEYYTDQIIKGLALAMLLAGTDSSAVTLEWSMCNVLNYPEVLEKIKAELDTHVGQDRLVDESDIPKLTYLKNVINETLRLYTPAPLLLPHSASDDCTIGGYKVPRDTIVLINAWALHRDPQLWTEATTFKPERFDKKGELEKLIPFGLGRRACPGELLAIRAISMTLALLIQCFDWKRVSDEEIDMGERDGFVLMKSIPVKAMCKSRPVINNVFK

SEQ ID NO: 22355 - protein, 493 aa, Cytophaga hutchinsonii ATCC 33406
MEFGRELPGKRDPQARLKDYKELYLDFSATQIKNQAARCMNCGVPFCHSGCPLGNIIPEFNDAVYRNDWEEAAEILFSTNNFPEFTGRICPAPCEASCVLGINKPPVTIENIEKSIVETAFEKGILKPNPPKKRTGKTVAVVGSGPAGLAAAAQLNSAGHTVTVFERADQVGGLLRYGIPDFKLEKWVIDRRVKLMEEEGVIFKTNTNVGVTVKAKDIVKEFDAVVLTGGSTVGRDLPIPGRQFKGVHFAMEFLSQQNKRVANIKPEIDHTGEAYKNGDLLATAKNVVVIGGGDTGSDCVGTSNRHGAKSVLQFELMPKPPENKNETTPWPNWPMILRTSTSHEEGCDRLWSITTKEFIGDADGNLTGLKIAEMGWVTAPDSKLPKYQELPGTERVIPCELTLLAMGFLHPQHAGMLNELGVEYDERGNIKANGKYQTNVDKVFTAGDMRRGQSLVVWAISEGREAARNVDIFLMGTTSLEAKDHGMLDTVYA

SEQ ID NO: 22356 - protein, 131 aa, Pseudoalteromonas tunicata D2
MLLNQFKGGCHCGAIRFVVSAAVDAQIEDCNCSICTKSGFLHLIVPNAQFELQTDKELLSTYTFNTGVAQHYFCKTCGIKPFYIPRSNPDGIDVNVRCLDEYPVSTMQVVPFDGQNWEQHAHTLSHKTKKP

SEQ ID NO: 22357 - protein, 748 aa, Vibrio angustum S14
MLTQLREIVDKVVSAQTLIEALDQLVMSTCQAMKTDCCSVYIANHERQLYTLMATQGLHKSQRRVSLRFNQGLVGLVGRSAELVNVADARVHPHFKHLPGIGEESFRSFFGTPIIHQRQVLGVLVVQQREKREFNESEESFLVTLAAQLSGILAHAKAQGMWFDQGNKLHLTGSAASAGVAVAKAWWDDTQPLLEHVAPTSCLDVNFEQERLTIAIEAASTEFRRLRKRFDSELQKETLAIFDLFSHLLNDPMLRKDLKARIACGDQAEWAVRQVVESYSARFANMKDQYLKERAQDIRELGQRLLFFLRDEEVDELQWDEPVVLLTRELTAAMLATVPLGKLAAVVAQEGAANSHAAILSRALGIPAIMGVDFVPHMVHNNLVIVDGYRGDFLVNPNRHVLIEYRRLLREEQELAKTVEGDLDKEAYTKDNQRIMVHLNAGLSADTSIAVNKGVDGVGLYRTEVPFLLQRSFPSEDEQINQYRSILQTYPDQTVVMRTLDIGGDKPLPYLTIEEDNPFLGWRGIRFTLDHPEIFLIQVRAMLRASIGLNNMDILLPMISGIAELDEAKILIERAYQEVAAQYDGELRKPRLGIMIEVPSMLYQLHALADKVDFISVGSNDLTQYLLAVDRNNSRVANVYDALHPAVLNALKHIIDSAERYQIPVCVCGELAGDPIGAILLVGMGYRSLSMNTRNVAKIKYILRHVSALDMAQLADDVLAVHLSCEVRDRTTLFVEQHGLGGFIRAGK

SEQ ID NO: 22358 - protein, 450 aa, Escherichia coli O157:H7 EDL933
MNAFRQEIIMNKYQAVIIGFGKAGKTLAVTLAKAGWRVALIEQSNAMYGGTCINIGCIPTKTLVHDAQQHTDFVRAIQRKNEVVNFLRNKNFHNLADMPNIDVINGQAEFINNHSLRVHRPEGNLEIHGEKIFINTGAQTVVPPIPGITTTPGVYDSTGLLNLKELPGHLGILGGGYIGVEFASMFANFGSKVTILEAASLFLPREERDIADNIATILRDQGVDIILNAHVERISHHENQVQVHSEHAQLAVDALLIASGRQPATASLHPENAGIAVNERGAIVVDKRLHTTADNIWAMGDVTGGLQFTYISLDDYRIVRDELLGEGKRSTDDRKNVPYSVFMTPPLSRVGMTEEQARESGADIQVVTLPVAAIPRARVMNDTRGVLKAIVDNKTQRILGASLLCVDSHEMINIVKMVMDAGLPYSILRDQIFTHPSMSESLNDLFSLVK

SEQ ID NO: 22359 - protein, 243 aa, Chlamydomonas reinhardtii
MPKRTTLTFTSEDGPRVDSAKLYVYHCKYSGRHAFTIDADLKKMPRRRTDGAYIVDTNEHTIKLYTTDGGLKYIKRQNGAIEKQYRQNLGQLPIAYKSDLTSPLLYILDNAVTTFSNQNARRAGKLLVPPCITRSDKTGLVEMRIELDERSHRCCLSRVTADVVRVHVTGLMAGDAVHEELFDLISKVLNVRLSQLDIRRAKHNRNRIMTVEGLTPEQVFERLREQLKKQSTAREEKRQRRHG

SEQ ID NO: 22360 - protein, 466 aa, Nostoc punctiforme PCC 73102
MSSTTVRRKSNTFYVILIAGAAALGGFLFGFDTAVINGAVLSLAKAFNTSSWVTGLAVSLALLGSAVGAFFAGQIADRYGRVKAMVVASVLFTISAIGSGMAFTIWDFIFWRVLGGIGIGVASVIAPAYIAECSPTHLRGRLGSLQQLAIVVGIFVALLSDYFIATSAGSADSPFLFGVAAWRWMFWTAVPPAVFYGMVALTIPESPRYLVAKGRESEAVNVLTKILGGDVLPKIEEIRQTVLRERQPKFSDLLSRSGGLLPIVWIGIGLSVLQQFVGINVIFYYSSVLWRAVGFSEKDSLSITVITGAVNIITTLIAIAFVDKFGRKPLLIIGSIGMTLTLGTMAYIFGNAPLDAAGNPSLAGSAGTVALIAANLYVFCFGFSWGPIVWVLLGEMFNNKIRAAALSVAAAIQWVANFLISTTFPPILQYFGLGSAYGLYTIAAATSFFFILFFIKETKGIELEDM

SEQ ID NO: 22361 - protein, 504 aa, Bordetella bronchiseptica RB50
MANQTAQVAHWIGGQAAYGAEHGLQDIHDPATGEVAAQVGLGGGDTVAQAVAAARAAQPAWAAKSPLHRARVLNRFLALLEDNKETLARMISREHGKVISDARGEVMRGIEVVEFACGAPELMKGAMSINVGGGIDNWVQREPLGVVAGITPFNFPVMVPLWMMPMALATGNAFVLKPSPLDASPSLALAEMLGQAGLPAGVASVVQGGVQAVNALIDHPDVKAVSFVGSTAVARQIYERSAREGKRVQALGGAKNHLVVMPDADPEGAADALVGAAFGSAGERCMAISVAVFVGGAAEAVMPHILRKARALKVRRGMQEDAEMGAIVSAAARDRIAAYIASGVDEGASLLLDGREIAAADCGEGCGNGYWLGPTVFDRVQPSMRIYREEIFGPVLACVHVETLEQAIDLINGHDFANGVSLYTDSGTAARAFVQGIEVGMVGVNVPIPVPAAWQGFGGWKQSLFGDLHVYGEEGVRFYTRQKSVMQRWAAKAAGMSFAMPRSG

SEQ ID NO: 22362 - protein, 440 aa, Zymomonas mobilis
MSIEVKMPALSPTMTEGTLAKWLVKEGDAVKAGDILAEIETDKAIMEFETVDAGIIAKILVPEGSENIAVGQVIAVMAEAGEDVSQVAASASSQISEPSEKADVAQKETADSETISIDASLDKAISNAGYGNKTENMTASYQEKAGRIKASPLAKRLAKKNHVDLKQVSGSGPHGRIIKADIEAFVTGANQASSNPSVSTPEVSGKITHDTPHNSIKLSNMRRVIARRLTESKQNIPHIYLTVDVQMDALLKLRSELNESLAVQNIKISVNDMLIKAQALALKATPNVNVAFDGDQMLQFSQADISVAVSVEGGLITPILKQADTKSLSALSVEMKELIARAREGRLQPQEYQGGTSSISNMGMFGIKQFNAVINPPQASILAIGSGERRPWVIDDAITIATVATITGSFDHRVIDGADAAAFMSAFKHLVEKPLGILAQ

SEQ ID NO: 22363 - protein, 319 aa, Burkholderia mallei ATCC 23344
MPLNPKIAQVLDMIERAKRPDYHEQTPAQARAAYEKSAPILDVAPAPMFSVEDLRVPSRDGGAFGARLYLPVEPSLAEPLPVLVYYHGGGFTVGSVNTHDALCRMFARDAQCAVLSVDYRLAPEHKFPTAVDDAEDALVWLHAHASRFGIDSARLAVGGDSAGGTLATVCAVLARDRGIALALQLLIYPGTVGHQQTESHARLAKGYLLSADTIQWFFGHYVRDASDRDDWRFAPLDGTRGAPSFERVAPAWIATAQYDPLSDEGEAYADKLRAAGNRVTLVAYAGMIHEFFKMGGYVPEVRLAHADAVGALRAAFDGD

SEQ ID NO: 22364 - protein, 138 aa, Shorea isoptera
EKNIPVLLGLLSIWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEVVSNHNELMSNFFAQPDALAFGKTPEELHK

SEQ ID NO: 22365 - protein, 282 aa, Streptococcus pyogenes SSI-1
MGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGAAPGQWIVIFGAGGLGNLAVQYAKKVFNAHVVAVDINNDKLELAKEVGADIVVNGKEIEDVPGYIQEKTGGAHGVVVTAVSKVAFNQAIDSVRAGGTVVAVGLPSEYMELSIVKTVLDGIKVVGSLVGTRKDLEEAFAFGAEGLVVPVVEKVPVDTAPEVFDEMERGLIQGRKVLDFIS

SEQ ID NO: 22366 - protein, 535 aa, Oceanobacter sp. RED65
MPVIKSKINVNAESFQQNAQHTQHIVSDLRNLIQRISLGGGEAAQARHKSRGKLLARERIAELLDEGSPFLEVGQLAAHEVYGEEVPCAGVVAGVGKVSGVECMIVANDATVKGGSYYPLTVKKHLRAQEIAQKNYLPCIYMVDSGGANLPRQDEVFPDRDHFGRIFYNQANMSAMGIPQIAVVMGSCTAGGAYVPAMADESIIVKEQGTIFLAGPPLVQMATGEQVDAETLGGGDMHTSTSGVADHLAQDDHHAIELTRQSIARLNWRKQVDLDVADVVAPLYPAEEIYGLVPSDLKKPMDVHEIIARIVDGSEFDEYKARFGNSLVCGFARIYGYPVGIIANAGILFSESAQKGANFIELCCQRNIPLVFLQNITGFMVGSKYEQEGIAKHGAKMVNAVACAKVPKFTMVIGGSFGAGNYGMCGRAYDPNFMWMWPNARISVMGGEQAAGVMALITKGAKEKRGEPFSEQDEAAFKAPLLEKYEQEGHPYYASARLWDDGVIDPAQSREVLGLAISASLNAPTQKTQFGIFRM

SEQ ID NO: 22367 - protein, 340 aa, Ginkgo biloba
MSSTGKIKIGINGFGRIGRLVARVALLRDDIELVAVNDPFISTDYMTYMFKYDSVHGQWKKHEVKVKDSNTLLFGEKAVTVFGCRNPEEIPWGETGVEYVVESTGVFTDKEKAAAHIKGGAKKVVITAPSKDAPMFVVGVNEHEYKPDLAIVSNASCTTNCLAPLAKVINDRFGIVEGLMTTVHSITATQKTVDGPSNKDWRGGRGAGFNIIPSSTGAAKAVGKVLPALNGKLTGMAFRVPTPDVSVVDLTVRLEKPASYDEIKAAIKEESEGKLKGILGYTEDDVVSTDFIGDNRSSIFDAKAGIALSDNFVKLVSWYDNEWGYSSRVIDLIVHMASTV

SEQ ID NO: 22368 - protein, 393 aa, Campylobacter jejuni RM1221
MKVYLDNNATTMLDPNAYELMLPFLKDIYGNPNSLHQYGSATHPALREALDKLYAGLGANDLDDIVITSCATESINWVLKGVYFDHILDRERNEVIISSVEHPAVAAAAYFLKSLGVKVIELPVNEEGVSTVEDLRKVISDKTALVSVMWANNETGMIFDIKAMAELAHEFGALFHTDATQAVGKIKVNLTQVGVDFASFSAHKFHGPKGVGGLFIKKGLKLTPLLHGGEHMGGRRSGTLNVPYIVAMGEALRIANTMLDFEDSHIRRLRDKLEDQILALPDTTVVGKREHRVPNTILASIKGVEGEAMLWDLNKNGIAASTGSACASEALESNPIMEAIGAEHDLAHTALRLSLSRFNTEEEIDYAAKQIKNATQRLRAISCTYAYNPNNYK

SEQ ID NO: 22369 - protein, 340 aa, Taxus baccata
MGSTGKIKIGINGFGRIGRLVARVALQRDDIELVAVNDPFISTESLTSLFKYDSVHGQWKKHEVKVKDEKTLLFGEKHVAVFGCRNPEEIPWGEVGAEYVVESTGVFTDKDKAAAHLKGGAKKVVISAPSKDAPMFVVGVNEHEYKSDLTIVSNASCTTNCLAPLAKVINDRFGIVEGLMTTVHSITATQKTVDGPSNKDWRGGRAAGFNIIPSSTGAAKAVGKVLPVLNGKLTGMCFRVPTQDVSVVDLTVKLEKSATYGEIKAAIKEESEGKLKGILGYTEDDVVSTDFIGDSRSSIFDAKAGIALNDNFVKLVSWYDNEWGYSSRVIDLIVHMDSTA

SEQ ID NO: 22370 - protein, 767 aa, Zea mays
MATRAGRLPTTPAPALLLLLAFPFLLQGVLPSRAGDTVAAGRPLSGGQSLVSKRGKFRLGFFRPGATDNSSQRWYLGIWYNQLSVHTTVWVANRGTPISDPESSQLSISKDGNMVVLDHSRSSTAVWSTNVTTGVSSTSTVGVIRDNGNLVLADASNTSAVLWQSFDHSGDTWLPGGKLGRNKRTGEVTRLVAWKGRDDPTPSLFALELDPRGSSQYLLNWNDSERMTSTGASPVSDYTFGYVDGANESYFTYDVADESVVTRFQVDVTGQIQFLTWVAAAAQWVLFWSEPKRQCDVYAVCGPFGLCTENALPSCTCPRGFRERDLAEWMQDDHTAGCARNTALQPCGAGAAARDGQKRRRDDDRFYTMPDVRLPSDARSAAAASAHDCELACLRNCSCTAYSYSGGCSLWYGDLINLQDTTSAGSGTGGGSISIRLAASEFSSNGNTKKLIIGLVVAGSSFVAAVTAIVLATVLVLRNRRIKSLRTVQGSLVAFTYRDLQLVTNNFSEKLGGGAFGSVFKGVLPDATLVAVKKLEGVRQGEKQFRAEVSTIGTIQHVNLIRLLGFCSEGSRRLLVYEHMPSGSLDRHLFDRDQQPGVLSWDARYQIALGVARGLDYLHEKCRDCIIHCDIKPENILLDDAFVPRVADFGLAKLMGRDFSRVLTTMRGTVGYLAPEWIAGTAVTTKADVFSYGMMLFEIISGRRNVGQRADGTVDFFPSTAVNRLIDGDVRSAVDSQLGGNADVAEVERACKVACWCVQDAESLRPS

SEQ ID NO: 22371 - protein, 474 aa, Ehrlichia ruminantium str. Gardel
MIKKYRKKCMQNYDVVVIGGGPGGYKCAIRSAQLGLKVACVDKNEILGGTCLRVGCIPSKALLHFSHEYYHIKNHLDEVGITCNSLSFNLDKIMSFKNKNITELGNGINYLFASNKIDRLCGVGKIRSINSNNFDITVTGNNGEEKITAKYVVIATGSEVASFPGIEIDENNVVSSTAALSFKEVPKKLVVVGAGAIGLEMSSVWSRFGSEVTVVEFLDKIAPSMDIDISKALLASLKKQGINFKLSTKVTSIDKSSDNLTIHLESVKDGKSEIIEAEKVLISIGRIPYTDGLIDQNCIECDSRGFIKVNNKYETNIPGIFAIGDVIGGAMLAHKAEEEGIAVAELIAGNIPHVDYDIIPSVIYTHPAVASIGKTEESLKNINYAYNVGKSNFSANSRSKITNNGEGFVKVLTSKENNAILGVHIIGAYADTIINEAAIAMAYRASSEDVFRISHSHPDVNEAFKDACEAAYLK

SEQ ID NO: 22372 - protein, 337 aa, Craterostigma plantagineum
MAKVKIGINGFGRIGRLVARVALVRDDVELVAVNDPFITVDYMAYMFKYDTVHGQYKHHELKVKDEKTLLFGDKPVAVFGLRNPEEIPWAETGAEYVVESTGVFTEKEKAAAHLKGGAKKVIISAPSKDAPMFVVGVNEKTYTPDIDVVSNASCTTNCLAPLAKVIHDRFGIVEGLMTTVHSITATQKTVDGPSSKDWRGGRAASFNIIPSSTGAAKAVGKVLPDLNGKLTGMAFRVPTVDVSVVDLTVTLAKEASYDEIKAAIKEESEGKLKGILGYTEEDVVSSDFVGDSRSSIFDAKAGIALSKKFVKIVAWYDNEWGYSSRVVDLIRHMAAAK

SEQ ID NO: 22373 - protein, 483 aa, Frankia sp. EAN1pec
MTRIVILGGGPGGYEAALVAASLGATVTVIDSDGIGGACVLTDCVPSKTLIATSETMTNFAMAPALGVRPHGDPSAEVGSWELTGLPHLTPPDVVTVDPEQVNERVRALAQAQSADIERRLERERVEVVHGTGRLVGPHAVETSDGETFVGDIVLVATGASPREISGCEPDGERILTWRHLYDLKEIPEHLVVVGSGVTGAEFASAYRALGAEVTLVSSRERVLPGEDPDAARVIEDVFVRRGIEVLNRSRAAAARRIGDGVLVELTDGRTVTGSHALMAVGSVPRTKGLGLTEVGVRLGSGGHVVVDRMSRTSVPGVYAAGDCTGVLPLASVAAMQGRIAMWHALGEAVTPLRLGTVSSNIFTEPEIATVGVTQRMKDSGAIAAEVTTVPLMRNPRAKMMGIADGFVKLFCRPGSGSVLGGVIVAPRASELILSISLAVENGLTVDQIAHTFSIYPSLSGSITEAARVLRPRDLFAGFDTPA

SEQ ID NO: 22374 - protein, 501 aa, Ehrlichia ruminantium str. Gardel
MTNHSVILCILDGWGNNKNSQFNAIAQADTPYWDSIISQYPQSNIVTHGPDVGLPDRQIGNSEVGHISLGSGRIVLQDLCRINEEIKNIRKNTHLLEFTEQIKRNNGICHIAGLLSDGGIHSSLSHMLDIIDALSYLKIQVVIHIFLDGRDTPPISALKYINILCSHIKDLNNVSIATISGRYYSMDRDNRLDRTTKAYNSIAFGDGKRYEEPISAVQDNYNAGITDEFIIPCVIGNYQGMNPTDGFIMTNFRSDRVIQILKMITEDQNTNHITLKNTIGMIKYSNELNIPCLFPNKKISNTLGEIISNQQLHQLRIAETEKYAHVTFFFNGGREEVFENEERIIIPSPSVTTYDLVPEMSAYEITDTLIKKINLQKYSLIIINYANADMVGHTGNIEATKKAITTLDQCLGKILKCIHNTNYILVITADHGNAEEMFDVQNNMPYTAHTLNPVPFVVCNYPKKIKLKNGRLSDVAPTILEILNIKQPEEMTGISLIDTSN

SEQ ID NO: 22375 - protein, 515 aa, Medicago sativa
MGTNEWHVERRDSIGTESPVAREVLETGTLSIVVLGASGDLAKKKTFPALFHLYKQELLPPDEVHIFGYARSKISDDELRNKLRSYLVPEKGASPKQLDDVSKFLQLVKYVSGPYDSEDGFRLLDKEISEHEYLKNSKEGSSRRLFYLALPPSVYPSVCKMIKTCCMNKSDLGGWTRVVVEKPFGRDLESAEELSTQIGELFEEPQIYRIDHYLGKELVQNMLVLRFANRFFLPLWNHNHIDNVQIVFREDFGTDGRGGYFDQYGIIRDIIPNHLLQVLCLIAMEKPVSLKPEHIRDEKVKVLESVLPIRDDEVVLGQYEGYTDDPTVPDDSNTPTFATTILRIHNERWEGVPFIVKAGKALNSRKAEIRVQFKDVPGDIFRSKKQGRNEFVIRLQPSEAIYMKLTVKQPGLEMSAVQSELDLSYGQRYQGITIPEAYERLILDTIRGDQQHFVRRDELKASWQIFTPLLHKIDRGELKPVPYNPGSRGPAEADELLEKAGYVQTPGYIWIPPTL

SEQ ID NO: 22376 - protein, 387 aa, Corynebacterium glutamicum ATCC 13032
MKIAVAGLGYVGLSNAALLSKNHKVVAVDIDEERVKLVQEFRSPIVDSDLEEYLSTKPQNLTATTDAEAAYKGADFIVIATPTNYDPESNFFDTSSVESVIEIVLKVSPGSTIVIKSTIPVGFTSELRIKHPEASIIFSPEFLREGRAFYDNLYPSRVVVGDRSPLGEEFATLLAEGAKEKPPILLTDSTEAEAIKLFSNTYLALRVAFFNELDTYASVRSLDTKQIIEGVGLDPRIGSHYNNPSFGYGGYCLPKDTKQLLANYKDVPQNLISAVVQANKTRKDFIAEDILSKSPTVVGIYRLVMKSGSDNFRSSSIQGVMKRIKAKGIEIVVFEPNLGEETFYNSKILNDIEEFKDYCDIIIANRPTDELSDVPEKVYTRDIFQRD

SEQ ID NO: 22377 - protein, 525 aa, Phaseolus vulgaris
MASSSVTLKANAHLANSEKGHLFRQESSFLGERVKVGPNNSAFVTNQLARCSRSQKRVNHGVASAILTSNDAKESLSLQVPSFMRRRVDPKNVVSIILGGGPGKQLFPLTQRAATPAVPVGGCYRLIDIPMSNCINSGINKIFVLTQFNSASLNRHIARTYFGNGINFGDGTVEVLAATQTPGEAGKKWFQGTADAVRQFTWVFEDAKNTHVENVLILAGDHLYRMDYMDLIQSHVDRNADITVSCAAVGNSRASDYGLVKVDDRGRIIQFSEKPKGDDMTAMQADTSLLGLSPPDALKSPYIASMGVYVFKTDVLLNLLKCRHPTSNDFGSEIIPAAVRDHNVQSYFFRDYWEDIGTIKSFYDANLALTEESHEFEFYDPKTPIYTSPGFLPPTKIDKSRIVDAIISHGCFLRECTVQHSIVGERSRLDYGVEIQDTVMMGADYYQTESEIASLLAEGKVPIGIGRNTKIRNCIIDKNAKIGKDVIIKNKDDVQEADRPEDGFYIRSGITIIAEKATIEDGTVI

SEQ ID NO: 22378 - protein, 374 aa, Ehrlichia ruminantium str. Gardel
MSQIKNYLNAILMLSDGKYFLGKSIGNKSNAVGEVCFTTSMTGYQHTITDPSFAGQIITFTFPHIGNIGINKEDFENTQVLAHGIVVKTISEDSHSSSYSNLENWMIENKITGISEIDTRALTRHLRNYGSQNGIIHHFHDINSLNLKELQNTASQYNYVNHCQSISQAFISDYNQKPKHKTLYNIVVINFGVKSSILNALSNIGCKVHIVPGHEFNLIDKVLSFNPDGIVLSNGPGDPSAISEHTIQQIRSIIELKVPTLGICLGHQLIALALGAQVKKMLFGHRGSNHPVYNKMLNNIEITSQNHGFTIDKNSLSSNIQITHTSLFDNTIEGIKVENYPIISVQYHPEGSPGPNDTRYILEDFVNLIQEKTV

SEQ ID NO: 22379 - protein, 443 aa, Aspergillus oryzae
MSPPSTSASSSSTARNRLASLSAQIMGSASPSVFSTSVVPAAPEDPLFGLAQAFRNDPSDKKVDLVIGAYRDDNAKPWILPVVRKAGDLIRNDPSINNEYLPIKGLPEFTSAAQKVILGSDSPAIREQRVATFQTISGTGAVHLGALFLAKFHPANPKPTVYLSNPTWANHNQIFTNVGLSLATYPYFDAKTKGLNFDGMLNGIREAPAGSVILLHACAHNPTGVDLTQDQWKQLAVVMRERRHFPFFDTAYQGFASGDLNRDAWAVRYFIEQGFELCVAQSFAKNFGLYGQRAGAFHFVSAPGATAKNDIANVASQLAILQRSEISNPPAYGAQIASRILNDATLFAEWEEDLRTMSGRIAEMRKGLRERLEAKGTPGTWNHVTDQIGMFSFTGLSEAQVKLLREKWHIYMTKNGRISMAGLNTHNIDYFAEAVDSVVRETS

SEQ ID NO: 22380 - protein, 140 aa, Leifsonia xyli subsp. xyli str. CTCB07
MTTAVEETLVLVKPDGVARNLTGEILRRIEAKGYSLVDIRMVQADRVLLAKHYAEHEGKPFYEPLVEFMESGPLVAIRLAGNRVIEGFRSLAGATDPTTALPGTIRGDLARDWGLKVQQNLVHGSDSPTSAARELALWFG

SEQ ID NO: 22381 - protein, 577 aa, Solanum tuberosum
MGVQLRLNPCSSSSAATSPSTFHNGTPYFCKKFNFLPFRTQPLNWVSGIYSRIQPRKHFEVFSSNGFPLNAVSVQDVQVPLTELGSGDTTVSITVIGASGDLAKKKILPALFALFYEDCLPENFVVFGYSRTKLSDEELRNMISTTLTCRIDKRENCDAKMEHFLERCFYHSGQYNSEDDFAELDYKLKEKEGCRVSNRLFYLSIPPNIFVDVVRCASLKASSTSGWTRVIVEKPFGRDLESSSELTRSLKKYLTEEQIFRIDHYLGKELVENLSVLRFSNLVFEPLWSRNYIRNVQFIFSEDFGTEGRGGYFDHYGIIRDIMQNHLLQILALFAMETPVSLDAEDIRNEKVKVLRSMRPLQLEDVVLGQYKGHSNGAKSYPAYTDDPTVPNGSITPTFSAAALFIDNARWDGVPFLMKAGKALHTKRAEIRVQFRHVPGNLYKRNFGTDMDKATNELVLRLQPDEAIYLKINNKVPGLGMRLDRSDLNLLYKAKYRGEIPDAYERLLLDAIEGERRLFIRSDELDAAWALFTPLLKELEEKKIAPELYPYGSRGPVGAHYLAAKHNVRWGDLSGDD

SEQ ID NO: 22382 - protein, 515 aa, Phaseolus vulgaris
MASMASIGSLNVPCSSSSSSSNGGRKILPRALSFSASQLYGDKISTDSVSVAPKRVRNPVVVSPKAVSDSQNSQTCLDPDASKSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHNVLEYLVLAGDHLYRMDYEKFIQVHRESDADITVAALPMDENRATAFGLMKIDEEGRIIEFAEKPKGEQLKAMKVDTTIFGLDDERAKEMPYIASMGIYVVSKNVMLNLLREKFPAANDFGSEVIPGATSIGLRVQAYLYDGYWEDIGTIEAFYNANLGITKKPVPDFSFYGRSSPIYTQPRYLPPSKMLDADVTDSVIGEGCVIKNCKIHHSVVGLRSCISEGAIIEDTLLMGADYYETDADKRFLAAKGSVPIGIGRNSHVKRAIIDKNARIGENVKILNSDNVQEAARETDGYFIKSGIVTVIKDALIPSGTVI

SEQ ID NO: 22383 - protein, 514 aa, Escherichia coli
MADSQPLSGAPEGAEYLRAVLRAPVYEAAQVTPLQKMEKLSSRLDNVILVKREDRQPVHSFKLRGAYAMMAGLTEEQKAHGVITASAGNHAQGVAFSSARLGVKALIVMPTATADIKVDAVRGFGGEVLLHGANFDEAKAKAIELSQQQGFTWVPPFDHPMVIAGQGTLALELLQQDAHLDRVFVPVGGGGLAAGVAVLIKQLMPQIKVIAVEAEDSACLKAALDAGHPVDLPRVGLFAEGVGVKRIGDETFRLCQEYLDDIITVDSDAICAAMKDLFEDVRAVAEPSGALALAGMKKYIALHNIRGERLAHILSGANVNFHGLRYVSERCELGEQREALLAVTIPEEKGSFLKFCQLLGGRSVTEFNYRFADAKNACIFVGVRLSRGLEERKEILQMLNDGGYSVVDLSDDEMAKLHVRYMVGGRPSHPLQERLYSFEFPESPGALLRFLNTLGTYWNISLFHYRSHGTDYGRVLAAFELGDHEPDFETRLNELGYDCHDETNNPAFRFFLAG

SEQ ID NO: 22384 - protein, 258 aa, Physcomitrella patens subsp. patens
MEEAAGDEEWYTIALWGYFAMAAIMFVLVNFCLSAPYGRHVRRGWGFSVPVREGWIIMESPALFVMALVYHAGQFHLQHVPHVLLRMHQMHYFHRTLVFPFRMRADGKAMPAAVVASGFFFNVYNSYIQARWISHIGVYPSSWLTSPQFLLGVAIFLVGFLGNIWADNVLLNLRDHKEDRSYKIPRGFLYEFITCPNYFCEIIEWLGWAIATNSVAGFFFFLSTLANLGPRAKTHHEWYHKKFNDYPRNRKALIPFLY

SEQ ID NO: 22385 - protein, 255 aa, Debaryomyces hansenii CBS767
MAAPTAIKDLPESKDVEAVSNEGIEGEEEMLIDAGSVPQENEEGASKKKESSEMVLDESGKPKFSAASKSGMKVKLESRKVPVPPHRMTPLKNTWTKIYPPLVDHLKLQVRMNLKTKTIEMKTNKNTVDQGALQKGADFVKAFTLGFDVDDAIALLRLDDLYIETFEVKDVKTLNGDHLSRAIGRIAGKDGKTKFAIENATRTRIVLADSKIHILGGFTHIRMAREAVVSLILGSPPGKVYGNLRTVASRMKERY

SEQ ID NO: 22386 - protein, 396 aa, Fusobacterium nucleatum subsp. nucleatum ATCC 25586
MRISDRVKNMKYSAVRKLAPLAAEAEKKGIKVYRLNIGQPNIETPKLFFEGLKNIPDHVIRYADSRGISILLEQVIEVYARDGHILKKEDIIVTEGGSEALTFAMLAICNPNDEVLIPEPFYSNYKSFLDIAGAKIIPIPTDIKNDFALPKKEEIQKLITSKTKAILYSNPCNPTGKVYTEEEVKLLANLAAENDLFVIADEPYREFIYDDNDKHYSLLDIEKAKENVIIIDSVSKHYSACGARVGFLISKNKDFMTYIMKLCQARLAAPTVEQYAVASLMKAPKEYFKEIKEIYKRRRDIIVNSLNKIEGVTCSTPKGAIYAFAKLPVESSEDFCKWLLTEFVYDNSTVMLAPGEGFYETEGLGKNEVRFSFCVGENDIEKAMRVLEEALKVYKK

SEQ ID NO: 22387 - protein, 411 aa, Cryptococcus neoformans var. neoformans JEC21
MRQETLAFAEPEPLKPARSPSLRQSSKSPSRHPSPAASTPSFADAPLPPPPRSRFAPPRSSHPPLVSCRSVYNYTRLNHIEEGTYGVVFRARCNDTGEIYALKKLKLDEEKQGFPITSLREVMALMISGGHENVVGIREIVVGDTLNQVFIVMPFIEHDLKTLLADMPHPFLQSEVKTIMLQLLSAVAHCHANWILHRDLKTSNLLMNNRGQIKVADFGLARKFGDPLGEMTQLVVTLWYRSPELLLGGKEYTTAVDIWSIGCIFAELMQGEPLFPGRGEIDQINRIFQLLGRPNDESWPGYSTLPLVQKINPIGPMFSTLRQKFKHLTYEGHNLLSSLLCYDPERRITAEEALKHPYFSEHPLPKHPDLFSSFPSQAAGERKHKSLISPSAPVREDRMAKDSLADLDSFV

SEQ ID NO: 22388 - protein, 601 aa, Mycoplasma genitalium G37
MAEQKRDYYEVLGITPDADQSEIKKAFRKLAKKYHPDRNNAPDAAKIFAEINEANDVLSNPKKRANYDKYGFDGVDGEPAFNFQADVFQSFFEEIAKSGVFNNQTNPEQKEKKKRYHWFSKKPKQEQPEINLDHVVEQTIKKVQQNQNQNKDPDELRSKVPGEVTASDWEALVGDTRYGYFDETGDWSWKGYFDEQGKWVWNEPVDSETSEVSVEPEPTPVAPEASFEEAQPEINAEPEASFESTPTPEPVAPEASFEEAQPEPTPIPEPIPTPVQVQPLLLDLNLFTIPTKATKDDLLFDNINLTTYEQVVDYLNSQATPNLAKTDGELQTIDGTNPLLLEQCKKIKKQAEQLFKKLFLKKQLPFITQPEVVEESKTSFDENNVNLVYFEKVPEILFINQQPKEVKYTRQVFDGLTNKTTSETITLEIQLLQTPKETVSAIFKGFGNDHGKGCGDLKIVFEKIKSPFFQVNEDGLHSACIIDPLVAYNGGIIDVFGPYTNFQVKVDGEIDINAIMKFEKLGIAKTKRKGDLFVHLYYSSVPKKKLTTNPQVQQFLELLQAEYELLQDNIKSLKYFKNNLVIPKKPLDQQSYQYLSQEPIS

SEQ ID NO: 22389 - protein, 181 aa, Chlamydomonas reinhardtii
MGLMVSKALSRLFGKKEMRILMVGLDAAGKTTILYKLKLGEIVTTIPTIGFNVETVEYKNISFTVWDVGGQDKIRPLWRHYFQNTQGLIFVVDSNDRDRIGEAKDELHRMLNEDELRDAVLLVFANKQDLPNAMNAAEITEKLGLHGLRQRHWYIQSTCATSGEGLYEGLDWLSQNIQNKS

SEQ ID NO: 22390 - protein, 476 aa, Ralstonia solanacearum GMI1000
MSLFRTKNLDHMIRTGQGDTGLKKVFGPLDLTFLGVGAIIGTGIFVLTGTGALTAGPALTLSFVVAALACGFAALCYAEFASTIPVSGSIYTYAYATLGELVAWIIGWDLMLEYGLATSAVSVGWSGYFQSLMAGFGLHLPAALMAAPGAIPGVQTLFNLPALLIMLIITAVLSLGVRESARFNNIMVAIKVAVVVLFIVVGARHVQPANWQPFMPFGMSGVFGAAALVFFAFIGFDAVTAAAEEVRNPERDLPIGIIGSLGVCTILYVVVAAIMTGIVPYTKFAGVDHPVSLALQMGGETWVAGFVDLGAIIGMTTVILVMGYGQTRVIFAMSRDGLLPKRLSRVHPRYATPFFNTWLVGIVFALIAAFVPLNVLAELINIGTLAAFSLIAIAVLVLRRKRPDLPRGFRCPGVPFVPAAAVVLCVFLMSQLQALTWIAFVVWMVIGLLVYFGYARSRSLLHAPDRAAVPGSEAAH

SEQ ID NO: 22391 - protein, 396 aa, Pseudomonas syringae pv. tomato str. DC3000
MSAQVLRKRICVLPGDGIGVEVMEAALPVIAALGLPFDLLHADIGWECWRREGETVPDDTWKVMASCDATLLGAITSKPLAEAEAELPLPLQGHSRRYVSPVIQLRQNLDLYANVRPVTDMTGENRFRFVVIRENTEGLYAGLDFGRIPDALVPLLEAREALGAAWQRAGQEDATVTLRLQTRSGLTRIFEYAFDYARNNNFSRVTFVDKPMVLRHSSAFARVIFEETAQRYPDITGAIENVDAVALWMVQRPERFGVIVAENMFGDILSDLGAGVMGGLGFAPSGNFGNSGAYFEPVHGSAPAHAGLTKANPSAMFLAIAMMLEHLGYPAQSDCITRAVSLVARSAVRTYDLGGSHTTCQVGEAIVQQCVELQGLLVDRRERSRSAQGERHVSAL

SEQ ID NO: 22392 - protein, 138 aa, Shorea bullata
EKNIPVLLGLLSIWNVSFLGYPARAILPYSQALEKFAPHIQQVSMESNGKGVSIDGVPLPYKAGEIDFGEPGTNGQHSFYQLIHQGRVIPCDFIGSAKSQQPIHLKGEVVSNHDELMSNFFAQPDALAFGKTPEELHK

SEQ ID NO: 22393 - protein, 303 aa, Nicotiana tabacum
MEKYEKLEKVGEGTYGKVYKAKDKATGQLVALKKTRLEMDEEGIPPTALREISLLQMLSHSLYIVRLLCVEQIDKNGKPLLYLVFEYLDTDLKKFVDSHRKGPNPRPLPPSLIQSFLYQLCKGVAHCHSHGVLHRDLKPQNLLVDKEKGILKIADLGLGRAFTVPIKSYTHEIVTLWYRAPEVLLGSTHYSTAVDMWSVGCIFAEMVRRQALFPGDSEFQQLLHIFRLLGTPTEKQWPGVSSLRDWHVYPKWEPQNLASAVPALGPDGVDLLTKMLQYDPADRISAKAALDHPYFDSLDKSQF

SEQ ID NO: 22394 - protein, 469 aa, Corynebacterium glutamicum ATCC 13032
MTEHYDVVVLGAGPGGYVSAIRAAQLGKKVAVIEKQYWGGVCLNVGCIPSKSLIKNAEVAHTFTHEKKTFGINGEVTFNYEDAHKRSRGVSDKIVGGVHYLMKKNKIIEIHGLGNFKDAKTLEVTDGKDAGKTITFDDCIIATGSVVNTLRGVDFSENVVSFEEQILNPVAPKKMVIVGAGAIGMEFAYVLGNYGVDVTVIEFMDRVLPNEDAEVSKVIAKAYKKMGVKLLPGHATTAVRDNGDFVEVDYQKKGSDKTETLTVDRVMVSVGFRPRVEGFGLENTGVKLTERGAIEIDDYMRTNVDGIYAIGDVTAKLQLAHVAEAQGIVAAETIAGAETQTLGDYMMMPRATFCNPQVSSFGYTEEQAKEKWPDREIKVASFPFSANGKAVGLAETDGFAKIVADAEFGELLGAHLVGANASELINELVLAQNWDLTTEEISRSVHIHPTLSEAVKEAAHGISGHMINF

SEQ ID NO: 22395 - protein, 292 aa, Corynebacterium glutamicum ATCC 13032
MVPAAGMGTRFLPATKTIPKELLPVVDTPGIELVAKEAADLGATRLAIITAPNKDGILKHFEEFPELEATLEARGKTDQLNKVRAARELIATVPVVQEKPLGLGHAVGLAESVLDDDEDVVAVMLPDDLVLPFGVTERMAEVRAKFGGSVLAAIEVAEDEVSNYGVFKLGELDAESESEGIRRVVGMVEKPAPEDAPSRFAATGRYLLDRAIFDALRRIEPGAGGELQLTDAIALLIEEGHPVHIVVHEGKRHDLGNPAGYIPAVVYFGLRHAEYGSKIHRAVKEILAEFES

SEQ ID NO: 22396 - protein, 294 aa, Nicotiana tabacum
MDQYEKVEKIGEGTYGVVYKARDRVTNETIALKKIRLEQEDEGVPSTAIREISLLKEMQHANIVRLQDVVHSEKRLYLVFEYLDLDLKKHMDSSPEFSKDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVTQRPLFPGDSEIDELFKIFRVMGTPNEDTWPGVTTLPDFKSAFPKWPSKDLATIVPNLDGAGLDLLDKMLRLDPSKRITARNALEHEYFKDIGYVP

SEQ ID NO: 22397 - protein, 2300 aa, Ehrlichia ruminantium str. Gardel
MYNFIKNHFIKLLLLLLMTACESNQHPVPRCIPADVFTEGRTTSVSAYFDPTSENFMSDNKVLGNSVEDNQVVRWKYTGYVTNGHPIVLRAEGMWTSWAKKSNNVTEVQTNTTDYGDDDVDRYNAILAVDRVCGPYKKIEKTFSNGTNQCKVSCEMISGVQDNLETGTYGPPCWFRNGYGAYLLFKRPEDPEPNETITNMRYPTSPVMHIGYKPLELAGTHGISTSSKKIKDSSCKDVELKPGWKIYIKILDRNYYDNVGGYTVTFIDGIKAEQEFSAFEWVRKEVRGRLDKAGEDLFKNIVKNPVFKNFVFSLLTLFLIFGSLAYILGIVRTPFADIIVRLLKISLMLLLISPNSWDFFYNHLLRLFIHGTDQIIAMINSYTGDYNPQAPFSFMDIMIRDKIFSPVIWKIKIRALIVANFSSIFAVLVIVIAVLIYIALCIYGFVIYLTAFVGITFLVGLMPLLLLGILFSQFKSLFDGWLTQCISFSLQAILIFTLISLFGTLIMNYYYRIFGFTVCYNEWMKVKICLFGRVGCLVDKSLFGWTPGQMYDPKVIGITSDFNVSDKKASSDDPDDIKMSGNARYKFTGGGWYISVPPDHKHKDFRYIDYPFLDPDTESDSNPYGVNVAKDSKLKELSHFVNALLTTDKKYVVARLVADIRVELEKLVKNNTITSESQNKVLNIIDERIKKDKDAGKSELDKYGDQNFKSQIIRSVIDNVIDGAAITPTSQEKLNEQYDYALIQGIRAGDLILWSEVGSLFLAALLIWQMRAFVQSVAVSLAGGSMMSQTIASMYEEGFLKTFSSIPVVGKVFKTIDGGLDSYKLLVGNYITETARRPLNMLQKVPVLGHAVKFTGKVAGGLTSSYGEYDRRHSSNFKQLNYARAFIGAHLGFSPLSAMKYLGGYAAGKMLGSRSGGLIHNMVQDRKAALDSLKAHILGPEQHKPSPYIPKKKEDDSNPFVKNDAKNLGGDSSSPGSKNYDGHVRGEPHSIARTDTGNVRGDSYDTNYAGNVIGDAAVAKGYAGGVVGSSGPITRLELQNQHSLLDDAGNVRVGKDNLADALEAREQLKTMRENTKDETALININYDIDRLDSALHKHLGHDFEQVTQDYASSHMAVQHSADLSATDYSRLNIDDISKLDSTAQISSASVPDTGQDILHSNAAAQSSMLDVGRDEISDFISASALKEETIPHEVIELNVLGTSSGQSLSSETSVHVQDEVQVDRRETVTAPSDTAQPSALDVELSGGRVSEISSTGASQGETSPEQQLSSEVGVYVQDGVQVERSETVTSPSDTTQPSALDVELSGDGLSDISSTSVSQGETSPQSEEIELNVLGATSEQQLSSEVGVYVQDGVQVERSEAVTSPSDTTQPSTLDVELSGDGLSDISSTGVSQGETSSQSEDLEAIFDQTLIGENESHASTSDNDIEPIASDENVLLGHENFDSLLDTDPLSHDTQESTGFIDEKSSNEFEESKELVDHKDTIENIPDVDHTPDAFGKELDVPQTSDQELIDMNAEGNSSVNVLSDQYQDTASELSSSESSDGSESRGSESDDKVLEPELQANTYYATDNEVLDVASLELGLSGVAVGNVEPAPEDSGTKPEAFEVESNESEGVVSVTEGHSDSAASSESIDKESSEDSQLDQTSMEEQDKVGEFERDSNAEDTSIDKEVSGKPDIVEPVQEGSETKPEAVEVESNESEGVVSVTEEHSDSAASSESIDKESSEDSQLDQTSMEEQDKVEEFEVAEDTSVDKEVSGKPDIVEPAQEGSETKPEAVEVESNESEGVVSVTEEHSDSAASSGNIDKESSEDSQLDQTSMEEQDKVGEFEVAEDTSVDKEVSGKPDIVEPAQEGSETKPEAVEVESNESEGVVDVTEEHSDSAASSESIDKESSEDSQLDQTSMEEQDKVGESERDSNAEDASIDGKEVSGKPDIVEPVQEGSETKPEAVEVEGNESEGVVDVTEEHSDSAASSESIDKESSEDSQLDQTSMEEQDKVGESEVAEDASIDGKEVSGKPDIVEPVQEGSTEEESTSVLDEDSKRDVEESEEEGHDTSSDEGTEVDEVDSDGDDSADVEKGSNDTLENDLEAEESKVELTEELAVKDMPEESVTEGRGMKKASVVTDDMSEGLAAVHQVDSGKEFKLQEKMGLEGAQSIHIPKSLKSEEKDAVSKKSSTAKKTESTDSKDSAKEKKGTSTSSKTKKTSLPKIMSGVKILVNQYAKQISTGLSESFDKFFEDTESKKRGKRKRSKEDIESMVRDLEQLLVSLKDKKSKLTDPSEIANIEDDIRKLESTIKSILDNQ

SEQ ID NO: 22398 - protein, 694 aa, Burkholderia mallei ATCC 23344
MAVDYTTRDGVAVITLNNPPVNGLGLSTRLGIMEGLERAQRDPAVAAIVLTGAGRAFSGGADITEFNTPKALQEPTLHTVIDAVEASGKPVVVAIHSVAMGGGLELALGAHYRVASAGAQIALPEVKLGLLPGAGGTQRLPRAVGLETALNMIVSGAPVPSEQLAKSGLFDAFVEGDLLEAAVAFARKAGAASGPHPRVRDREIVHENAAGFIQFARNSVKAVAQHYPAPHKCIDAIEAGVLQGFDKGLAFERDCFVALVQTPESRALRHAFFGERAAGKIADVPADTAVRGIESVAVIGAGTMGGGITMNFLNAGLPVTLLETKQEALERGLATIRKNYDAQVSKGKLTQEKLDARMALLRPTLSYDDLKDADLVIEAVFEELGVKEQVFKRLDEVAKPGAILASNTSTLDVNKIAAFTRRPQDVVGLHFFSPANVMKLLEVVRGEHTAKDVLATVMQLAKKIRKTAVVSGVCDGFIGNRMVEQYIRQALFMLEEGALPAQIDRAIEAFGFAMGPFRMSDLAGNDIGWAIRKRRYVEQPDLHYSKIADRLCEQGRFGQKTGAGWYDYVPGERRAKPSKLVDEMIVAYSSERGVARRQIGDAEIVERLVYALVNEGAKILEEKIASKASDIDMVYLTGYGFPLWRGGPMLYADTVGLYNVERAMRGYAQRANGDAWQIAPSIVELAKSGRGFNA

SEQ ID NO: 22399 - protein, 351 aa, Solanum tuberosum
MASLLRRRFYSSESSFAQRLRDLPKYLPGTNIKTQVSQLIGKTPLVYLNKVSEGCGAYIAVKQEMMQPTSSIKDRPAFAMINDAEKKGLITPGKTTLIEPTSGNMGISMAFMAAMKGYKMILTMPSYTSLERRVTMRAFGADLVTTDPTKGMGGTIKKAYDLLESTPNAYMLQQFSNPANTQAHFETTGPEIWEDTQGNVDIFVMGIGSGGTVSGVGQYLKSKNPNVKIYGIEPTESNVLNGGNPGPHEITGNGVGFKPDILDMDVMEEVLMVSSEESVNMARELALKEGLMVGISSGANTVAALRLANRPENKGKLIVTIHPSFGERYLSSVLYEDIRKEAQNMQPVSVD

SEQ ID NO: 22400 - protein, 155 aa, Capsicum annuum
MANPKVFFDLTIGGQPAGRVVMEMFANDVPKTAENFRALCTGEKGVGRMGKPLHYKGSTFHRVMPGFMCQGGDFTAGNGTGGESIYGAKFADESFRGKHTGPGVLSMAIAPGTNGSQFFIICTAETELLDRKAVVFGQVVEGFDVISSVIISPNI

SEQ ID NO: 22401 - protein, 525 aa, Burkholderia mallei ATCC 23344
MGSNMSFSRSEAAPAAPLPDLAATLAALRDDAFQQLGAAFVTRLPAAPLPAPYVVGFSDDAARMLGLEPALRDAPGFAELFCGNPTRDWPQASLPYASVYSGHQFGVWAGQLGDGRALTIGELAHDGRRYELQLKGAGRTPYSRMGDGRAVLRSSIREFLCSEAMHHLGIPTTRALAVIGSDQPVVREEIETSAVVTRVAQSFVRFGHFEHFFANDRPEQLRALADHVIERFYPACRDADDPYLALLAEATRRTAELVAQWQAVGFCHGVMNTDNMSILGLTIDYGPFGFIDAFDAKHVCNHSDTQGRYAYRMQPRIAHWNCFCLAQALLPLIGLHRDAPSEDARAERAVEDAHAVLGRFPEQFGPALERAIRAKLGLALEREGDAALANQLLEIMDASHADFTLTFRHLARVSKHDARGDAPVRDLFIDRDAFDRWANLYRARLSEEARDDASRAAAMNRVNPKYVLRNHLAETAIRRAKEKDFSEVERLAAVLRRPFDEQPEHDAYAALPPDWASTLEVSCSS

SEQ ID NO: 22402 - protein, 525 aa, Corynebacterium diphtheriae NCTC 13129
MTQQTSQKHNPVLVVDFGAQYAQLIARRVREANIYSEVVPHTATVEEIKAKNPAALILSGGPSSVYADGAPSLDPQVLELGIPVFGICYGFQAMTHALGGTVANTGNREYGRTEMTVDGGILHADLEETHKVWMSHGDAVSVAPEGFVVTAHSEGAPVAAFECAEKRMAGVQYHPEVLHSPHGQEVMVRFLTEIAGLEQNWTAANIAEELIDAVCAQVGPEGRAICGLSGGVDSAVAAALVQRAIGDRLTCVFVDHGLLRAGEREQVQTDFVAATGAKLVTVDEREAFLNKLAGVTEPEAKRKAIGAEFIRSFERAVAGILDDAPEGSTVDFLVQGTLYPDVVESGGGSGTANIKSHHNVGGLPDDVEFQLVEPLRLLFKDEVRAVGRELGLPEEIVNRQPFPGPGLGIRIIGEVTEERLETLRAADLIARTELTAAGLDSEIWQCPVVLLADVRSVGVQGDGRTYGHPIVLRPVSSEDAMTADWTRLPYDVLEKISTRITNEVSDVNRVVLDCTSKPPGTIEWE

SEQ ID NO: 22403 - protein, 147 aa, Zea mays
MAVAALKVQLNALLSNMFATGMVDEQFQQLQSLEEGGTASGFVAEVATLFIEDADRIIADIAALLDQPVVDFDKVDAHVHQLKGSSSSVGAQKVKLACMHFRQFYEAKSKEGCLMALAFVRSEFCDVRNKFQTMMQLEQQIEACSPK

SEQ ID NO: 22404 - protein, 559 aa, Ashbya gossypii ATCC 10895
MSDNNDAGAVGRHLTHPGTRDLPTSLRSLCVNWYKHSRAEIAIGRRANDSHAHEGPPLPGYRSESFETAPEAEEAEAARRTLLKQKRWAIFTTGAGLFSDGYINNSIGVVNTCLDRIYGDKYRESPSMSNVASLAFAGTVLGQLSFGYFADRYGRKLAMLVGTGMLILFTILAAGAWGKGTSQTEPGGLFAALAAYRFLVGIAIGSEYSTGSPAAAEASNALPRGRRNRWFVWFTNTMIDLGFVVATIVPVILLVAGIKNLTIVWRLTLGLGALPPLSLFYLRTQFKESEEFAKTRFRKKVPYVLVAKFYWFRVAVVSTVWFLYNFSSYAFGTYSSYLLNQILGDDESPTRVFAWNILFTFFYLPGSLLGALLADYIGPRLTLAAGVFIQGIVGFAMAGCLDKLKRNVAGFSVIYGIFMSLGEMGPGANIGLLASKTTATPVRGQLYGLCAAIGKIGAFTGTYAFPHIIAAAGGEKTTSGLQAPFYLASSLAIISGIITLLFLPCLGQDVINEEDQRLLEYLSNSGYDVNGMGEEDEKGEVITETMPRYSGLPDKGKLG

SEQ ID NO: 22405 - protein, 872 aa, Arabidopsis thaliana
MEGHRGLLLALIVNIFSIVHLVHAQNPEGFISLDCGLPAKESPYTESTTSLVFTSDANFISSGISTKLPKHDDYKPYNFLRYFPDGTRHCYDLSVKQGTNYLIRASFVYGNYDGRNIMPRFDLYIGPNIWAVVSELDLYSPEEEIIHMTKSTSLQICLVKTGPTTPFISTLELRPLRNDNYITQSGSLKLMQRMCMTETVSTLRYPDDVYDRLWYTDGIYETKAVKTALSVNSTNPFELPQVIIRSAATPVNSSEPITVEYGGYSSGDQVYLYLHFAEIQTLKASDNREFDIVWANNIKKLAYKPKVSQIDTLLNTSPNKCDNTFCKAFLVRTQRSTLPPLLNAYEVYILVEFPYSETHPDDVVAIKKIKAAYGLKIISWQGDPCLPREYKWEYIECSYTNNSIPPRIISLDLSNRGLKGIIEPVLQNLTQLEKLDLSINRLSGEVPEFLANMKSLSNINLSWNNLKGLIPPALEEKRKNGLKLNTQGNQNLCPGDECKRSIPKFPVTTVVSISAILLTVVVLLIVFIYKKKKTSKVRHRLPITKSEILTKKRRFTYSEVEAVTNKFERVIGEGGFGIVYHGHLNDTEQVAVKLLSHSSTQGYKQFKAEVELLLRVHHTNLVNLVGYCNEEDHLALVYEYAANGDLKQHLSGESSSAALNWASRLGIATETAQGLEYLHIGCEPPMIHRDVKTTNILLDEHFHAKLADFGLSRSFPVGVESHVSTNVAGTPGYLDPEYYRTNWLTEKSDVYSMGIVLLEIITNQPVIQQVREKPHIAEWVGLMLTKGDIKSIMDPKLNGEYDSSSVWKALELAMSCVNPSSGGRPTMSQVISELKECLIYENSRKEGRSEVDSKSSIELSTSFTAEVTPDAR

SEQ ID NO: 22406 - protein, 315 aa, Triticum aestivum
  misc_feature (303)..(303): Xaa can be any naturally occurring amino acid
MTSGAARAAAAAEADAGLGRTPTWKERENNKRRERRRRAIAAKIFTGLRALGNYKLPKHCDNNEVLKELCREAGWVVEDDGTTYRKGYKPPSSGPFGGVSSAGMSPCSSSQLLSAPSSSFPSPVPSYNASPASSSFPSPTRLDNPSPACLLPFLRGLPNLPPLRVSNSAPVTPPLSSPTASRPPKILKPDWEVDPFRHPFFALSAPASPTRGRRHEHPDTIPECDESDVSTVDSGRWISFQMATTAPTSPAYNLVNLGASSSNSMELDGMAGERGRSGPEFEFDKGEGDALGKGERIHEVAAXEELELTLGVGSK

SEQ ID NO: 22407 - protein, 276 aa, Dehalococcoides sp. BAV1
MIKISIQGARGSFHDIVARHKFPGDSEIIESNTSHQVFEDVKKGLADYGVVAIENSLYGSFLENYDNLLKYESKIVGEIYLHVILNLITLPGVKLEQIREVYTHPIAMIQAESFLEKHPSVIRIESHDTAGSVRMIKEKGLKTAAAIGSNLAAQLYDMKILAKDIETEKQNYTRFLIIAKDPKYPPLANKTSLAIKAENNAGSLYKCLKCFYDQGINLSKIESRPIMGRTWGYYFYLDFERGLNTPETQRALKELEKVTESIQVLGSYEQGKVFEE

SEQ ID NO: 22408 - protein, 444 aa, Yersinia pestis KIM
MGLVKQGARVAVIERYNNVGGGCTHWGTIPSKALRHAVSRIIEFNQNPLYSDNARTIKSSFADILNHADRVINQQTRMRQGFYDRNHCHMFSGDASFIDANTVNVRYADGTSDTLQADNIVIATGSRPYRPVNVDFNHERIYDSDTILQLSHEPQHVIIYGAGVIGCEYASIFRGLSVKVDLINTRDRLLAFLDQEMSDALSYHFWNNGVVIRHNEEFEQIEGTTDGVIVHLKSGKKVKADCLLYANGRTGNTSGLGLENIGLEADSRGLLKVNSMYQTALSHVYAVGDVIGYPSLASAAYDQGRIAAQAMIKGEANVHLIEDIPTGIYTIPEISSVGKTEQELTAMKVPYEVGRAQFKHLARAQIVGMDTGSLKILFHRETKQILGIHCFGERAAEIIHIGQAIMEQKGEGNTLEYFVNTTFNYPTMAEAYRVAALNGLNRLF

SEQ ID NO: 22409 - protein, 473 aa, Listeria innocua Clip11262
MSKGQVIQVMGPVVDVKFEGGNLPEIYNALVIEYKSDAEEAPTSQLTLEVAIQLGDDVVRTIAMASTDGVQRGMEVIDTGSPITVPVGTVTLGRVFNVLGNTIDLDEPLPSDIKRNKIHREAPTFDQLATTTEILETGIKVVDLLAPYLKGGKIGLFGGAGVGKTVLIQELIHNIAQEHGGISVFAGVGERTREGNDLYFEMKDSGVIEKTAMVFGQMNEPPGARMRVALTGLTIAEYFRDEEHQDVLLFIDNIFRFTQAGSEVSALLGRMPSAVGYQPTLATEMGQLQERITSTNVGSVTSIQAIYVPADDYTDPAPATTFAHLDATTNLERKLTEQGIYPAVDPLASTSRALSPDIVGEEHYEVATEVQRLLQRYKELQDIIAILGMDELSDEDKQSVSRARRVQFFLSQNFHVAEQFTGQKGSYVPVKETVKGFKDLLAGKYDHIPEDAFRSVGRIEDVLEKAKDMGVEV

SEQ ID NO: 22410 - protein, 257 aa, Oryza sativa Japonica Group
MAAASVLLLLPSPFLRPSSPAHRARCGIATTTTTSTSGRRGLFLFASRCRPGPRRRAASAAVPPEHGLSQPQPQARAVGSYEAALGDAKDALYAALEGMNRGIFGMTSEKRSEIHALVELLESKNPTPEPTDKLQDKVDGCWRLVYSTISILGKKRTKLGLRDFISLGDFFQMIDVKEEKAVNVIKFSARALKILSGQLTIEASYKITTKTKVDITLDSSTITPDQLMNIFQKNYDMLLAIFNPEGWLEITYPFRLM

SEQ ID NO: 22411 - protein, 369 aa, Aspergillus nidulans FGSC A4
MQSLLRRGASLLTPSPSPSPAQSSPSTPNPAPREIRSSEDFVKASLPEALFSKTNPVTDGEECEHDCATCTIRYPAKFDVDQEDELYGHVNGWSTHLLVATGKTDWVRDVADEEGSVMEAIERGGVLPGNGKLKLSASNMPVPDEYHHHEKGEQPTTVLLLPSFTIIDHVTPKLAPDLIRNFVDRAVTTTTPLNGVGASTENKETEPATEEQVMTSLRSRSCPHAAVILLCSQKTRDARCGQSAPLLRREFERHLRPLGLHRDLDDERPGGVGIYFISHVGGHKYAANVIVYRRRDFDWYKTTKTQVAEAEPVTANAPDEGASQCIWLARVRPEDCENIVRYTVLQGKVVKPGTQLRGGFDRERGLISW

SEQ ID NO: 22412 - protein, 720 aa, Mycobacterium smegmatis str. MC2 155
MAENTIKWDKDADGIVTLTLDDPTGSANVMNEHYKESMHNAVERLAAEKDSITGVVITSAKKTFFAGGDLKGMMKVGPENAAESFAEVEFIKADLRKLETLGVPVVAAINGAALGGGLEIALACHHRIAADVKGVVIGLPEVTLGLLPGGGGVARTVRMFGIQKAFMEVLSQGTRFKPGKALEVGLVDQLVSSVDELVPAAKAWITEELKANPETVAVQPWDRKGYKMPGGTPSSPALASILPSFPALLRKQLKGAPMPAPRAILAAAVEGAQVDFDTATRIESRYFVSLVTGQTAKNMIQAFFLDMQTINGGGSRPDGIAKQEIKKVGVLGAGMMGAGIAYVSARAGFEVVLKDVTLEAAERGKGYSEKIEAKALERGRTTKEKSDALLARITPTADAADLKGVDFVIEAVFENQELKHKVFQEIEDIVEPNAILGSNTSTLPITGLATGVKRQEDFIGIHFFSPVDKMPLVEIIKGEKTSDEALARVFDYTLAIGKTPIVVNDSRGFFTSRVIGTFVNEALAMLGEGVPAASIEQAGSQAGYPAPPLQLSDELNLELMQKIATETRKAAEATGATYEPHPAEAVVNKMIEIGRPSRLKGAGFYEYVDGKRVGLWPGLADTFGSGKVDIPLQDMIDRMLFAEALETQKCIDEGVLTSTADANIGSIMGIGFPPYTGGSAQFIVGYQGELGVGKEAFVARAKQLAERYGERFNPPASLES

SEQ ID NO: 22413 - protein, 404 aa, Mycobacterium smegmatis str. MC2 155
MRELPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSLNLIYDEDPDYIIIFGADHVYRMDPEQMMQFHIESGAGATVAGIRVPRSEASAFGCIDADESGRIREFIEKPADPPGTPDDPEQTFVSMGNYIFTTKVLIDAIRADADDDHSDHDMGGDIIPRLVADGMAAVYDFKNNEVPGATERDHGYWRDVGTLDAFYDAHMDLVSVHPVFNLYNKRWPIRGESENLAPAKFVNGGSAQESVVGAGSIISAASVRNSVLSSNVVVDDGAIVEGSVLMPGVRIGRGAVVRHAILDKNVVVGPGEMVGVDLDKDRERFAISAGGVVAVGKGVWI

SEQ ID NO: 22414 - protein, 470 aa, Pseudoalteromonas tunicata D2
MNNNKISDDLMVQFEQLKNATITMAPSSTAARVEQLKQLKAALLAHQNELLQALSTDYGQRSDFDSFMADLLPSIQHLNYTLKHLSKWMKPERRHTGLLLLPSKVVVEAFPLGVVGIIVPWNFPINLAFAPLITAIAAGNRVMLKLSEFTPHTNQVIRKICSPFIADLIEVVEGEREISEQFSSLPFDHLFFTGSTAVGRMVMAAAAKNLTPVTLELGGKSPVVITPDMPIKVAVERLIFGKCLNAGQICVAPDYVLLPKGKELAFIAQFRAAFKRMYKQGLADSDYSSIINHAQYQRLKNLLSQAEQTEAIISSIAEPAFDDELHRLAPHIIYNIDTNSALLNDEIFGPLLPIVFYNTIEEAISYINSKPHPLALYIMSFDKQLQHQIRTQTRSGAVIINDTVMHVAVDDAPFGGVGASGMGQYHGKEGFLTFSKSRTIFKSYAFNPRTWLIMNAKNMMMKVIKQLFVK

SEQ ID NO: 22415 - protein, 287 aa, Arthrobacter keyseri
MTTETIDTTASETPRLRLLHGHSIPRLGLGTWPMLEDECEAAVRVAVQSGYRLVDTAFQYRNEEAVGRGIRTAGVPRSELFISSKFNKESHSIDGVQRAYDESLRKLGLDHLDMFMCHWPVPALGKYVDAWKGLVKLLEEGRVKAIGVSNFKPSHLKEIIDATGVVPDVNQIQLSPDIARTEPRAVHRLLGTVTEAWSPIGRSSGLRANPIIIEIAQRLNKSPAQILLRWHVQQDIVPIPQASDPLWLTENLSVFDFSLSATEMAAIRQLDKGEGAARDSDLPENGH

SEQ ID NO: 22416 - protein, 429 aa, Vibrio angustum S14
MKLYNLKEHQEQVSFGQAVRQGLGRNQGLFFPSELPQFSDIDALLEMDFVTRSSKILSAFIGDELSEETVSQMVDSAFQFPAPINKVKDGVYALELFHGPTLAFKDFGGRFMAQSLAAVTADSESDITILTATSGDTGAAVAHAFYGMDNIKVVILYPKGKISPLQEKMFCTLGKNITTVAVNGTFDDCQALVKQAFDDAELRKEVGLNSANSINISRLMAQICYYFEAVAQLPKAEREQLVISVPSGNFGNLTAGLLAKSLGLPVKRFIAATNENDTVPRYLQTGEWSPKVTVPTISNAMDVSQPNNWPRIEELCQLKGWGLNELGYGAVTDEQTAETLKQMTAEGYLCEPHGAIAYRILNEQLNDGETGLFLCTAHPAKFKEVVDEILDKDIPLPAPLAKHNAMELLSLERDNDFEAVKAVLRSVQS

SEQ ID NO: 22417 - protein, 629 aa, Mycobacterium sp. KMS
MGVTFDPIRLSRSRESQHMAVSVQMPALGESVTEGTVTRWLKQEGDTVEQDEPLLEVSTDKVDTEIPSPASGVLQKIVAQEDDTVEVGGELAVIGEGGEDSGDSSDDSSSDEDEDEEPAEEAESETTSEESDSSEETDSSEETESEPEPEPEPKKESKPKPKSSGSATPVTMPELGESVTEGTVTRWLKKVGDSVEVDEPLLEVSTDKVDTEIPSPVAGTLLEIIAEEDDTVEVGGELAKIGDADQAEAEEPEPEPEPEPEPEPEPEPEPEPKQESKPEPKPEPKQESKQEAKPEPKKEPEPQQDAEPSDGSGPYVTPLVRKLAAEHDVDLAAVKGTGVGGRIRKQDVLAAAEADKKAKSGPEDAAEAPGKAPAAATASANASDAPLAHLRGTKQKANRIRQLTAKKTRESLQATAQLTQTHEVDMTKIVALRAKAKNDFAEREGVNLTYLPFIARAVIDALKQHPNVNASYNEDTKEITYYDAEHLGFAVDTDQGLLSPVIKNAGDLSLAGLARAIADIAARARSGDLKPDELSGGTFTITNIGSQGALFDTPILVPPQAAMLGTGAIVKRPRVIVDEFGNESIGVRSICYLPLTYDHRLIDGADAGRFLTTIKRRLEEGSFEADLGL

SEQ ID NO: 22418 - protein, 403 aa, Oryza sativa Japonica Group
MADPSRSSPTAAAAGDALLAAAAAPGDAPDATALAVAADADAEFGFQRAELGTEKLAGTVQFHERHVFLCYKGPEVWPSHVEAAESDRLPRLLAAAIKTHKSDLKKKTKLTICEGEDGTESSNGDVLIFPDMIRYRGLTHFDVDNFVQEVLVKDTEWLPGSPEAIKGSYVFVCCHASRDKRCGVCGPALIKRFKEEIGVQGLADQVSVSACSHVGGHKYAGNVIVFSADAKGEVTGHWYGYVSPDDVPVLLHKHIGQGEIVDHLWRGQMGLSEEEQRKALESKHVTNGVTEDGAHESPEETTNGSACNPVAAGGCCQGNGGFTCCQSDLPKEDKSITAEQNQKSSEKGADKECAAGSKKRHMKMCSMPTWFETWETADTYAALGIVAAAASVFVAFRIYKNLN

SEQ ID NO: 22419 - protein, 465 aa, Oryza sativa Japonica Group
MMMQGGRIARRGLSRLAAAVETAAVAPPRMADFNHVPLPYDGPSAAEIARKRAEFLSPSLFHFYSKPLNIVEGKMQYLFDERGRRYLDAFAGIATVCCGHCHPDVVGAIAAQAGRLQHSTVLYLNHAIADFAEALASKMPGDLKVVFFTNSGTEANELAIMMARLYTGSHDIISLRNSYHGNAAGTMGATAQKNWKFSVVQSGVHHAVNPDPYRGAFGSDAEKYARDVQEIIEFGTTGQVAGFISEAIQGVGGIVELSPGYLPLAYEAVRSAGGLCIADEVQAGFARVGSHFWGFETHGVVPDIVTMAKGIGNGIPLGAVVTTPEIAQVLTRRCYFNTFGGNPLCTAGGLAVLRVLEKEGLQANAHAVGSYLKDRLRALQDKHEIIGDVRGTGFMLGVELVTDRQLKTPAKDEICRAMEHMKEMGVLVGKGGFYGNVFRITPPLCFTKEDADFFVAVMDSALSKL

SEQ ID NO: 22420 - protein, 431 aa, Heliophilum fasciatum
MFIFVVGLNHKSAPVEIREQLTFSESTIGKALDLLYSEPGITGCAILSTCNRTEIYGSTTDIEKGLAAVRRFVTKMGPLAIENFANYFYTHTLYDAIRHLFRVASGLDSMVLGETQILGQVRRAYQLATEHGVSNSVVNTWFQQAITVGKRVRTETGIDQHAVSTSYTAVELARQVFNDLNGKTALILGAGKMSELTLTHLIANGVSTVLVANRSFQRAEELAGRCGGEAIHFDKLEERMHEADIVISCTAATHYVIRRDMVERVMATRKERPIFFIDIAVPRDIEPSVGTVGGVHLFDIDDLQNVIDQNLAERSKAAALAEVIIDQEINDFLKWLNSLFVVPTIVALKAKGEEVRKKELERVLGRMKDLPEKDQKTISALASSIVNQLLHDPITQIRHYAASPDGHLYSEILQNLFGLAISGQRAKGKSE

SEQ ID NO: 22421 - protein, 138 aa, Shorea fallax
EKNIPVLLGLLSIWNVSFLGYPARAILPYSQALEKFAPHIQQVSMESNGKGVSMDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 22422 - protein, 120 aa, Zea mays
  misc_feature (26)..(26): Xaa can be any naturally occurring amino acid
MSTTVSRASLDQKLALAKRCSRGMVXEATLAGAKAAAAATIASAIPTLASVRMLPWAKANINPTGQALIVSTVAGMAYFIAADKKILSLARRHSFEQAPEHLKNTSFQGTGRPHPAFFRP

SEQ ID NO: 22423 - protein, 138 aa, Shorea fallax
EKNIPVLLGLLSIWNVSFLGYPARAILPYSQALEKFAPHIQQVSMESNGKGVSIDGVLLPYEAGEIDFGEPGTNGQHSFYQLIHQGRVIPCDFIGSAKSQQPIHLKGEVVSNHDELMSNFFAQPDALAFGKTPEELHK

SEQ ID NO: 22424 - protein, 362 aa, Campylobacter jejuni RM1221
MPADLNDYFNKKNRNSNNNGNNNRQNFNFKAPEFNFKGFGKFSPFIYGVIIIILFLIVAKPFMVINSGEMGIKSTTGKYDPNPLEPGLHFFLPFVQKITIIDTRVRQINYASIEGSNENLSSGSGVINKNSISVLDSRGLPVSIDVTVQYRLNPLQVPQTIATWSLNWENKIIDPVVRDVVRSVVGKYTAEELPTNRNTIAAQIEEGIRKTIEAQPNEPVELRAVQLREIILPSKVKEQIERVQIAKQEAERTKYEVERANQEALKKAALAEGEANATIISAKGKAMAVKIEADAQAYSNKEIANSLNTPLLNLKQIETQKEFNEALKVNQDAKIFLTPGGAVPNIWVDTKDAKKQSSANIN

SEQ ID NO: 22425 - protein, 376 aa, Xanthomonas campestris pv. campestris str. ATCC 33913
MNFAPVPELIEELRAGRMVVIVDDEDRENEGDLIMAAELVKPSDINFMVTHARGLVCLSLTRERCTQLGLAPMVRNNTAQFHTNFTVSIEAAEGVTTGISAYDRAHTVRTAVRPDAKPHDLSQPGHIFPLIAQPGGVLTRAGHTEAASDLPMLAGLEPAGVLVEVLNPDGSMARRPQLEVFAREHGLKMGSIADLIAYRLANEHTVERVDEREIETEFGPFHLVTYRDRIAHDLHFALVRGTPDPTTPTLVRVQVENPLADLLHWQRDDFGVAATDALRAIAAEGQGVMVVLSAPRDSESLLARLRQQPEVAANAKDVSQWRRNGAGAQILADLGLGKLRVLGTPRRQVGLAGFGLEVVEFLECHPGAASRVAAAP

SEQ ID NO: 22426 - protein, 119 aa, Brassica napus
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALA

SEQ ID NO: 22427 - protein, 154 aa, Xanthomonas campestris pv. campestris str. ATCC 33913
MTHYEGDLRPTTARFVIIASRWNARITDALVTGARQSLAGNGIGEDAIDVVRVPGAWEIPMAANRVAQGGQHAAIIALGCVIRGDTRHYEHVADLCAEGLMSVQLQTGVPVLNGVLAVERVEDAEARAGGSHGNKGEECALAALELVNLMELLP

SEQ ID NO: 22428 - protein, 572 aa, Ashbya gossypii ATCC 10895
MAKRTEKTEGANKSGRRRGPGSDAEGAEDSGTRRYSLWNFWVASTALKLLLMPGYYSTDFEVHRNWLAVTHRLPLRKWYVDATSQWTMDYPPLFAWLEWALSQVVPGAVRRDGCLKLVAEGRYGWPTVVFQRLTVIASEVLLYVVLQVYVSSSAAQERTVNFVVTTSVALSPAFLLVDHIHFQYNGFLFAVLVASIVAARERRYVLCGALFTVALCLKHIFLYLAPAYFVFLLRAYVLDLGEFRFRSYRDLVFAVRWGNLCRLGGVVLAIMAVTFAPFAGVMPQLMARLFPFSRGLTHAYWAPNFWAIYSFVDKVLTFLMLRVPYVYKLATSLVQPPLIPASIDEIRARMAAGNHGTRGLVQDVSFVILPQIQPKLTFLLTLFYQVLAVLPVLFDPSFKRFIGSLSLCGFSAFLFGWHVHEKAIMLVIVPFSFLVSFDQRLLTPFRLAPGRRAMCPCSRCYIALAASVIQGSLYTLIWCIVYHSALKRTVPASASVQRRVFFFDRLAAVYVMLLLPMVLGVKYLELLEGKFEALEKYQFLGLMCYSIYCAIGVCTSWMGLSWLYNFDEPLWV

SEQ ID NO: 22429 - protein, 753 aa, Methanosarcina acetivorans C2A
MTEEMNLRVAEAYHKDVGRGIARIDTRLMQEMGLVSGDIIEISGRSKTYAIVWPNVERGQENRIRIDGNLRSNAKVGIDDRVTIQKVQAKHAQRVTLAPSQPVRLVGGAHYILRIIEGRPLNKGQQIRVETVNNPLTFVVASTRPAGPVVVTKDTEIVIKEKSIEEIKTPEGISYEDIGGLRREIQLVREMIELPMRHPELFQKLGIEPPKGVLLHGPPGTGKTMIAKAVASETDANFITISGPEIVSKYYGESEQKLREIFDEAEKDAPSIIFIDEIDSIAPKRGEVTGEMERRVVAQLLSLMDGLKSRGEVVVIAATNRPNSIDEALRRGGRFDREIEIGIPDRNGRRQILLIHTRGMPLEDEVSLGEIADVTHGFVGADLSSLCKEAAMHALRRITPEIDIEEEIPQEIIDNLVVTKEDFREALKNIEPSAMREVYVEVPHVGWDDIGGLDKAKQELIESVEWPLKYPEMFKAVNIKPPRGVLLFGPPGTGKTLLAKAVASESEANFISIKGPELLSKYVGESERAIRETFRKAKQAAPTVIFFDEIDSIAPERSSVSDTHVSERVVSQILTELDGVEELKDVIIVAATNRPDMVDPALLRPGRFDRLIYIKPPGKEGREKIFEIHTKGKPLAEDVKLSELAEMTEGYVGADIEGICREAAMLALREIVTPGTDRKSIKEKAGDVRLSKRHFERAIRRVRPTTSRETLSAYEKSAELFARYAAELEEESSEAKEEEKEIEGKEVPNFPKV

SEQ ID NO: 22430 - protein, 572 aa, Ashbya gossypii ATCC 10895
MAIRTVPHNGNGSKEMYQKSNSSSSSLVGSLIKSWKTPSSAKSNQLASPSLEPADSDGNISAIRRSQTMQRSLSSHSSSHRGVHLSPLRSNTTGGSNHAGGKKDKYFTDLDEDWSAVIDDYNTPIPMMANGGIETMIRPLMGAQKTADKGARSSPLRRSGSYPSLPQMSTPGGKHISAELRLQLEAQHERDVQELNAVMQRLAKFQAVLEPQGSASQVIKLNDLRKLSWNGVPMVHRPQVWKLLIGYLPANLKRQQSTIQRKRQEYRDGIQRVFSDLHLRDEPTWHQIEIDIPRTNPHIPLYQFKVVQESLQKILYLWAIRHPASGYVQGINDLVTPFYQVFLSEYLSPSQKDKVDTLDPASYLTPSQQQDVEADSFWCLTKLVEQITDYYIHGQPGILTQVKHLGQLVKRIDGDLYAHFQAEGVEFIQFAVRWMNCLLMREFQMNMVIRMWDTYLSETSLETYTDSPAKSVSAITSPPSTMASSATGASAAVGSSPNAPPRQPSLSEFHVFVCAVFLVKWSDQLVSMDFQAIITFLQNPPTRHWTESEVEMLLSEAYIWQSLYKDAISHWR

SEQ ID NO: 22431 - protein, 415 aa, Bradyrhizobium sp. ORS278
MSTHPAVSNGSYDVARIREDFPALALQVYGKKLVYLDNAASAQKPRAVLDRMTQAYTSEYANVHRGLHYLANAATEAYEGGRERVTRFLNARRSEEIIFTRNATEAINLVASSWGAPNIGEGDEIVLSIMEHHSNIVPWHFLRERQGAVIKWAPVDDDGNFLIDEFEKLLTPRTKIVAITQMSNMLGTLVPVKEVVRLAHARGIPVLIDGSQAAVHLAIDVQDIDCDFYVFTGHKLYGPTGIGVLYGKYDLLAAMRPYNGGGEMIREVSRDVVTYGDPPHRFEAGTPMIVEAVGLGAAIDYVNSVGKERIAAHEHDLVTYAQERLREINALRLIGTAKGKGPVISFEMKGAHAHDVATVIDRQGIAVRAGTHCVMPLLERFNVTATCRASFGMYNTREEVDQLAQALIKARDLFA

SEQ ID NO: 22432 - protein, 358 aa, Triticum aestivum
  misc_feature (149)..(149): Xaa can be any naturally occurring amino acid
MATAFDSPTSSPAAAPFHDDPFLSFADSPTPAAADVHVSGDGFPASPDPYAFRPDSAAAHPFGMPDSNGGGVVMHHDAADDDDGLFTDPGPVLPDPAQMGADEGFLLREWRRQNALLLEDKEKHEKELRSQIILEAEEFTKGFVEKRKXNLETSKDHNRERGKLFLSNQEKFHKGADKQYCKAISDLIPQDIVHIERSTAKNEKDKKPGIIVVQGPNPGKATEMPGFARILSELKYTAPSNIKPPPPPAWAPARKGRSPGARQKGTSLGCISRPPLRPQPEPHRRLLKPGVPRAIPKPLPEGFKSGVSGNLFPGENARARSVKGDPKRMRGGENTRVHHGESWRRHTQCTIINLSLLL

SEQ ID NO: 22433 - protein, 508 aa, Mycoplasma genitalium G37
MIDHLKRTKIIATCGPALTKSLVSLKMLDDNEYAAIKKVAYANIEAIIKSGVSVIRLNFSHGTHEEQQVRIKIVRDVAKAMNIPVSIMLDTNGPEIRIVETKKEGLKITKDSEVIINTMSKMIASDNQFAVSDASGKYNMVNDVNIGQKILVDDGKLTLVVTRVDKQHNQVICVAKNDHTVFTKKRLNLPNAQYSIPFLSEKDLKDIDFGLSQGIDYIAASFVNTVADIKQLRDYLKLKNASGVKIIAKIESNHALNNIDKIIKASDGIMVARGDLGLEIPYYQVPYWQRYMIKACRFFNKRSITATQMLDSLEKNIQPTRAEVTDVYFAVDRGNDATMLSGETASGLYPLNAVAVMQKIDKQSETFFDYQYNVNYYLKNSTANKSRFWHNVVLPLTKKTVPKRKLVNSAFKYDFIVYPTNNINRIYALSNARLAAAVIILTNNKRVYTGHGVDYGIFCYLIDKNPNQLTKAELIELAWKAINHYQAYGDLEKLKQCLAVYNETIINL

SEQ ID NO: 22434 - protein, 159 aa, Zea mays
IEYGADDFAFHISTNLESAYHISQLSHPLLKASGYGSIVFLSSVAGVVFTSGGSIYSLTKGALNQLARNLACEWAKDSIRANAVAPNIIKTPLALPYLEDVGFREGLFGRTPLGRAGEPHEVASLVVFLCLPAASYITGQTICVDGGLTINGFSYQPQA

SEQ ID NO: 22435 - protein, 476 aa, Bradyrhizobium sp. ORS278
MSFSNLGLSDKVLAAVAATGYTTPTPIQEQAIPHVLARRDVLGIAQTGTGKTAAFVLPMLTILEKGRARARMPRTLILEPTRELAAQVKENFDRYGAGQKLNVALLIGGVSFGDQDAKLTRGVDVLIATPGRLLDHTERGGLLLTGVELLVIDEADRMLDMGFIPDIERICKLVPFTRQTLFFTATMPPEIRRITDAFLHNPQKVEVSKPATTAVTVTQLQVPSGREAHQKREVLRRLLREAKDLKNAIIFCNRKRDVAIVHKSLQKHGFSVGALHGDMDQSARMAALDQFRKGELPLLVASDVAARGLDIPEVSHVFNFDVPHHSDDYVHRIGRTGRAGRTGTAISIVSPPDQKSVAAIEKLIGQSIPTIEGDYEVQESSRDDEARERRPRDSSRRSRGKAPREREAREPREREPRPAAASPRAAQPAAPHPAPNARHEQPRNESRRPRRDHDNEPADHSHLPAFLLRPVRAPLP

SEQ ID NO: 22436 - protein, 826 aa, Vitis vinifera
MRSIKDGFRFHAHAIKNGITSTVFTSNQLIHLYSKHGFLAEAHKLFDEMPERNVFTWNAIIWAYIKTQNLKQARELFDSAPSKDLVTYNSMLSGYINTDGYETNALKLFIEMQSLNDETRIDEFSLTRMLNLSAKLSMESYGKQLHSYMVKTANNISGFAVSSLIDMYSKCGCFREVCQVFDGCAGVLDLVSKNAMVAACCREGELEMGVNLFWRDLELNDVVSWNTLISGYVQNGCEEDALKLFVHMEENEVRWNEHTIAGLLSACAGLRSLKLGKEVHGWVLKYELGFNPFISSGLVDVYCKCGNMKYAELVYATIGTGNAFSITSMIVGHSSQGNMGEARRLFDSLTEKSSIIWTALFTGYVKSQQCEAVFELLSEFRVKEAMVPDALILISVLGACAIQAALNPGKQIHAYVLRIGIELDEKLVSAMVDMYSKSGNIKYAEKIFQRVTNRDAVIYNIMTAGYAHHGHENQAIQQFEEMLERGVRPDAVTFVALLSACRHCGLVELGEKYFASMTDYNILPEIDHYACMIDLYGRANQLEKAVAFMKRIPIEPDAVILGAFLNACRINRNTKLAREAEEKILRIEGDNGARYVQLANVYAAEGKWVEMGRIRRKMRENEIKKFAGCSWVYVENRVHIFTSGDSSHSSAEAIYSILLILTAELNDTARESNNGVGSTNGPAFECILMKDFLKSLSKRLKGNIAGYENYHRVYVPERQSPKFDPKEPLRVYVLFQHIQKMLSGEITVIAETGYSWFNCQKLKLPRKCRYEFQMQYGSIGWLVGVTLGYVQATPKKRVMISCIGDGSFYVTLLDISIMILLIRNRQ

SEQ ID NO: 22437 - protein, 554 aa, Ralstonia solanacearum GMI1000
MSQVVEIKVPDIGDYKDVPVIELHVKAGDTVSAEDSLVTLESDKATMDVPSPKSGVVKEVKIKVGDAVSEGSLVLLLEEQGATAASAPQAAPAPAPVAAALAPAAQAPVSAPAAQPAAGGGTIEVKVPDIGDYKDVPVIEISVKVGDKVEAEQSLITLESDKATMDVPSPAAGTVKDIRVKVGDAVSEGTLIVVLEGAGGAAAAAPAPAPAPAAAAPSPAPAVAPVAAPAAAPATYTADTVGTIGKAAHASPSVRKYARELGVDVNLVGGTGPKNRITQEDVQRYVKGVMTGQAAAPGKAAAAAAPAGGGELNLLPWPKVDFTKFGPVEPKPLSRIKKISGANLHRNWVMIPHVTNNDEADITELEAFRVQMNKEHEKAGVKFTMLAFVIKAVVGALKKFPTFNASLDGDNLVFKQYYHIGFAADTPNGLVVPVIRDADKKGVVDIAREMAELSKAAREGKLKPDQMQGGCFSISSLGGIGGTHFTPIINAPEVAILGLSRGYQKPVWDGKQFVPRLTLPLSLSYDHRVIDGAEAARFNAYLAAVLADFRRVLL

SEQ ID NO: 22438 - protein, 438 aa, Corynebacterium glutamicum ATCC 13032
MQAKEEEKRAFDNDRAHVFHSWSAQDKISPKVWAAAEGSTLYDFDGNAFIDMGSQLVSANLGHNNPRLVEAIQRQAARLTNINPAFGNDVRSDVAAKIVSMARGEFSHVFFTNGGADAIEHSIRMARLHTGRNKILSAYRSYHGATGSAMMLTGEHRRLGNPTTDPDIYHFWAPFLHHSSFFATTQEEECERALKHLEDVIAFEGAGMIAAIVLEPVVGSSGIILPPAGYLNGVRELCNKHGILFIADEVMVGFGRTGKLFAYEHAGDDFQPDMITFAKGVNAGYAPLGGIVMTQSIRDTFGSEAYSGGLTYSGHPLAVAPAKAALEIYAEGEIIPRVARLGAELIEPRLRELAEENVAIADVRGIGFFWAVEFNADATAMAAGAAEFKERGVWPMISGNRFHIAPPLTTTDDELVALLDAVEAAAQAVELTFAGALF

SEQ ID NO: 22439 - protein, 460 aa, Exiguobacterium sibiricum 255-15
MGLTTTGLDVARQIEVQRGFFKTGATRSIAFRLSMLTFLKQAIETHEEAIYDALKVDLNKGRQDAFTTEIGFVYGEINRMEKQLRRLAKPRRVKTPLLHFGSKSEIRFEPYGNVLVIAPWNYPFQLALAPVVGAIAAGNTVVLKPSELTPNVSRVLREVFETAFHERFGVVIEGDAEVSTAVLEEKFDYIFFTGSTRVGKIVHQAAAKHLTPVTLELGGKSPTIIHKDADLRLAAKRIAWGKWLNAGQTCIAPDYVFVHRDVQETFLRLIEEEAFSQYGNGVGVGSYVKIVSDGHLERLTGYLEQGNIEFGGQVDPETRKMAPTVMTNVPLDSKLMQEEIFGPILPVLVYDEIEDVITFVTDRDKPLALYLFTENEFVKERVLNRISFGGGCVNDTLMHVAQHNLPFGGVGASGIGGYHGKYSFETFSHRKGLVHNTTKFDLPFRYMRSNTDSKWMRFLL

SEQ ID NO: 22440 - protein, 594 aa, Ralstonia solanacearum GMI1000
MSVVEIKVPDIGDYKDVDVIEVMVKAGDVVAVDQSLITLETDKATMDVPADVAGRIVEVKIKVGDKASQGTVIATVEAGAAAAAPAPTQAPAPAAAPAAAPAASAPAPQAAKHGGSADLECDMLVLGSGPGGYSAAFRSADLGMNTVLVERFGTLGGVCLNVGCIPSKALLHTAAIMDEVKAMASHGIVYSEPKVDLDQLRKHKETVVGKLTGGLAGMAKSRKVQVVRGVGTFLDPNHLEVQLTSGEGKQATGEKKVIRFAKAIIAAGSESVKLPFIPEDPRIVDSTGALELRQVPGKMLVIGGGIIGLEMATVYSTLGARIDVVEMLDSLMNGADRDLVKVWDKMNKSRFDKVMLKTKTVGVEAKPDGIYVRFEGEQAPAEPQRYDMVLVAVGRSPNGKRIGAEKAGVAVTDRGFIDVDKQQRTNVPHIYAIGDIVGQPMLAHKAVHEAHVAAEAAHGEKAYFDAKQIPSVAFTDPEVAWAGLTEDQCKAQGIKYGKGVFPWAASGRAIANGRDEGFTKVIFDEETHRIIGGGIVGTHAGDLISEICLAIEMGADAIDIGKTIHPHPTLGESVGMAAEIYEGVCTDVPPARKR

SEQ ID NO: 22441 - protein, 219 aa, Malva pusilla
MADEVVLLDFWPSPFAMRAKLALELKGINYECKQQDLLNKDPLLLQMNPVHKKIPVLIHNGKPVCESLVIVRYIDEVWNHVSPLLPSDPYRRSQALFWTDYIEKTVYGVGRRIFIATGEEQEKAKEELIQFLKTIETELGEKLYFGGDSIGFVDVALLPFTAWFYTYETCGNFSIEESCPKLIEWVKRCTQKESVSKAIAHPHKIYDFFLEYKEKLGGN

SEQ ID NO: 22442 - protein, 762 aa, Azoarcus sp. BH72
MDQDFIAAALDYHRAPTRGKISVVPTKGLTNQRDLALAYSPGVAAACDAIVADPAEARELTSRGNLVAVVTNGTAVLGLGNIGPLAAKPVMEGKGCLFKKFANIDVFDIELAENDPDKLIDIIASLEPTLGGINLEDIKAPECFYIEKKLRERMKIPVFHDDQHGTAIISAAGLINGLKVIGKNIAEVKLVCSGAGAAAIACLDLMVSVGLKRENVYVCDSKGVIYQGREENMEPTKARYAQITEARTLGDVIAGADVFLGLSTAGVLKPEMVAKMADKPLIFALANPNPEILPADAKAVRPDCIIATGRSDFPNQVNNVLCFPFIFRGALDVGATTINEEMKLACVKAIAELAQAEQSDVVASAYGGAELSFGPEYIIPKPFDPRLIVKVAPAVAKAAMESGVATRPIEDFEAYIASLTDLVYTSGMVMKPVFSAAKRVPLEQKRVVYAEGEDERVLHATRVVIDEGLARPILVGRPSVIEMRIKKIGLNLVPGRDFDVVNPESDPRYRDLWNEYYRLKGRDGVTPDIAKAKMRRDTTLIGAMLLRTGDADALVCGTFGTYEYHFQHVQDVIGLRAGAKQFAAMNLLMLPKRTLAITDTYVNEDPSAEEVAEIARMAAEELRRFGIEPRVALLSHSNFGSSRSASARKMREASELLRQLAPELECDGEMHGDAALSVEIRNKVHPDSSLVGEANLLVMPNLDAANISFNLMKIANGDGVSVGPILLGAAKPVHILTPSATVRRLVNITALAVVDAQESRRA

SEQ ID NO: 22443 - protein, 540 aa, Burkholderia mallei ATCC 23344
MTLNSLPVWPALQAHYEEIRDAHLRDWFAPANDRAPTRAERFTFEGGGLAADFSKNRLTDATLALLVRLAREAGVEARRDAMFAGETVNPTEGRAALHTALRANAPDAPFQAQVAAERAKMARFADAVRSGAWTGYTGKRIRHVVNIGIGGSDLGPKMVVHALHHVATPDIATHFVSNVDGADLARVLERIDPEETLAIIVSKTFTTLETMTNARSLRDWFVANGCPEGALAKHFVGVSANPAEVVKFGIAEANVFEMWDWVGGRYSLWSAVGLSIMIAIGPERFDELLAGARDMDEHFRTAPLERNLPVLQGLVGIWYRNFFGAQSYLVAPYSEALHYLPSYLQQLEMESNGKSARIDGAFVDYPTSAVTWGEPGTNGQHAFFQMLHQGPTLVPIDFIAVLTPEHPLASHHPKLLANCFAQSEALMLGRTLDEARKIAGPAKPELAPHLTFPGNRPTTTLLVDALTPRTLGALIALYEHKVLVQAAVWNINPFDQWGVELGKILGKVVEADLTAAQVDPAKHDSSTSALIARARKALGE

SEQ ID NO: 22444 - protein, 196 aa, Lentinus sajor-caju
HWHGFFQSGSTWADGPAFVNQCPIASGNSFLYDFNVPDQAGTFWYHSHLSTQYCDGLRGPFIVYDPSDPHLSLYDVDNADTIITLEDWYHVVAPQNAVLPTADGTLINGKGRFAGGPTSALAVINVESNKRYRFRLISMSCDPNFTFSIDGHSLQVIEADAVNIVPIVVDSIQIFAGQRYSFVLNANQTVDNYWIR

SEQ ID NO: 22445 - protein, 518 aa, Aspergillus oryzae
MIPLLILAALAVVFRLVWSIFTSLRHAQNARKWHCGAIPTYPGDILGINTLKEVLRADKEKLIPVLSAQRVETMTAREGRYVSTFRLRQMGRESIFTSDPKNMQAILATQFKEFELGSLRRNSLHPLLGSGIFSTDGEAWSRSRSLLRPQFTRDQVSDLDLEERHVQKAMAGMLADPATKWTPEIDIQSIFFRLTIDSATEFLFGDSVESQTAALSGSRIIEDKFPSYFDRGQWYAAQRARFEKLYWIVNNKESRETDRFVHAYVDRFIDAALAAVKEGKIDPEKRNSDHYVFLHGLTTATQDPVELRSQLLNILLAGRDTTASLLSWCVLLLARHPDIFQKLRNTILADFGDYRNPRNITFSSLKSCRYLHYFMNEVLRLYPIVPGNRRVALKDTTLPRGGGPDGSEPVYVRKGQPVVYSVFVTHRRKDIWGADAEVFNPDRWEDLKVGWEYLPFNGGPRICIGQQFALTEAGYVLVRLLQRFDQIVDARPEREIRFNATLTSAPWENVIVRLREGA

SEQ ID NO: 22446 - protein, 197 aa, Lentinus sajor-caju
HWHGFFQAGTSWADGPAFVTQCPIAAGNSFLYDFKVPDQAGTFWYHSHLSTQYCDGLRGAFVVYDLFDPHRLRYDIDNADTVITLEDWYHVVAPQNGPIPTPDSTLINGLGRYAGGPTSPLAVVRVLWGLRYRFRLVSLSCDPNWTFSIDGHKLLVIEADAVNVQPVEVDSIQIFAGQRYSFVLKANQQSRNYWIRA

SEQ ID NO: 22447 - protein, 325 aa, Medicago sativa
MAEGLVLRGTMRAHTDVVTAIATPIDNSDMIVTASRDKSIILWHLTKEDKTYGVPRRRLTGHSHFVQDVVLSSDGQFALSGSWDGELRLWDLNAGTSARRFVGHTKDVLSVAFSIDNRQIVSASRDRTIKLWNTLGECKYTIQDGDAHSDWVSCVRFSPSTPQPTIVSASWDRTVKVWNLTNCKLRNTLAGHSGYVNTVAVSPDGSLCASGGKDGVILLWDLAEGKRLYSLDAGSIIHALCFSPNRYWLCAATESSIKIWDLESKSIVEDLKVDLKTEADAAIGGDTTTKKKVIYCTSLNWSADGSTLFSGYTDGVVRVWGIGRY

SEQ ID NO: 22448 - protein, 308 aa, Aspergillus oryzae
MFGIIADLLSSIITILFPIFASFKALRSANPSQLAPWLMYWVVLSAILMAESWTVWILGWLPFYSWIRLFFFSYLVLPQTQGARILYQTYVDPFLAQHEREIEEFIGRSHERAKALGLQYFYQGLDWVRENVFHLPAQQAAAPPPATGPAAYAQSLLSRFNVPTAAGGNATTPAQGNDWLSAIGSAVASMTSTGKTPEARAEELSASGSFLPRDMAGMSHDEKAKYLSNQQDMLEVLRNALAKEQQNLHGRDDDLAYGSSLRKNRSDNSFDHIEPEDIRNQSTSSNWTSGVDYAVRAAEELARSRGSH

SEQ ID NO: 22449 - protein, 351 aa, Listeria innocua Clip11262
MYKGLLEKYKEYLPVTEKTPMISLAEGNTPLIPLPNLSKELGVTLYGKYEGLNPTGSFKDRGMVMAVAKAKEEGAEAVICASTGNTSAAAAAYATRAGLKAYIVIPEGKVALGKLAQAVMYGADIISIQGNFDEALKSVRELAETEAVTLVNSVNPYRLEGQKTAAFEICEQLGSAPDVLAIPVGNAGNISAYWKGFKEWNEANASGLPRMHGFEAEGAAAIVQGKPIDNPETIATAIRIGNPASWELAEAARDESGGYIHSVTDDEIVNAYKKIAAQDGVFIEPGSAASLAGVIQHVANGTIKQGEKVVCVFTGNGLKDPDTAMSVHEIPISHVDDIEAMRTHLRSGVKA
